United States Patent 7,411,051 (ANTIBODIES TO HDPPA04 POLYPEPTIDE) - sequence listing, part 4

SEQ ID NO: 5411 - DNA, 952 bp, Homo sapiens
  misc_feature (3)..(3): n equals a,t,g, or c
  misc_feature (12)..(12): n equals a,t,g, or c
  misc_feature (15)..(15): n equals a,t,g, or c
  misc_feature (24)..(24): n equals a,t,g, or c
canccctcactnaanggaacaaangctgggggctccaccgcggtggcggccgctctagaactagtggatcccccgggctgcaggaattcggcacgagcggccgcagagttgtcgctactggagaagtccctgggactgagtaaggggaataaatacagtgctcagggcgagcgacagattccagttcttcagacaaacaatggtccaagtctaacaggattgactactatagcagctcatctagtcaagcaagccaacaaagaatatttgctggggagtactgcagaagaaaaagcaatcgttcagcagtggttagaatacagggtcactcaagtagatgggcactccagtaaaaatgacatccacacactgttgaaggatcttaattcatatcttgaagataaagtctaccttacagggtataactttacattagcagatatactattgtactatggacttcatcgctttatagttgacctgacagttcaagaaaaggagaaatatcttaatgtgtctcgctggttttgtcacattcagcattatccaggcatcaggcaacatctgtctagtgttgtcttcatcaagaacagactatatactaattcccactagaagctgtccatgccatacagaagatctattaaaaatgttttaaatggaaaatgtactctagaccacaggactaatgtaaattaatatacagtcattcattatttgttgaagttgatagaatttttgaagtgtaaacttgtgtctgaatgttttatttgttctttagctgaagttttgcaatttttatgtcaaaattcaattgctattaaacaagttgagatccagttataaattaaccttgtttttagtagatgacatttatttcaataaaagttgcaaatcggaaaaaaaaaaaaaaaaaaaaaaaaaaaaaaaaaaaaaaaaaaaaaaactcgta

SEQ ID NO: 5412 - DNA, 498 bp, Homo sapiens
  misc_feature (34)..(34): n equals a,t,g, or c
  misc_feature (75)..(75): n equals a,t,g, or c
  misc_feature (135)..(135): n equals a,t,g, or c
aattaggcattaaaaaagccttaaatttaggaantgtttccttaagcagatggtctttccttttagaactgtcanaacttgtttacccttcaagctgggcactgtggtaagttgactctttgggtccttggttgnaaacatgagaatcccattctggctgactcaagcagacatggattttattcgaaggatgtgggggtggctttgagcatagaggcgttgggatggactgaaccatgggcccaggggacaggcacaggctgcctgtgtatttagggcactgcttgggttgcctggagagtggtttattggcccagattctgccacttcttggccaggggaggcctttcatggacagcctcatcagagtggcagcagagagaagagcagggcaggtcctcaaaggaacactgaaaaggttctctgaaagacaggggcgkagayactgagctggcaataacagcgctgayccacyggaatggggaagggccttcgtag

SEQ ID NO: 5413 - DNA, 894 bp, Homo sapiens
  misc_feature (726)..(726): n equals a,t,g, or c
  misc_feature (771)..(771): n equals a,t,g, or c
  misc_feature (775)..(775): n equals a,t,g, or c
  misc_feature (816)..(816): n equals a,t,g, or c
  misc_feature (849)..(849): n equals a,t,g, or c
gaattcggcacgagctttccccttcaagaagcttagattagtgtgattaaatcagtgtgatacagtggtgataagagatccagcactccactcgacatcattgtccgttgtcatgacaccaagttacagcatttgatcaatggttcctgtgccatgttgcagtacacttggctcatcttagtctttttgtcaagctgcctttcagcgacctggttctgcaaagtggttgtggcagccattggatccacagtggggagctccaggctacactttaaaagaagtggtcagtgtttgagatgacgggcatgccagttaccctgatctgatcactataccttataggtatagaaatgtcactaggtgcccagggatatgtataattattattaatcagttaaaaaataaaataaatgattgagaaaacttcagttgttcatatccaagaagggargggctgcctgagattcctgatggggagtggggtctcatgtcacccccagtcgccaccatgtgctawtttcttcccaaaacttggagcgtggttcctttgctcctttatcttgacaggtggatgccatgaattctcaccattttaagatatagatcaggtgataacacattttccccataaagtttcatagttttttgagttgtctgcatgtcttttctaatgccgtcttttctaacttttctgttcagaggatatatcctggattagatcagatnaacacagatctattacatacattggagaggaataatttctgcatntgtntcaactgaacactttttagaaaatgaaatagctcatggttntgaaaagaacacggatgctggagtcagaaaggnctatgttcaaatccctcttactacctgtacttgaataacagctta

SEQ ID NO: 5414 - DNA, 666 bp, Homo sapiens
  misc_feature (40)..(40): n equals a,t,g, or c
  misc_feature (56)..(56): n equals a,t,g, or c
acaaagcacccccagctccagtggacaccccctgcctttntggactccctccgacntcgtgagcagaagacgccttccttttcttaaagggccagttcaggggtactgttcagtgaagctgagtatgactgaaagtcactaaaggtaactgggatagaacccagtttctggctactgtaaataaagctgccatgaacacttcatgaacctgaaagagccaatccttccaaatggatcctgagtggctaactggrtctaaattmagaatggagccaggtcacaaacgtcttctgcattctctgagaaaccacaggctcgcgtgatttggggactttcatggctgtctgctcctatttatgctccctgatttgatgggtgctgggaagtctcatcttgacttctggatctaacaaatagacttgtgacttgcattgaccaatcaaaaccaaacatacttgcatccctctcacttgcagagcagaccagagtgggaatctgggtgggagctttttctataaaggataacctgtctctctgttctcagggagagcatctttgttttgtactgaaggctgggtctccctggtttgcaaactgcttacaggaataaaatcattctcttttttaaggaaaaaaaaaaaaaaaaaaaaactcgagggggcccgt

SEQ ID NO: 5415 - DNA, 1014 bp, Homo sapiens
ggcacgaggtcagccagaacatgtctttcaacctgcaatcatcaaagaaactgttcattttcttaggaaaatcactgtttagtcttctggaggctatgatttttgccttactcccaaagccacggaagaacgttgctggtgaaatagtcctcatcacaggtgctggaagtggactcggaaggctcttagccttgcagtttgcccggctgggatctgttcttgttctctgggatatcaataaggaggggaatgaggaaacatgtaagatggctcgggaagctggagccacaagagtgcacgcctatacctgcgattgcagccaaaaggaaggagtgtatagagtagccgaccaggttaaaaaagaagtcggcgatgtttccatcctaatcaacaatgccggaatcgtaacaggcaaaaagttccttgactgtccagatgagcttatggaaaagtcatttgatgtgaatttcaaagcacatttatggacttataaagcctttctacctgctatgattgctaatgaccatggacatttggtttgcatttcaagttcagctggattaagtggagtaaatgggctggcagattactgtgcaagtaaatttgcagcctttgggtttgctgaatctgtatttgtagaaacatttgtccaaaaacaaaaggggatcaaaaccacgattgtgtgccccttttttataaaaactggaatgtttgaaggttgtactacaggctgtccttctctgttgccaattctggaaccaaaatatgcagttgaaaaaatagtagaagctattctacaagaaaaaatgtacttgtatatgccaaaagttgttatacttcatgatgtttcttaaaaaggtaattacatcagcttctattacttccctaacatgccagtctacagttttactcccaaatcccacccaggaaaaagccactttwaaaaatacctgataaattaaaattcattaatttaattctaaaaaaaaaaaaaaaaaaaaaaaaaaaaaaaaa

SEQ ID NO: 5416 - DNA, 3030 bp, Homo sapiens
  misc_feature (60)..(60): n equals a,t,g, or c
  misc_feature (2388)..(2388): n equals a,t,g, or c
ctctaagaacctagtggatccccccggcctgcaggaattcgggcacggaggggagacttnctgtggctaagggagggcgggaagggccctctgtggggctgccattttggctgggacctaaatgcagtaaaggagcagctacgggaatatagagagtggggcttccaggcagagaagcctgcagtgcaaaggtctgcagacaacgacctgggcgtcttcaagggacacaaggaatcatattgccagaacacattgtacaggtagccaggtgtcggtctccagcctgagaactctggctgttgttccttgtgtcgtcccatattcctgcctggcctgcgatggacatcagcaagggcctcccaggcatgcagggaggcctccacatatggatctctgagaaccggaagatggtgccggtacccgagggggcttacgggaactttttcgaggaacactgctatgtcatcctccacgtcccccagagcccgaaggycacgcagggggcgtccagcgacctgcactactgggtcgggaagcaggcgggtgcggaagcgcagggcgctgcggaggccttccagcagcgcctacaggacgagctggggggccagaccgtgctgcaccgcgaggcgcagggccacgagtccgactgcttctgcagctacttccgcccgggaatcatctacaggaagggaggcctagcatctgacctcaagcatgtggagaccaacttgttcaacatccagcgactgctgcacatcaaagggaggaagcacgtgtctgccactgaggtggagctctcctggaacagctttaataagggtgacatcttcctgctggacctaggcaagatgatgattcagtggaatgggcccaagaccagcatttctgagaaggctcgggggctggycttgacctacagcctccgggacagggaacgtggtggtggtcgtgcacagattggtgtggtggatgatgaggccaaagccccggacctcatgcagatcatggaggctgtgctgggccgcagggtgggcagmctgcgtgycgccacgcccagcaaggatatcaaccagctgcagaaggccaatgttcgcctgtaccatgtctatgagaagggcaaagacctggtggtcctggagttggcgacccccccactgacccaggacctgctgcaggaggaggacttctacatcctggaccagggtggcttcaagatctatgtgtggcagggacgcatgtctagcctccaggagagaaaggctgccttcagccgggctgtgggcttcatccaggccaagggctacccgacctacaccaacgtggaggtggtgaacgacggcgccgagtcggccgcgttcaagcagctcttccggacttggtctgagaagcggcgcaggaaccagaagmtcggcgggagggataaatcgattcatgtaaagctggacgtgggcaagctgcacacccagcctaagttagcggcccagctcaggatggtggacgacggctctgggaaggtggaggtgtggtgcatccaggacttacacaggcagcccgtggaccccaagcgtcatggacagctgtgtgcaggcaactgctaccttgtgctctacacataccagaggctgggccgtgtccagtacatcctgtacctatggcagggccaccaggccactgcggatgagattgaggccctgaacagcaacgctgaggaactagatgtcatgtatggtggcgtcctagtacaggagcatgtgaccatgggcagcgagcccccccacttcctcgccatcttccagggccagctggtgatcttccaggagagagctgggcaccacggaaaggggcagtcagcatccaccacaaggcttttccaagtgcaaggcactgacagccacaacaccaggaccatggaggtgccagcccgtgcctcatccctcaactccagtgacatcttcttgctggtcacagccagcgtctgctacctctggtttgggaaagggctgtaatggtgatcagcgtgagatggcacgggtggtggtcactgtcatttccaggaagaatgaggaaacggtgctggagggtcaggagcctccccacttctgggaggccctgggaggccggggccccctaccccagcaacaagaggctccctgaggaggtccccagcttccagccacgactgtttgagtgctccagccacatgggctgcctggtcctcgcagaagtggggttcttcagccaggaggacctggacaagtatgacatcatgttactggacacctggcaggagatcttcctgtggcttggggaagctgcaagtgagtggaaggaggcggtggcctggggccaggagtacctgaagactcacccagcagggaggagcccggncacacccatcgtgctggtcaagcagggscatgagcctcccaccttcattggatggttcttcacttgggacccctacaagtggactagccacccatcccacaaggaagtggtggatggcagcccggcagcagcatcaaccatctctgagataacagcagaagtcaacaacttccggctatccagatggccgggcaatggcagggcaggtgccgtggccctgcaggccctcaagggctcccaggacagctcagagaatgatytggtgcgaagccccaagtcggctggcagcagaaccagcagctccgtcagcagcaccagcgccacgatcaacgggggcctgcgccgggaacaactgatgcaccaggctgttgaggacctgccagagggcgtggaccctgcccgcagggagttctatctctcagactctgacttccaagatatctttgggaaatccaaggaggaattctacagcatggccacgtggaggcagcggcaggagaaaaagcagctgggcttcttctgaacccaagccctctcgactgcccctatcccctggaccccaacatacctacaatgctggggaggccctgcttccactcccctcagaggcttttggtcatcctctgcgtgtcagtaaaagca

SEQ ID NO: 5417 - DNA, 1255 bp, Homo sapiens
ggcacgaggcagcgcagggagctgtctgcagaggccagggtgcgcctgccacgaatccccaggcaccggtggccgccgcggcccgagtagctcggcgggtaaacatggccgcactgacgacggttgtggtagcggctgcggccaccgcggtagccggggctgtggcaggggcgggcgcggccaccgggaccggcgtgggagcgacgccagcgcctcaacagagtgatggctgttttagtacttcaggtggaattcgtccttttcatcttcagaactggaagcagaaagttaatcagactaagaaagcagaatttgtacgcacagcagaaaaatttaaaaatcaagtaattaacatggaaaaagataaacacagtcatttctacaaccaaaaaagtgacttcagaattgagcatagtatgctagaagaattggaaaataaattgattcacagcaggaaaacagaaagagcaaaaatccagcaacaattggccaaaatacataataatgtaaagaaacttcagcatcaattaaaagatgtgaagcctacacctgattttgttgagaagctcagagaaatgatggaagaaattgaaaatgcaattaacacttttaaagaagagcagaggttgatatatgaagagctaattaaagaagagaagacaactaataatgagttgagtgccatatcaagaaaaattgacacatgggctttgggtaattcagaaacagagaaagctttcagagcaatctcaagcaaagttcctgtagacaaagtaacaccaagtactcttccagaagaggtactagattttgaaaaattccttcagcaaacaggagggcgacaaggtgcctgggatgtgatcaccagaactttgtaaaggtgagaaacaaacataaagggaagccaacatttatggaagaagttctagaacaccttcctggaaaaacacaagatgaagttcaacagcatgaaaaatggtatcaaaagtttctggctctagaagaaagaaaaaaagagtcaattcagatttggaaaactaaaaagcagcaaaaaagggaggaaattttcaagttaaaggaaaaggcagacaacacacctgtgctttttcataataaacaagaggataatcaaaagcaaaaagaggaacaaagaaagaaacagaaattggcagttgaagcttggaagaaacagaaaagtatagaaatgtcaatgaaatgtgcttcccagttaaaaaaaaaaaaaaaaaaaaaaaaa

SEQ ID NO: 5418 - DNA, 1579 bp, Homo sapiens
ggcacgaggcagcgcagggagctgtctgcagaggccagggtgcgcctgccacgaatccccaggcaccggtggccgccgcggcccgagtagctcggcgggtaaacatggccgcactgacgacggttgtggtagcggctgcggccaccgcggtagccggggctgtggcaggggcgggcgcggccaccgggaccggcgtgggagcgacgccagcgcctcaacagagtgatggctgttttagtacttcaggtggaattcgtccttttcatcttcagaactggaagcagaaagttaatcagactaagaaagcagaatttgtacgcacagcagaaaaatttaaaaatcaagtaattaacatggaaaaagataaacacagtcatttctacaaccaaaaaagtgacttcagatttgagcatagtatgctagaagaattggaaaataaattgattcacagcaggaaaacagaaagagcaaaattccagcaacaattggccaaaatacataataatgtaaagaaacttcagcatcaattaaaagatgtgaagcctacacctgattttgttgagaagctcagagaaatgatggaagaaattgaaaatgcaattaacacttttaaagaagagcagaggttgatatatgaagagctaattaaagaagagaagacaactaataatgagttgagtgccatatcaagaaaaattgacacatgggctttgggtaattcagaaacagagaaagctttcagagcaatctcaagcaaagttcctgtagacaaagtaacaccaagtactcttccagaagaggtactagattttgaaaaattccttcagcaaacaggagggcgacaaggtgcctgggatgtgatcaccagaactttgtaaaggtgagaaacaaacataaagggaagccaacatttatggaagaagttctagaacaccttcctggaaaaacacaagatgaagttcaacagcatgaaaaatggtatcaaaagtttctggctctagaagaaagaaaaaaagagtcaattcagatttggaaaactaaaaagcagcaaaaaagggaggaaattttcaagttaaaggaaaaggcagacaacacacctgtgctttttcataataaacaagaggataatcaaaagcaaaaagaggaacaaagaaagaaacagaaattggcagttgaagcttggaagaaacagaaaagtatagaaatgtcaatgaaatgtgcttcccagttaaaaaaaaaaaaaaaaaaaaaaaaaaaaaatcagaaagaacgccagcgccagtttaagttaaaattactactagaaagttatacccagcagaagaaagaacaggaagaatttttgaggcttgaaaaggagataagggaaaaggcagaaaaggcagaaaaaaggaaaaatgctgctgatgaaatttccagatttcaagaaagagatttacataaacttgaactgaaaattctagatagacaggcaaaggaagatgaaaagtcacaaaaacaaagaagactggcaaaattaaaagaaaaggttgaaaacaatgttagtagagatccctctaggctttacaaacccaccaaa

SEQ ID NO: 5419 - DNA, 1293 bp, Homo sapiens
  misc_feature (1214)..(1214): n equals a,t,g, or c
ggcacgagcaggaaccccttcctgcccccgttgccgaggcagcactgccctctgctaggaacagctccgtgttggcctctctgtccccacacactgggcctgcagggcttctccgagactcttcagttcaggtatcaaccctkggctgtctcctggratgtggggggcgratgttctttccttgcctccccacgctcytcytgcggatccttcactccgggtgggtcggcctcttcctcctgatcagctccagagccccytctagttccctggcatggaaacacggcccgggtragctgtggtggccccgraggcctctccgctcctgcacaggccttgcttcctgcgggtgacgaggtcctggactctctcctgcccaggcttctgggtgctttccttagttcagcaccagtgctctgtgtgggcagcgtctcccccgaggatccgcagctccgggttacccgcaggcgtccatctccggtatggtgctgcccttcactgatcctggttgtatttctgtttcctgctttcctcatcgcctcctgtttcggttgattccttctttttgctggtgcccgtctcacagtagcttcctgagaacggggacctggcaggtacacttcagacctcctgtgtctgaaatagtgtcctggttctgacctgcacttgagtgtcggtgaggcctgggcagggttccgggtgggagctcagtttcgtcctgagtttctcaggccccaaccatggcctgtggtggcttcacgggctacaaggcaaaggacgcaaacgaagaggcttcacgtgacagggttgtatgctcagccagctctggaggctggagtctgagctggcagcactgacagggtcagctctcctcggaggctgctggggaggagcctcctgcctcttccgggctccgggggcctctggcacccccggtgtccccgggcttggagacgcagcactcccatgtctgccggttcccctggccgcctcctctgtgtcattgtctgttctcttcatatagggacaccagtcatcgaattggaggttcactctactcaagtatgacgtcaccgtgatttcactgattttatgtcccaggccgtattctaacaagggcacatcctgtgttctgggaagggcgtgtcgctggggaaatactcttcacccggctgcaacctctcactgtagaactgcctctgtggagaagcccnaagggcatttgcggcttctaggagccaagtaggaggaggctgggatccgtgtktcaggcgggactccaggcttgggcgg

SEQ ID NO: 5420 - DNA, 2304 bp, Homo sapiens
  misc_feature (2273)..(2273): n equals a,t,g, or c
  misc_feature (2278)..(2278): n equals a,t,g, or c
atgaatacgccagctcgaaattaaccctcactaaagggaacaaaagctggagctccaccgcggtggcggccgctctagaactagtggatcccccgggctgcaggaattcggcacgagcttgtcgtgtggctctgtgtcgacactgtgcgccaccatggccgtgactgcctgtcagggcttggggttcgtggtttcactgattgggattgcgggcatcattgctgccacctgcatggaccagtggagcacccaagacttgtacaacaaccccgtaacagctgttttcaactaccaggggctgtggcgctcctgtgtccgagagagctctggcttcaccgagtgccggggctacttcaccctgctggggctgccagccatgctgcaggcagtgcgagccctgatgatcgtaggcatcgtcctgggtgccattggcctcctggtatccatctttgccctgaaatgcatccgcattggcagcatggaggactctgccaaagccaacatgacactgacctccgggatcatgktcattgkctcaggtctttgtgcaattgctggagtgtctgtgtttgccaacatgctggtgactaacttctggatgtccacagctaacatgtacaccggcatgggkgggatggtgcagactgttcagaccaggtacacatttggtgcggctctgttcgtgggctgggtcgctggaggcctcacactaattgggggtgtgatgatgtgcatcgcctgccggggcctggcaccagaagaaaccaactacaaagccgtttcttatcatgcctcaggccacagtgttgcctacaagcctggaggcttcaaggccagcactggctttgggtccaacaccaaaaacaagaagagatacgatggaggtgcccgcacagaggacgaggtacaatcttatccttccaagcacgactatgtgtaatgctctaagacctctcagcacgggcggaagaaactcccggagagctcacccaaaaaacaaggagatcccatctagatttcttcttgcttttgactcacagctggaagttagaaaagcctcgatttcatctttggagaggccaaatggtcttagcctcagtctctgtctctaaatattccaccataaaacagctgagttatttatgaattagaggctatagctcacattttcaatcctctatttctttttttaaatataactttctactctgatgagagaatgtggttttaatctctctctcacattttgatgatttagacagactccccctcttcctcctagtcaataaacccattgatgatctatttcccagcttatccccaagaaaacttttgaaaggaaagagtagacccaaagatgttattttctgctgtttgaattttgtctccccacccccaacttggctagtaataaacacttactgaagaagaagcaataagagaaagatatttgtaatctctccagcccatgatctcggttttcttacactgtgatcttaaaagttaccaaaccaaagtcattttcagtttgaggcaaccaaacctttctactgctgttgacatcttcttattacagcaacaccattctaggagtttcctgagctctccactggagtcctctttctgtcgcgggtcagaaattgtccctagatgaatgagaaaattattttttttaatttaagtcctaaatatagttaaaataaataatgttttagtaaaatgaaaaaaaaaaaaaaaaaactcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcaaattgtaagcgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgkggactccaacgtcaaagggcgaaaaaccgtctatcagggcgatggcccactacgtgaaccattaccctaatcaaggttttttggggtcgaggtgccgtaaagcactaaatcggaaccctaaagggagccccgattaaagcttgacgggnaaagncggcaacgtgcgagaaggaaggagaa

SEQ ID NO: 5421 - DNA, 1668 bp, Homo sapiens
cggcacgagttcaccacccctcccttctgtatatgatgcttctgtagctctgtaacgccccctacatttaccttccttatatctcccccgtcttcctctccatagatctcctcccatttccccttccatggtccccatcttccttctgaaatgtctactccttcatgttcctttatgtatgtcttccaatctttccttccatagctctcatcaccttcatatatttcttccatctttctcctcccacctgcctcgccctctgtatatacccccactctcccccttttatatcttctccatctccccccatatctttcctctatgtccacatctgtgtattccccccaacttcccctccatatatcttttttactccccttttcctccctgtatcctctgtgttccccccatcttgctctacatcattcttcccaagatctttacgtctcccatcttgatctctccatctccactttctcctaacattttcatttccgttccttagtgtctctagagagatcattcttgatagcctcagctctttctctgtgtttttcaggtttgtattctgctctgctctacctctcctccttgccccttttctctcccaggatgtctctcctttccaaatcctttttgtacctgaataccttttgccccaccctgggctctcatttccatctcagaccttagcctgggatctaaagggctgacagtgtccctttcttcatgcagatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaagacagagcacaaattagagatcaccatgctgtcccagggcgtgtccatgctctattccttcttcatgccagctgccaagctcaaggaacggttggatcagccgatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataactcccaaaaaaaaaaaaaaaaaaaaaa

SEQ ID NO: 5422 - DNA, 277 bp, Homo sapiens
  misc_feature (255)..(255): n equals a,t,g, or c
gttcaccacccctcccttctgtatatgatgcttctgtagctctgtaacgccccctacatttaccttccttatatctcccccgtcttcctctccatagatctcctcccatttccccttccatggtccccatcttccttctgaaatgtctactccttcatgttcctttatgtatgtcttccaatctttccttccatagctctcatcaccttcatatatttcttccatctttctcctcccacctgcctcgccctctgnatatacccccactctccccctt

SEQ ID NO: 5423 - DNA, 3714 bp, Homo sapiens
  misc_feature (3695)..(3695): n equals a,t,g, or c
gctagttctagatcgcgatctagaacctaggttttgttccggccccaggctcagcgtccgccatcttgtgtcggcggctcggctgtaaggaggtggcagggacaaccacaaccacaacggccgggggaggagaaggcggcagcggcgattctaggcggcccaggcggcggggaggaggagaaggaggagggtggcggccgggcttggcttcggctccttgaggagttggcggcggcgcgacccggggaaccggcattgatgtccagctcgccgctgtccaagaaacgtcgcgtgtccgggcctgatccaaagccgggttctaactgctcccctgcccagtccgtgttgtccgaagtgccctcggtgccaaccaacggaatggccaagaacggcagtgaagcagacatagacgagggcctttactcccggcagctgtatgtgttgggccatgaggcaatgaagcggctccagacatccagtgtcctggtatcaggcctgcggggcctgggcgtggagatcgctaagaacatcatccttggtggggtcaaggctgttaccctacatgaccagggcactgcccagtgggctgatctttcctcccagttctacctgcgggaggaggacatcggtaaaaaccgggccgaggtatcacagccccgcctcgctgagctcaacagctatgtgcctgtcactgcctacactggacccctcgttgaggacttccttagtggtttccaggtggtggtgctcaccaacacccccctggaggaccagctgcgagtgggtgagttctgtcacaaccgtggcatcaagctggtggtggcagacacgcggggcctgtttgggcagctcttctgtgactttggagaggaaatgatcctcacagattccaatggggagcagccactcagtgctatggtttctatggttaccaaggacaaccccggtgtggttacctgcctggatgaggcccgacacgggtttgagagcggggactttgtctccttttcagaagtacagggcatggttgaactcaacggaaatcagcccatggagatcaaagtcctgggtccttatacctttagcatctgtgacacctccaacttctccgactacatccgtggaggcatcgtcagtcaggtcaaagtacctaagaagattagctttaaatccttggtggcctcactggcagaacctgactttgtggtgacggacttcgccaagttttctcgccctgcccagctgcacattggcttccaggccctgcaccagttctgtgctcagcatggccggccacctcggccccgcaatgaggaggatgcagcagaactggtagccttagcacaggctgtgaatgctcgagccctgccagcagtgcagcaaaataacctggacgaggacctcatccggaagctggcatatgtggctgctggggatctggcacccataaacgccttcattgggggcctggctgcccaggaagtcatgaaggcctgctccgggaagttcatgcccatcatgcagtggctatactttgatgcccttgagtgtctccctgaggacaaagaggtcctcacagaggacaagtgcctccagcgccagaaccgttatgacgggcaagtggctgtgtttggctcagacctgcaagagaagctgggcaagcagaagtatttcctggtgggtgcgggggccattggctgtgagctgctcaagaactttgccatgattgggctgggctgcggggagggtggagaaatcatcgttacagacatggacaccattgagaagtcaaatctgaatcgacagtttcttttccggccctgggatgtcacgaagttaaagtctgacacggctgctgcagctgtgcgccaaatgaatccacatatccgggtgacaagccaccagaaccgtgtgggtcctgacacggagcgcatctatgatgacgattttttccaaaacctagatggcgtggccaatgccctggacaacgtggatgcccgcatgtacatggaccgccgctgtgtctactaccggaagccactgctggagtcaggcacactgggcaccaaaggcaatgtgcaggtggtgatccccttcctgacagagtcgtacagttccagccaggacccacctgagaagtccatccccatctgtaccctgaagaacttccctaatgccatcgagcacaccctgcagtgggctcgggatgagtttgaaggcctcttcaagcagccagcagaaaatgtcaaccagtacctcacagaccccaagtttgtggagcgaacactgcggctggcaggcactcagcccttggaggtgctggaggctgtgcagcgcagcctggtgctgcagcgaccacagacctgggctgactgcgtgacctgggcctgccaccactggcacacccagtactcgaacaacatccggcagctgctgcacaacttccctcctgaccagctcacaagctcaggagcgccgttctggtctgggcccaaacgctgtccacacccgctcacctttgatgtcaacaatcccctgcatctggactatgtgatggctgctgccaacctgtttgcccagacctacgggctgacaggctctcaggaccgagctgctgtggccacattcctgcagtctgtgcaggtccccgaattcacccccaagtctggcgtcaagatccatgtttctgaccaggagctgcagagcgccaatgcctctgttgatgacagtcgtctagaggagctcaaagccactctgcccagcccagacaagctccctggattcaagatgtaccccattgactttgagaaggatgatgacagcaactttcatatggatttcatcgtggctgcatccaacctccgggcagaaaactatgacattccttctgcagaccggcacaagagcaagctgattgcagggaagatcatcccagccattgccacgaccacagcagccgtggttggccttgtgtgtctggagctgtacaaggttgtgcaggggcaccgacagcttgactcctacaagaatggtttcctcaacttggccctgcctttctttggtttctctgaaccccttgccgcaccacgtcaccagtactataaccaagagtggacattgtgggatcgctttgaggtacaagggctgcagcctaatggtgaggagatgaccctcaaacagttcctcgactattttaagacagagcacaaattagagatcaccatgctgtcccagggcgtgtccatgctctattccttcttcatgccagctgccaagctcaaggaacggttggatcagccgatgacagagattgtgagccgtgtgtcgaagcgaaagctgggccgccacgtgcgggcgctggtgcttgagctgtgctgtaacgacgagagcggcgaggatgtcgaggttccctatgtccgatacaccatccgctgaccccgtctgctcctctaggctggccccttgtccacccctctccacaccccttccagcccagggttcccatttggcttctggcagtggcccaactagccaagtctggtgttccctcatcatccccctacctgaacccctcttgccactgccttctaccttgtttgaaacctgaatcctaataaagaattaataactcccaaaaaaaaaaaaaaaaaaaaaaaaaaaaaaaaaaaaaaaaaaaaaaaaaaaaaaaaaaaaanaaaaaaaaaaaaaaaaaaa

SEQ ID NO: 5424 - DNA, 2837 bp, Homo sapiens
taaccctcactaaagggaacaaaagctggagctccaccgcggtggcggccgctctagaactagtggatcccccgggctgcaggaattcggcacgaggcaatgacttcagtaagccaggcatccttggatgtctccatgataataattatttccttaggagcaatttgtgcagtgttgctggttattatggtgctatttgcaactaggtgtaaccgcgagaagaaagacactagatcctataactgcagggtggccgaatcaacttaccagcaccacccaaaaaggccatcccggcagattcacaaaggggacatcacattggtgcctaccataaatggcactctgcccatcagatctcatcacagatcgtctccatcttcatctcctaccttagaaagagggcagatgggcagccggcagagtcacaacagtcaccagtcactcaacagtttggtgacaatctcatcaaaccacgtgccagagaatttctcattagaactcacccacgccactcctgctgttgaggtctctcagcttctttcaatgcttcaccaggggcaatatcagccaagaccaagttttcgaggaaacaaatattccaggagctacagatatgcccttcaagacatggacaaatttagcttgaaagacagtggccgtggtgacagtgaggcaggagacagtgattatgatttggggcgagattctccaatagataggctgctgggtgaaggattcagcgacctgtttctcacagatggaagaattccagcagctatgagactctgcacggaggagtgcagggtcctgggacactctgaccagtgctggatgccaccactgccctcaccgtcttctgattataggagtaacatgttcattccaggggaagaattcccaacgcaaccccagcagcagcatccacatcagagtcttgaggatgacgctcagcctgcagattccggtgaaaagaagaagagtttttccacctttggaaaggactccccaaacgatgaggacactggggataccagcacatcatctctgctctcggaaatgagcagtgtgttccagcgtctcttaccgccttccctggacacctattctgaatgcagtgaggtggatcggtccaactccctggagcgcaggaagggacccttgccagccaaaactgtgggttacccacagggggtagcggcatgggcagccagtacgcattttcaaaatcccaccaccaactgtgggccgccacttggaactcactccagtgtgcagccttcttcaaaatggctgccagccatggaggagatccctgaaaattatgaggaagatgattttgacaatgtgctcaaccacctcaatgatgggaaacacgaactcatggatgccagtgaactggtggcagagattaacaaactgcttcaagatgtccgccagagctaggagattttagcgaagcatttttgtttccatgtatatggaaatagggaacaacaacaacaacaaaaaaccctgaaagaactggcattgccaaatagttgcatttatcataaatgtgtctgtgtatattgaatattaaatactgtattttcgtatgtacacaatgcaagtgtgattattttaatctgtattttaaaaatacatttgtaccttatatttatgtgtaatttaacaaacaaattttatttttttactcccatgacagacatgtttttcctagtcgtgtagaaactagccactgttcaaatctgatacactattcaaccacaaagtgtaaaggcactgcttagattagttttgttggggaagaattattatgttgtatgaacaaccccactgaagcattatacaattcttaattccattaagtgatcccactttttttcaataactttttagaaattaagaatcattaaaattgttaagctattttattgttattttctctactttctactagccccaatagttgaactcttataggaaaatcgaaagataaagtgaaagtttatttcaggactgagaaatatcttgaaggttatttattagatgactatctcaaatgaactttttatagacaatgatgaaaacagaaytaaagtcaatgtttcctgactcccaggcccctactattccaggccatcacactggcctgttccggagaatatttctctcacaatattattatctacttataattatggtaaacaataaattttattccatccttgtagtatgaaacatgctccaaggaaatggaatctgtcctttaaatggataacagtatgtgttctaatggcataaaatattactggataaaaacagttgtgtcagtgtctctcctaaggtagtaaatataattgacttattctgaacccattctattttgaatctcccctttcctctcacaatacttgaacattttaatcttttggaatattgtctttctttgttataactattcatttttagcttttgtctccagtgcatgatctcatatttttgcttttatttttagtataagaacatttataaaatcatatttttgttactgcaattgttttatttgttgtgtggcaaatgagaaatcctttatttattgtgctgtgatctctctgtgtggaatgccttggtgagagagatgcttattatgactattatcatttctgaccaagcttctattaatgttatttctaataatacactatcttgattgtactctccagaaaatttttctgtcagtgaaaataaaagaaaaattaaagtaaagctaaaaaaaaaaaaaaaaaaaaaaaaaaaaaaaaactcgagggggggcccggtacccaattcgccct

SEQ ID NO: 5425 - DNA, 2837 bp, Homo sapiens
  misc_feature (2771)..(2771): n equals a,t,g, or c
taaccctcactaaagggaacaaaagctggagctccaccgcggtggcggccgctctagaactagtggatcccccgggctgcaggaattcggcacgaggcaatgacttcagtaagccaggcatccttggatgtctccatgataataattatttccttaggagcaatttgtgcagtgttgctggttattatggtgctatttgcaactaggtgtaaccgcgagaagaaagacactagatcctataactgcagggtggccgaatcaacttaccagcaccacccaaaaaggccatcccggcagattcacaaaggggacatcacattggtgcctaccataaatggcactctgcccatcagatctcatcacagatcgtctccatcttcatctcctaccttagaaagagggcagatgggcagccggcagagtcacaacagtcaccagtcactcaacagtttggtgacaatctcatcaaaccacgtgccagagaatttctcattagaactcacccacgccactcctgctgttgaggtctctcagcttctttcaatgcttcaccaggggcaatatcagccaagaccaagttttcgaggaaacaaatattccaggagctacagatatgcccttcaagacatggacaaatttagcttgaaagacagtggccgtggtgacagtgaggcaggagacagtgattatgatttggggcgagattctccaatagataggctgctgggtgaaggattcagcgacctgtttctcacagatggaagaattccagccagctatgagactctgcacggaggagtgcarggtcctgggacactctgaccagtgctggatgccaccactgccctcaccgtcttctgattataggagtaacatgttcattccaggggaagaattcccaacgcaaccccagcagcagcatccacatcagagtcttgaggatgacgctcagcctgcagattccggtgaaaagaagaagagtttttccacctttggaaaggactccccaaacgatgaggacactggggataccagcacatcatctctgctctcggaaatgagcagtgtgttccagcgtytyttaccgccttccctggacacctattctgaatgcagtgaggtggatcggtccaactccctggagcgcaggaagggacccttgccagccaaaactgtgggttacccacagggggtagcggcatgggcagccagtacgcattttcaaaatcccaccaccaactgtgggccgccacttggaactcactccagtgtgcagccttcttcaaaatggctgccagccatggaggagatccctgaaaattatgaggaagatgattttgacaatgtgctcaaccacctcaatgatgggaaacacgaactcatggatgccagtgaactggtggcagagattaacaaactgcttcaagatgtccgccagagctaggagattttagcgaagcatttttgtttccatgtatatggaaatagggaacaacaacaacaacaaaaaaccctgaaagaactggcattgccaaatagttgcatttatcataaatgtgtctgtgtatattgaatattaaatactgtattttcgtatgtacacaatgcaagtgtgattattttaatctgtattttaaaaatacatttgtaccttatatttatgtgtaatttaacaaacaaattttatttttttactcccatgacagacatgtttttcctagtcgtgtagaaactagccactgttcaaatctgatacactattcaaccacaaagtgtaaaggcactgcttagattagttttgttggggaagaattattatgttgtatgaacaaccccactgaagcattatacaattcttaattccattaagtgatcccactttttttcaataactttttagaaattaagaatcattaaaattgttaagctattttattgttattttctctactttctactagccccaatagttgaactcttataggaaaatcgaaagataaagtgaaagtttatttcaggactgagaaatatcttgaaggttatttattagatgactatctcaaatgaactttttatagacaatgatgaaaacagaaytaaagtcaatgtttcctgactcccaggcccctactattccaggccatcacactggcctgttccggagaatatttctctcacaatattattatctacttataattatggtaaacaataaattttattccatccttgtagtatgaaacatgctccaaggaaatggaatctgtcctttaaatggataacagtatgtgttctaatggcataaaatattactggataaaaacagttgtgtcagtgtctctcctaaggtagtaaatataattgacttattctgaacccattctattttgaatctcccctttcctctcacaatacttgaacattttaatcttttggaatattgtctttctttgttataactattcatttttagcttttgtctccagtgcatgatctcatatttttgcttttatttttagtataagaacatttataaaatcatatttttgttactgcaattgttttatttgttgtgtggcaaatgagaaatcctttatttattgtgctgtgatctctctgtgtggaatgccttggtgagagagatgcttattatgactattatcatttctgaccaagcttctattaatgttatttctaataatacactatcttgattgtactctccagaaaatttttctgtcagtgaaaataaaagaaaaattaaagtaaancaaaaaaaaaaaaaaaaaaaaaaaaaaaaaaaaactcgagggggggcccggtacccaattcgccct

SEQ ID NO: 5426 - DNA, 2718 bp, Homo sapiens
ggcaatgacttcagtaagccaggcatccttggatgtctccatgataataattatttccttaggagcaatttgtgcagtgttgctggttattatggtgctatttgcaactaggtgtaaccgcgagaagaaagacactagatcctataactgcagggtggccgaatcaacttaccagcaccacccaaaaaggccatcccggcagattcacaaaggggacatcacattggtgcctaccataaatggcactctgcccatcagatctcatcacagatcgtctccatcttcatctcctaccttagaaagagggcagatgggcagccggcagagtcacaacagtcaccagtcactcaacagtttggtgacaatctcatcaaaccacgtgccagagaatttctcattagaactcacccacgccactcctgctgttgagcgtctctcagcttctttcaatgcttcaccaggggcaatatcagccaagaccaagttttcgaggaaacaaatattccaggagctacagatatgcccttcaagacatggacaaatttagcttgaaagacagtggccgtggtgacagtgaggcaggagacagtgattatgatttggggcgagattctccaatagataggctgctgggtgaaggattcagcgacctgtttctcacagatggaagaattccagcgcagctatgagactctgcacggaggagtgcagggtcctgggacactctgaccagtgctggatgccaccactgccctyaccgtcttctgattataggagtaacatgttcattccaggggaagaattcccaacgcaaccccagcagcagcatccacatcagagtcttgaggatgacgctcagcctgcagattccggtgaaaagaagaagagtttttccacctttggaaaggactccccaaacgatgaggacactggggataccagcacatcatctctgctctcggaaatgagcagtgtgttccagcgtctcttaccgccttccctggacacctattctgaatgcagtgaggtggatcggtccaactccctggagcgcaggaagggacccttgccagccaaaactgtgggttacccacagggggtagcggcatgggcagccagtacgcattttcaaaatcccaccaccaactgtgggccgccacttggaactcactccagtgtgcagccttcttcaaaatggctgccagccatggaggagatccctgaaaattatgaggaagatgattttgacaatgtgctcaaccacctcaatgatgggaaacacgaactcatggatgccagtgaactggtggcagagattaacaaactgcttcaagatgtccgccagagctaggagattttagcgaagcatttttgtttccatgtatatggaaatagggaacaacaacaacaacaaaaaaccctgaaagaactggcattgccaaatagttgcatttatcataaatgtgtctgtgtatattgaatattaaatactgtattttcgtatgtacacaatgcaagtgtgattattttaatctgtattttaaaaatacatttgtaccttatatttatgtgtaatttaacaaacaaattttatttttttactcccatgacagacatgtttttcctagtcgtgtagaaactagccactgttcaaatctgatacactattcaaccacaaagtgtaaaggcactgcttagattagttttgttggggaagaattattatgttgtatgaacaaccccactgaagcattatacaattcttaattccattaagtgatcccactttttttcaataactttttagaaattaagaatcattaaaattgttaagctattttattgttattttctctactttctactagccccaatagttgaactcttataggaaaatcgaaagataaagtgaaagtttatttcaggactgagaaatatcttgaaggttatttattagatgactatctcaaatgaactttttatagacaatgatgaaaacagaaytaaagtcaatgtttcctgactcccaggcccctactattccaggccatcacactggcctgttccggagaatatttctctcacaatattattatctacttataattatggtaaacaataaattttattccatccttgtagtatgaaacatgctccaaggaaatggaatctgtcctttaaatggataacagtatgtgttctaatggcataaaatattactggataaaaacagttgtgtcagtgtctctcctaaggtagtaaatataattgacttattctgaacccattctattttgaatctcccctttcctctcacaatacttgaacattttaatcttttggaatattgtctttctttgttataactattcatttttagcttttgtctccagtgcatgatctcatatttttgcttttatttttagtataagaacatttataaaatcatatttttgttactgcaattgttttatttgttgtgtggcaaatgagaaatcctttatttattgtgctgtgatctctctgtgtggaatgccttggtgagagagatgcttattatgactattatcatttctgaccaagcttctattaatgttatttctaataatacactatcttgattgtactctccagaaaatttttctgtcagtgaaaataaaagaaaaattaaagtaaarmwaaaaaaaaaaaaaaaaaaaaaaaaaaaaaaaaactcga

SEQ ID NO: 5427 - DNA, 1837 bp, Homo sapiens
ggcacgagcagaaagcaacctcagctgaaacaaatgcataattataatttgatttcagaagtggaaacatgacccgaattcatgcacctactgattactccaaattcctttattgttgaagctggagcagaagtgggggtccaccgtggaagtaaggaaaagcaaaacagaacaggggtctcatccagggagccatgtcgatggctatggggagctccaccttgctcttggggtggggccctggccctgggtgggactgtggggtgatgagggttgtgctatgctggctacctggtggtaattgccaaggagagagcagcacgtagatcctccctgtcatcaggcagagctcttcagtgaggtgggctcagggagggctctgtgcctctgttcagcagagctgcagctgctgcccagctctcaggaggcaagctggactccctcactcagctgcaggagcaaggacagtgaggctcaaccccgcctgagccatgccagccaacttcacagagggcagcttcgattccagtgggaccgggcagacgctggattcttccccagtggcttgcactgaaacagtgacttttactgaagtggtggaaggaaaggaatggggttccttctactactcctttaagactgagcaattgataactctgtgggtcctctttgtttttaccattgttggaaactccgttgtgcttttttccacatggaggagaaagaagaagtcaagaatgaccttctttgtgactcagctggccatcacagaaaagcaagccagggtcctcattgtgatcgcctggagcctgtcttttctgttctccattcccaccctgatcatatttgggaagaggacactgtccaacggtgaagtgcagtgctgggccctgtggcctgacgactcctactggaccccatacatgaccatcgtggccttcctggtgtacttcatccctctgacaatcatcagcatcatgtatggcattgtgatccgaactatttggattaaaagcaaaacctacgaaacagtgatttccaactgctcagatgggaaactgtgcagcagctataaccgaggactcatctcaaaggcaaaaatcaaggctatcaagtatagcatcatcatcattcttgccttcatctgctgttggagtccatacttcctgtttgacattttggacaatttcaacctccttccagacacccaggagcgtttctatgcctctgtgatcattcagaacctgccagcattgaatagtgccatcaaccccctcatctactgtgtcttcagcagctccatctctttcccctgcagggagcaaagatcacaggattccagaatgacgttccgggagagaactgagaggcatgagatgcagattctgtccaagccagaattcatctagaccctagggcagtgccagtgctaggctgagcaccatcagctctcccaggtccttgtcacctgcttgggcacgtgcatggaacccgagccaacttcaccccaccctcgtcattacctgggagatgcacaagacaaatgttctaatgactgcatgcactgcttaagtattggccaacacgaactccccagttattcatgccagccaggaaggaaacgccttccttccccaccattcccagccctccttcccactggccagcacctgaacccagtgaacacaggcatcagtggtccagggtcctggcttggagccagtgagtagacaggcaagcagaggggacaaaggtagctgggttatacatgaatattctcattacaatagaagaaaataaaagacttaattaagcccaaaaaaaaaaaaaaaaaaaa

SEQ ID NO: 5428 - DNA, 888 bp, Homo sapiens
  misc_feature (503)..(503): n equals a,t,g, or c
gcagaaagcaacctcagctgaaacaaatgcataattataatttgatttcagaagtggaaacatgacccgaattcatgcacctactgattactccaaattcctttattgttgaagctggagcagaagtgggggtccaccgtggaagtaaggaaaagcaaaacagaacaggggtctcatccagggagccatgtcgatggctatggggagctycaccttgctcttggggtggggccctggccctgggtgggactgtggggtgatgagggttgtgctatgctggctacctggtggtaattgccaaggagagagcagcacgtagatcctccctgtcatcaggcagagctcttcagtgaggtgggctcagggagggctctgtgcctytgttcagcagagctgcagctgctgcccagctctcaggaggcaagctggactccctcactcagctgcaggagcaaggacagtgaggctcaaccccgcctgagccatgccagccaacttcacanagggcagcttcgattccagtgggaccgggcagacgctggattcttccccagtggcttgcactgaaacagtgacttttactgaagtggtggaaggaaaggaatggggttccttctactactcctttaagactgagcaattgataactctgtgggtcctctttgtttttaccattgttggaaactccgytgtgcttttttccacatggaggagaaagaagaagtcaagaatgaccttctttgtgactcagctggccatcacaggtaagtaactatgcaagtgagaggcaggaagctatatgtgaagtccctatggcttcctgcttttaatgaattttatcaaaaaaaaaaaaatgtaacgcatcggtcaatttgggaataatttctg

SEQ ID NO: 5429 - DNA, 431 bp, Homo sapiens
catgagatgcagattctgtccaagccagaattcatcttgaccctagggcagtgccagtgctaggctgagcaccatcagctctcccaggtccttgtcacctgcttgggcacgtgcatggaacccgagccactcaccccccaccctcgtcattacctgggagatgcacaagacaaatgttctaatgactgcatgcactgcttaagtattggccaacacgaactccccagttattcatgccagccaggaaggaaacgcctccttccccaccattcccagccctccttcccactggccagcacctgaacccagtgaacacaggcatcagtggtccagggtcctggcttggagccagtgagtagacaggcaagcagaggggacaaaggtagctgggttatacatgaatattctcattacaatagaagaaaataaaa

SEQ ID NO: 5430 - DNA, 930 bp, Homo sapiens
ggcacgagtggacatgagggtccctgctcagctcctggggctcctgctgctctggctctcaggtgccaaatgtgacactcagatgacccagtcgccatcctccctgtctgcatctgtaggagacacagtcaccatcacttgccaggcgagtgacgacattagcaaagatttaaattggtttcagcagaaaccagggactgcccctaagctcctgatcttcgatgcatccaatttggaaacaggggtcccatcaaggttcagcggaagtggatctgggacagattttactttcaccatcagcagcctgcagcctgaagattttgcaacatattactgtcaacagtatgataatcccccctcactttcggcggagggaccaaagtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaactctacgcctgcgaagtcacccatcagggcctgagctcgcccgtcacaaagagcttcaacaggggagagtgttagagggagaagtgcccccacctgctcctcagttccagcctgaccccctcccatcctttggcctctgaccctttttccacaggggacctacccctattgcggtcctccagctcatctttcacctcacccccctcctcctccttggctttaattatgctaatgttggaggagaatgaataaataaagtgaatctttgcaaaaaaaaaaaaaaaaaaa

SEQ ID NO: 5431 - DNA, 1061 bp, Homo sapiens
  misc_feature (305)..(305): n equals a,t,g, or c
  misc_feature (422)..(422): n equals a,t,g, or c
  misc_feature (437)..(437): n equals a,t,g, or c
  misc_feature (452)..(452): n equals a,t,g, or c
  misc_feature (1052)..(1052): n equals a,t,g, or c
  misc_feature (1054)..(1054): n equals a,t,g, or c
ctcccagccgccctgcagtccagagcccatatcaatgcctgggtcagagctctggaggarctgctcagttaggacccagagggaaccatggaarccccagcgcagcttctcttcctcctgctactctggctcccagataccaccggagaaattgtgttgacrcagtctccagscaccctgtctttgtctccaggggaaagagccaccctctcctgcagggccagtcagagtgttagcagctacttagcctggtaccagcagaaacctggccaggctcccaggctcctcatctatgrtgcatccancagggccactggcatcccagmcaggttcagtggcagtgggtctgggacagacttcactctcaccatcagcagmctrgagcctgaagattttgcagtttattactgtcagcagcgtancaactggcctccsangtacactttcggccnagggaccaaggtggaratcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagagggagaagtgcccccacctgctcctcagttccagcctgaccccctcccatcctttggcctctgaccctttttccacaggggacctacccctattgcggtcctccagctcatctttcacctcacccccctcctcctccttggctttaattatgctaatgttggaggagaatgaataaataaagtgaatctttgcaaaaaaaaaaaaaaaaaaaaaaaaaaaamrrgggggggccccggwcccmattcccccctntnttaattc

SEQ ID NO: 5432 - DNA, 1333 bp, Homo sapiens
cactttaaagctctgctgagggagttcggagcccaggctttcaggcgacctctgccctccctgcctctcctcaccctccctctcttcctgcagggcctgggaagggctttgagggagcctgggagccatgtgaagaggggcacgcctgggctgtcccacagtttagatccagttggaggttctccctggctcctgcaggcctgcggggatctctccccacttcaggcctccggcagctgcctgccctcttgtctgtgcttcagccctgcacaaaagcagcttggtgacaccactcagccacccagagtacgtgtttacaggctttccagatcaccttcctgtggggtgaacgtaatgaggcggggctggtccttggaatttcccctggaaaatggtaacagactccatccttgacccggggatgagcatgaaggcattgtcccaaaggcagaggccaccgtggtaggaattccaccaaggccagaagggaaaaaggaagaacccaccgtgtctggctgtgcgggccctggggagggtcgtgagtgcagcccctctctacttcygtgcctttgtaaaacgtgtagataaccgcagtggttggctgagccaagaactctcctaaatcagtggctttctccccaccccttgctggggagtcatttttaaaaaaatctgtgggatataaaattggcctcctgctgcttcagcctacctctccctctgctgacttaatgtcgtgattctgtttcttcagatatttaaggctgttaggttgtgtgagccttgaagtgtgtgtgtgtgtcccagcgactgtccactgtccaggagatgcatgtctttgtattggagatatttctgtaactcattctcttggtgctcacgattgccatggccatagggccacagtgccgtatctgctgcagacatgattgtttcttgttctagaggttttcttgttttcgaatcttgcctgatgaatccagccagaccaaggggcctagatttgacctctgtcctgggctcctgggccaggtgcaggaacatctgaggccactctgctggccacctccagtgggtgctgaccacaggatgggctttgtttacactcattttcaccctgattcttgcccccactttcataaaagaaacttcaaaatgctgacgctttggagagtaagaaaatcaatcttggctgggcacggtggctcctgcctgtgatcctagcactttgggaggctgaagctgaaggatcacttgagctcaggagttggagaccaaccctggcaacataacaagaccctgtctctacaaaaaaaaaaaaaaaaaaactcga

SEQ ID NO: 5433 - DNA, 1133 bp, Homo sapiens
  misc_feature (528)..(528): n equals a,t,g, or c
  misc_feature (552)..(552): n equals a,t,g, or c
  misc_feature (1133)..(1133): n equals a,t,g, or c
ggcacagcttggaatgaacccctgtggataagggggactattagatagaataaacatcaataaatgcttgatgaataaacgctaatcctaccttcccagcctgacacctcccagtggacaccacacttcacttgaagccttagaaacctttcccacccatgcttccagccctggcttcatgttgccatttctcacccccagaacaggccgcccgcctgaagaaactacaagagcaagagaaacaacagaaagtggagtttcgtaaaaggatggagaaggaggtgtcagatttcattcaagacagtgggcagatcaagaaaaagtttcagccaatgaacaagatcgagaggagcatactacatgatgtggtggaagtggctggcctgacatccttctcctttggggaagatgatgactgtcgctatgtcatgatcttcaaaaaggagtttgcaccctcagatgaagagctagactcttaccgtcgtggagaggaatgggacccccagaaggctgaggagaagcggaacntgaaggagctggcccagaggcaangaggaggaggcagcccagcaggggcctgtggtggtgagccctgccagcgactacaaggacaagtacagccacctcatcggcaagggagcagccaaagacgcagcccacatgctacaggccaataagacctacggctgtktgcccgtggccaataagagggacacacgctccattgaagaggctatgaatgagatcagagccaagaagcgtctgcggcagagtggggaagagttgccgccaacctcctaggcgccccgcccagctccctttgacccctggggcagggcagggggcagggagagacaaggctgctgctattagagcccatcctggagccccacctctgaaccacctcctaccagctgtccctcaggctgggggaaaacaggtgtttgatttgtcaccgttggagcttggatatgtgcgtggcatgtgtgtgtgtgtgtgagagtgtgaatgcacaggtgggtatttaatctgtattattccccgttcttggaattttcttcccatggggctggggtactttacattcaataaatactgtttaacccaaaaaaaaaaaaaaaaaagaaagaagn

SEQ ID NO: 5434 - DNA, 3187 bp, Homo sapiens
  misc_feature (473)..(473): n equals a,t,g, or c
ccccgggctgcaggaattcggcacagccagtgctgctggacgagccccccgaggaggaggacggcctgcgtggggggccgccaccggccgccgccgcccaggccaggttcagggagcaagtttccgaggttggaaagaagtgacttcactgtttaacaaagatgatgagcagcatctcctggaaagatgtaaatctcccaagtccaaaggaactaacttacgattaaaagaagagttgaaggcagagaagaaatctggattttgggacaatttggttttaaaacagaatatacagtctaaaaaaccagatgaaattgaaggttgggagcctccaaaacttgctcttgaagacatatcggctgaccctgaggacaccgtgggtggcacccatcctggtcaggctgggaggatgacgccaagggctcgaccaagtacaccagcctggccagctctgccaacagctccaggtggancttgcgcgcggcagggaaggctggtgagcatccgacggcagagtaaaggccacctgacagatagccggakgaggcggagtgaggggggctgygtggcaagtgtgccccgacatggtggccttttatgagtataccatgtagttgttgagtcttttccgcgttagaaagaatagagagtctactttttgcctatatttgatatttggacctctgtttctttatttaatgaactctcacacacactgtgactccttggtgaacacgtgcagggattgtacatttgattgccttattgcagaaatattcacctatcagtccatgttttgcagaaactggagatgtgaatttatgatgctctcccataatacagcagtaatgatttgcagtttctcacaaaatgattttcatgctgctctgtgttgtagttctgtttcagaacttccgtacctttttcttgtatgtagcacgtataaatgcagctgtcatgcagttcttttcttttgctagaaaattagtcaggaggtaagatgaatcttccaaagttatgttaaattttgtttaacttgacaaattaaactttgttcttattaaacaaatacgtaaacaaatactggaaaagcaaaggttatatttgggagtaaaatgtatcttaaaatgcatgttcatcttttgctgagggaggaatagcttcttgtatgtccactggatagtaacagtggttcttttttggaattttatttttacctcttttgaacttctaaatcggtccctttattttcttaaaacatttgctctcttttttgtttacagattaaagaagtatggatcaattttagtcagttgataatttcatttaggaaacattgtcttgctcattatagagagttaagactgtgcataaaatactgaagtgcctcttttttattaggctcatatgtttgttcttgcaaagcgagatgcctattgtgattggtgttagatctgtaagaagctgtgttttttccacaagaataatcgacgaccrgtttgagagcatctctcgcgttctttttctgtctgcttactgtccttgacaatgtgatcctgcacagtatcaggtgccagttatgcgtccctggaaggttggctcttatcagcaagtcctgcagatatctcttagataaaagtggtttgaaagaaaaggtatatttttcttttttgtttaaaagtaaaataaaacctccagttacactgtgcattcccctcacgtaaaaacaagacaaaaaccctttcctgagttgctcggcatgcactcctgtgctgtttcatgcatgtggatgttccttccgtttgttcctgtggaataactgagtgtgcctgatggcagaacacactgcagtgttatcagtgtctgcatgttttttaatagaacaggtttacttgatctgtcatctgttatgsaaaaaacagcaattacttttgcatccatctagctaaatctataatctgtgtcaatcacttatacctatcaatcatccgtatctattcacctgtcctctatgtctgtcttctctcagtctacatccatctagccttctgtcaatcatctacttttttttttaatagaacaagaagtttacttatcaagtcttgaaagggggacatgtttcaattggtgttcaaacaaaaattccagcttgtattagaaccttgaaatggtgaagttgtggaggttttctttgttccataatacagagacaagttcataatttttagtataacagctaagttgacaaattctaagtttcctcaggtaaatagtcgtaactgtccttttccctagagaagtgcttgctgggatagtaaaaacatacaccatttcatgacttctgcaaatactttccagcggaagtcagtgtaggtttgtttttggctaacatggtcttgctgcgcaggaatgtaaacactgtgtttgaaactctggaaatcacgtgtgtggggagatggggacgcttcccatgttgtggggagctctgtggctgtgatggctgcagttgccgtgcctctgttggaacgccaagtgcctgcaactcacgtcaatcatagaattgtgacgcacagttggcaaaatagttctttatgctatttctcaaaatttgaggacaaacccagattgggattggaatatgcactgtaaatcaaatttttcttatctacaaagactaatgtaaaaatgattttttcttctgtgcctgattaaattaactgtggtttttaatataaatatttattggtgtgctttgggagaaaaattatcttttcttgaaagaagttatcaaagcaaatttattatcttcacaagttaatgggagaatgtggttttgattctgggtgtttgaattgtgtaaacacacagcttccttgtgtgaagagagttgtcctgtgctccttctactgtactttttttattttttaataggaaagtgatgtgcttcagagaagggttcctccttaatgttgaggttttttaaaaataaaaatactgtttttaagctctttccttattggtttgcatgattattggcatctgcttacgatggctttaatcactcagagctaatggcacctttcctatttagcctcattttagaatgcagtcaacacatgtagacttttcacaaataaatgaacaacttcaaccttggttttcaagatgtgtcttctgcgtatttgaa

SEQ ID NO: 5435 - DNA, 2076 bp, Homo sapiens
cggcacgaggtttggtctaagagtgagcagaactgtgttgagatgggagcacatttggttgtgttcaacacagaagcagagcagtggaaggaggcatgcatccccagctgataccttcggttattgctgtagttttcatcttacttctcggtgtctgttttattgcaagttgtttggtgactcatcacaacttttcacgctgtaagagaggcacaggagtgcacaagttagagcaccatgcaaagctcaaatgcatcaaagagaaatcagaactgaaaagtgctgaagggagcacctggaactgttgtcctattgactggagagccttccagtccaactgctattttcctcttactgacaacaagacgtgggctgagagtgaaaggaactgttcagggatgggggcccatctgatgaccatcagcacggaagctgagcagaactttattattcagtttctggatagacggctttcctatttccttggacttagagatgagaatgccaaaggtcagtggcgttgggtgggaccagacgccatttaacccacgccagagtattctggcataagaatgaacccgacaactctcagggagaaaaactgtgttgttcttgtttataaccaagataaatgggcctggaatgatgttccttgtaactttgaagcaagtaggatttgtaaaatacctggaacaacattgaactagaaactcagaaagtggtccttgtgatggaaagagaaaagaaaaaccaattagaataaggcagaatgtacgtgcgtcattggaacacagaaaacatgctggttcatacagcgtttttagtcataatggtcttttttattttgtttgattcattcgagacaacatgtgtgtatgtgtgtgtgtgtgtgtgtagataatgtggtttttgtatggtgtttgatggaaggaataatctttctttgctttcttagtagtatttcaaggtgtttacttttcaattggtgtgcactgaatgcatgtatggaagaatagcgtgaataatgcaatctctttgtcatttttccccttctcagactcttagctcttaaaattcaaagatgggatattctaactggtagtggtgcatcatttttaacccaaatattgcaagcactttaaagatttgaaaccacatttttattgtttgatgtttcattttcagactttttaatgtcagtcattacaattacattgcatgaggaaaatttttccagaacaacagtgtggaatagttctgaattatgctgttctacagatagaaaaaaagtccaaatgcctttaaaaatttacttcttactccacccaacacgtttttgcaaagcaagaagtctttgtaagacaccttaaacaaagtccttcaattctacagcagaggaaataaaatcccccagaagccaaagggctcaccttcacattgttagttcatgacagacccaggtgtgcttcattagagataacatacattccctttggtatcacaggaagttactggggattactcgacctcatctacttagctaacgactggataaaatttcttaattatttgaagtaacattgtattcgtgtttgcattattaatttgaatagcaaataatcacattttcaacccatttatacaaattgttaatgtttctttagagctgtataactatagtttgaactagcaaggaagttattgttttgacaaccagaaattatgcttttcctggtgcatgaaacattaattgcaaagggcagtcacatccaactttaataaaatatggtggtctttcttaaaattttcaatttgctaatttttcctggatctaagctgaaaaattccaagcaacagctttttaacctaactttcctactactacttttaaaagcagtatttattttgtaaattagctactgattttttgggtttgaaatactggtgtttgattgtgtggtggtggtggtggtgatggatgcgtgtagctgtgttaaaagctgatacttttagctgaaatggtgctaaataaatttgactgtgtttgccatattcactaaaaaaaaaaaaaaaaaa

SEQ ID NO: 5436 - DNA, 2059 bp, Homo sapiens
cggcacgaggtttggtctaagagtgagcagaactgtgttgagatgggagcacatttggttgtgttcaacacagaagcagagcagtggaaggaggcatgcatccccagctgataccttcggttattgctgtagttttcatcttacttctcggtgtctgttttattgcaagttgtttggtgactcatcacaacttttcacgctgtaagagaggcacaggagtgcacaagttagagcaccatgcaaagctcaaatgcatcaaagagaaatcagaactgaaaagttgctgaagggagcacctggaactgttgtcctattgactggagaaccttccagttccaactgctattttcctccttactgacaacaagacgtgggctgagagttgaaaggaactgttcagggatgggggcccatctgatgaccatcagcacggaagctgagcagaactttattattcagtttctggatagacggctttcctatttccttggacttagagatgagaatgccaaaggtcagtggcgttgggtgggaccagacgccatttaacccacgccagagtattctggcataagaatgaacccgacaactytcagggagaaaactgtgttgttctggtcttataaccaagataaatgggcctggaatgatgttccttgtaactttgaagcaagtaggatttgtaaaatacctggaacaacattgaactagaaactcagaaagtggtccttgtgatggaaagagaaaagaaaaaccaattagaataaggcagaatgtacgtgcgtcattggaacacagaaaacatgctggttcatacagcgtttttagtcataatggtcttttttattttgtttgattcattcgagacaacatgtgtgtatgtgtgtgtgtgtgtgtgtagataatgtggtttttgtatggtgtttgatggaaggaataatctttctttgctttcttagtagtatttcaaggtgtttacttttcaattggtgtgcactgaatgcatgtatggaagaatagcgtgaataatgcaatctctttgtcattttttcccctttctcagactcttagctcttaaaattcaaaagatgggatattctaactggtagtggtgcatcatttttaacccaaatattgcaagcactttaaagatttgaaaccacatttttattgtttgatgtttcattttcagactttttaatgtcagtcattacaattacattgcatgaggaaaatttttccagaacaacagtgtggaatagttctgaattatgctgttctacagatggaaaaaagtccaaatgcctttaaaaatttacttcttactccacccaacacgtttttgcaaagcaagaagtctttgtaagacaccttaaacaaagtccttcaattctacagcagaggaaataaaatcccccagaagccaaagggctcaccttcacattgttagttcatgacagacccaggtgtgcttcattagagataacatacattccctttggtatcacaggaagttactggggattactcgacctcattacttagctaacgactggataaaatttcttaattgtttgaagtaacattgtattcgtgtttgcattattaatttgaatagaaaataatcacattttcaacccatttatacaaattgttaatgtttctttagagctgtataactatagtttgaactagcaaggaagttattgttttgacaaccagaaattatgcttttctggtgcatgaaacactaattgcaaagggcagtcacatccaactttaataaaatatggtggtctttcttaaaattttcaatttgctaatttttcctggaaacctaactttcctactactacttttaaaagcagtatttattttgtaaattagctactgattttttgggtttgaaatactggtgtttgattgtgtggtggtggtggtggtgatggatgcgtgtagctgtgttaaaagctgatacttttagctgaaatggtgctaaataaatttgactgtgtttgccatattcactaaaaaaaaaaaaaaaaaactagaggggggg

SEQ ID NO: 5437 - DNA, 2418 bp, Homo sapiens
  misc_feature (565)..(565): n equals a,t,g, or c
  misc_feature (1863)..(1863): n equals a,t,g, or c
cccacgcgtccgcccacgcgtccgcccacgcgtccgcccacgcgtccgggactcagcgaagggtgggcgccgccgaggcctcctgccgctggcgggtttccgcggagtgccgcccggctccgctctgccgccggcgcggctcatgggcagagtcggccgggcgggccggcattaaactgaagaaaagatgtccctgtacgatgacctaggagtggagaccagtgactcaaaaacagaaggctggtccaaaaacttcaaacttctgcagtctcagcttcaggtgaagaaggcagctctcactcaggcaaagagccaaaggacgaaacaaagtacagtcctcgccccagtcattgacctgaagcgaggtggctcctcagatgaccggcaaattgtggacactccaccgcatgtagcagctgggctgaaggatcctgttcccagtgggttttctgcaggggaagttctgattcccttagctgacgaatatgaccctatgtttcctaatgattatgagaaagtagtgaagcgcgcaaagagaggaacgacagagacagcgggagtgganaagacaaaaggaaatagaagaaagggaaaaaaggcgtaaagacagacatgaagcaagtgggtttgcaaggagaccagatccagattctgatgaagatgaagattatgagcgagagaggaggaaaagaagtatgggcggactgccattgccccacccacttctctggtagagaaagacaaagagttaccccgagattttccttatgaagaggactcaagacctcgatcacagtcttccaaagcagccattcctcccccagtgtacgaggaacaagacagaccgagatctccaaccggacctagcaactccttcctcgctaacatggggggcacggtggcgcacaagatcatgcagaagtacggcttccgggagggccagggtctggggaagcatgagcagggcctgagcactgccttgtcagtggagaagaccagcaagcgtggcggcaagatcatcgtgggcgacgccacagagaaaggtgtgtccccagggaagcgtgtgactagagggaaaggactggccccatccatatcagacatggccagtcttgatcctcatgtgtcagcagggggacaatgaggcgtgtggccagagggagagggctggccctgccatcactagaacacaggccgtcctgttcatatgatgcactgccacttccgttttgtgaaaccaggaatcctgaggctcatctttattttttcagaacagacgtagagagatgaaggcttgtggaggaaaagatggtgagagacttgggcagaaaatgagtagtcctcaggaagaaatcttggttatgtgtttagagcatgaaggacagagccatatagtgtggcagtgaatatacctgctatctccatctcagaggtcgtctctacttttcccttttgccctttcagtatagatgtgatttctgattctcttacagattgtttgctttgcgagatctgatgttatgttgcagtctcttggtaaatgatgcctagttggtgttttattttcatttaatttttacagtctgttctgtgttgagggaattcaggaaagagacaaacatatgttagcattttaatcagggaattaagtttgagtcagcctagctgaacttcctttgctaaagaaagaagaaaacttttctggcagccccgttcatgcacagcttagggatacatcacgagcctgacagatgcatccaagaagtcagattcaaatccgctgactgaaatacttaagtgtcctactaaagtggtcttactaaggaacatggttggtgcgggagaggtggatgaagacttggnaagttgaaaccaaggaagaatgtgaaaaatatggcaaagttggaaaatgtgtgatatttgaaattcctggtgcccctgatgatgaagcagtacggatatttttagaatttgagagagttgaatcagcaattaaagcggttgttgacttgaatgggaggtattttggtggacgggtggtaaaagcatgtttctacaatttggacaaattcagggtcttggatttggcagaacaagtttgattttaagaactagagcacgagtcatctccggtgatccttaaatgaactgcaggctgagaaaagaaggaaaaaggtcacagcctccatggctgttgcataccaagactcttggaaggacttctaagatatatgttgattgatcccttttttattttgtggttttttaatatagtataaaaatccttttaaaaaaacaacaatctgtgtgcctctctggttgtttctcttttttattattactcctgagttgatgacattttttgttagatttcatggtaattctcaagtgcttcaatgatgcagcatttcttgcact

SEQ ID NO: 5438 - DNA, 1545 bp, Homo sapiens
  misc_feature (1091)..(1091): n equals a,t,g, or c
gaaagacaaaaggaaatagaagaaagggaaaaaaggcgtaaagacagacatgaagcaagtgggtttgcaaggagaccgagatctccaaccggacctagcacggtggcgcacaagatcatgcagaagtacggcttccgggagggccagggtctggggaagcatgagcagggcctgagcactgccttgtcagtggagaagaccagcaagcgtggcggcaagatcatcgtgggcgacgccacagagaaaggtgtgtccccagggaagcgtgtgactagagggaaaggactggccccatccatatcagacatggccagtcttgatcctcatgtgtcagcagggggacaatgaggcgtgtggccagagggagagggctggccctgccatcactagaacacaggccgtcctgttcatatgatgcactgccacttccgttttgtgaaaccaggaatcctgaggctcatctttattttttcagaacagacgtagagagatgaaggcttgtggaggaaaagatggtgagagacttgggcagaaaatgagtagtcctcaggaagaaatcttggttatgtgtttagagcatgaaggacagagccatatagtgtggcagtgaatatacctgctatctccatctcagaggtcgtctctacttttcccttttgccctttcagtatagatgtgatttctgattctcttacagattgtttgctttgcgagatctgatgttatgttgcagtctcttggtaaatgatgcctagttggtgttttattttcatttaatttttacagtctgttctgtgttgagggaattcaggaaagagacaaacatatgttagcattttaatcagggaattaagtttgagtcagcctagctgaacttcctttgctaaagaaagaagaaaacttttctggcagccccgttcatgcacagcttaggatacatcacgagcctgacagatgcatccaagaagtcagattcaaatccgctgactgaaatacttaagtgtcctactaaagtggtcttactaaggaacatggttggtgcgggagaggtggatgaagacttgggaagttgaaaccaaggaagaatgtgnaaaaatatggcaaagttggaaaatgtgtgatatttgaaattcctggtgcccctgatgatgaagcagtacggatatttttagaatttgagagagttgaatcagcaattaaagcggttgttgacttgaatgggaggtattttggtggacgggtggtaaaagcatgtttctacaatttggacaaattcagggtcttggatttggcagaacaagtttgattttaagaactagagcacgagtcatctccggtgatccttaaatgaactgcaggctgagaaaagaaggaaaaaggtcacagcctccatggctgttgcataccaagactcttggaaggacttctaagatatatgttgattgatcccttttttattttgtggttttttaatatagtataaaaatccttttaaaaaaacaamaaaaaaaaaaaaaactcgagggggggcccggtacccaattt

SEQ ID NO: 5439 - DNA, 1072 bp, Homo sapiens
  misc_feature (374)..(374): n equals a,t,g, or c
ggcasagcccttatctccttcgcagtgcagctccttcaacctcgccatggcctctgccggaatgcagatcctgggagtcgtcctgacactgctgggctgggtgaatggcctggtctcctgtgccctgcccatgtggaaggtgacygctttcatcggcaacagcatcgtggtggcccaggtggtgtgggagggcctgtggatgtcctgcgtggtgcagagcaccggccagatgcagtgcaaggtgtacgactcactgctggcgctgccacaggacctgcaggctgcacgtgccctctgtgtcatcgccctccttgtggccctgttcggcttgctggtctaccttgctggggccaagtgtaccacctktttttatnataaggattccaaggcccgcctggtgctcacctctgggattgtctttgtcatctcaggggtcctgacgctaatccccgtgtgctggacggcgcatgccatcatccgggacttctataaccccctggtggctgargcccaaaagcgggagctgggggcctccctctacttgggctgggcggcctcaggccttttgttgctgggtggggggttgctgtgctgcacttgcccctcgggggggtcccagggccccagccattacatggcccgctactcaacatctgcccctgccatctctcgggggccctctgagtaccctaccaagaattacgtctgacgtggaggggaatgggggctccgctggcgctagagccatccagaagtggcagtgcccaacagctttgggatgggttcgtaccttttgtttctgcctcctgctatttttcttttgactgaggatatttaaaattcatttgaaaactgagccaaggtgttgactcagactctcacttaggctctgctgtttctcacccttggatgatggagccaaagaggggatgctttgagattctggatcttgacatgcccatcttagaagccagtcaagctatggaactaatgcggaggctgcttgctgtgctggctttgcaacaagacagactgtccccaagagttcctgctgctgctgggggctgggctt

SEQ ID NO: 5440 - DNA, 1227 bp, Homo sapiens
ggcacgaggtggggtcctcctctggcctcctgcccctcctgctgctgctgctgcttccattgctggcagcccagggtgggggtggcctgcaggcagcgctgctggcccttgaggtggggctggtgggtctgggggcctcctacctgctcctttgtacagccctgcacctgccctccagtcttttcctactcctggcccagggtaccgcactgggggccgtcctgggcctgagctggcgccgaggcctcatgggtgttcccctgggccttggagctgcctggctcttagcttggccaggcctagctctacctctggtggctatggcagcggggggcagatgggtgcggcagcagggcccccgggtgcgccggggcatatctcgactctggttgcgggttctgctgcgcctgtcacccatggccttccgggccctgcagggctgtggggctgtgggggaccggggtctgtttgcactgtaccccaaaaccaacaaggatggcttccgcagccgcctgcccgtccctgggccccggcggcgtaatccccgcaccacccaacacccattagctctgttggcaagggtctgggtcctgtgcaagggctggaactggcgtctggcacgggccagccagggtttagcatcccacttgcccccgtgggccatccacacactggccagctggggcctgcttcggggtgaacggccacccgaatcccccggctactaccacgcagccagcgccagctagggccccctgcctcccgccagccactgccagggactctagccgggcggaggtcacgcacccgccagtcccgggccctgcccccctggaggtagctgactccagcccttccagcccaaatctagagcattgagcactttatctcccacgactcagtgaagtttctccagtccctagtcctctcttttcacccaccttcctcagtttgctcacttaccccaggcccagccttcggacctctagacaggcagcctcctcagctgtggagtccagcagtcactctgtgttctcctggcgctcctcccctaagttattgctgttcgcccgctgtgtgtgctcatcctcaccctcattgactcaggcctggggccaggggtggtggagggtgggaagagtcatgttttttttctcctctttgattttgtttttctgtctcccttccaacctgtcccttccccccaccaaaaaaaaaaaaaaaaaa

SEQ ID NO: 5441 - DNA, 368 bp, Homo sapiens
  misc_feature (365)..(365): n equals a,t,g, or c
ggagaacaggggcaatgacacatgctccttggcttcctagtcctgatcccttggggttccttgatcctagggtcatctgacttagatccatcctcccttcctctaggcaccaggggccatggctggaggtggccacccctcagtcctgtacagattctgtacccactggctggagacccccatgcagctgtctcctgctcttgctgcggggagactgaactcagggctctgctcactggctccctcccaatggaagccttctctgggcttcacagcattgaatattcctccagaacagcttgttaaatcaaattttttttttttttagatggagycttgctytgkcgcccaggctggaatgcacnggc

SEQ ID NO: 5442 - DNA, 739 bp, Homo sapiens
  misc_feature (532)..(532): n equals a,t,g, or c
  misc_feature (555)..(555): n equals a,t,g, or c
  misc_feature (639)..(639): n equals a,t,g, or c
  misc_feature (648)..(648): n equals a,t,g, or c
  misc_feature (686)..(686): n equals a,t,g, or c
  misc_feature (702)..(702): n equals a,t,g, or c
  misc_feature (737)..(737): n equals a,t,g, or c
gcccaaaagtgctgggagtacaggcatgaaccaccgtgcctggccatttttaccgtttttttttttttttttgagacggagtcttgctctgtcgcccaggctggagtgcagtggcgccgtctcggctcactgcgggctccgcctcccgggttcacgccattctcctgcctcagcctcccgagtggctgggactgcaggcgcccgctaccacgcccggctagttttttttgtatttttggtagagacggggtttcaccgtgttggccaggatggtctcgatctcctgacctcgtgatccgcccgcctcggcctcccaaagtgctgggattacaggcgtgagccaccgcgcccggcctatttttaccgtttttaagtatacagttcagtagtaataaatacatttctattctttttctcctcccttcaactccccccacccacttcctggcctttgataaccaccagtttatttatctttatgagatttaactctgacatatgagtgaaaacatgcaataagttggctttctgngcttggtttatttcacttaacgngatggcttccagttccatccatattgctgcaaatgacaggatttcatttatttttatggctgaataatattccggaatggatgnataccacantttctttaagcacttaagttggacttcatggttttggncattgggaaaagggcntgcaataaaccgtaggaatacaactatcttccaanaa

SEQ ID NO: 5443 - DNA, 306 bp, Homo sapiens
  misc_feature (256)..(256): n equals a,t,g, or c
  misc_feature (301)..(301): n equals a,t,g, or c
cgggctgcaggaattcggcacgagatgatggtggtggtgaggataatggttgtgatggcttctcttcaggtggagcctgcagttggcaaagaacagctcagggagaggcagggtccagagctccttggctgggtggctggcctggcttttgtgtgtctctttgcctgtgttggggtgggggtcgctccctgtcactccttcgattctgaagctgcctccttcctcctcctgtactcctggtgcacgcccaggctcntgtcttggctccgggacactccctccccactcgcctccggcacgntccct

SEQ ID NO: 5444 - DNA, 278 bp, Homo sapiens
  misc_feature (28)..(28): n equals a,t,g, or c
ctctccctcctcctcactccctccaccntcaaccaggccctgctgacttcttrwwccttctttgtgtccatgtgtgctcagcgtttggctcccactcataagtgagagccatgtttggttttcttgcctgtgtcagttcccttagggtcatggcctccagctccagccatgttacttcagaggacatgatcttgttcttaatatcctgtggtatatatgtaccacattttctttatccagttgaccgttgatgggcatacagcacttttacaattaga

SEQ ID NO: 5445 - DNA, 1772 bp, Homo sapiens
tcgacccacgcgtccgggaggatccccagccgggtcccaagcctgtgcctgagcctgagcctgagcctgagccgagccgggagccggtcgcgggggctccgggctgtgggaccgctgggcccccagcgatggcgaccctgtggggaggccttcttcggcttggctccttgctcagcctgtcgtgcctggcgctttccgtgctgctgctggcgcactgtcagacgccgccaagaatttcgaggatgtcagatgtaaatgtatctgccctccctataaagaaaaattctgggcatatttataataagaacatatctcagaaagattgtgattgccttcatgttgtggagcccatgcctgtgcgggggcctgatgtagaagcatactgtctacgctgtgaatgcaaatatgaagaaagaagctctgtcacaatcaaggttaccattataatttatctctccattttgggccttctacttctgtacatggtatatcttactctggttgagcccatactgaagaggcgcctctttggacatgcacagttgatacagagtgatgatgatattggggatcaccagccttttgcaaatgcacacgatgtgctagcccgctcccgcagtcgagccaacgtgctgaacaaggtagaatatggcacagcagcgctggaagcttcaagtccaagagcagcgaaaagtctgtctttgaccggcatgttgtcctcagctaattggggaattgaattcaaggtgactagaaagaaacaggcagacaactggaaaggaactgactgggttttgctgggtttcattttaataccttgttgatttcaccaactgttgctggaagattcaaaactggaagkaaaaacttgcttgatttttttttcttgttaacgtaataatagagacatttttaaaagcacacagctcaaagtcagccaataagtcttttcctatttgtgacttttactaataaaaataaatctgcctgtaaaataaattaaaaaatcctttacctggaacaagcactctctttttcaccacatagttttaacttgactttccaagataattttcagggtttttgttgttgttgttttttgtttgtttgttttggtgggagaggggagggatgcctgggaagtggttaacaacttttttcaagtcactttactaaacaaacttttgtaaatagaccttaccttctattttcgagtttcatttatattttgcagtgtagccagcctcatcaaagagctgacttactcatttgacttttgcactgactgtattatctgggtatctgctgtgtctgcacttcatggtaaacgggatctaaaatgcctggtggcttttcacaaaaagcagattttcttcatgtactgtgatgtctgatgcaatgcatcctagaacaaactggccatttgctagtttactctaaagactaaacatagtcttggtgtgtgtggtcttactcatcttctagtacctttaaggacaaatcctaaggacttggacacttgcaataaagaaattttattttaaacccaagcctccctggattgataatatatacacatttgtcagcatttccggtcgtggtgagaggcagctgtttgagctccaatgtgtgcagctttgaactagggctggggttgtgggtgcctcttctgaaaggtctaaccattattggataactggctttttttcttcctctttggaatgtaacaataaaaataatttttgaaacatcaaaaaaaaaaaaaaaaaaaa

SEQ ID NO: 5446 - DNA, 1136 bp, Homo sapiens
  misc_feature (1087)..(1087): n equals a,t,g, or c
tcgacccacgcgtccggaaatctagttcgggaaaagtgtgaggggctcttcacgtggggaaggaacagcaggcgcggaggagggggcaagcgtgtgtgagattcagtggtccatgcgtgcgtttgtcgtgtaagggtcattcctggggtttggagtgggggaacaaatcaatgtggctgtttttccgtggaaagaattcccactgcagtgtcccggagcctgcgtgtggtgggcaagctcctcaaatggtatctcacagggaataggggagtcttgaaaacgcagcttcggcagtaggaacatgaacctcttacctaaaagttccagggagtttggctccgttgactattgggagaagttcttccagcagcgaggaaagaaagctttcgagtggtatggaacctacctggaactgtgcggggtgctacataaatatatcaagcccagggaaaaggtgctggtgattgggtgtggcaactcagaactgagtgagcaactgtatgatgtgggctatcgggatatagtgaacatcgacatcagtgaggttgtcatcaagcaaatgaaggaatgtaatgccacccgacggccccagatgagcttcttgaagatggacgtgacgcagatggagtttcctgatgcctcgttccaggtggtgttggacaagggcaccctggatgctgtcctgacagatgaggaagagaagaccttacaacaggtggacaggatgctggctgaggttggccgtgtcctgcaggtgggcggtcgctatctctgcatctccctggctcaggctcacatcctgaagaaagcagtgggccacttctcccgggaggggtggatggtgagggtgcaccaagtggccaacagccaggaccaggtgttggaagcagagcctcagttctccttgcctgtctttgccttcatcatgaccaagttcaggccagtccctggctctgcccttcagatctttgagctgtgtgctcaggagcagcgcaacctgtgcggctggagagtgccgagcggctggccgargcggtgcaggarcgacacagttatgcctggctgtgcagccagctgcgccgcaagncaggctggggaatgtgtctctggacttgtgcgatggggacacgggggaa

SEQ ID NO: 5447 - DNA, 1533 bp, Homo sapiens
  misc_feature (1486)..(1486): n equals a,t,g, or c
  misc_feature (1532)..(1533): n equals a,t,g, or c
cactggacttgygcgatggggacacgggggagccacgctacaccctccacgtggtggacagccccactgtgaaaccatcgcgggataatcattttgcgattttcatcatccctcagggccgggagaccgagtggctctttggcatggatgagggccggaaacagctggcggccagtgctggcttcaggaggttgattacagtggcccttcaccgaggtcagcagtatgaaagcatggaccacatccaagctgagctgtcrgctagagtcatggagctggccccagctgggatgcccacccagcagcaggtcccctttctgtctgtgggtggggacattggggtccggaccgttcagcaccaagactgcagccccttgagcggtgactatgtcattgaggatgtgcaaggggatgacaagcgatacttccgtcgactgatcttcctcagcaacaggaatgtggtgcagtccgaagccaggttgctgaaggatgtgtctcacaaagcccagaagaagcggaaaaaggacaggaagaagcagcggcctgctgatgcggaggacctccctgcagccccggggcagtccattgataagagttacctgtgttgtgaacaccacaaagccatgatcgctggccttgccctgctgagaaacccagagctactcctagagatcccactggcattgttggtggtaggcctgggcgggggcagcctccccctctttgtccacgatcattttccaaagtcctgcattgatgctgtggagatcgatccctccatgttggaagtggccacccagtggtttggcttctcccagagtgaccgaatgaaggtccacattgcagatggcctggactatatcgccagcttggcaggaggaggagaagcacggccttgctacgatgtcataatgtttgatgttgacagtaaggacccaacactgggaatgagttgtccgcccccagcatttgtggagcaatcttttctacagaaggttaaaagcatcttgactcctgaaggtgtttttattctcaaccttgtgtgccgagacttggggctaaaagactcagtgctggctgggctcaaggcagtgttccccctcctatatgtccggcgaattgagggtgaagtgaatgagatcctgttctgtcagctgcaccctgagcaaaaacttgccacaccagagctcctagaaacagcccaggctttggagcggaccctgaggaagcctgggaggggttgggatgacacgtatgtcttgtcagatatgctcaagacggtgaaaattgtgtgactgcttaggccaagcagccctcctgcctagactgaccttggactcccagcctgccagagaatgaagaaatacaacgcacagtacttttgaagcttcgtatttttcttggtttcacactcagctacatgtgacctccagcttggtgaggttgcctgaagattagggaaaataaaaatgtccttcccatcttntarwaaaaaaaaaaaaaaaaaaaaaaaaaaaaaaaaaaaaaaaatnn

SEQ ID NO: 5448 - DNA, 1322 bp, Homo sapiens
  misc_feature (82)..(82): n equals a,t,g, or c
  misc_feature (1320)..(1322): n equals a,t,g, or c
cttctgggagcgaccgctccgctcgtctcgttggttccggaggtcgctgcggcggtgggaaatgctggcgcgcgcggcgcgnggcactggggcccttttgctgaggggctctctactggcttctggccgcgctccgcscgcgcctcctctggattgccccgaaacaccgtggtactgttcgtgccgcagcaggaggcctgggtggtggagcgaatgggccgattccaccggatcctggagcctggtttgaacatcctcatccctgtgttagaccggatccgatatgtgcagagtctcaaggaaattgtcatcaacgtgcctgagcagtcggctgtgactctcgacaatgtaactctgcaaatcgatggagtcctttacctgcgcatcatggacccttacaaggcaagctacggtgtggaggaccctgagtatgccgtcacccagctagctcaaacaaccatgagatcagagctcggcaaactctctctggacaaagtcttccgggaacgggagtccctgaatgccagcattgtggatgccatcaaccaagctgctgactgctggggtatccgctgcctccgttatgagatcaaggatatccatgtgccaccccgggtgaaagagtctatgcagatgcaggtggaggcagagcggcggaaacgggccacagttctagagtctgaggggacccgagagtcggccatcaatgtggcagaagggaagaaacaggcccagatcctggcctccgaagcagaaaaggctgaacagataaatcaggcagcaggagaggccagtgcagttctggcgaaggccaaggctaaagctgaagctattcgaatcctggctgcagctctgacacaacataatggagatgcagcagcttcactgactgtggccgagcagtatgtcagcgcgttctccaaactggccaaggactccaacactatcctactgccctccaaccctggcgatgtcaccagcatggtggctcaggccatgggtgtatatggagccctcaccaaagccccagtgccagggactccagactcactctccagtgggagcagcagagatgtccagggtacagatgcaagtcttgatgaggaacttgatcgagtcaagatgagttagtggagctgggcttggccagggagtctggggacaaggaagcagattttcctgattctggctctagcttccctgccaagattttggtttttatttttttatttgaactttagtcgtgtaataaactcaccagtggcaaaccaaaaaaaaaaaaaaaaaaaaaaaaaaaaaaaaaaaaaaaaaaaaaaaaannn

SEQ ID NO: 5449 - DNA, 908 bp, Homo sapiens
  misc_feature (361)..(361): n equals a,t,g, or c
gaattcggcagaggggaggcctgccctgcccttcctcctgcagagagccaggttcacagcagggcgkcctgcaggacattagcatgcctagtagatacacagtgtcgttggggcgtgggcattttgwtttctgttccttctttttccctatttaactatcatgtttggggacctttgcctctcaatttttaagagattaaaaaaaaatgagrgcggcctttattatacactacatgtgttttctcccagtttgtcagttgtcttttgcctttttggtaattttgccaggtacttatgtcaacttgcattaagatgtccccttattaataaaagtaatttgctctcattgtatgcaattaanagaatactaaaatttctaatgatcctaccacttaaagctgtataaacgctgctaacataccaggtatcccattccaggcttgcttgtatgtgtatatatattaatatttatctgtagctgtatgtctgkgacactctaaattattaaaaatttgtcccagtggcttacaaatttttttttgtagtagcagcagcttttaaaaaatacaaatcttagcatagttaacagaaaaaaagagttgctccggttaaggtagattctaatccccaccagggcccctgagacatgtccttaaattgctacaaaatgtacaacaaaccactagtaaagtttattctatttgataactctgtttgcttttaaaaacttcatgtatagtgattattttcctgttattctgtattcttcacctgcttcatatttagtgactgccaagtattctattgtatgtttatgacacaagtaatttaactattttcttatcattgaacatttacatttgtatatacttttactgttttgccaaaaaaaaaaaaaaaaaactcga

SEQ ID NO: 5450 - DNA, 1320 bp, Homo sapiens
  misc_feature (831)..(831): n equals a,t,g, or c
ctaacagcgagaacgctttggtgaggacggagccctcacgacctcagcagtgttgcgttggggatcaggtttccgatggtgaacttggggacacgtccacaccacagcacgtgcctattgtgtttctcggtggctggtgtgtttgaggatggcgcgtgcatgcgttttccagctttctttgtggaggaagttacctgtgggtattaacctgtccccagccatcctctcactgagcttgggttgcctgggcctgggtttcctgttgttgctggaacgaatgaccacagacagtggcattagacagcgcaggcagacatgacctcctgggcttctgcgggtgccaacactgccgctccttctggaggctcagggaggctcttgagggcattgggacatcgtsctgccggccgccgggcagagccgktttgtttattttttragacttccgggaacatagttataaataactttaatttgccttggcctgcccactgcagtacagtcacgtgtcacataacattctgtctaccgtggaccacatatacgaccacgcggtcacataagctgacaatactgtatttttactccactttctctatttagatacacagttgccattgtgtcccagcagccttcagtamtcagtacagccatgtgctgtgcaggtgtytagctcaggggcatgrggccmtggcccagcccagtgtgcagtgggtggcaccttctggatttgtgtcagtcamtgtggagttcgcacaatgacagaytcacctgggaggccttccgtgsgsttctgtttctttctctmatttgattgtggctagaaacagnstgggaaccaggagtgcagyttctcggagtamgtggctgccccacggggtgggatgtgcattttcagtcacatttggggagagcacgcgtgttcttaagtttttagtgggttctagtaagaatggatgttgatttttagaattctctcctgtttattttttaacattttgtggtgggaatttgtgaaagaatacgaagtcaagagcatggtacggtgaggacccagcaccatctccaacctccccggggtccacgtggggtctgcgtgtggccgcctgtccctcagcacgatgtctgggtgtaaatctgagacatcacagcatgcaggctgcagacgtaggcatctctacaaaagaaggatgcgtttacaggagaatcgcttgaacctgggaggcagaggttgcagtgaatcgagatcatggcactgccctccagcctgggcgacaaagcycagactccgtctcaaaaaaaaaaaaaaaaaaactcgag

SEQ ID NO: 5451 - DNA, 1202 bp, Homo sapiens
  misc_feature (282)..(282): n equals a,t,g, or c
  misc_feature (596)..(596): n equals a,t,g, or c
  misc_feature (607)..(607): n equals a,t,g, or c
  misc_feature (1200)..(1200): n equals a,t,g, or c
gaattcggcacgagattaagttgtgcactttaattgggtgaattgtacatgtragttatatatctractgtagttgtwattaaaaaacaacaggaggccatgtgggctgctaggagtagcaatgtctgtycccagccagcaggtagagaccagggctggacagagkagtatgggctgtgctgcagattatttgtggtacccaactgttgcataaaacagggtgtgatctcttgcattgctatgcatgagtggattcccagtaaattgtgccaggctgcctgnatgatgtgtggcttgtgctttggatcgtaatgcttacctatgctacttaagttacataccctgtggcctttgtggccaggactgtgggctactacctgkagtgattcgttaggggaaaggacccacagcctgtgcaggaggaaaaaagcatctctgagtacagggtggatgagctggatgagctgccgggcaagagccacgcacacccaggtggtgagtcttaaggataaggtggaatttgccccatagctgtcctggacagaaactgcccagagaagaatgaatggaggacatagggctctgtggtcccaccnttttttggganacctgtgactggtcctgttaccatgtcaacttagccccaaacccatctctgattgacttggttgcttattttggcacattcttgctccacacagccacatacatactggctgctcctcsaaggccaggcagatgcagcagctgttgggccascaaagargaargtcctggaargttctggcctgaacgctgcatctgttgtgtgacagccacaactgctcaggcttccttgtctgtgggtgcactgtggggaggagtgttatgataagaacattggctctcagtcttccctggggagaagtttggcctcacgtgggatttgggcgttgcctttaggaaggctctctgcatgtctagttccagtttgtactgggaagaattaaaaaagtctgccagcttctttagtttgtcctgtcttttgtgatgattctttctgagatcccctcctatcagctcaggagtgggattttctggagaaggaaagtgtttttcctgttcctcactgctcaccttggggcattcaggaacatgggcctgatgaatttgcttgaaggcagtctgtaatcccatcactttgggagccaaagaggcggnca

SEQ ID NO: 5452 - DNA, 804 bp, Homo sapiens
gaattcggcacgagattttcttcatgcagtattctcagattggaaacatgcttcatgtttcttataaataaccctcaattatgagggcgtacttttcactttgaagaaaattgacttgcattaaagtggctaacaattctttcctgggcaggatgtaaaattttcctctcctctaataccagtactgttgagctcacattctcccacttttcctcttttcaggtggttcacgtatttgggattttatgaaacctcagaagcagacatgttaacttttcttatctttttattccctgaggtagtcctggggctcttaagagattacagttcttaaaacctggaaagtgacaccagagaggtagatcttagttcccaaaattaaagttactttctagggcataaaaccttttcagaattcagattaaattttatttattttttcttttttctgtaaccttatatttgaggggaaaattttattttcaacttttgcatatatctaatttaacatttgggaaaactgtaaatgggccaaagtttctccctttatatgattttccagatttttaccactttcttagtgccacttgatgctaggcattgtctattggagactcactggtacgtaactgcaggttttaccatggaaccacatatacacatgtcttggaattgagggttagggtttccagaaggacttagttgtcctgtgcttttgtctgccccatgccaaagaccactaagaacagttttgtaagtgaaacttgggtctacacgttaaaaaaaaaaaaaaaaaaaactcga

SEQ ID NO: 5453 - DNA, 1674 bp, Homo sapiens
  misc_feature (734)..(734): n equals a,t,g, or c
gagaagtcctagtggctctctgctggtgctgaggcaggaagggccagaagctggtgagcttccctgaaccctggtgtgcctgggagtcagttccgaagaaggcagctgtcccagagatgtgacaggacctggctgttgtttctctctgaccctaacaggatttatgccctgcatccgcggtgtttttcactgttttattcttattattcttattctcttggcgtcacatgcgtttagtggatctggaaatcaaaggctgaaggaagcgctgacattgatcgtatctgttaatgtggatattgccagacacaggcccttcttggagcgtatacatgttaagaagggcaacacttagcccccaaaacagtaccccagtgttgcgtttacatgcagcagaaatagctggatggagagagattttgagccagggtctgccaatgccacttcagcctcarggctgagctgggcctggagaggaaagctgctgagccaccgttggagcaaatgactgaggacctctgctgcccctacttctgcccgagagctgagctgacctgattgtgctttggcatcaccacccactctggccccaacatctagccttgccaagttcaggtgctagtcatgaccatgtagagctcaccgtgtacccaaagactgtggcagcttcctggctgctggagctttccaggccccctatcttctgtttattcactcasccagcattaactgancatggactggatagggttgctgcccttgtggaatgcaccatctggararararaggaatgtggtatcgcagacgctacagttgctgccagtttagggatagaagtatcagggatgtcttcccagaagcagtgatgctccaacaacatctcaggcacttggctgtggccacatatcggtgcagaaggagaagcccatgcaaggcacccacagttgaggaagcagagggtggcaagccacgagcagtgccctcaggcacaggattccagaagcatgggcaagagcctggagggtccacatccccacattggttctggggacatttgcaactccttgtcttgagtgtcaacaacaggcagctctttgttcagggcagggcagggtatttggagatgactggtttgccctgtccaaagctgctgctcacactgttgagaggcttgacgcctggggtgggacatgggctgtgtgcatatcggcgaggctgtctggcctggcggctggacamagcctcctagtggagatgatatttggcctgtgaactgaatcaggtgaaggataggagaagaaamcascatatttggagacttagtggccagagcatgtcttggcagagaaactggaaggaggctggaatggctgcaccaggcagaaggaagactcctaaagtggggatgacgggtaacctgggtcacatgtgcgagatcttcttgtagcctgggggaggagcttacactgtcctgagagcagtggggagcctcaggagcctgcctccagagtatctaggcattagttacatgccatgttacagatgagattgcccaggcacagtggctcatgcctaaaatcccagcactttgggagaccacagtgggaagatcacttgaagccaggagttccagaccagcctgtctctacaaaaaaaaaaaaaaaaaactcgta

SEQ ID NO: 5454 - DNA, 1224 bp, Homo sapiens
  misc_feature (1205)..(1205): n equals a,t,g, or c
ggcacgaggggactttccacagtcagctggacgcacactcagcccagtaaaagaggggacccatcccgggagccccggggagggcacagctgcctcctcccgggctcccctgccacctggtgcctacctgccccctgctccctgccgggtccggtcctcaccccatcttcatctggccttgactctgcccttgaggggcctaggggtgcagccagcctgctccgagctcccctgcagatggaggaggccatcctggtcccctgcgtgctggggctcctgctgctgcccatcctggccatgttgatggcactgtgtgtgcactgccacagactgccaggctcctacgacagcacatcctcagatagtttgtatccaaaggggcatccagttcaaacggcctcacacggttgccccctggccacctgcctacccacctgtcacctcctacccacccctgagccagccagacctgctccccatcccaagatccccgcagccccttgggggctcccaccggacgccatcttcccggcgggattctgatggtgccaacagtgtggcgagctacgaaacgaggaaccagcctgtgaggatgcggatgagatgaggacgactatcacaacccaggctacctggtggtgcttcctgacagcaccccggccactacactgctgccccatcagctcctgcactcagcacccctggcatccgagacagtgccttctccatggagtccattgatgattacgtgaacgttccggagagcggggagagcgcagaagcgtctctggatggcagccgggagtatgtgaatgtgtcccaggaactgcatcctggagcggctaagactgagcctgccgccctgagttcccaggaggcagaggaagtggaggaagagggggctccagattacgagaatctgcaggagctgaactgagggcctgtggaggccgagtctgtcctggaaccaggcttgcctgggacggctgagctgggcagctggaagtggctctggggtcctcacatggcgtcctgcccttgctccagcctgacaacagcctgagaaatccccccgtaacttattatcactttggggttcggcctgtgcccccgaacgctctgaccttctgacgcagcctgagaatgacctgcctggccccagccctactctggtaatacaataaaggcctgcgtgtgtctgtgtnaaaaaaaaaaaaaaaaaaa

SEQ ID NO: 5455 - DNA, 930 bp, Homo sapiens
aattcggcmcagagatgaggaagtggcaggcaggcaggctggccccggggacttctctctggccctgctccctccgagcgctccgccgttgcccgcctggcccctacggagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgagttcctgatgtcgggctggctgagcacctatacctggcgctgtgaccctcaggactgcaccttagggcagtgtccgtcagtgccctctccacctacacctgtgaccaaggcttatgtggtcaggactgagcaggggactggccctcccctccccacagctgctctacagggaccacggctttggttcctcacccacttcccccgggcagctccagggatgtggcctcattgctgtctgccactccagagctgggggctaaaagggctgtacagttatttccccctccctgccttaaaacttgggagaggagcactcagggctggccccacaaagggtctcgtggcctttttcctcacacagaagaggtcagcaataatgtcactgtggacccagtctcactcctccaccccacacactgaagcagtagcttctgggccaaaggtcagggtgggcgggggcctgggaatacagcctgtggaggctgcttactcaacttgtgtcttaattaaaagtgacagaggaaaccaaaaaaaaaaaaaaaaaaaaaaactcgaaaattacttcctaaaa

SEQ ID NO: 5456 - DNA, 1514 bp, Homo sapiens
gagcagatgaggaagtggcaggcaggcaggctggccccggggacttctctctggccctgctccctccgagcgctccgccgttgcccgcctggcccctacggagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgagttcctgatgtcgggctggctgagcacctatacctggcgctgtgaccctgtggactattccaacagccctgaggcacttaggatggttcgggtggcctggctcttcctcttctccaagttcattgagctgatggacacagtgatctttattctccgaaagaaagacgggcaggtgaccttcctacatgtcttccatcactctgtgcttccctggagctggtggtggggggtaaagattgccccgggaggaatgggctctttccatgccatgataaactcttccgtgcatgtcataatgtacctgtactacggattatctgcctttggccctgtggcacaaccctacctttggtggaaaaagcacatgacagccattcagctgatccagtttgtcctggtctcactgcacatctcccagtactactttatgtccagctgtaactaccagtacccagtcattattcacctcatctggatgtatggcaccatcttcttcatgctgttctccaacttctggtatcactcttataccaagggcaagcggctgccccgtgcacttcagcaaaatggagctccaggtattgccaaggtcaaggccaactgagaagcatggcctagataggcgcccacctaagtgcctcaggactgcaccttagggcagtgtccgtcagtgccctctccacctacacctgtgaccaaggcttatgtggtcaggactgagcaggggactggccctcccctccccacagctgctctacagggaccacggctttggttcctcacccacttcccccgggcagctccagggatgtggcctcattgctgtctgccactccagagctgggggctaaaagggctgtacagttatttccccctccctgccttaaaacttgggagaggagcactcagggctggccccacaaagggtctcgtggcctttttcctcacacagaagaggtcagcaataatgtcactgtggacccagtctcactcctccaccccacacactgaagcagtagcttctgggccaaaggtcagggtgggcgggggcctgggaatacagcctgtggaggctgcttactcaacttgtgtcttaattaaaagtgacagaggaaaccaaaaaaaaaaaaaaaaaaaaaaaaaaaaaaaaaaaaaaactcgag

SEQ ID NO: 5457 - DNA, 1130 bp, Homo sapiens
gcgtcagtcccagtgagggataagcgcctggcggaaggcgcagggaggtgtttctctgcttcaggagtgcccgccggcccttgcagctgctggaagacccatktatctcatgcttcttgttttctttggggacctgcaggggaaggaagcagggtgacggtttggtatccccacctaagaccctcccctttcccctgaggccagccgtcagcccctggcagggggtcttggaagccagaggtttttgctcagggcagggaaagggctgcaggatccccgggggctgccggaggtcggtctcactgacatcatggctgccggcttaggacccccagctccgacatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatggtggcaagtgcaggcagctgtcccggttatgccggaatcattgcaggtgagtccatcagaaacaggagctgacaaccygctgggcacccgaagaccaagccccctgccagctcaccgtgcccagcctcctgcatcccctcgaagagcctggccagagagggaagacacagatgatgaagctggagccagggctgccggtccgagtctcctacctcccccaaccctgcccgcccctgaaggctacctggcgccttgggggctgtccctcaagttatctcctctgytaagacaaaaagtaaagcactgtggtctttgcaaaaaaaaaaaaaaaaaaaaaaaaaaaaaaaaaaaaaaaaaaaaaaaaaaaaaaactcga

SEQ ID NO: 5458 - DNA, 891 bp, Homo sapiens
ggcacgagcgcagcagccaccgccgcgtccctctctccacgaggctgccggcttaggacccccagctccgacatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtggcaagtgcaggcagctgtcccggttatgccggaatcattgcaggtgagtccatcagaaacaggagctgacaacccgctgggcacccgaagaccaagccccctgccagctcaccgtgcccagcctcctgcatcccctcgaagagcctggccagagagggaagacacagatgatgaagctggagccagggctgccggtccgagtctcctacctcccccaaccctgcccgcccctgaaggctacctggcgccttgggggctgtccctcaagttatctcctctgttaagacaaaaagtaaagcactgtggtctttgaaaaaaaaaaaaaaaaa

SEQ ID NO: 5459 - DNA, 929 bp, Homo sapiens
  misc_feature (660)..(660): n equals a,t,g, or c
  misc_feature (822)..(822): n equals a,t,g, or c
ggcacgagggcttaggacccccagctccgacgtaagtccctctcgcgcgccacctccatccgctgcccctctgcccacgggccgggctcasatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtggcaagtgcaggcagctgtcccggttatgccggaatcattgcaggtgagtycatcagaaacaggagctgacaacctgctngggmacccgaagaccaagccccctgccagctcaccgtgcccagcytcctgcatcccctcgaagagcctggccagagagggaagacacagatgatgaagctggarccagggytgccggtycaagtctcctamctyccccaamcctgccsgcccytraaggctncctggcgccttgggggctgtccctcaagttatctcctctgctaagacaaaaagtaaagcactgtggtctttgaaaaaaaaaaaaaaaaaaaaaaaaaaaaactcgag

SEQ ID NO: 5460 - DNA, 958 bp, Homo sapiens
ggcacgagggcttaggacccccagctccgacgtaagtccctctcgcgcgccacctccatccgctgcccctctgcccacgggccsscgctccgasatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtggcaagtgcaggcagctgtcccggttatgccggaatcattgcaggtgagtccatcagaaacaggagctgacaacctgctgggcacccgaagaccaagccccctgccagctcaccgtgcccagcctcctgcatcccctcgaagagcctggccagagagggaagacacagatgatgaagctggagccagggctgccggtccgagtctcctacctcccccaaccctgcccgcccctgaaggctacctggcgccttgggggctgtccctcaagttatctcctctgctaagacaaaaagtaaagcactgtggtctttgcaaaaaaaaaaaaaaaaaaaaaaaaaaaaaaaaaaaaaaaaaaaaaaaaaaaaaaactcgag

SEQ ID NO: 5461 - DNA, 1020 bp, Homo sapiens
  misc_feature (10)..(10): n equals a,t,g, or c
  misc_feature (50)..(50): n equals a,t,g, or c
  misc_feature (104)..(104): n equals a,t,g, or c
  misc_feature (931)..(931): n equals a,t,g, or c
gacgacagangggtacggctgcgagaagacgacagaaggatacggctgcnagaagacgacagaagggtacggctgcgagaagacgacagaagggtacggctgcnagaagacgacagaaggggaccctccgcctggacgcagcagccaccgccgcgtccctctctccacgaggctgccggcttaggacccccagctccgacatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgstgtttcatyacaggcatcatcatcctcaccagtggcaagtgcaggcagctgtyccggttatgccggawtcattgcaggtgagtccatcagaaacaggagctgacaacctgstgggcacccgaagaccaagccccctgccagytcaccgtgcccagcytcctgcatcccctcgaagagcctggccagagagggaagacacagatgatgaagctggagccagggctgccggtccgagtctcctacctcccccaaccctgcccgcccctgaaggctncctggcgccttgggggctgtccctcaagttatctcctctgctaagacaaaaagtaaagcactgtggtctttgcaaaaaaaaaaaaaaaa

SEQ ID NO: 5462 - DNA, 941 bp, Homo sapiens; identical to SEQ ID NO: 4443

SEQ ID NO: 5463 - DNA, 696 bp, Homo sapiens
  misc_feature (550)..(550): n equals a,t,g, or c
  misc_feature (664)..(664): n equals a,t,g, or c
  misc_feature (679)..(679): n equals a,t,g, or c
  misc_feature (693)..(693): n equals a,t,g, or c
gcttggcctcgcaaagtgctgggagtataggcatgagccaccactcctggccaggacagcatattttggaaattcacctatgttgcatgtgtcaatagttaattcctttgtattcctgagtagtattccattttgtggaaatactacgatttatgtacgggttgagtatctgttatctgaaatgcttggggccagaagtattttggactttttttttattttggaatacttctatttgcattttaccggttgaacatcccaaatctgaaatatccaaaatccaaaatgttccagtgagcctgaattcatctgttgatgggcatttgagttatttccggtttgaggctattatgagggaagctgctgtacatgtgtttgtatatgttaaatgtgttttcacttgtcagattttaaaagatttaacagatttttaaagtgaaaattgttttaatgatggtatgcttatttagactattaggaatttaaaaaattatcatttaagattcattccaggtcctgcattgattttattgggtcacaataatagtgnccatttgaagatatttcaattttttcagcaccgtcaatttcacttctagctgctatcagkataccttctgtaatatctarcttccgrattctcctttcatgagttagaaagcanggaaaattggggaantaatgggattaaangag

SEQ ID NO: 5464 - DNA, 423 bp, Homo sapiens
  misc_feature (316)..(316): n equals a,t,g, or c
  misc_feature (387)..(387): n equals a,t,g, or c
  misc_feature (419)..(419): n equals a,t,g, or c
gaaactttcaaattgtaactgctttcagttgctttccgaagtggggataatggtggatctgatctcttctgttttgttcttgcagctctattatcaagtcctaaattttggaatgattgtctcatcggcactaatgatctggaaggggttaatggtaataactggaagtgaaagtccgattgtagtggtgctcaggtaacagtttttcctttcaaggcatggaattgcatggcattacttgggagaaaaattgagatatgaaataactggcatatcattctcttagaaactactcttttccagaaaagggcctggnaggaaaattagtccactacttatccagttgtaaggaaattctccaggctggggcacggtgggcttatgccngtaaatcccaccatttggggttgctgaggccngtgg

SEQ ID NO: 5465 - DNA, 1709 bp, Homo sapiens; identical to SEQ ID NO: 3375

SEQ ID NO: 5466 - DNA, 1187 bp, Homo sapiens
  misc_feature (926)..(926): n equals a,t,g, or c
  misc_feature (953)..(953): n equals a,t,g, or c
  misc_feature (1186)..(1186): n equals a,t,g, or c
gcacacactaaaatattcatgaggaaagggagttgctgattttaaggcgtagctttaaaacccacgtctgtcggcttgatggtcagtgtcccgccacacagtctggaagtgtgacgtggccaaggaggacccccagaaggatcctgtgtcttccgtggggactactcctttcctcagaggagcgggttcacaggaaactggagcagaaggatgcctttagccccactcctgttggtcctcagtcccttctcctttgatcaggtggttcaagcacgccttgaagttccggtgttcaaacaacgtgacctctgcaattacgttctaatacttgtcggtgcccaacttaaaccactagcaatgttagttaaaaacatcagggattacaggcttgagccaccatgcccggcctgtatagacactttctatcccacttttaaaacaggcatgttctccctatgctttaaaatgcctttaaaatatttctaatggtgctaattctctaatttgggagtgtctaatttgcttccagtttttaaaaactattttttattatagtaattaaccttttaaatacatgaatcttgggcatatttttaatgatttccttaggagagattccttacagtgaatttcttgagtaaaaggaggttaactgtaagattcttgatataccttgctaaattgtyttctagaaagcttgaaccaagttctgcacattttagcaaagtatgaaatgtccttctctccatatcttcatcagcattgagtgttctctcttttttatctttagacaaaaaggttacattctttttggttcatctactcagaagctatttaatgaatgttcactccatgtcaggcatgtggcatgttttcatctctaccagtaacgctgaactttcttcttgtgtgcatcagcctgttgntttcttttgtaaatgttctgttcgtgnccattatcaacttttctactagggtgtgactgtttctatgatatatttataacgatgtgtgtgtgtgtgtgtgtgtrtacaatatttggggtaaawacttttcccagcttctttgacttttaatttgcttawactttawtggaaatacmgaacctttawtttawtataatwatwatactttaagtctgggawacatgggcaaaacgcgccagcttgcacatagggataaacgng

SEQ ID NO: 5467 - DNA, 649 bp, Homo sapiens
  misc_feature (553)..(553): n equals a,t,g, or c
  misc_feature (563)..(563): n equals a,t,g, or c
  misc_feature (569)..(569): n equals a,t,g, or c
  misc_feature (597)..(597): n equals a,t,g, or c
atgggcagaacgtgcaggtttgttacataggtataaacgtgccatggtggtttgctgcacccatcaaaccaccatctacattaggtatttctcctaatgctatccctcccatagtccgccacccaccaacaggccctggtgtgtgatgttctgctccctgtgtccatgtgttctcatgagaacctttatattttatgtagtggagtaagttattttatcttttttttttcctgtgtaacttctgttacctcaggcttaggaattccttcctacccagaagttagaaaatattcatctatttttttttaaagtttcatttttaacattaaactcaccaaattagaagtaagatgtggccaggcacagtggctcacacctgtaatctcagtgctttgcgggggctaaggtggaaaaatcacttgaggctaggagttcaagacaagcctgggtaacacagtgagaccccacctctaccaaaaaatttaaaaattaggcaggcatggtagcatgtgtctgtagtcctagctgcttgggaggctgaggtgggaggatnacttcagccnagaagnttgaggctgtagttagctattatcatgntattgcattccagcctaggcaacagagcaagaaccctgtgtctttaaaaaaa

SEQ ID NO: 5468 - DNA, 1481 bp, Homo sapiens
ggcacgagcgcttctggatccacacgcaggacgccgtgtactccctgcagcagttcgggttttcagagaaagatgctgatgaggtgaaaggaatttttgtagataccaacttatacttcctggcgctgaccttctttgtcgcagcgttccatcttctctttgatttcctggcctttaaaaatgacatcagtttctggaagaagaagaagagcatgatcggcatgtccaccaaggcagtgctctggcgctgcttcagcaccgtggtcatctttctgttcctgctggacgagcagacgagcctgctggtgctggtcccggcgggtgttggagccgccattgagctgtggaaagtgaagaaggcattgaagatgactattttttggagaggcctgatgcccgaatttcagtttggcacttacagcgaatctgagaggaaaaccgaggagtacgatactcaggccatgaagtacttgtcatacctgctgtaccctctctgtgtcgggggtgctgtctattcactcctgaatatcaaatataagagctggtactcctggttaatcaacagcttcgtcaacggggtctatgcctttggtttcctcttcatgctgccccagctctttgtgaactacaaggtaagacggtgtgtgctgcccgcggcccggcccccgtctcctgtgctgcccacagctgacctgggcctgtctctcctgtttcagttgaagtcagtggcacatctgccctggaaggccttcacctacaaggctttcaacaccttcattgatgacgtctttgccttcatcatcaccatgcccacgtctcaccggctggcctgcttccgggacgacgtggtgtttctggtctacctgtaccagcggtggctttatcctgtggataaacgcagagtgaacgagtttggggagtcctacgaggagaaggccacgcgggcgccccacacggactgaaggccgcccgggctgccgccagccaagtgcaacttgaattgtcaatgagtatttttggaagcatttggaggaattcctagacattgcgttttctgtgttgccaaaatcccttcggacatttctcagacatctcccaagttcccatcacgtcagatttggagctggtagcgcttacgatgcccccacgtgtgaacatctgtcttggtcacagagctgggtgctgccggtcaccttgagctgtggtggctcccggcacacgagtgtccggggttcggccatgtcctcacgcgggcaggggtgggagccctcacaggcaagggggctgttggatttccatttcaggtggttttctaagtgctccttatgtgaatttcaaacacgtatggaattcactccgcatggactctgggatcaaaggctctttcctcttttgtttgagagttggttgttttaaagcttaatgtatgtttctattttaaaataaatttttctggctgtggcaaaaaaaaaaaaaaaaaa

SEQ ID NO: 5469 - DNA, 1170 bp, Homo sapiens
cgagcactccatgcaggcgctgtcctggcgaactctaacttgagccgcgccaagcttaaagcctccagccggacctcggctctgctctccggcttcgccatggtggcaatggtggaggtgcagctggacgctgaccacgactacccaccggggctgctcatcgccttcagtgcctgcaccacagtgctggtggctgtgcacctgtttgcgctcatgatcagcacctgcatcctgcccaacatcgaggcggtgagcaacgtgcacaatctcaactcggtcaaggagtccccccatgagcgcatgcaccgccacatcgagctggcctgggccttctccaccgtcatcggcacgctgctcttcctagctgaggtggtgctgctctgctgggtcaagttcttgcccctcaagaagcagccaggccagccaaggcccaccagcaagccccccgccagtggcgcagcagccaacgtcagcaccagcggcatcaccccgggccaggcagctgccatcgcctcgaccaccatcatggtgcccttcggcctgatctttatcgtcttcgccgtccacttctaccgctcactggttagccataagactgaccgacagttccaggagctcaacgagctggcggagtttgcccgcttacaggaccagctggaccacagaggggaccaccccctgacgcccggcagccactatgcctaggcccatgtggtctgggcccttccagtgctttggccttacgcccttccccttgaccttgtcctgccccagcctcacggacagcctgcgcagggggctgggcttcagcaaggggcagagcrtggagggaagaggatttttataagagaaatttctgcactttgaaactgtcctctaagagaataagcatttcctgttcttccagctccaggtccacctcctgttgggaggcggtggggggccaaagtggggccacacactcgctgtgtcccctctcctcccctgtgccagtgccacctgggtgcctcctcctgtcctgtccgtctcaacctccctcccgtccagcattgagtgtgtacatgtgtgtgtgacacataaatatactcataaggacacaaaaaaaaaaaaaaaaaaaaaaaaaaaactcgagggggggcccgtacccaatcgcctgtgatgcatcgtata

SEQ ID NO: 5470 - DNA, 2040 bp, Homo sapiens; identical to SEQ ID NO: 5031
  misc_feature (2027)..(2027): n equals a,t,g, or c

SEQ ID NO: 5471 - DNA, 1775 bp, Homo sapiens
  misc_feature (889)..(889): n equals a,t,g, or c
tttaacgttttttattccaatgtttattgacatcctacattactaatgttttgcagaatacagtttggtaaacattgttcagaagtatcaggtgagctgtgttttgataaatatataaaagcagtcatttgttttaaattcatttgtttcttgtaggttatcactgtgaatataagatgcggacaggaaggaaacctgatggctgtgctgtttgcttcaaacattccaaattttcactcttgtcagtgaacccagtggaattcttccgccctgatatttctctgttggacagagacaatgttggattagttttactcttacagcccaaaattccatatgctgcctgccctgcaatctgcgtacaaatacgcatctgttgtataatccaaggcgaggtgatattaagctgacgcaattggcaatgctactggcagagatttccagtgttgcccaccagaaagatggcagcttctgccctattgttatgtgtggtgactttaattctgttcctggttctccactatatagtttcataaaggaaggaaaattgaattatgaaggacttcccataggaaaggtatctggccaggaacagtcttcacggggacaaagaattttatctattccaatttggcccccaaacctaggtatctcacagaactgtgtgtatgaggtacagcaggtaccaaaagtagaaaagacagacagtgatctgacacaaacacagctgaagcaaacagaggtcctagtgacagctgaaaaattgtcttcaaatttacagcaccatttcagtttgtcatctgtttattcacattactttcctgacactggaattccagaagtgaccacctgtcattcccgaagtgccataactgtggattatattttnctactctgcagaaaaggaaratgttgctgggcacccaggagctgaagttgctttggttggtggcttgaaacttctagctagactgtcacytcttacagaacaagacttatggactgttaatggacttccaaacgaaaataactcttcagatcatctgcctttattggcaaagttcagacttgagctctgactctctttgatcacatactaattttctttccaatttgtattgtttttcaaagaatgtaaagttcttaagtgtatgcatgttgtttatttttgcactgtggagattctgaagcggttatgttagatgctttgaaactccatatcagaagaaataactttataacaattttttttaataatgaaaaatattttcstgacaagtgagctctaaattctctttattgtaaaagagatgtaaaggttttatattctaaatcctagtaaaattgacagtgatttttaaatataatgcatcttcctttgtctgcttagtaaaaaatttcatttcataattttggcaagctctgtagtggatccaaagtatctttgagttcttgcaaactacaagttgtttcctttccagaaggcttgatttcattaggagacccctctattgagttctaaatagtttatcttagaaagccttgggtcattcacaggtatccaaccagccattgtttagtttgkttttgaaggggtttgataatgctttttaagttgtacagaatgcttaatccatcttattactgtcctgagccatgtaatatgcctgcatcgtgttggggraatgtttgggaaatataagccagcataacgtgtaaagctcactctttcaccctggaacagacaagaggtgggcttaatagaggcagagact

SEQ ID NO: 5472 - DNA, 2877 bp, Homo sapiens
tcgacccacgcgtccgggatgaggcccggcctctcatttctcctagcccttctgttcttccttggccaagctgcaggggatttgggggatgtgggacctccaattcccagccccggcttcagctctttcccaggtgttgactccagctccagcttcagctccagctccaggtcgggctccagctccagccgcagcttaggcagcggaggttctgtgtcccagttgttttccaatttcaccggctccgtggatgaccgtgggacctgccagtgctctgtttccctgccagacaccacctttcccgtggacagagtggaacgcttggaattcacagctcatgttctttctcagaagtttgagaaagaactttccaaagtgagggaatatgtccaattaattagtgtgtatgaaaagaaactgttaaacctaactgtccgaattgacatcatggagaaggataccatttcttacactgaactggacttcgagctgatcaaggtagaagtgaaggagatggaaaaactggtcatacagctgaaggagagttttggtggaagctcagaaattgttgaccagctggaggtggagataagaaatatgactctcttggtagagaagcttgagacactagacaaaaacaatgtccttgccattcgccgagaaatcgtggctctgaagaccaagctgaaagatgtgaggcctctaaagatcaaaacacccctgtcgtccaccctcctcccactccagggactgtggtcatggtggtgtggtgaacatcagcaaaccgtctgtggttcagctcaactggagagggttttcttatctatatggtgcttggggtagggattactctccccagcatccaaacaaaggactgtattgggtggcgccattgaatacagatgggagactgttggagtattatagactgtacaacacactggatgatttgctattgtatataaatgctcgagagttgcggatcacctatggccaaggtagtggtacagcagtttacaacaacaacatgtacgtcaacatgtacaacaccgggaatattgccagagttaacctgaccaccaacacgattgctgtaactcaaactctccctaatgctgcctataataaccgcttttaatatgctaatgttgcttggcaagatattgaactttctgtggatgagaatggattgtgggttatttattcaactgaagccagcactggtaacatggtgattagtaaactcaatgacaccacacttcaggtgcttaaacacttggtataccaggcagtataaaccatctgcttctaacgccttcatggtatgtggggttctgtatgccacccgtactatgaacaccagaacagaagagattttttactattatgacacaaacacagggaaagagggcaaactagacattgtaatgcataagatgcaggaaaaagtgcagagcattaactataacccttttgaccagaaactttatgtctataacgatggttaccttctgaattatgatctttctgtcttgcagaagccccagtaagctgtttaggagttagggtgaaagagaaaatgtttgttgaaaaaatagtcttctccacttacttagatatctgcaggggtgtctaaaagtgtgttcattttgcagcaatgtttaggtgcatagttctaccacactagagatctaggacatttgtcttgatttggtgagttctcttgggaatcatctgcctcttcaggcgcattttgcaataaagtctgtctagggtgggattgtcagaggtctaggggcactgtggggctagtgaagcctactgtgaggaggcttcactagaagccttaaattaggaattaaggaacttaaaactcagtatggcgtctagggattctttgtacaggaaatattgcccaatgactagtcctcatccatgtagcaccactaattcttccatgcctggaagaaacctggggacttagttaggtagattaatatctggagctcctcgagggaccaaatctccaacttttttttcccctcactagcacctggaatgatgctttgtatgtggcagataagtaaatttggcatgcttatatattctacatctgtaaagtgctgagttttatggagagaggcctttttatgcattaaattgtacatggcaaataaatcccagaaggatctgtagatgaggcacctgctttttcttttctctcattgtccaccttactaaaagtcagtagaatcttctacctcataacttccttccaaaggcagctcagaagattagaaccagacttactaaccaattccaccccccaccaacccccttctactgcctactttaaaaaaattaatagttttctatggaactgatctaagattagaaaaattaattttctttaatttcattatgaacttttatttacatgactctaagactataagaaaatctgatggcagtgacaaagtgctagcatttattgttatctaataaagaccttggagcatatgtgcaacttatgagtgtatcagttgttgcatgtaatttttgcctttgtttaagcctggaacttgtaagaaaatgaaaatttaatttttttttctaggacgagctatagaaaagctattgagagtatctagttaatcagtgcagtagttggaaaccttgctggtgtatgtgatgtgcttctgtgcttttgaatgactttatcatctagtctttgtctatttttcctttgatgttcaagtcctagtctataggattggcagtttaaatgctttactcccccttttaaaataaatgattaaaatgtgctttgaaaaaaaaaaaaaaaaaaaaaaaaaaaaaaaaaaaaaaaaaaaaaaa

SEQ ID NO: 5473 - DNA, 2888 bp, Homo sapiens
  misc_feature (1812)..(1812): n equals a,t,g, or c
tcgacccacgcgtccgggatgaggcccggcctctcatttctcctagcccttctgttcttccttggccaagctgcaggggatttgggggatgtgggacctccaattcccagccccggcttcagctctttcccaggtgttgactccagctccagcttcagctccagctccaggtcgggctccagctccagccgcagcttaggcagcggaggttctgtgtcccagttgttttccaatttcaccggctccgtggatgaccgtgggacctgccagtgctctgtttccctgccagacaccamctttcccgtggacagagtggaacgyttgggaattcacagctcatgttctttctcagaagtttgagaaagaactttcyaaagtgagggaatatgtccaattaattagtgtgtatgaaaagaaactgttaaacctaactgtccgaattgacatcatggagaaggataccatttcttacamtgaactggacttcgagctgatcaaggtagaagtgaaggagatggaaaaactggtcatacagctgaaggagccttttggtggaagctcagaaattgttggaccagctggaggtggagataagaaatatgactctcttggtagagaagcttgagacactagacaaaaacmatgtcctkgccattcgccgagaaaycgtggctctgaagaccaagctgaaagagtgtgaggcctctaaagatcaaaacacccctgtcgtccaccctcctcccactccagggagctgtggtcatggtggtgtggtgwacatcagcaaaccgtctgtggttcagctcaactggagagggttttcttatctatatggtgcttggggtagggattactctccccagcatccaaacaaaggactgtattgggtggcgccattgaatacagatgggagactgttggagtattatagactgtacaacacactggatgatttgctattgtatataaatgctcgagagttgcggatcacctatggccaaggtagtggtacagcagtttacaacaacaacatgtacgtcaacatgtacaacaccgggaatattgccagagttaacctgaccaccaacacgattgctgtgactcaaactctccctaatgctgcctataataaccgcttttmatatgctaatgttgcttggcaagatattgactttsctgtggatgagaatggattgtgggttatttattcaactgaagccagcactggtaacatggtgattagtaaactcaatgacaccacacttcaggtgctaaacacttggtataccargcagtataaaccatctgcttctaacgccttcatggtatgtggggttctgtatgccacccgtactatgaacaccagaacagaagagattttttactattatgacacaaacacagggaaagagggcaaactagacattgtaatgcataagatgcaggaaaaagtgcagagcattaactataacccttttgaccagaaactttatgtctataacgatggttaccttctgaattatgatctttctgtcttgcagaagccccagtaagctgtttaggagttagggtgaaagagaaaatgtttgttgaaaaaatagtcttctccacttacttagatatctgcaggggtgtctaaaagtgtgttcattttgcagcaatgtttaggtgcatagttctaccacactagagatctaggacatttgtcttgatttggtgagttctcttgggaatcatctgcctcttcaggcgcattttgcaataaagtctgtctagggtgggattgtcagaggtctaggggcactgtgggcntagtgaagcctactgtgaggaggcttcactagaagccttaaattaggaattaaggaacttaaaactcagtatggcgtctagggattctttgtacaggaaatattgcccaatgactagtcctcatccatgtagcaccactaattcttccatgcctggaagaaacctggggacttagttaggtagattaatatctggagctcctcgagggaccaaatctccaacttttttttcccctcactagcacctggaatgatgctttgtatgtggcagataagtaaatttggcatgcttatatattctacatctgtaaagtgctgagttttatggagagaggcctttttatgcattaaattgtacatggcaaataaatcccagaaggatctgtagatgaggcacctgctttttctttwctctcattgtccaccttactaaaagtcagtagaatcttctacctcataacttccttccaaaggcagctcagaagattagaaccagacttactaaccaattccaccccccaccaacccccttctactgcctactttaaaaaaattaatagttttctatggaactgatctaagattagaaaaattaattttytttaatttcattatgracttttatttacatgactctaagactataagaaaatctgatggcagtgacaaagtgctagcatttattgttatctaataaagaccttggagcatatgtgcaacttatgagtgtatcagttgttgcatgtaatttttgcctttgtttaagcctggaacttgtaagaaaatgaaaatttaatttttttttctaggacgagctatagaaaagctattgagagtatctagttaatcagtgcagtagttggaaaccttgctggtgtatgtgatgtgcttctgtgcttttgaatgactttatcatctagtctttgtctatttttcctttgatgttcaagtcctagtctataggattggcagtttaaatgctttactcccccttttaaaataaatgattaaaatgtgctttgaaaaaaaaaaaaaaaaaaaaaaaaaaaaaaaaaaaaaaaaaaaaaaagggcggcc

SEQ ID NO: 5474 - DNA, 1969 bp, Homo sapiens
  misc_feature (996)..(996): n equals a,t,g, or c
  misc_feature (1040)..(1040): n equals a,t,g, or c
  misc_feature (1058)..(1058): n equals a,t,g, or c
  misc_feature (1068)..(1068): n equals a,t,g, or c
ccacgcgtccgcgcgcggagggcgcctggtgcagcatgggcggcccgcgggcttgggcgctgctctgcctcgggctcctgctcccgggaggcggcgctgcgtggagcatcggggcagctccgttctccggacgcaggaactggtgctcctatgtggtgacccgcaccatctcatgccatgtgcagaatggcacctaccttcagcgagtgctgcagaactgcccctggcccatgagctgtccggggagcagctacagaactgtggtgagacccacatacaaggtgatgtacaagatagtgaccgcccgtgagtggaggtgctgccctgggcactcaggagtgagctgcgaggaagttgcagcttcctctgcctccttggagcccatgtggtcgggcagtaccatgcggcggatggcgcttcggcccacagccttctcaggttgtctcaactgcagcaaagtgtcagagctgacagagcggctgaaggtgctggaggccaagatgaccatgctgactgtcatagagcagccagtacctccaacaccagctacccctgaggaccctgccccgctctggggtccccctcctgcccagggcagccccggagatggaggcctccaggaccaagtcggtgcttgggggcttcccgggcccaccggccccaagggagatgccggcagtcggggcccaatggggatgagaggcccaccaggtccacagggccccccagggagccctggccgggctggagctgtgggcacccctggagagaggggacctcctgggccaccagggcctcctggcccccctgggcccccagcccctgttgggccaccccatgcccggatctcccagcatggagacccattgctgtccaacaccttcactgagaccaacaaccactggccccagggacccactgggcctccaggccctccagggcccatgggtccccctgggcctcctggccccacaggtgtccctgggagtcctggtnacataggacccccaggccccactggacccaaaggaatctctggncacccaggagagaagggngagaagaaangactgcgtggggagcctggcccccaaggctctgctgggcagcggggggaacctggccctaagggagaccctggtgagaagagccactggaaccagagctggggtctgggcgggccctgccggcacaggcacccccagcctccttcggggcaagagggcggacatgcaaccaactaccgggatcgtggcccccaggagccgggacgagagaggctgagggtggtggcggcccctgaggcagaccaggccaggcttcccctcctacctggactcggccagctgcctccagggaccgcccgtccatatttattaatgtcctcagggtcccttctgccatctaggccttaggggtaagcaggtctcagtcctggcaccatgcacatgtctgaggctgagcaagggctgagaggagaggcttgggcctcagtttccctctgtgaagtggggggaggcaggccttcaaggagggatagaggtacaaggcttcgtctcatctgctgtctgagcatccaggcccaaaggcactgagggagtcaggagctggggctcggcacatgcagagatgacagggcagggggcagtcttcctccccctccccgaccaaacctcggggagccctcctgtgcccctccctccttgttgtccagtgctgggttccccaccccgaggtcaggctgcccaatcctctgactggatcaccgggggcttcttgcctcagttcttccctctgagcccccaggccctcccgcatctcaggttggggatggggacatggagaggaaggggccgcctactcctgcaaatgcttgtgacagatgccaggaggtagatgtgtgctggccaataaaggcccctacctgattccccgcaaaaaaaaaaaaaaaaaaaaaaaaaaaaaaaaa

SEQ ID NO: 5475 - DNA, 3777 bp, Homo sapiens
  misc_feature (3740)..(3740): n equals a,t,g, or c
cactatagaaggtacgcctgcaggtaccggtccggaattcccgggtcgacccacgcgtccgcaggaagagaccgacccgccacccgccgtagcccgcgcgcccctggcactcaatccccgccatgtgggggctcctgctcgccctggccgccttcgcgccggccgtcggcccggctctgggggcgcccaggaactcggtcctgggcctcgcgcagcccgggaccaccaaggtcccaggctcgaccccggccctgcatagcagcccggcacagccgccggcggagacagctaacgggacctcagaacagcatgtccggattcgagtcatcaagaagaaaaaggtcattatgaagaagcggaagaagctaactctaactcgccccaccccactggtgactgccgggccccttgtgacccccactccagcagggaccctcgaccccgctgagaaacaagaaacaggctgtcctcctttgggtctggagtccctgcgagtttcagatagccggcttgaggcatccagcagccagtcctttggtcttggaccacaccgaggacggctcaacattcagtcaggcctggaggacggcgatctatatgatggagcctggtgtgctgaggagcaggacgccgatccatggtttcaggtggacgctgggcaccccacccgcttctcgggtgttatcacacagggcaggaactctgtctggaggtgaggcagactaaccctaggtcaggaggtcacagaaggactggggtgggagtcctgggggcaccgatgatctctctccacctctcctgccaggtatgactgggtcacatcatacaaggtccagttcagcaatgacagtcggacctggtggggaagtaggaaccacagcagtgggatggacgcagtgagtggtcccactgtggctggggcctccatgctgggagttgggcacccagtccaggctaggctgaggctcctctgaggacaaggaatagacgccagcttaggcttcccaggggggtgtggcttgttgtcaagagggtggcacacggcaggcaccattgggagccagctgctttgggacatgcccacatcctccccagataatgccaccacagggtgggtgctgcttcacggtacagcttcctcctggcatgccccttctggcccggggcctctggtccacatcacttcttgccttctcgtggttctgacttccgcatctcatggacctctttttacagcaggctacaatgtggagtcctggccagctctaggattggcttcccccgagtcatgtggccaaactggtctaatgaactgtgtccaatccagagagcaaggctgcctagggctgcccattggcaggggctgtgggccggggtctgtgtttgatgcacagtgcaagtctctagctgagcccactagggtggggagacagtgagcttggaggcctgagctccttccctgggtcctgggccaggcttctggggtttgagcagccacaacagagaacttgctgcccccaggtatttcctgccaattcagacccagaaactccagtgctgaacctcctgccggagccccaggtggcccgcttcattcgcctgctgccccagacctggctccagggaggcgcgccttgcctccgggcagagatcctggcctgcccagtctcagaccccaatgacctattccttgaggcccctgcgtcgggatcctctgaccctctagactttcagcatcacaattacaaggccatgaggaaggtcagatataacccctatgacctgggaaggagggcccacccatctcaggtccccttcccaccttcccaccggggcacaacctgctgtgactgcgcttgtatgcccctgctgcctcctgatgtctcagccttctctcctgtggacccctaagctccatcccactttcccttattatggcgcccccccagtcctgccccttcctcccggctctgctgccgctcccctcctgtaccatgatgggatgccccctctgtgtgggccatcgctgactttttaagtctttccatggcacatgtgatctgcccctgggtgtacccctcccatgcctcatgccacgctacactctgcccaccagctgatgaagcaggtacaagagcaatgccccaacatcacccgcatctacagcattgggaagagctaccagggcctgaagctgtatgtgatggaaatgtcggacaagcctggggagcatgagctgggggagcctgaggtgcgctacgtggctggcatgcatgggaacgaggccctggggcgggagttgcttctgctcctgatgcagttcctgtgccatgagttcctgcgagggaacccacgggtgacccggctgctctctgagatgcgcattcacctgctgccctccatgaaccctgatggctatgagatcgcctaccaccggggttcagagctggtgggctgggccgagggccgctggaacaaccagagcatcgatcttaaccataattttgctgacctcaacacaccactgtgggaagcacaggacgatgggaaggtgccccacatcgtccccaaccatcacctgccattgcccacttactacaccctgcccaatgccaccgtgagtattttgagggcggcagtggaggtctgtggggggcggaccttgtctctgtctcctgcccctcctgacctgccccatgccaggtggctcctgaaacgcgggcagtaatcaagtggatgaagcggatcccctttgtgctaagtgccaacctccacgggggtgagctcgtggtgtcctacccattcgacatgactcgcaccccgtgggctgcccgcgagctcacgcccacaccagatgatgctgtgtttcgctggctcagcactgtctatgctggcagtaatctggccatgcaggacaccagccgccgaccctgccacagccaggacttctccgtgcacggcaacatcatcaacggggctgactggcacacggtccccgggagcatgaatgacttcagctacctacacaccaactgctttgaggtcactgtggagctgtcctgtgacaagttccctcacgagaatgaattgccccaggagtgggagaacaacaaagacgccctcctcacctacctggagcaggtgcgcatgggcattgcaggagtggtgagggacaaggacacggagcttgggattgctgacgctgtcattgccgtggatgggattaaccatgacgtgaccacggcgtggggcggggattattggcgtctgctgaccccaggggactacatggtgactgccagtgccgagggctaccattcagtgacacggaactgtcgggtcacctttgaagagggccccttcccctgcaatttcgtgctcaccaagactcccaaacagaggctgcgcgagctgctggcagctggggccaaggtgcccccggaccttcgcaggcgcctggagcggctaaggggacagaaggattgatacctgcggtttaagagccctagggcaggctggacctgtcaagacgggaaggggaagagtagagagggagggacaaagtgaggaaaaggtgctcattaaagctaccgggcaccttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggsggccgctctagaggatccctcgaggggcctcacngttacgcgtgcatgcgacgtcactagctctctcccct

SEQ ID NO: 5476 - DNA, 1702 bp, Homo sapiens
  misc_feature (1671)..(1671): n equals a,t,g, or c
  misc_feature (1674)..(1674): n equals a,t,g, or c
cactatagaaggtacgcctgcaggtaccggtccggaattcccgggtcgacccacgcgtccgcaggaagagaccgacccgccacccgccgtagcccgcgcgcccctggcactcaatccccgccatgtgggggctcctgctcgccctggccgccttcgcgccggccgtcggcccggctctgggggcgcccaggaactcggtcctgggcctcgcgcagcccgggaccaccaaggtcccaggctcgaccccggccctgcatagcagcccggcacagccgccggcggagacagctaacgggacctcagaacagcatgtccggattcgagtcatcaagaagaaaaaggtcattatgaagaagcggaagaagctaactctaactcgccccaccccactggtgactgccgggccccttgtgacccccactccagcagggaccctcgaccccgctgagaaacaagaaacaggctgtcctcctttgggtctggagtccctgcgagtttcagatagccggcttgaggcatccagcagccagtcctttggtcttggaccacaccgaggacggctcaacattcagtcaggcctggaggacggcgatctatatgatggagcctggtgtgctgaggagcaggrcgccgatccatggtttcaggtggacgctgggcaccccacccgcttctcgggtgktatcacacagggcaggaactytgtctggaggtgaggcagactaaccctaggtcaggaggtcacagaaggactggggtgggagtcctgggggcaccgatgatctctctccacctctcctgccaggtatgactgggtcacatcatacaaggtccagttcagcaatgacagtcggacctggtggggaagtaggaaccacagcagtgggatggacgcagtgagtggtcccactgtggctggggcctccatgctgggagttgggcacccagtccaggctaggctgaggctcctctgaggacaaggaatagacgccagcttaggcttcccaggggggtgtggcttgttgtcaagagggtggcacacggcaggcaccattgggagccagctgctttgggacatgcccacatcctccccagataatgccaccacagggtgggtgctgcttcacggtacagcttcctcctggcatgccccttctggcccggggcctctggtccacatcacttcttgccttctcgtggttctgacttccgcatctcatggacctctttttacagcaggctacaatgtggagtcctggccagctctaggattggcttcccccgagtcatgtggccaaactggtctaatgaactgtgtccaatccagagagcaaggctgcctagggctgcccattggcaggggctgtgggccggggtctgtgtttgatgcacagtgcaagtctctagctgagcccactagggtggggagacagtgagcttggaggcctgagctccttccctgggtcctgggccaggcttctggggtttgagcagccacaacagagaacttgctgcccccaggtatttcctgccaattcagacccagaaactccagtgctgaacctcctgccggagccccaggtggcccgcttcattcgcctgctgccccaracctggctccaggraggcgcgccttgcctccgggcagagatcctggcctgccagtctcanacnccaatgacctattccttgaggccccctg

SEQ ID NO: 5477 - DNA, 768 bp, Homo sapiens
  misc_feature (573)..(573): n equals a,t,g, or c
  misc_feature (675)..(675): n equals a,t,g, or c
  misc_feature (690)..(690): n equals a,t,g, or c
  misc_feature (695)..(695): n equals a,t,g, or c
  misc_feature (725)..(725): n equals a,t,g, or c
  misc_feature (752)..(752): n equals a,t,g, or c
gcaggaagagaccgaccckccacccgccgtagcccgcgcgcccctggcactcaatccccgccatgtgggggctcctgctcgccctggccgccttcgcgccggccgtcggcccggctctgggggcgcccaggaactcggtcctgggcctcgcgcagcccgggaccaccaaggtcccaggctcgaccccggccctgcatagcagcccggcacagccgccggcggagacagctaacgggacctcagaacagcatgtycggattcgagtcatcaagaagaaaaaggtcattatgaagaagcggaagaagctaactctaactcgccccaccccactggtgactgccgggccccttgtgacccccactccagcagggaccctcgaccccgctgagaaacaagaaacaggctgtcctcctttgggtctggagtccctgcgagtttcagatagccggcttgaggcatccagcagccagtcctttggtcttggaccacaccgaggacggctcaacattcagtcaggcctggaggacggcgatctatatgatggagcctggtgtgctgaggagcaggacgccnatccatggtttcaggtggacgctgggcaccccacccgctttctgggtggtatcacacagggcaaggaacttttgtctggaggtgaaggcagactaaccctangtcaggaggtacagnaaggnctggggcttggaagtcctgggggcaccgangatctctcttcaccttttctggcaggnatgatggggtcacata

SEQ ID NO: 5478 - DNA, 485 bp, Homo sapiens
  misc_feature (427)..(427): n equals a,t,g, or c
  misc_feature (441)..(441): n equals a,t,g, or c
  misc_feature (461)..(461): n equals a,t,g, or c
  misc_feature (466)..(466): n equals a,t,g, or c
gggaaacagggtcgaatcggggtcctggagtctggttcgagcagatatgtctctctttgtcttggacaggagtgaggagaatatggggagaggaacagttttttctttcacaatgttgggactcacaatatgtatctcccctgccaaatggcttgttctttatttgtgctatttgtgatatggttgctcttgaaaatttttcaagctgggccacagctcatgagtttggctcatgggtcagctaccctagtgctagatgggatgaacatctttggccctagtggctatggtcaggagtgcagggtcgcatgcaactactttagaaaatgtagagttcccagctgggcscgttgtctcatgcctgtaatcccagcactctgggaggctgaggcggcagatcagctgaggttaggagtttgagaccagnctggccaacatggngaaatcctatctctattaanaatanaaaaattagctggcaatgg

SEQ ID NO: 5479 - DNA, 466 bp, Homo sapiens
ttgttattcatcacggtcctttcaaactgaattaaatcgtcctgcctttggatttttgtttgctcaaggaacttaattttactaaactattctctcgcatttatgggatacttttccctcaagagcaaaactggggcaacttcagagcacacatgtgataaaatacctctcctgggcactaccagtcagaagacaaagtaagtgacatgaatgtcaataatgaagttcctattctcattccctcacatacttgagtcttctagtcccctacaaagtctctccaaatatttytgactttaccaagagaaacctctcatgtggccacgaaccagcctgttgtatgtagtccccaggtggctcctgccatgttcttccctcccctgccckctccctgaaataaagaacagcttgacagaaaaaaaaaaaaaaaaaaaaaaaaacaaaaaaaaaaaaaaagggcggccgc

SEQ ID NO: 5480 - DNA, 1295 bp, Homo sapiens
gaattcggcacgagatttggtagaaggcttcagagaataactgggggactcgggggagaagataggacaggtcagggagaggctgggaattcaggcaatgggaaccttgatggtcttgacaagattagctgtgctgttggccacctccttggctgactgtacaaactggcgcttggcagtaggattggtggtacgggcagaagccaggcgacagctgttacacagtgcagaggtgtgtttagccacaatggtggctgcagagagcacctgggcctgggtacagccaggctctcccaaactctggcaggccatctgaattgcctggtttgcacgggcaaactgtgtgggctccactagcccttgctgtccagcttggctattggggtcagagacaccaaccagatatgcagcctgtgcagctgcctcggtgaagccacaaagtgcctttgaggctgtggaaatggcatctccaaactctggcaggtttccgttcttggcattttgggagatgccagtcatggcctcgcccagcacctttgagttctccattacactgtccaggcaaccaaagtaggacatgtcattgatgggctggactgggttctccaggagttcccggaccgtctccaattcccgcagggcgttatcacactccttctggccgggtgcctgctgggtgcacatagtgatgagctgattgatgctgtcagttactgccctggcagctgcagccagctgactcttgaggttaggggcagcagggtccgtggacagggccttggcagccagaagaagtttgcttgaagacatggagatgcccttcaagttggacacaacttgggctcggtcctcctggctcggagcctggcctgccatctccacaccagcttccaggaaggtgctgaagtcctgtccaaatcggcctgaggctcgagccaggtcctgaggggttccccgagaggcctgcaccagttctgtggctgcctgattcagcccagcagcagcttcattcaaccggctctgagcttcttgaaatgtcccagtgctaggaggaagcgagtcactcaggagtcgcttgctggcatctccaactgccctcagggcattatccacatcgcgctggccaggtaggcagctgacacagcggttcagagcctgggtcactgctttagccacctgggcaagccgctgctggctctcagggtcccctggatggccagctgcctttttcgcctcctcaatgaggctgctggccttgtccagcacatcactggccgtatcaagtacaatggccc

SEQ ID NO: 5481 - DNA, 366 bp, Homo sapiens
  misc_feature (322)..(322): n equals a,t,g, or c
ctgctcccttggcagcytctaccatcttggctgtggcatcagctaggatcttggcagcacttaagagcttgcgggagttctccagatcactttccccctcagcatcagccttgatggcattgaccaggtcagatgtggcttgggccaggatgcgggcctgtcgcaccatctccccagcatcacccatggagctaaagatgttctcagtgacggttaggatggtgtcagtagcctggtcataacggccagcaggcccagcccctgtggcatgggctttcacatgctgcagcagctcatttagggcctgggtgacagctgtggntgctgctcctacccctcgcaacagttgcccatcatctgtagctg

SEQ ID NO: 5482 - DNA, 930 bp, Homo sapiens
tcgagtttttttttttttttttttggatatggagtctcactctgttgcccaggctggagtgctgtggtacgatttcagctcaatgcaagctctgcctcctgggtttaagcaattctcctgcctcagcctccccagtaggtgggactacgggtgtgcaacacaacatccggctaatttttgtatttttcgtagagacagggtttcacatgttggccaggctggtcttaaactcctgacctcagttgatccacctgcctgggcctcccaaagtgctgggattacaggcaaaagccactgtgcccagctgcattgttgctgttttttattgttagttaagagagaccaaccattagaaaaatgtttaaggcttttcaaaggaagaatcctatgtaggcagccccactacaggttactttctgatgaatgtccaggactattacaaaatccatgattgtggaaattctgtcaaaagagatgacagagaaatcttgcctttggtcacaatcctgtctgaccccaacaaaagctaaggaaatcctaatcaggtgtgactcatgataaagaaaaacatgcatccaaattttggttcagaagtacagaaagtgtgcaacttctgtcaagttaattaatgtatttgctccataactccccgacatataaggtaagttggttggagtatgtggtttgaaggctgctttcaaagatttaacgtctttgatttttttagtcaccatgggtgccaggatagaataagatctggagactttcgaataactgcttacagatgtagataattataaattgatactaataaagaatgaagatctcagcattccccagagagggctatttttagaaaaaggaaatagccaaaaacaaagtaaaacaaaaaacatcatgggatatcaggacttagctcgtgccgaattc

SEQ ID NO: 5483 - DNA, 994 bp, Homo sapiens
gaattcggcagaggttcggcgaagatagggaataaggaagcacaggagtaggggagaaggaagcacaggagtaggggagatatacagcggtcaggataagggggaaagggcggtggttgcscaagaggtgaaacaagatgtgagagacaaggggtagggaagaaatggggcagcggttaggttcagaagcgcatagaccgtggcggacgggcaatgcgaggggcacagaaaggaactgaggggtgggctattttaarggagatggtccttcagccctcttyttttctgcgtagttctcctcctccaggccgcgcgcggatatgtcgtccggaaaccagcccagtctaggctggatgatgacccacctccttctacgctgctcaaagactaccagaatgtccctggaattgagaaggttgatgatgtcgtgaaaagactcttgtctttggaaatggccaacaagaaggagatgctaaaaatcaagcaagaacagtttatgaagaagattgttgcaaacccagaggacaccagatccctggaggctcgaattattgccttgtctgtcaagatccgcagttatgaagaacacttggagaaacatcgaaaggacaaagcccacaaacgctatctgctaatgagcattgaccagaggaaaaagatgctcaaaaacctccgtaacaccaactatgatgtctttgagaagatatgctgggggctgggaattgagtacaccttcccccctctgtattaccgaagagcccaccgccgattcgtgaccaagaaggctctgtgcattcgggttttccaggagactcaaaagctgaagaagcgaagaagagccttaaaggctgcagcagcagcccaaaaacaagcaaagcggaggaacccagacagccctgccaaagccataccaaagacactcaaagacagccaataaattctgttcaatcatttaaaaaaaaaaaaaaaaaaaaaaaaaaaaaaaggggagggg

SEQ ID NO: 5484 - DNA, 1699 bp, Homo sapiens
ggcacgagggggcaggcatgggagccgcgcgctctctcccggcgcccacacctgtctgagcggcgcagcgagccgcggcccgggcgggctgctcggcgcggaacagtgctcggcatggcagggattccagggctcctcttccttctcttctttctgctctgtgctgttgggcaagtgagcccttacagtgccccctggaaacccacttggcctgcataccgcctccctgtcgtcttgccccagtctaccctcaatttagccaagccagactttggagccgaagccaaattagaagtatcttcttcatgtggaccccagtgtcataagggaactccactgcccacttacgaagaggccaagcaatatctgtcttatgaaacgctctatgccaatggcagccgcacagagacgcaggtgggcatctacatcctcagcagtagtggagatggggcccaacaccgagactcagggtcttcaggaaagtctcgaaggaagcggcagatttatggctatgacagcaggttcagcatttttgggaaggacttcctgctcaactaccctttctcaacatcagtgaagttatccacgggctgcaccggcaccctggtggcagagaagcatgtcctcacagctgcccactgcatacacgatggaaaaacctatgtgaaaggaacccagaagcttcgagtgggcttcctaaagcccaagtttaaagatggtggtcgaggggccaacgactccacttcagccatgcccgagcagatgaaatttcagtggatccgggtgaaacgcacccatgtgcccaagggttggatcaagggcaatgccaatgacatcggcatggattatgattatgccctcctggaactcaaaaagccccacaagagaaaatttatgaagattggggtgagccctcctgctaagcagctgccagggggcagaattcacttctctggttatgacaatgaccgaccaggcaatttggtgtatcgcttctgtgacgtcaaagacgagacctatgacttgctctaccaacaatgcgattcccagccaggggccagcgggtctggggtctatgtgaggatgtggaagagacaacaccagaagtgggagcggaaaattattggcatgatttcagggcaccagtgggtggacatggatggttccccacaggaattcacacgtggctgttcagagatcactcctctccaatatatcccagatatatctattggagtataaggaaactacctggattgtagggaggggtgacacagtgtccctcctgcagcaactaaggtcgtcatgttcttattttaggagaggccaaattgttttttgtcattgccgtgcacacgtgtgtgtgtgtgtgtgtgtgtgtgtaaggtgtcttataatcttttacctatttcttacaattgcaagatgactggctttactatttgaaaactggtttgtgtatcatatcatatatcatttaagcagtttgaaggcatacttttgcatagaaataaaaaaaatactgatttggggcaatgaggaatatttgacaattaagttaatcttcacgtttttgcaaactttgatttttatttcatctgaacttgtttcaaagatttatattaaatatttggcatacaaaaaaaaaaaaaaaaaacgggggggcccgtacccaattcgccctatagtgaggcgatac

SEQ ID NO: 5485 - DNA, 456 bp, Homo sapiens
  misc_feature (80)..(80): n equals a,t,g, or c
  misc_feature (385)..(385): n equals a,t,g, or c
  misc_feature (414)..(414): n equals a,t,g, or c
  misc_feature (455)..(456): n equals a,t,g, or c
ggcacgagccggctcgcggagtgcctgcgagcgstgctcatggcgctctatgagctcttctctcacccggtcgagcgcanttaccgcgcggggctctgctccaaagccgcgctgttcctgctgctggccgctgcgctcacgtacatcccgccgctgctggtggccttccggagccacgggttttggctgaagcggacagctacgaggagcagccgaccgtgcgcttccaacaccaggtgctgctcgtggccctgctcggacccgaaagcgacgggttcctcgcctggagcacgttccccgccttcaaccggctgcaaggggatcgcctgcgcgtcccgctcgtttcgtggaggagataatgcctgttgtgtaaagcaagacagtnggtcattgtgtatttacagaagtgatgtngattcctcccagaactcattagtgaccaagggtgctgggcnn

SEQ ID NO: 5486 - DNA, 813 bp, Homo sapiens
  misc_feature (4)..(4): n equals a,t,g, or c
  misc_feature (589)..(589): n equals a,t,g, or c
  misc_feature (665)..(665): n equals a,t,g, or c
  misc_feature (669)..(669): n equals a,t,g, or c
  misc_feature (689)..(689): n equals a,t,g, or c
  misc_feature (715)..(715): n equals a,t,g, or c
  misc_feature (723)..(723): n equals a,t,g, or c
  misc_feature (758)..(758): n equals a,t,g, or c
  misc_feature (774)..(774): n equals a,t,g, or c
  misc_feature (783)..(783): n equals a,t,g, or c
gagnttgcaccgmgcgcacgcgtcatggcggtcctcggagtacagctggtggtgaccctgctcactgccaccctcatgcacaggctggcgccacactgctccttcgcgcgctggctgctctgtaacggcagtttgttccgatacaagcacccgtctgaggaggagcttcgggccctggcggggaagccgaggcccagaggcaggaaagagcggtgggccaatggccttagtgaggagaagccactgtctgtgccccgagatgccccgttccagctggagacctgccccctcacgaccgtggatgccctggtcctgcgcttcttcctggagtaccagtggtttgtggactttgctgtgtactcgggcggcgtgtacctcttcacagaggcctactactacatgctgggaccagccaaggagactaacattgctgtgttctggtgcctgctcacrgtgaccttctccatcaagatgttcctgacagtgacacggctgtacttcagcgccgaggaggggggtgagcgctctgtctgcctcacctttgccttyctcttcctgctgctggccatgctggtgcaagtggtgcggnaggagaccctcgagctgggcctggacctggctggcagcatgacccagaacttagagccacttctgaagaagcaggnctgngactgggcgcttcctgtggncaagctgctatcgcgggactgcatgnggcttggntggtgcttctacttcagctgggtggcaacacggcnatgcattgagaaacantatctctgnaaatctgtctgtaccggttaaacatgcgat

SEQ ID NO: 5487 - DNA, 807 bp, Homo sapiens
  misc_feature (4)..(4): n equals a,t,g, or c
  misc_feature (505)..(505): n equals a,t,g, or c
  misc_feature (538)..(538): n equals a,t,g, or c
  misc_feature (541)..(541): n equals a,t,g, or c
  misc_feature (577)..(577): n equals a,t,g, or c
  misc_feature (654)..(654): n equals a,t,g, or c
  misc_feature (709)..(709): n equals a,t,g, or c
  misc_feature (717)..(717): n equals a,t,g, or c
  misc_feature (752)..(752): n equals a,t,g, or c
  misc_feature (768)..(768): n equals a,t,g, or c
  misc_feature (777)..(777): n equals a,t,g, or c
gagnttgcaccgcgttctcgcacgcgtcatggcggtcctcggagtacagctggtggtgaccctgctcactgccaccctcatgcacaggctggcgccacactgctccttcgcgcgctggctgctctgtaacggcagtttgttccgatacaagcacccgtctgaggaggagcttcgggccctggcggggaagccgaggcccagaggcaggaaagagcggtgggccaatggccttagtgaggagaagccactgtctgtgccccgagatgccccgttccagctggagacctgccccctcacgaccgtggatgccctggtcctgcgcttcttcctggagtaccagtggtttgtggactttgctgtgtactcgggcggcgtgtacctcttcacagaggcctactactacatgctgggaccagccaaggagactaacattgctgtgttctggtgcctgctcacggtgaccttctccatcaagatgttcctgacagtgacacggctgtacttnarcgccsaggaggggggtgagcgctctgtctgnctnacctttgccttyctcttcctgctgctggccatgctnggtgcaagtggtgcggaaggagaccctcgagctggcctggacctggctggcagcatgacccagaacttagagcattntaagaacaggctggactggcgcttctgtggcaactgctatcgcgggactgcatgnggcttggntggtgcttctacttcagctgggtggcaacacggcnatgcattgagaaacantatctctgnaaatctgtctgtaccggttaaacatgcgat

SEQ ID NO: 5488 - DNA, 648 bp, Homo sapiens
  misc_feature (267)..(267): n equals a,t,g, or c
  misc_feature (420)..(420): n equals a,t,g, or c
  misc_feature (464)..(464): n equals a,t,g, or c
gggcgtaccgtctttctatggctctgtgacagttacagatccgaaaattaggtgtaatggcttttgaagcaaaaatctcattctgaataaatctcccatctgtttcaataacattttaattgcgcatcaaatatggkacttatttttaaamactgcctagcaggatagtttgtgtwactctgcctgtatccatgaccgtgataagaaatgtaagaaaaggccaggcatggtggctcacacctgtaatcccagcactttgggaggccnaggtgggtggatcacctgaggtcaggaatccagacaagcctggccggcatggagagaccctgtctctattaaaaatataaaaatgagccagatgcggtggtgcatatctgtaatcccagctacttgggaggctgaggcaggagaatcgcttgnacccaggaggtggaggttggagtgagcgaagatcatgccactgnactccagcctgggtgacagagagacagactgtctcaaaaaaaaaaaaaaaaaaaaaaaatgtaagaaaagaggttgagtcttattttcatttgtatttctctcactgcctagcatagtgcctttcactcagttggaatatataataaatgttcattaaactgamaaaaaaaaaaaaaaaaaaaa

SEQ ID NO: 5489 - DNA, 878 bp, Homo sapiens
gcggacgcgtgggcaaacaaaaaaaccccaccccagttgacactttaatatttcccaatgaagactttatttatggaatggaatggaaaaaaaaacagctattttgaaaatatatttatatctacgaaaagaagttgggaaaacaaatattttaatcagagaattattccttaaagatttaaaatgtatttagttgtacattttatatgggttcaaccccagcacatgaagtataatggtcagatttattttgtatttatttactattataaccactttttaggaaaaaaatagctaatttgtatttatatgtaatcaaaagaagtatcgggtttgtacataattttccaaaaattgtagttgttttcagttgtgtgtatttaagatgaaaagtctacatggaaggttactctggcaaagtgcttagcacgtttgcttttttgcagtgctactgttgagttcacaagttcaagtccagaaaaaaaaagtggataatccactctgctgactttcaagattattatattattcaattctcaggaatgttgcagagtggttgtccaatccatgagaatttacatccttattaggtggaatatttggataagaaccagacattgctgatctattatagaaactctcctcctgccccttaatttacagaaagaataaagcaggatccatagaaataattaggaaaacgatgaacctgcaggaaagtgaatgatggtttgttgttcttctttcctaaattagtgatcccttcaaaggggctgatctggccaaagtattcaataaaacgtaagatttcttcattattraaaaaaaaaaaaaaaaagggcggccgctctagaggatccaagcttacgtacgcgtgc

SEQ ID NO: 5490 - DNA, 2584 bp, Homo sapiens
  misc_feature (1389)..(1389): n equals a,t,g, or c
acccacgcgtccgcgggcaccggccgacatggcggcagcggtggcggctgcgctggcgcggcttttggcggcctttctgctcctcgcggcccaggtggcctgtgagtacggcatggtgcacgtggtctcccaggccgggggccccgaaggcaaagactactgcatcctctacaacccgcagtgggcccatcttccgcacgacctcagcaaggcatctttcctgcagctgcgcaactggacggcctccctgctctgctccgcagccgacctccccgcccgtggcttcagcaaccagatcccgctggtggcgcgggggaactgcaccttctatgagaaagtgaggctggcccagggcagcggacacgcgggctgctcatcgtcagcagggagargctggtccccccggggggtaataagacgcatatgatgagattggcattcccgtggccctgctcagctacaaagacatgctggacatcttcacgcgtttcggccgcacggtgagggcggcgctgtatgcgcctaaggagccggtgctggactacaacatggtcatcatcttcatcatggctgtgggsaccgtcgccatcggcggctactgggccgggaktcgggacgtgaagaaaaggtacatgaagcacaagcgcgacgatgggcccgagaagcaggaggacgaggcggtggacgtgacgccggtgatgacctgcgtgtttgtggtgatgtgctgctccatgctggtgctgctctactayttctacgacctcctcgtgtrcgtggtcatcgggatcttctgcctggcctccgccaccggcctctacagctgcctggcgccctgtgtgcggcggctgcccttcggcaagtgcaggatccccaacaacagcctgccctacttccacaagcgcccgcaggcccgtatgctgctcctggcgctcttctgcgtggscgtcagcgtggtgtggggcgtcttccgcaacgargaccagtgggcctgggtcctccaggatgccctgggcatcgccttctgcctctacatgctgaagaccatccgtctgcccaccttcaaggcctgcacgctgctgctgctggtgctgttcctctacgacatcttcttcgtgttcatcacgcccttcctgaccaagagtgggagcagcatcatggtggaggtggccactgggccctcggactcagccacccgtgagaagctgcccatggtcctgaaggtgcccaggctgaactcctcacctctggccctgtgtgaccggcccttctccctcctgggtttcggagacattttggtgccagggctgctggtggcctactgccacaggtttgacatccaggtacagtcctccagggtatacttcgtggcctgcaccatcgcctatggynttggcctccttgtgacattcgtggcactggccctgatgcagcgtggccagcccgctctcctctacctggtgccctgcacgctggtgacgagctgcgctgtggcgctctggcgcygkgagctgggcgtgttctggacgggcagcggctttgcgaaagtcctacctccatctccgtgggccccagcaccagccgacggcccgcagcctcccaaagactctgccacgccactctccccgcagccgcccagcgaagaaccagccacatccccctggcctgctgagcagtccccaaaatcacgcacgtccgaggagatgggggctggagccatgctgggascctgggagcccagctgaatccgagggccgggaccaggccagccgtccccggtaacccagcctggcgcctcggcctaggggaggggtgagacgctcgctgccgtgcccgccacaccaagatgttggggctgcctggcgcccactggagacagacagacagacgcytgtcccccgggaccgaggcctgtgccgtccccacccgccccaacatggtgcttatccttgccgagacccctgcagtccgtgcccgcgcccagcccagctgccccggctgcacgcctgctgctcccagctcgcccggctgccacaagctctctgcgggtccatcctccccgcaggaggaggggtccgtcctcgcaggccytgcccggcctctctgcagaccctcaagcgtcgtctgcatgagtgagcaggcgtgggtggactctggccgcggccacacttggtgctcaccagctgcttcggccttcaggtgacctccctccccacggcatcctgctctccgggtggaagagcagctttctgtctcccagaaggcatcgcttttccctcttgagcagatcggagcccctgggaggtttggaagctgcctccaagcctaggacacggaccggtggccggggcggcctctggcccctgacgctggctgagacaggcccgtggggcggggttttggggcgtgaacaaggctggcagtaagtggacaagctgctcccctggctaaggccctgccctgccctcagccagaggtgcctggccatgcctgcacactcctccccattttaataaatggtcgcaacttcaaaaaaaaaaaaaaaaaaaaaaaaaaaaaaaaaaaaaaaaaaaaaaagggcggccgc

SEQ ID NO: 5491 - DNA, 2581 bp, Homo sapiens
  misc_feature (1591)..(1591): n equals a,t,g, or c
  misc_feature (1703)..(1703): n equals a,t,g, or c
tgcaaaaccactggacactggacaagtacgggatcctggscgacgcacgcctcttctttgggccccagcaccggsccgtcatccttcggttgtccaaccgccgcgcactgcgcctccgtgccagcttctcccagcccctcttccaggctgtggstgccatctgccgcctcctcagcatccggcaccccgaggagctgtccctgctccgggctcctgagaagaaggagaagaagaagaaagagaaggagccagaggaagagctctatgacttgagcaaggttgtcttggctgggggcgtggcacctgcactgttccgggggatgccagctcacttctcggacagcgcccagactgaggcctgctaccacatgctgagccggccccagccgccacccgaccccctcctgctccagcgtctgccacggcccagctccctgtcagacaagacccagctccacagcaggtggctggactcgtcgcggtgtctcatgcagcagggcatcaaggccggggacgcactctggctgcgcttcaagtactacagcttcttcgatttggatcccaagacagaccccgtgcggctgacacagctgtatgagcaggcccggtgggacctgctgctggaggagattgactgcaccgaggaggagatgatggtgtttgccgccctgcagtaccacatcaacaagctgtcccagagcggggaggtgggggagccggctggcacagacccagggctggacgacctggatgtggccctgagcaacctggaggtgaagctggaggggtcggcgcccacagatgtgctggacagcctcaccaccatcccagagctcaaggaccatctccgaatctttcggccccggaagctgaccctgaagggctaccgccaacactgggtggtgttcaaggagaccacactgtcctactacaagagccaggacgaggcccctggggaccccattcagcagctcaacctcaagggctgtgaggtggttcccgatgttaacgtctccggccagaagttctgcattaaactcctagtgccctcccctgaggcatgagtgagatctacctgcggtgccaggatgagcagcagtatgcccgctggatggctggctgccgcctggcctccaaaggccgcaccatggccgacagcagctacaccagcgaggtgcaggccatcctggcyttcctcagcctgcagcgcacgggcagtgggggcccgggcaaccacccccacggccctgatgcctctgccgagggcctcaacccctacggcctcgttgccccccgtttccagcgaaagttcaaggccaagcagctcaccccacggatcctggaagcccaccagaatgtggcccagttgtcgctggcagaggcccagctgcgcttcatccaggcctggcagtccctgcccgacttcggcatctcctatgtcatggtcaggttcaagggcagcaggaaagacgagatcctgggcatcgccaacaaccgactgatccgcatcgacttggccgtgggcgacgtggtcaagacctggcgtttcagcaacatgcgccagtggaatgtcaactgggacatccggcangtggccatcgagtttgatgaacacatcaatgtggccttcagctgcgtgtctgccagctgccgaattgtacacgagtatatcgggggctacattttcctgtcgacgcgggagngggcccgtggggaggagctggatgaagacctcttcctgcagctcaccgggggccatgaggccttctgagggctgtctgattgcccctgccctgctcaccaccctgtcacagccactcccaagcccacacccacaggggctcactgccccacacccgctccaggcaggcacccagctgggcatttcacctgctgtcactgactttgtgcaggccaaggacctggcagggccagacgctgtaccatcacccaggccagggatgggggtgggggtccctgagctcatgtggtgccccctttccttgtctgagtggctgaggctgatacccctgacctatctgcagtcccccagcacacaaggaagaccagatgtagctacaggatgatgaaacatggtttcaaacgagttctttcttgttactttttaaaatttcttttttataaattaatattttattgttggatcctcctcctttctctggagctgtgcttggggctactctgacactctgtctcttcatcaccagccaaggaaaggggctttcctgataaagacaagagttggttagagaaagggacacctaagtcagtctagggttggaagctaggagagaggtgagggcagaagggcacagctttcaggaacaaggaataggggctggggtkgtkgttctcacgggtaggcggtacctgcagggcctccttgaagtacttgggaaggaggaagccatcagtattccctggagtcagaatcaccccattggcagagcggaagaagggtattccatctgctgacagagccagagatgtgactcatgccctccccgaaggcaaagtcagctcctgctttgtccagactcacctgccagagccaggggtc

SEQ ID NO: 5492 - DNA, 766 bp, Homo sapiens
  misc_feature (1)..(1): n equals a,t,g, or c
  misc_feature (5)..(5): n equals a,t,g, or c
nccangattacgccaagctctaatacgactcactatagggaaagctggtacgcctgcaggtaccggtccggaattcccgggtcgacccacgcgtccggaagggtgtggtgatggtcaatctggctgtcggaacagattctggtgtcttgggctgataacagtgttgttgattctgattgtgaatcccctcaactctagcagacacatacacacccctgaaatggggctgcagagcaggctgtctcagccttgccactgtcggcatctcgggctgggtaattctgttgtggggactgtcctgttccttgtaggatgtttagtagcatccctgcccccacctactagatgccaggggcactgttctccccagccccccgccccagttgtgacaatagtctctaaacattgtcaaatggtccaaggaaaggggaaaattgccccggttgagaagagcactgctgtaaagtaatgagcctcggctctcctgtctgcacctgtccggttactacttggccaccacgcagccttggctcctacagcccaaaagggagaatggagggaggctccaggctttgctggaggggcctgggtgagttctgtttgctccttgtaccaccatccaaatggtgttatcaaatctcttagattccaaagaggttgaataattaatgttcaaaggcaagagggcaaggcattttttaacactttttaaaataaaaatttataccacaaaaaaaaaaaaaaaaaaaaaaaaaaaaaaaaaaaa

SEQ ID NO: 5493 - DNA, 2099 bp, Homo sapiens
gtctctctggcaatgttccacggcttctccttcctgggagctggctccataacttgattttccccaaacgtgttgcaatccctgctgccccttagccacccagggtcttgtgtgggtatgagtgtagaggatgggggtatgccaggcctgggccgtcccaggcaggcccgctggaccctgatgctactcctatccactgccatgtacggtgcccatgccccattgctggcactgtgccatgtggacggccgagtgcccttccggccctcctcagccgtgctgctgactgagctgaccaagctactgttatgcgccttctcccttctggtaggctggcaagcatggccccaggggcccccaccctggcgccaggctgctcccttcgcactatcagccctgctctatggcgctaacaacaacctggtgatctatcttcagcgttacatggaccccagcacctaccaggtgctgagtaatctcaagattggaagcacagctgtgctctactgcctctgcctccggcaccgcctctctgtgcgtcaggggttagcgctgctgctgctgatggctgcgggagcctgctatgcagcagggggccttcaagttcccgggaacacccttcccagtccccctccagcagctgctgccagccccatgcccctgcatatcactccgctaggcctgctgctcctcattctgtactgcctcatctcaggcttgtcgtcagtgtacacagagctgctcatgaagcgacagcggctgcccctggcacttcagaacctcttcctctacacttttggtgtgcttctgaatctaggtctgcatgctggcggcggctctggcccaggcctcctggaaggtttctcaggatgggcagcactcgtggtgctgagccaggcactaaatggactgctcatgtctgctgtcatgaagcatggcagcagcatcacacgcctctttgtggtgtcctgctcgctggtggtcaacgccgtgctctcagcagtcctgctacggctgcagctcacagccgccttcttcctggccacattgctcattggcctggccatgcgcctgtactatggcagccgctagtccctgacaacttccaccctgattccggaccctgtagattgggcgccaccaccagatccccctcccaggccttcctccctctcccatcagcagccctgtaacaagtgccttgtgagaaaagctggagaagtgagggcagccaggttattctctggaggttggtggatgaaggggtacccctaggagatgtgaagtgtgggtttggttaaggaaatgcttaccatcccccacccccaaccaagttcttccagactaaagaattaaggtaacatcaatacctaggcctgagaaataaccccatccttgttgggcagctccctgctttgtcctgcatgaacagagttgatgaaagtggggtgtgggcaacaagtggctttccttgcctactttagtcacccagcagagccactggagctggctagtccagcccagccatggtgcatgactcttccataagggatcctcacccttccactttcatgcaagaaggcccagttgccacagattatacaaccattacccaaaccactctgacagtctcctccagttccagcaatgcctagagacatgctccctgccctctccacagtgctgctccccacacctagcctttgttctggaaaccccagagagggctgggcttgactcatctcagggaatgtagcccctgggccctggcttaagccgacactcctgacctctctgttcaccctgagggctgtcttgaagcccgctacccactctgaggctcctaggaggtaccatgcttcccactctggggcctgcccctgcctagcagtctcccagctcccaacagcctggggaagctctgcacagagtgacctgagaccaggtacaggaaacctgtagctcaatcagtgtctctttaactgcataagcaataagatcttaataaagtcttctaggctgtagggtggttcctacaaccacagccaaaaaaaaaaaaaaaaaactcgagggggggcccgtcccaatcsccmtatagt

SEQ ID NO: 5494 - DNA, 1966 bp, Homo sapiens
gcccacgcgtccgcccacgcgtccggctccgaacaggaagaggacgaaaaaaataaccgtccgcgacgccgagacaaaccggacccgcaaccaccatgaacagcaaaggtcaatatccaacacagccaacctaccctgtgcagcctcctgggaatccagtataccctcagaccttgcatcttcctcaggctccaccctataccgatgctccacctgcctactcagagctctatcgtccgagctttgtgcacccaggggctgccacagtccccaccatgtcagccgcatttcctggagcctctctgtatcttcccatggcccagtctgtggctgttgggcctttaggttccacaatccccatggcttattatccagtcggtcccatctatccacctggctccacagtgctggtggaaggagggtatgatgcaggtgccagatttggagctggggctactgctggcaacattcctcctccacctcctggatgccctcccaatgctgctcagcttgcagtcatgcagggagccaacgtcctcgtaactcagcggaaggggaacttcttcatgggtggttcagatggtggctacaccatctggtgaggaaccaaggccacctttgtgccgggaaagacatcacataccttcagcacttctcacaatgtaactgctttagtcatattaacctgaagttgcagtttagacacatgttgttggggtgtctttctggtgcccaaactttcaggcacttttcaaatttaataaggaaccatgtaatggtagcagtacctccctaaagcattttgaggtaggggaggtatccattcataaaatgaatgtgggtgaagccgccctaaggattttcctttaatttctctggagtaatactgtaccatactggtctttgcttttagtaataaaacatcaaattaggtttggagggaactttgatcttcctaagaattaaagttgccaaattattctgattggtctttaatctcctttaagtctttgatatatattacttgttataaatggaacgcattagttgtctgccttttcctttccatcccttgccccacccatcccatctccaaccctagtcttccatttcctcccgccagtctccattgaatcaatggtgcaggacagaaagccagtcagactaatttccttctttcctcgcacttctccccactcgtcatcttttaactagtgtttcacaaggatcctctgaaaccctctctgtgccccaagtacagatsccattacttctgctttcgtatctcctcaggcaaaagtggagggtgccttatgggccctcctcataggttgtctctgcatacacgaacctaacccaaatttgctttggtgccagaaaaactgagctatgtttgaacaaagatgtcgtgcaaactgtactgtgaacaacagttggtttaaaatatgaggggcaaggaggaggatgcatttcaaaagcttgattgatgtgttcagagctaaattaagaggagttttcagatcaaaaactggttaccattttttgtcagagtgtctgatgcggccactcattcggctccccagaattcctagactgggttratagggtcatattgtgaatgtctcactacaaaatgacttgagtccagtgaaatctcattagggtttaagaatatttcagggatccttaatgttttgatttttgttttctgaaattggattttattttattttatcttataatttcagttcatctaaattgtgtgttctgtacatgtgatgtttgactgtaccattgactgttatggaagttcagcgttgtatgtctctctctacactgtggtgcacttaacttgtggaatttttatactaaaaatgtagaataaagactattttgaagatttgaataaagtgatgaagttgcattacaaaaaaaaaaaaaaaaaaaaaaaaaaagggcggccgct

SEQ ID NO: 5495 - DNA, 845 bp, Homo sapiens
  misc_feature (29)..(29): n equals a,t,g, or c
ggtggcctgactgcgcggccagacgccancgccatggaggagtacgctcgggagccctgcccatggcgaattgtggatgattgcggtggagccttcactatgggtgtcatcggtggcggagtcttccaggccatcaagggtttccgcaatgcccctgttggaattcggcaccggttgagaggtagtgccaatgctgtgaggatccgagccccccagattggaggtagcttcgcagtgtgggggggcctgttctccaccatygactgtggcctggtgcggcttcggggcaaggaggatccctggaactctatcaccagtggagcattgaccggggctgtgctggctgcccgcagtggcccactggccatggtgggctcagcaatgatggggggcatcctgttggccctcattgagggcgttggcatcctcctcactcgctacacagcccagcagttccgaaatgcgcccccattcctggaggaccccagccagctgccccctaaggatggcaccccggccccaggctaccccagctatcagcagtaccactgaggaagccactgccaccatgggagctacttctcggttccctccccgatggtctacctcgaagggagggctggctcccagttagccctgggaccctccagagagggtttctactctgctccctagtcccagggtgggggtggggcaccccagctgccctgacagatgggtcccctttttctctctcagggcaccccagccccacactcacatgtacgaagttctcaccccagctcctttgtgtggcaccctgatgagtatttaaagcccgttttgaaatgccaaaaaaaaaaaaa

SEQ ID NO: 5496 - DNA, 1984 bp, Homo sapiens
  misc_feature (707)..(707): n equals a,t,g, or c
  misc_feature (1947)..(1947): n equals a,t,g, or c
ggtcgaaccaagcgtccgcggacgcgtggggggaaacatggctctagcgcggccggtgcggctcttttccctcgtgactcggttgctcctggcgccgcgacggggcctcacggtccgcagtcccgacgaacccctgccggtggtgcgcatcccagtggctctacagcggcagttggaacagcggcagagcaggcggcggaacctcccgaggccggtgctggttcgacccggaccgctgctggtttcggcgcggcggccggagttgaaccagccggcgcgcctcacactgggccgttgggagcgcgcgccgctagcctctcaaggctggaagagtcgacgcgcgcgtcgggaccacttctccatcgagcgcgcgcaacaggaggcgccagcggtgcgaaagctctcgtctaagggcagctttgctgacctgggcctggagccccgtgtgctgcacgcactacaggaggctgcgcctgaagtcgttcagcccacaaccgtgcagtctagcaccatcccctcactacttcgcggccgccatgtcgtttgcgccgcagaaaccggcagtggcaagactctcagctacctcctgccgctgcttcaacggctcttgggccagccaagcctggactcccttcctatccccgcgccccgaggcctggtccttgttccttcccgagaattggcccaacaggtgcgggctgtggccnaacccttgggccgctccttgggcctgctggtgcgggacctggagggaggccacggcatgcgtaggatcaggctgcagctgtccagacagccttcagcagatgtgcttgtggccactccaggggctctgtggaaggccctgaaaagtcgactgatcagtctggagcaactctccttcttggtgttggatgaggcagacacactgctggatgaaagcttcctggaactggtggactacatcttagagaagagccacatagcagaaggcccagctgacttggaagaccccttcaatcccaaagctcagttagtgctggtaggagccacatttcccgaagtgtaggccagttgctgaataaagtcgccagcccagatgctgtcaccaccatcaccagctccaagctccactgtatcatgcctcatgtgaaacagacatttctgagactgaagggagcagataaggtggccgagctggtgcacatcctcaagcatcgtgacagagcagaaaggactggtccctcaggaactgttctggtgttctgtaatagctccagcactgtgaactggctgggatatattctggatgaccacaaaatccaacacctaaggttgcaggggcaaatgccagccttgatgagggtaggaatcttccagtccttccagaagagctcccgagacatacttctctgcacagacatagcctctcggggcctggacagcactggtgtggagctggttgtcaattatgatttccccccaacgctgcaagattacatccacagagcagggagagtgggccgtgtggggagcgargtgccaggcaccgtcatcagttttgtgacccatccctgggatgtgagcctggttcagaagattgagctggcggctcgccgaaggagaagtcttccaggactagcatcctcggtgaaagagcctttgccccaagcaacctgattttgacaaatctgattaaaatgtgatgctagaacagggatctttcccagtatcttgagtgggtgaccacacttgtcagtgggaggctctgggctgcctgtcggctccttgagggcgggatgaactgctttgtgacttggaaaggtacgctgctggccagcattggagaagaagctgctgagcatggctttctgtagtctttagcaagacacaagtggattttgactttgtatcatgtcatgatttctaacaataaatgatgtttttatgtgcaaaaaaaaaaaaaanaaaaaaaaaagggcgccgctcgcgatctagaactagt

SEQ ID NO: 5497 - DNA, 1984 bp, Homo sapiens
ggtcgaaccaagcgtccgcggacgcgtggggggaaacatggctctagcgcggccggtgcggctcttttccctcgtgactcggttgctcctggcgccgcgacggggcctcacggtccgcagtcccgacgaacccctgccggtggtgcgcatcccagtggctctacagcggcagttggaacagcggcagagcaggcggcggaacctcccgaggccggtgctggttcgacccggaccgctgctggtttcggcgcggcggccggagttgaaccagccggcgcgcctcacactgggccgttgggagcgcgcgccgctagcctctcaaggctggaagagtcgacgcgcgcgtcgggaccacttctccatcgagcgcgcgcaacaggaggcgccagcggtgcgaaagctctcgtctaagggcagctttgctgacctgggcctggagccccgtgtgctgcacgcactacaggaggctgcgcctgaagtcgttcagcccacaaccgtgcagtctagcaccatcccctcactacttcgcggccgccatgtcgtttgcgccgcagaaaccggcagtggcaagactctcagctacctcctgccgctgcttcaacggctcttgggccagccaagcctggactcccttcctatccccgcgccccgaggcctggtccttgttccttcccgagaattggcccaacaggtgcgggctgtggcccaacccttgggccgctccttgggcctgctggtgcgggacctggagggaggccacggcatgcgtaggatcaggctgcagctgtccagacagccttcagcagatgtgcttgtggccactccaggggctctgtggaaggccctgaaaagtcgactgatcagtctggagcaactctccttcttggtgttggatgaggcagacacactgctggatgaaagcttcctggaactggtggactacatcttagagaagagccacatagcagaaggcccagctgacttggaagaccccttcaatcccaaagctcagttagtgctggtaggagccacatttcccgaagtgtaggccagttgctgaataaagtcgccagcccagatgctgtcaccaccatcaccagctccaagctccactgtatcatgcctcatgtgaaacagacatttctgagactgaagggagcagataaggtggccgagctggtgcacatcctcaagcatcgtgacagagcagaaaggactggtccctcaggaactgttctggtgttctgtaatagctccagcactgtgaactggctgggatatattctggatgaccacaaaatccaacacctaaggttgcaggggcaaatgccagccttgatgagggtaggaatcttccagtccttccagaagagctcccgagacatacttctctgcacagacatagcctctcggggcctggacagcactggtgtggagctggttgtcaattatgatttccccccaacgctgcaagattacatccacagagcagggagagtgggccgtgtggggagcgargtgccaggcaccgtcatcagttttgtgacccatccctgggatgtgagcctggttcagaagattgagctggcggctcgccgaaggagaagtcttccaggactagcatcctcggtgaaagagcctttgccccaagcaacctgattttgacaaatctgattaaaatgtgatgctagaacagggatctttcccagtatcttgagtgggtgaccacacttgtcagtgggaggctctgggctgcctgtcggctccttgagggcgggatgaactgctttgtgacttggaaaggtacgctgctggccagcattggagaagaagctgctgagcatggctttctgtagtctttagcaagacacaagtggattttgactttgtatcatgtcatgatttctaacaataaatgatgtttttatgtgcaaaaaaaaaaaaaaaaaaaaaaaaagggcgccgctcgcgatctagaactagt

SEQ ID NO: 5498 - DNA, 681 bp, Homo sapiens
  misc_feature (1)..(1): n equals a,t,g, or c
  misc_feature (7)..(7): n equals a,t,g, or c
  misc_feature (23)..(23): n equals a,t,g, or c
  misc_feature (673)..(673): n equals a,t,g, or c
  misc_feature (676)..(677): n equals a,t,g, or c
  misc_feature (679)..(679): n equals a,t,g, or c
  misc_feature (681)..(681): n equals a,t,g, or c
naaaggnaaccttccctataggntaagctgctacgcctgcaggtaccggtccggaattcccgggtcgacccacgcgtccgcttggggcagagtcttcaagattttaaggtgatagggcctgtctcttaagaatttattaatcgtaagtgctcactgctggtttagagttagatacatttccctcaaaacagccatgggcaggttatgtactcagaactgccagggtgaaaacaatgagatccagaaaaatcccacaacaatccaggtttttcactcctcttttttttctcaatcttccgatacttgtggtacctcttccatcaacagatacctcatgtagtgacttccagtatcaagttttcaaaacttcctacccaccctcatcagtgcctccttcactacagagtcacaaacattggtgctctcaaataaaaatcagccccaaacaatgtcaaagagatcccttgagtagttttcaggcgagagatatgttctcatttcaagtcttggagaaaactggatccatgttcacgtggaacttctctcgcggaggtgctatctcattttgcattaaactttaagcaggacagattgctgaagccatgatatttaaggkttgactttttaaaaatctcattactcttaaaataaatgctgscacatcagagaaccnccnncnan

SEQ ID NO: 5499 - DNA, 526 bp, Homo sapiens
  misc_feature (66)..(66): n equals a,t,g, or c
  misc_feature (106)..(106): n equals a,t,g, or c
  misc_feature (484)..(484): n equals a,t,g, or c
ctctgacagcttcctctttggccaagccctgcctctgtacagcctcgagtggacagccagaggtcnagactggagcccagagcccaagatggagccccagctgggncctgaggctgccgccctccgccctggctggctggccctgctgctgtgggtctcagccctgagctgttctttctccttgccagcttcttccctttcttctctggtgccccaagtcagaaccagctacaattttggaaggactttcctcggtcttgataaatgcaatgcctgcatcgggacatctatttgcaagaagttctttaaagaagaaataagatctgacaactggctggcttcccaccttgggactgcctcccgattccctttgstttcttatccttgcaaattactccaratgattyccaaaatctggsgsccttgtggaratcttttaactggtcagcaawtwtcaaacgaaatctccaaacaggaaatcttntgcctcctgcatccacccccaaagaacttgcacattgacgtt

SEQ ID NO: 5500 - DNA, 1455 bp, Homo sapiens
  misc_feature (5)..(5): n equals a,t,g, or c
  misc_feature (39)..(40): n equals a,t,g, or c
ggcanagctgggatggggtcagcacccagaagccagccnnctctgacagcttcctctttggccaagccctgcctctgtacagcctcgagtggacagccagagggcacgagggagcccagagcccaagatggagccccagctggggcctgaggctgccgccctccgccctggctggctggccctgctgctgtgggtctcagccctgagctgttctttctccttgccagcttcttccctttcttctctggtgccccaagtcagaaccagctacaattttggaaggactttcctcggtcttgataaatgcaatgcctgcatcgggacatctatttgcaagaagttctttaaagaagaaataagatctgacaactggctggcttcccaccttggactgcctcccgattccttgctttcttatcctgcaaattactcagatgattccaaaatctggcgccctgtggagatctttagactggtcagcaaatatcaaaacgagatctcagacaggaaaatctgtgcctctgcatcagccccaaagacctgcagcattgagcgtgtcctgcggaaaacagagaggttccagaaatggctgcaggccaagcgcctcacgccggacctggtgcaggactgtcaccagggccagagagaactaaagttcctgtgtatgctgagataacaccagtgaaaaagcctggcatggagcccagcactgagaacttccagaaagtgttagccttctcccaactgtgttataccaaccacattttcaaatagtaatcattaaagaggcttctgcatcaaaccttcacatgcagctcccatgccacctccagaattcaccaacacacaggcccaccagcaacaggtacctttgcacaatattttttgatgacaatccaaagccccggctctttcccaccacactgtggtcccctagatggggctgttgctgagcccaccccaatcccagatgtgatcccccctgtgatctacttcctggcaagattcctccagtcctggacaggtcttccctatgagatagaacctgataaggagctagggcaattctgacaacattaccaaaggcccacataacttctaaattttggtctggtctgaaggaaaacctgttcttgccctagtgatggatgaactctcttatctctggcttctagagggaaaaaaaagcatacctcttttactttttaagtacctccatcagagtcatgaaatcacctgtcaagactatctatcttttatgtttccattctggtaagaactctttaaatgaggacactgctgattgctggtgatgttttttgagcaaacactcgggggtatggatgaaagccaatcgcaggtcaaatgactccttggggaagctacttctcctctattcagatttcactaaaatcttccaagatgaaagcaaaaaaaaaaaaaaaaaaaaaaaaa

SEQ ID NO: 5501 - DNA, 1517 bp, Homo sapiens
gattacgccaactcgaatttaaccctcactaaagggaacaaaagctggagctccaccgcggtggcggccgctctagaactagtggatcccccgggctgcaggaattcggcacgagggagcccagagcccaagatggagccccagctggggcctgaggctgccgccctccgccctggctggctggccctgctgctgtgggtctcagccctgagctgttctttctccttgccagcttcttccctttcttctctggtgccccaagtcagaaccagctacaattttggaaggactttcctcggtcttgataaatgcaatgcctgcatcgggacatctatttgcaagaagttctttaaagaaagaaataagatctgacaactggctggcttcccaccttgggactgcctcccgattcccttgctttcttatcctggcaaattactcaggatgattccaaaatctggcgccctgtggagatctttagactggtcagcaaatatcaaaacgagatctcagacaggaaaatctgtgcctctgcatcagccccaaagacctgcagcattgagcgtgtcctgcggaaaacagagaggttccagaaatggctgcaggccaagcgcctcacgccggacctggtgcaggactgtcaccagggccagagagaactaaagttcctgtgtatgctggagataacaccagtgaaaaagccttggcatggagccccagcactgagaacttccagaaagtgttagccttctcccaactgtgttataccaaccacattttcaaatagtaatcattaaagaggcttctgcatcaaaccttcacatgcagctcccatgccaccctccagaattcaccaacacacaggcccaccagcaacaggcttaccttttgcacaatattttttgatgacaatccaaagccccggctctttcccaccacactgtggtcccctagatggggctgttgctgagcccaccccaatcccagatgtgatccccctgtgatctacttctgggccaagattctccagtctggacaggtcttcccctatgagatagaacctgataaggagctagggcaattctgacaacattaccaaaggcccacataacttctaaattttggtctggtctgaaggaaaacctgttcttgccctagtgatggatgaactctcttatctctggcttctagagggaaaaaaaagcatacctcttttactttttaagtacctccatcagagtcatgaaatcacctgtcaagactatctatcttttatgtttccattctggtaagaactctttaaatgaggacactgctgattgctggtgatgttttttgagcaaacactcgggggtatggatgaaagccaatcgcaggtcaaatgactccttggggaagctacttctcctctattcagatttcactaaaatcttccaagatgaaagcaaaaaaaaaaaaaaaaaaaaaaaaactcgagggggggcccgtacccaattcgccctatagtgagtcgtatt

SEQ ID NO: 5502 - DNA, 526 bp, Homo sapiens; identical to SEQ ID NO: 5499
  misc_feature (66)..(66): n equals a,t,g, or c
  misc_feature (106)..(106): n equals a,t,g, or c
  misc_feature (484)..(484): n equals a,t,g, or c

SEQ ID NO: 5503 - DNA, 4150 bp, Homo sapiens; identical to SEQ ID NO: 3433

SEQ ID NO: 5504 - DNA, 331 bp, Homo sapiens
  misc_feature (240)..(240): n equals a,t,g, or c
  misc_feature (288)..(288): n equals a,t,g, or c
gaggaggagggaggtggcggcgccgtggcggaggagcaggagcaggagggggatggagaggagaaggctcctgggtggcatggcgctcctgctcctccaggcgctgcccagccccttgtcagccagggctgaacccccgcaggataaggaagcctgtgtgggtaccaacaatcaaagctacatctgtgacacaggacactgctgtggacagtctcagtgctgcaaactactactatgaantctggtggttctggctggtgtgggaccatcatcatcatcctgagctgntgctgtgtttggcaccaccgccgaaccgagcacggcttcaagg

SEQ ID NO: 5505 - DNA, 605 bp, Homo sapiens
  misc_feature (444)..(444): n equals a,t,g, or c
  misc_feature (470)..(470): n equals a,t,g, or c
  misc_feature (517)..(517): n equals a,t,g, or c
  misc_feature (560)..(560): n equals a,t,g, or c
  misc_feature (564)..(564): n equals a,t,g, or c
  misc_feature (593)..(593): n equals a,t,g, or c
agggtagaggaggagagggaggaggaggagggaggtggcggctcctgctcctccaggcgctgcccagccccttgtcagccagggctgaacccccgcaggataaggaagcctgtgtgggtaccaacaatcaaagctacatctgtgacacaggacactgctgtggacagtctcagtgctgcaactactactatgaactctggtggttctggctggtgtggaccatcatcatcatcctgagctgctgctgtgtttgccaccaccgccgagccaagcaccgccttcaggcccagcagcggcaacatgaaatcaacctgatcgcttaccgagaagcccacaattactcagcgctgccattttatttcaggtttttgccaaactatttactacctcctttatgaggaagtggtgaaacgacctccaactccttcccccaccatacagtgncttccagctacagcagcagcagcttnttccttccaacagtgttgcccttcaagttggcagttccccccggggnatcgattcccaccaagggggattcccagggggggcaccagaancagncccctttgttttgagccccagccagaaanccagcaccaaga

SEQ ID NO: 5506 - DNA, 832 bp, Homo sapiens
  misc_feature (16)..(16): n equals a,t,g, or c
  misc_feature (29)..(29): n equals a,t,g, or c
  misc_feature (90)..(90): n equals a,t,g, or c
  misc_feature (193)..(193): n equals a,t,g, or c
  misc_feature (783)..(783): n equals a,t,g, or c
  misc_feature (802)..(802): n equals a,t,g, or c
  misc_feature (804)..(804): n equals a,t,g, or c
  misc_feature (827)..(827): n equals a,t,g, or c
  misc_feature (830)..(830): n equals a,t,g, or c
ccctttgcttccaaancttgggggaaaancttgcttgcttctkggaaatttgggaaaaattccttgcttcgttaattggtgttcaaccancaggccatkccgggccggcccgtgccmaggttccgggtkccccaaggctctcragcttgcttcctcaragactgmcagagccttcctcytcatcaccaggggnccgcacatggcagctgtcgcagaagtccaggggcccatccagagcatcatcgatgagtgtgttgaactctttgaggtcatcgtcatggtggccccggttgcacacacacacttcaatgcccgagtcacctgtgaagcggcgatgtctcccaggcgtcttctctttgctgtcgggtgcgccgtgttcagagctgtcatctttcagcagctcctccctacattctgcatctttgtccaggaaggcccccgggtccagctcccccaggccagccacagagccactgggctccatccctggggctttggtggctgctcggtcaactggtaggtcagagggatcagggtcagcgatgcttgggggtcttgtgctgcttctgctgggctcagacaaggggctgctctgtgccccctgggatcccctggtgggatcgatgcccgggggactgccacctgcagggccacactgtggaggcagcagctgctgctgctgtagctggaaggcactgtatggtgggggaggagttggaggtcggttcaccacttcctcataaggaggtagtaaatagtttggcaaaaacctgaaataaaatnccagcgctgagtaattgtncncttctcggtaagcgatcaggttnatnaa

SEQ ID NO: 5507 - DNA, 2376 bp, Homo sapiens
  misc_feature (86)..(86): n equals a,t,g, or c
  misc_feature (275)..(275): n equals a,t,g, or c
  misc_feature (1965)..(1965): n equals a,t,g, or c
ttgatctgtcaaattccaggtgacaagatctatgcaccccatgcgtccttgaggggcctcttccccgcagctctggctggccgcanggcttctggtgtgaaaggttatactgccttttctttgtttgtttgtttttttctctaaaaacaaacagcaaaagacagctgaaaacaagaacttcaccggtgggcaggcaagaattctcttctggaaaatgacgtttgtggctctttcccaagttggccttcaaagaagcctgcctgctgttgagccangaagatgtctcgtgtgaaggctggggtggcggctgtcttggaacctctgtgagcaggaggcctaagcgcagcagtggatagaggtgcagctctctgcctctctgccctttggtctrtgttcacaggtgacccgtgtcagcctgcatcgcaagcacacaccctgcgggccttcaagtctcactgttccgtatgaggaaacagacagcggactgaggaagcgatggccccagagaaagggcccctgtagcctggctctcacacagtattttatctttgattctgaataaatattttttgtggggtttttttttttttttggkggcagttgtttgttttaaactgaccacttggaagaaacaccttggttatctgtggttttcatgccttgtccctgcctctacccccaccccttttgagtcgggtgactcatttttctgtgtagagactcggtggcccaggcaggaggtgaaagcagccatccggaaggccctggggacccttgtgcctgttgctcgccttcaggtcaccagctgagctgcgataggaaaatctgaatggaggcagcaaacagccaaaacaaacattccccacccggccctgtgcatatgaagtctttcttcccccaactcttgaacgatgatgatattcagacgaagcattgatgttatggaagaaagaaagaaacaaacaaaaaatatatatatatgtccaaaaacagacaaatccaagggtgtgaggtaaacgagtgtctgcatttagattccacaaaaccaaaatccatgttgaacaaagttaagtccgtacacagtgactttttgggtgagccgtgtgtgtctgtctgttgtgtgtgtgcctcaagccctgttttcctgtgaagatactttgagtggcagccattctctccacgtgaaccacacgtctggagcacagacaggcctctcaaggtcattgatcttacgcatttactgtttaccgaacaaatgtctgactgtgtactcgggtgtactccgcagcattgtcgactgcagtcccctgtgtttgccagagatactgtgctcgaagtagaggttttactctactcatcactgcgatttgcacattgctccgtggacactcggaggcctgcgttctgttccctataaatggaagcgtgctctgagcctgtctgcctccctcggctgctgctggtcctcagtaccagcgcccgggggtgtccacaaccacttgggacagaagaaggtggaatttcagacagaagcttgactgggtcttcaatgacaggcttggactagctgtggcccagacatcggccctgcccagaattgccaggaggaggctttgcaggctctagaggagccgcagggcctgcctgcctctggtgagtccaacaggcacaagcaagctggcgtgtggccagaggtagccggagtgtgtcacagcccctcagatgcctttccttccacctttttttattttttaagaatcccaaataactcactgaagtgtctcaaaggcgaacaagttttaccaaaatgaatcctttttcagttaacagatcaaatggatgagttctgagcctctcaagttcctttccccagttagagtggggaactgggcaagtgttaactgtgggactcactgcagcgtcctatcctaaaggcacgagaagacggaaatgcaacctgcgganctgggcttggttcccaggtcacagtttggcccccgctacaggatgctgccctgctcagagagagatttaatagggagctgaaggaatcgttagggggccagggagatgtgactgaggctggctttccacgtgaatgagacggggtcggtggagggtttggtgctacagccagtcagaagatttgcaaatgcgaacacattcctgtgtgaggcacgttaccctttgtcagttattgtgaatatgtgtattttaagcaataagattcagctggtcagacttttctgggcagtctcagtgacgcatttcctgtgctgtgattgttctgaagacagagtggctctaaccactgtgagaagcccaaataaaaattgatcccaaaaaaaaaaaaaaaaaaaaaaactcgaggggggg

SEQ ID NO: 5508 - DNA, 674 bp, Homo sapiens
  misc_feature (578)..(578): n equals a,t,g, or c
  misc_feature (625)..(625): n equals a,t,g, or c
  misc_feature (628)..(628): n equals a,t,g, or c
  misc_feature (671)..(671): n equals a,t,g, or c
gccggctactcctgctcagcatggctgctttagkgactgttctcttcacaggtgtccggaggctgcactgcagcgcagccgcttgggcgggcggccagtggcgactacagcagggactggctgccaacccctccggctacgggccccttaccgagctcccagactggtcatatgcggatggccgccctgctcccccaatgaaaggccagcttcgaagaaaagctgaaagggagacgtttgcaagacgagttgtactgctgtcacaggaaatggacgctggattacaagcatggcagctcaggcagcagaagttgcaggaagaacaaaggaagcaggaaaatgctcttaaacccaaaggggcttcactgaagagcccacttccaagtcaataaaaagcaactcctgcctcccttcctcaccctgtctctggatttcttttctatcacctagatgcttcatccagccagaagatagccttcacgttccccatctgtcttcagagcaaaagagctgggacaccaagaacaagctgktagatcactgcctgggaggcttggcttartactctcatctctggntccattccagttcarctaagtcttgctttaaaawttttacctcctanctnggtgcsgtgggtacgcctggatcccacactttggaggctgagnggc

SEQ ID NO: 5509 - DNA, 683 bp, Homo sapiens
  misc_feature (5)..(5): n equals a,t,g, or c
  misc_feature (534)..(534): n equals a,t,g, or c
  misc_feature (555)..(555): n equals a,t,g, or c
  misc_feature (643)..(643): n equals a,t,g, or c
  misc_feature (649)..(649): n equals a,t,g, or c
  misc_feature (682)..(682): n equals a,t,g, or c
ggttnatgaacgccagctcgaaattaaccctcactaaagggaacaaaagctggagctccacccgcggtggcaggccgctctagaactagtggatcccccgggctgcaggaattcggcacgagtatccctccaaaatcttgatgaacctgagcacagccctgctgttcctgaatctcctcttcctcctagatggctggatcacctccttcaatgtggatggactttgcattgctgttgcagtcctgttgcatttcttccttctggcaacctttacctggatggggctagaagcaattcacatgtacattgctctagttaaagtatttaacacttacattcgccgatacattctaaaattctgcatcattggctggggtttgcctgccttagtggtgtcagttgttctagcgagcagaaacaacaatgaagtctatggaaaagaaagttatgggaaagaaaaaggtgatgaattctgttggattcaagatccagtcatattttatgtgacctgtgctgggtattttggagtcatgntttttctgaacattgccatgntcattgtggtaatggtgcagatctgtgggaggaatggcaagagaagcaaccggaccctgagagaagaagtggtaaggaacctgcgcantgtggntagcttgacctttctggtgggcatgacatgggng

SEQ ID NO: 5510 - DNA, 3085 bp, Homo sapiens
  misc_feature (949)..(949): n equals a,t,g, or c
  misc_feature (3073)..(3073): n equals a,t,g, or c
  misc_feature (3080)..(3080): n equals a,t,g, or c
gcttacatccaaatctaaatccagctctaccacctatttcaaaaggaatagccacacagataatgtctcctatgagcattccttcaacaaaagtggatcactcagacagtgcttccatggacaagtccttgtcaaaactggcccatgctgatggagatcaaacatcaatcatccctgtccatcaggtcattgataaggtcaagggttattgcaatgctcattcagacaacttctataaaaatattatcatgtcagacaccttcagccacagcacaaagttttaatgtctttaagaaaaagaaatcaatctgcagaaatgtgaagatttgcaagcagtgtaaactgcaactagtgatgtaaatgtgctattacctaggtaactgcatatatataaggaatgtattttgttaagaaggcttttgtgaaattcagaatttttctttttaatatatttcttccatggaagagttgtcatcactaaaacttcagtactgagagtaacatgactcagtagccacagaagctatgatttgtaaaatatataattgaatcagagtaatcataatgcaggggagacattcaaattagagacaagggagaagcaatgctgaggaagaccctagatagagctcattttactccacctaatcgttatatctggatatacccattttctgcatcttctttctcaacaataaaaaatgtaactattttgaatgcccacaaatcccattccagtgttactttctgtgaatgcagtaccatattctcattttcaatgacatttcaaccacaggcagaaaagactgtttactccttgacccaaagattaaaaaggattttttattattttaaatattacaccttcagaaccataacatgcttaagraaactttcccaaaatgttgacctrgttaaatgaggctatataaatttctaatattttacnttattctattcaaggcatagggccaaagcattaagtataatttaatcccatacattcgagttaagtttagtgttgatgttccatcattctggacctcccaggagttgtttaagaatgaatctcttacacctctacttttgcccctctactgtatattaagcccataggcttgtgggaggaaggagaatttccattaggcaagctgtatgcagtggaattttccttttaggagacacacaattaagactctctggttctgkccttgctttggagactttaagacatttcctaaagcacaaataaaagcctcgtatttccccattgagagttttgttccaaggaatatgaagtgagacatatgggtgagtcataataatcaaaataatttatgaagagctgggtctgcaatagctagtctaaaaactacttgtgtgtcagtcctctggktatagtatataagagcctgaggaggtctggcaagatagatggtgkattatttatggatcargctgctgcatacaaaccttgcatactattatgcagcttacctaactctcagactattctgagtaatgcttgcttgctaatgaatgtataggagaccacattgtaattgttcttagatgatggagtccatgcagtttcttagaaatcggtctcagtgcatgctgtgctttttcacatttgctctgggttatctgggaagtatcaggttctgggaggcaacagcattaagtgataagaaaaggagacattctggcaaagcaatctgcttaaaggcaaagtccagaacctggaacctagaggcctttctctctgcacgaaaaacaggtagtttgcagtctgagatatgggagagcttttaggctacacagcaacccaagggacctctcaccttttgctgagcttcaatcaggaagctatttgcctggctccagcagatgatgagataatgaggtagtgggttttttattactgttccattttgcaacatcctgcaacaccatcctgggagacaagagcattacccagcttggctttcacgggggagggttgtattcagtaaaaaagaatagtaaatataaggtcactgagattctaagtaagatagtaaatctaaggtcactgagccaaatccttttcaataggcatatattaacaggctgcttattttggcggaggttacatatggatgaaaatgaatcttagtcactgaatattcatatacatttcccccaaaaccttagacattcatagtagattttaattagttagctttctaactagtcagatttctgcccaaagtgcttagtcaatagtaattaagatatagcttcaaaaatggctttgcttttgatttctactcatattcgtatggctccagaaaaatatttttttcatatttgacaatgtcagctccactttagaaattttcaataaccagatgagaaaaaaattaagaaattgctcaagggaaacatttgtaaatggatttgaaagattgagccaaattctgttgtcagttctaagcatgcagttctcacctccatttagtcccccatcagaacagaggtcaggaatttagctggggagcctaaatttagttcagcttacctttgagaatagcatcaattcagactctcttttcattatgttttcttttctttttccctctttttaaactacattgtgttagagtcatagtctaggatcctgagagattttccattcttgtcaccattcacttgcattgtaaagattttctttgtctgttgttggcatagattcttttgtacatatttatttatttgtgtttatatatgtcaattggtttcctttcttagcttgatattgcctagctttgttgttttaattaactttctattagagagactgtatatattttttctaaatactttgtgaaatcatttttggtagcaatatctttgaatatgatgaataaaagtgactgtgagtgcaaatagaattagcagtaagaagctactctagctaatttgccattttacttaaatggaaaatgtttttcaaataaatacttatgttgttcatgttaaaaaaaaaaaaaaaaaaaaaaaaaaaaaaaaaaaaaaaaaaaaaaaaaanggggggnccccc

SEQ ID NO: 5511 - DNA, 2577 bp, Homo sapiens
cggcacgagggtctgagggagcgatggcggtacgcgcgttgaagctgctgaccacactgctggctgtcgtggccgctgcctcccaagccgaggtcgagtccgaggcaggatggggcatggtgacgcctgatctgctcttcgccgaggggaccgcagcctacgcgcgcggggactggcccggggtggtcctgagcatggaacgggcgctgcgctcccgggcagccctccgcgcccttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgcccactcgctcagcgaagagatggagctggagttccgcaagcggagcccctacaactacctgcaggtcgcctacttcaagatcaacaagttggagaaagctgttgctgcagcacacaccttcttcgtgggcaatcctgagcacatggaaatgcagcagaacctagactattaccaaaccatgtctggagtgaaggaggccgacttcaaggatcttgagactcaaccccatatgcaagaatttcgactgggagtgcgactctactcagaggaacagccacaggaagctgtgccccacctagaggcggcgctgcaagaatactttgtggcctatgaggagtgccgtgccctctgcgaagggccctatgactacgatggctacaactaccttgagtacaacgctgacctcttccaggccatcacagatcattacatccaggtcctcaactgtaagcagaactgtgtcacggagcttgcttcccacccaagtcgagagaagccctttgaagacttcctcccatcgcattataattatctgcagtttgcctactataacattgggaattatacacaggctgttgaatgtgccaagacctatcttctcttcttccccaatgacgaggtgatgaaccaaaatttggccctattatgcagctatgcttggagaagaacacaccagatccatcggcccccgtgagagtgccaaggagtaccgacagcgaagcctactggaaaaagaactgcttttcttcgcttatgatgtttttggaattccctttgtggatccggattcatggactccagaagaagtgattcccaagagattgcaagaagaaacagaagtcagaacgggaaacagccgtacgcatctcccaggagattgggaaccttatgaaggaaatcgagacccttgtggaagagaagaccaaggagtcactggatgtgagcagactgacccgggaaggtggccccctgctgtatgaaggcatcagtctcaccatgaactccaaactcctgaatggttcccagcgggtggtgatggacggcgtaatctctgaccacgagtgtcaggagctgcagagactgaccaatgtggcagcaacctcaggagatggctaccggggtcagacctccccacatactcccaatgaaaagttctatggtgtcactgtcttcaaagccctcaagctggggcaagaaggcaaagttcctctgcagagtgcccacctgtactacaacgtgacggagaaggtgcggcgcatcatggagtcctacttccgcctggatacgcccctctacttttcctactctcatctggtgtgccgcactgccatcgaagaggtccaggcagagaggaaggatgatagtcatccagtccacgtggacaactgcatcctgaatgccgagaccctcgtgtgtgtcaaagagcccccagcctacaccttccgcgactacagcgccatcctttacctaaatggggacttcgatggcggaaacttttatttcactgaactggatgccaagaccgtgacggcagaggtgcagcctcagtgtggaagagccgtgggattctcttcaggcactgaaaacccacatggagtgaaggctgtcaccagggggcagcgctgtgccatcgccctgtggttcaccctggaccctcgacacagcgagcgggacagggtgcaggcagatgacctggtgaagatgctcttcagcccagaagagatggacctctcccaggagcagcccctggatgcccagcagggcccccccgaacctgcacaagagtctctctcaggcagtgaatcgaagcccaaggatgagctatgacagcgtccaggtcagacggatgggtgactagacccatggagaggaactcttctgcactctgagctggccagcccctcggggctgcagagcagtgagcctacatctgccactcagccgaggggaccctgctcacagccttctacatggtgctactgctcttggagtggacatgaccagacaccgcaccccctggatctggctgagggctcaggacacaggcccagccacccccaggggcctccacaggccgctgcataacagcgatacagtacttaagtgtctgtgtagacaaccaaagaataaatgattcatggttttttttaaaaaaaaaaaaaaaaaaa

SEQ ID NO: 5512 - DNA, 2615 bp, Homo sapiens
  misc_feature (5)..(5): n equals a,t,g, or c
  misc_feature (2605)..(2605): n equals a,t,g, or c
  misc_feature (2609)..(2609): n equals a,t,g, or c
tttcntttaggtctgagggagcgatggcggtacgcgcgttgaagctgctgaccacactgctggctgtcgtggccgctgcctcccaagccgaggtcgagtccgaggcaggatggggcatggtgacgcctgatctgctcttcgccgaggggaccgcagcctacgcgcgcggggactggcccggggtggtcctgagcatggaacgggcgctgcgctcccgggcagccctccgcgcccttcgcctgcgctgccgcacccagtgtgccgccgacttcccgtgggagctggaccccgactggtcccccagcccggcccaggcctcgggcgccgccgccctgcgcgacctgagcttcttcgggggccttctgcgtcgcgctgcctgcctgcgccgctgcctcgggccgccggccgccactcgctcagcgaagagatggagctggagttccgcaagcggacccctacaactacctgcaggtcgcctacttcaagatcaacaagttggagaaagctgttgctgcagcacacaccttcttcgtgggcaatcctgagcacatggaaatgcagcagaacctagactattaccaaaccatgtctggagtgaaggaggccgacttcaaggatcttgagactcaaccccatatgcaagaatttcgactgggagtgcgactctactcagaggaacagccacaggaagctgtgccccacctagaggcggcgctgcaagaatactttgtggcctatgaggagtgccgtgccctctgcgaagggccctatgactacgatggctacaactaccttgagtacaacgctgacctcttccaggccatcacagatcattacatccaggtcctcaactgtaagcagaactgtgtcacggagcttgcttcccacccaagtcgagagaagccctttgaagacttcctcccatcgcattataattatctgcagtttgcctactataacattgggaattatacacaggctgttgaatgtgccaagacctatcttctcttcttccccaatgacgaggtgatgaaccaaaatttggcctattatgcagctatgcttggagaagaacacaccagatccatcggcccccgtgagagtgccaaggagtaccgacagcgaagcctactggaaaaagaactgcttttcttcgcttatgatgtttttggaattccctttgtggatccggattcatggactccagaagaagtgattcccaagagattgcaagagaaacagaagtcagaacgggaaacagccgtacgcatctcccaggagattgggaaccttatgaaggaaatcgagacccttgtggaagagaagaccaaggagtcactggatgtgagcagactgacccgggaaggtggccccctgctgtatgaaggcatcagtctcaccatgaactccaaactcctgaatggttcccagcgggtggtgatggacggcgtaatctctgaccacgagtgtcaggagctgcagagactgaccaatgtggcagcaacctcaggagatggctaccggggtcagacctccccacatactcccaatgaaaagttctatggtgtcactgtcttcaaagccctcaagctggggcaagaaggcaaagttcctctgcagagtgcccacctgtactacaacgtgacggagaaggtgcggcgcatcatggagtcctacttccgcctggatacgcccctctacttttcctactctcatctggtgtgccgcactgccatcgaagaggtccaggcagagaggaaggatgatagtcatccagtccacgtggacaactgcatcctgaatgccgagaccctcgtgtgtgtcaaagagcccccagcctacaccttccgcgactacagcgccatcctttacctaaatggggacttcgatggcggaaacttttatttcactgaactggatgccaagaccgtgacggcagaggtgcagcctcagtgtggaagagccgtgggattctcttcaggcactgaaaacccacatggagtgaaggctgtcaccagggggcagcgctgtgccatcgccctgtggttcaccctggaccctcgacacagcgagcgggacagggtgcaggcagatgacctggtgaagatgctcttcagcccagaagagatggacctctcccaggagcagcccctggatgcccagcagggcccccccgaacctgcacaagagtctctctcaggcagtgaatcgaagcccaaggatgagctatgacagcgtccaggtcagacggatgggtgactagacccatggagaggaactcttctgcactctgagctggccagcccctcggggctgcagagcagtgagcctacatctgccactcagccgaggggaccctgctcacagccttctacatggtgctactgctcttggagtggacatgaccagacaccgcaccccctggatctggctgagggctcaggacacaggcccagccacccccaggggcctccacaggccgctgcatracagcgatacagtacttaagtgtctgtgtagacaaccaaagaataaatgattcatggttttttttaaaaaaaaaaaaaaaaaaactcgagggggggcccgtacccaattcgccaanctanagccca

SEQ ID NO: 5513 - DNA, 3047 bp, Homo sapiens
attaaccctcactaaagggaacaaaagctggagctccaccgcggtggcggccgctctagaactagtggatcccccgggctgcaggaattcggcacgagctcgtgccgagctggtgcagcccttcagctcgctgttcccgaaggtggagtacatcgccagggccgggtggacccgggatggcaaatacgcctgggccatgttcctggaccggccccagcagtggctccagctcgtcctcctccccccggccctgttcatcccgagcacagagaatgaggagcagcggctagcctctgccagagctgtccccaggaatgtccagccgtatgtggtgtacgaggaggtcaccaacgtctggatcaatgttcatgacatcttctatcccttcccccaatcagagggagaggacgagctctgctttctccgcgccaatgaatgcaagaccggcttctgccatttgtacaaagtcaccgccgttttaaaatcccagggctacgattggagtgagcccttcagccccggggaagatgaatttaagtgccccattaaggaagagattgctctgaccagcggtgaatgggaggttttggcgaggcacggctccaagatctgggtcaatgaggagaccaagctggtgtacttccagggcaccaaggacacgccgctggagcaccacctctacgtggtcagctatgaggcggccggcgagatcgtacgcctcaccacgcccggcttctcccatarctgctccatgagccagaacttcgacatgttcgtcagccactacagcagcgtgagcacgccgccctgcgtgcacgtctacaagctgagcggccccgacgacgaccccctgcacaagcagccccgcttctgggctagcatgatggaggcagccagctgccccccggattatgttcctccagagatcttccatttccacacgcgctcggatgtgcggctctacggcatgatctacaagccccacgccttgcagccagggaagaagcaccccaccgtcctctttgtatatggaggcccccaggtgcagctggtgaataactccttcaaaggcatcaagtacttgcggctcaacacactggcctccctgggctacgccgtggttgtgattgacggcaggggctcctgtcagcgagggcttcggttcgaaggggccctgaaaaaccaaatgggccaggtggagatcgaggaccaggtggagggcctgcagttcgtggccgagaagtatggcttcatcgacctgagccgagttgccatccatggctggtcctacgggggcttcctctcgctcatggggctaatccacaagccccaggtgttcaaggtggccatcgcgggtgccccggtcaccgtctggatggcctacgacacagggtacactgagcgctacatggacgtccctgagaacaaccagcacggctatgaggcgggttccgtggccctgcacgtggagaagctgcccaatgagcccaaccgcttgcttatcctccacggcttcctggacgaaaacgtgcactttttccacacaaacttcctcgtctcccaactgatccgagcagggaaaccttaccagctccagatctaccccaacgagagacacagtattcgctgccccgagtcgggcgagcactatgaagtcacgttgctgcactttctacaggaatacctctgagcctgcccaccgggagccgccacatcacagcacaagtggctgcagcctccgcggggaaccaggcgggagggactgagtggcccgcgggccccagtgaggcactttgtcccgcccagcgctggccagccccgaggagccgctgccttcaccgccccgacgccttttatccttttttaaacgctcttgggttttatgtccgctgcttcttggttgccgagacagagagatggtggtctcgggccagcccctcctctccccgccttctgggaggaggaggtcacacgctgatgggcactggagaggccagaagagactcagaggagcgggctgccttccgcctggggctccctgtgacctctcagtcccctggcccggccagccaccgtccccagcacccaagcatgcaattgcctgtcccccccggccagcctccccmacttgatgtttgtgttttgtttggggggatatttttcataattatttaaaagacaggccgggcgcggtggctcacgtctgtaatcccagcactttgggaggctgaggcgggcggatcacctgaggttgggagttcaagaccagcctggccaacatggggaaaccccgtctctactaaaaatacaaaaaattagccgggtgtggtggcgcgtgcctataatcccagctactcgggaggctgaggcaggagaatcgcttgaacccgggaggtggaggttgcggtgagccaagatcgcaccattgcactccagcctgggcaacaagagcgaaactctgtctcaaaataaataaaaaataaaagacagaaagcaaggggtgcctaaatctagacttggggtccacaccgggcagcggggttgcaacccagcacctggtaggctccatttcttcccaagcccgagcagagggtcatgcgggccccacaggagaagcggccagggcccgcggggggcaccacctgtggacagccctcctgtccccaagctttcaggcaggcactgaaacgcaccgaacttccacgctctgctggtcagtggcggctgtcccctccccagcccagccgcccagccacatgtgtctgcctgacccgtacacaccaggggttccggggttgggagctgaaccatccccacctcagggttatatttccctctccccttccctccccgccaagagctctgccaggggcgggcaaaaaaaaaagtaaaaagaaaagaaaaaaaaaaaaaagaaacaaaccacctctacatattatggaaagaaaatatttttgtcgattcttattcttttataattatgcgtggaagaagtagacacattaaacgattccagttggaaacatgaaaaaaaaaaaaaaaaaaag

SEQ ID NO: 5514 - DNA, 1837 bp, Homo sapiens
  misc_feature (417)..(417): n equals a,t,g, or c
  misc_feature (1813)..(1813): n equals a,t,g, or c
  misc_feature (1827)..(1827): n equals a,t,g, or c
cacgccccaccatggggtctactctcgggaggaggagctgctgagggagcggaaaccctgggggtcttcggcatcacctcctacgacttccacagcgagagtggcctcttcctcttccaggccagcaacagcctcttccactgccgcgacggcggcaagaacggcttcatggtgtcccctatgaaaccgctggaaatcaagacccagtgctcagggccccggatggaccccaaaatctgccctgccgaccctgccttcttctccttcatcaataacagcgacctgtgggtggccaacatcgagacaggcgaggagcggcggctgaccttctgccaccaaggtttatccaatgkcctggatgaccccaagtctgcgggtgtggccaccttcgtcatacaggaagagttcgaccgcttnactgggtactggtggwgccccacagcctcctgggaaggttcagagggcctcaagacgctgcgaatcctgtatgaggaagtcgatgagtccgaggtggaggkcattcacgtcccctctctgcgctagaagaaaggaagacggactcgtatcggtaccccaggacaggcagcaagaatcccaagattgccttgaaactggctgagttccagactgacagccagggcaagatcgtctcgacccaggagaargagctggtgcagcccttcagctcgctgttcccgaaggtggagtacatcgccagggccgggtggacccgggatggcaaatacgcctgggccatgttcctggaccggccccagcagtggctccagctcgtcctcctccccccggccctgttcatcccgagcacagagaatgaggagcagcggctagcctctgccagagctgtccccaggaatgtccagccgtatgtggtgtacgaggaggtcaccaacgtctggatcaatgttcatgacatcttctatcccttcccccaatcagagggagaggacgagctctgctttctccgcgccaatgaatgcaagaccggcttctgccatttgtacaaagtcaccgccgttttaaaatcccagggctacgattggagtgagcccttcagccccggggaagatgaatttaagtgccccattaaggaagagattgctctgaccagcggtgaatgggaggttttggcgaggcacggctccaagatctgggtcaatgaggagaccaagctggtgtacttccagggcaccaaggacacgccgctggagcaccacctctacgtggtcagctatgaggcggccggcgagatcgtacgcctcaccacgcccggcttctcccatarctgctccatgagccagaacttcgamatkttcgtcagccacatmacagcacaagtggctgcagcctccgcggggaaccaggcgggagggactgagtggcccgcgggccccagtgaggcactttgtcccgcccagcgctggccagccccgaggagccgctgccttcaccgscccgacgccttttatccttttttaaacgctcttgggttttatgtccgctgcttcttggttgccgagacagagagatggtggtctcgggccagcccctcctctccccgccttctgggaggaggaggtcacacgctgatgggcactggagaggccagaagagactcagaggagcgggctgccttccgcctggggctccctgtgacctctcagtcccctggcccggccagccaccgtccccagcacccaagcatgcaattgcctgtcccccccggccagcctccccmacttgatgtttgtgttttgtttggggggawawttttcataawtatttaaaagaacanggccgggcccccgnggggttaacg

SEQ ID NO: 5515 - DNA, 604 bp, Homo sapiens
aacaagagcgaaactctgtctcaaaataaataaaaaataaaagacagaaagcaaggggtgcctaaatctagacttggggtccacaccgggcagcggggttgcaacccagcacctggtaggctccatttcttcccaagcccgagcagagggtcatgcgggccccacaggagaagcggccagggcccgcggggggcaccacctgtggacagccctcctgtccccaagctttcaggcaggcactgaaacgcaccgaacttccacgctctgctggtcagtggcggctgtcccctccccagcccagccgcccagccacatgtgtctgcctgacccgtacacaccaggggttccggggttgggagctgaaccatccccacctcagggttatatttccctctccccttccctccccgccaagagctctgccaggggcgggcaaaaaaaaaagtaaaaagaaaagaaaaaaaaaaaaaagaaacaaaccacctctacatattatggaaagaaaatatttttgtcgattcttattcttttataattatgcgtggaagaagtagacacattaaacgattccagttggaaaaaarwaaaaaaaaaaaaaaaaaag

SEQ ID NO: 5516 - DNA, 1006 bp, Homo sapiens
gcgkgcctycaaggccctgctcccagtgggcgcctatgaagtcttcgcccgggaggcggtgggtgcgggtgcagctcggggcctgctgcctggagatgaggacgctggtcgagctcgggccctgggctggggactttgggcctgacctgctgctcaccctgctcttcctgctcttcctggcgcacggggtcaccttggacggggcctcggccaaccccactgtgtccctgcaggagttcctcatggccgagcagtctctgcctggcacgctgttgaagctggcggcacaggggctgggcatgcaggccgcctgcaccctgaygcgcctctgctgggcctgggagctcagtgacctgcacctgctgcagagcctcatggcccagagctgcagctcggccctgcgcacatccgtgccccacggggcgcttktggaggccgcctgcaccttttgtttccatctgaccctcctgcacctgcggcacagtcctccsgcctacagcgggccygctgtggctctgttggtcaccgtcayggcctacacggccggcccttacgtctgcttcttcaaccctgccctggccgctctgtgacctttgcctgctcgggacacaccttactggagtacgtgcaggtgtactggctgggccctctgacagggatggtcctggctgtgctgctgcaccagggccgcttccccrccttttccagaggaacctgttctacggccagaagaacaagtaccgagcaccccgagggaagccggccccggcctyaggggacacccagacccctgcaaaggggtccagtgtccgggagcctgggcgcagtggtgttgaggggccacattccagctgagtggccttgctctgtgtgagccccgtgcgagggccctgcttgtagctggaccctggaaccttctgtagctaagagggaatcctggccccctccccagaagccatttgtcaataaaccatttctaagaaaaaaaaaaaaaaagggcggccgc

SEQ ID NO: 5517 - DNA, 700 bp, Homo sapiens
  misc_feature (614)..(614): n equals a,t,g, or c
  misc_feature (640)..(640): n equals a,t,g, or c
  misc_feature (660)..(660): n equals a,t,g, or c
ggaaacagcccccgcgcagtcggtgtcgctgtgaacggaaaagggccttccttacacaggaaacggggtctctgggggatccagtgacgtgcccaaccacagagaccaggtgagactggctgatggtgtctggggctgcaggtgacttagttgggggacctgctcttggcctccagactgggcctgatggcgtgggcgcctgcctgtgtgcaggcccaagggctcagctgcctctgtctgttcccagacccctcctcctgtagagagtggtgctgccctctcgggatgtacctgcaggtggagacccgcaccagctcccgcctccatctgaagagggctccaggcatccggtcctggtccctgctggttggtaaggctctccacgtccctccccagaaccccagaaccggaagcctgactttcaaaaaggatgaaaatgaaacaaaatattttctcttttttctattaccttgaaatctaatggctattttggttctttggatccattcaaattctatctggtgtacttggttttacagataatgcatgtctgtttgtccccttttaatcactaacacccagcgtatttaatatactctatgagcttttctgangtcaccatattttcctttgacttggntttgaaccacgtgatggggngatcgggggttcccatggctcctcctccctgggtccttaa

SEQ ID NO: 5518 - DNA, 732 bp, Homo sapiens
gtgcagctcagtgtccctgctgggatgctgcacagtctctgtgtgcagctcttcatcactgctgggtccctgtgtgccacacacagccagtgcttatcaaaggctgacggggccagaccttccatcctgtatctcacgtgccctctccacagccccataaaaaatggtccccagattcgggttgaagaagctgatgtttcgagtagtgaaacagctctgccaaggtcacggagggatggargggcaaagccagggtgtgaaaccgggtgctgtatgtggctacaggcacttaacattgtcacctggaggcttccccagcacattgtgagatccaagcctcaggaaccagaacagcagaactcctgtcacccacagaagccggcgccggggactgcagtgcagataggcaggcgttcttcacagcagtggctactgcgcactccactcacgcagcagcggtccccagatgcctgccgttcacctgarrmwgctctgagtgctttggatatggcaggagacacacaagtctggccctcacagagtctgtttgcaaagttaaaagttaaataagtaaaatagatgccaggcagggtggtgcatgcctgtaatccagggcatttgggaggctggggcaggaggatcacttgagcccaggagttcaagtctaacctgagcaacatagcaagaccctgtctctacaaaaaaaactaaaaaaaaaaaaaaaaaactcga

SEQ ID NO: 5519 - DNA, 879 bp, Homo sapiens
  misc_feature (780)..(780): n equals a,t,g, or c
  misc_feature (809)..(809): n equals a,t,g, or c
  misc_feature (853)..(853): n equals a,t,g, or c
  misc_feature (856)..(856): n equals a,t,g, or c
  misc_feature (878)..(878): n equals a,t,g, or c
gttgcaaggaattggtactaaccgtgactacaacaaaaattcttgattgacttttaaagttatttcctggcattctggtaccttcacccagcctgagtgccctggagagggaacaggaaatgctgatctctacccctgggtgagaccagaacctcagggctgatactgttgagtggcttcctcggtttactctgtgtactgtgaaagtwttttcatattttttctgtgtgccagagtgaaaaaggacagcttctgagtgtggtaattgtgcctctagcacccagcctttcaaagcccacctgaaacctgggggtggatgaaagaactagaatagaagactgaagctgggtaggccgctcagtgtccactggcattttgctaaaccgacaaggaaggctgtgtgcttagctctccccagagggagggcgagaagggtgtggtgatggtcaatctggctgtcggaacagattctggtgtcttgggctgataacagtgttgttgattctgattgtgaatcccctcaactctagcagacacatacacacccctgaaatggggctgcagagcaggctgtctcagccttgccactgtcggcatctcgggctgggtaattctgttgtggggactgtcctgttccttgtaggatgtttagtagcatccctgcccccacctactagatgccaggrgcactgttctccccagccccccgccccagttgtgacaatagtctctaaacattgtcaaatggtccaaggaaaggggaaaattgccccggttganaagagcactgctgtaaagtaatgagcctnggctctcctgtctgcacctgtccggttactacttggccaccacncancctttgggctcctacagcccana

SEQ ID NO: 5520 - DNA, 534 bp, Homo sapiens
  misc_feature (10)..(10): n equals a,t,g, or c
  misc_feature (16)..(16): n equals a,t,g, or c
  misc_feature (19)..(19): n equals a,t,g, or c
  misc_feature (524)..(524): n equals a,t,g, or c
  misc_feature (529)..(529): n equals a,t,g, or c
ttaaaaaaancccccnaancctttccggctctaaagcaatagcatcaaaaaccaaagagattgaacaggtttaccgacaagactgtgaaactttcgggatggtggtgaaaatgctgattgaaaaagatccttcattagaaaagtctatacagtttgcattgaggcagaatttacatgaaataggtgagcggtgtgttgaagaactcaagcatttcattgcagagtatgatacttccactcaagattttggagagcctttttagatttttctgctcaggctaaaaaaaaaaaaaacagtttctaaaaattttttttcctggattgkgtaaatccttaatatatggaatttttgkgatgcagagaaatactttatgatagttgacaacatttcagtattaaataaacatctaaaatagtctgtttaaaatgtttgattcaaatttttgtattttttgtagagatggggttcaccatgttggccaggctagtctctaactcctggcctcaaggatctgcctgcctcngaggnacccc

SEQ ID NO: 5521 - DNA, 503 bp, Homo sapiens
  misc_feature (11)..(11): n equals a,t,g, or c
  misc_feature (30)..(30): n equals a,t,g, or c
  misc_feature (82)..(82): n equals a,t,g, or c
aattgggcccncggggccaaggaattcggncacggggggagcctttttagatttttctgctcaggctaaaaaaaaaaaaaancagtttctaaaaattttttttcctggattgtgtaaatccttaatatatggaatttttgtgatgcagagaaatactttatgatagttgacaacatttcagtattaaataaacatctaaaatagtctgtttaaaatgtttgattcaaatttttgtattttttgtagagatggggttcaccatgttggccaggctagtctctaactcctggcctcaagtgatctgcctgcctcagcctctcaaagtgttgagattacaggcgtgaccaccgctccctgcccaacacatataccatctgaaaatgttagaattctgagttgtgattttattgacttgttgcttgctttttcttaggctttgtaacttgtaatatgttaaagtgtactatcctaataaactgaatactttggtatcttagagaaaa

SEQ ID NO: 5522 - DNA, 840 bp, Homo sapiens
  misc_feature (825)..(825): n equals a,t,g, or c
tgcaggtaccggtccggaattcccgggtcgacccacgcgtccggttctgagtcaggccgagaaggttctagaagaagtggactggctaatcaccaagcttaagggacaagtgagccaagaaaccttatcagaagaggcctcttctcaggcaaccctaccaaatcagcctgttgagaaagctatcatcatgcaactgggaactctgcttacatttttccacgagctggtgcagacagctctgccatcaggcagctgtgtggacaccttgttaaaggacttgtgcaaaatgtacaccacacttacagcccttgtcagatattatctccaggtgtgtcagagctccggaggaattccaaaaaatatggaaaagctggtgaagctgtctggttctcatctgacccccctgtgttattctttcatttcttacgtacagaataagagtaagagcctgaactatacgggagagaaaaaggagaaacctgctgccgttgccacagccatggccagagttcttcgggaaaccaagccaatccctaacctcatctttgccatagaacagtatgaaaaatttctcatccacctttctaagaagtccaaggtgaacctgatgcagcacatgaagctcagcacctcacgagacttcaagatcaaaggaaacatcctagacatggttcttcgagaggatggtgaagatgaaaatgaagagggcactgcatcagagcatgggggacagaacaaagaaccagccaagaagaaaaggaaaaaataaatgaaatgcctgagttaatgtgaaaaaaaaaaaaaaaaaaaaaaaaaaaaaaaaanaaaaagggcggccgc

SEQ ID NO: 5523 - DNA, 997 bp, Homo sapiens
  misc_feature (850)..(850): n equals a,t,g, or c
  misc_feature (872)..(872): n equals a,t,g, or c
  misc_feature (882)..(882): n equals a,t,g, or c
  misc_feature (889)..(889): n equals a,t,g, or c
  misc_feature (913)..(913): n equals a,t,g, or c
  misc_feature (923)..(923): n equals a,t,g, or c
  misc_feature (984)..(984): n equals a,t,g, or c
ggcaggcggaaggcggtggctccgagataggggtcaccgccctcagtgtctacctcacccccaagaccagtgacagtgggaactggatcgagatcgcctatggcaccagctcagggggcgtgcgggtcatcgtgcagcacccggagactgtgggctcggggcctcagctcttccagaccttcactgtgcaccgcagccctgtcaccaagatcatgctgtcggagaagcacctcatctcagtctgtgccgacaacaaccacgtgcggacatggtctgtgactcgcttccgcggcatgatttccacccagcccggctccaccccactcgcttcctttaagatcctggctctggagtcggcagatgggcatggcggctgcagtgctggcaatgacattggcccctacggtgagcgggacgaccagcaagtgttcatccagaaggtggtgcccagtgccagccagctcttcgtgcgtctctcatctactgggcagcgggtgtgctccgtgcgctccgtggacggctcacccacgacrgccttcacagtgctggagtgcgagggctcccggcggctcggctctcggccccggcgctacctgctcactggccaggccaacggcagcttggccatgtgggacctaaccaccgccatggacggcctcggccaggcccctgcaggtggcctgacggagcaagagctgatggaacagctggaacactgtgagctggccccgccggctccttcagctccctcatggggctgtctccccaagcccctcacccgcatctccctcaccagcccttcactcagccttcaagcaacaaccttcctttgtcttggccacccgtgggnagccccaaagcccccccgcaangcttgaaggncccgggnggcccctgggtgggggggcaagcnttttgtgggnaaacggcttgcccagggaaacttgggtgcccggaaatggggcccaagaaccttcccaaacngggccaaccccaa

SEQ ID NO: 5524 - DNA, 533 bp, Homo sapiens
  misc_feature (492)..(492): n equals a,t,g, or c
  misc_feature (503)..(504): n equals a,t,g, or c
gaactatttcttttttctctgggtggcaagattatgaaaaaattttcttacgcttttctatattttccaagtttgaatttcactgtaagcacctggctttgtactgccctttttctgttacacagtcatcatttgcttgcttgwtgtgggagcacttttgcacaggtctgcttggttagtgaaagcatgtctccctttctaggaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaaggtgggtcctgccgtgcggcgcctgccctgagtccccgtcccttctcccagttcttagtcactttcagcgcatcgtcgyacgtggycatttgtgcanccggctctcgnnggaggggtaaacaaccctggtttacaccg

SEQ ID NO: 5525 - DNA, 2831 bp, Homo sapiens
gcgccgctcgggtcagtcggcggccggactgggaagatggacgcagctactctgacctacgacactctccggtttgctgagtttgaagattttcctgagacctcagagcccgtttggatactgggtagaaaatacagcattttcacagaaaaggacgagatcttgtctgatgtggcatctagactttggtttacatacaggaaaaactttccagccattggggggacaggccccacctcggacacaggctggggctgcatgctgcggtgtggacagatgatctttgcccaagccctggtgtgccggcacctaggccgagattggaggtggacacaaaggaagaggcagccagacagctacttcagcgtcctcaacgcattcatcgacaggaaggacagttactactccattcaccagatagcgcaaatgggagttggcgaaggcaagtccataggccagtggtacgggcccaacactgtcgcccaggtcctgaagaagcttgctgtcttcgatacgtggagctccttggcggtccacattgcaatggacaacactgttgtgatggaggaaatcagaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaagcactgcttcatgatgccccagtccctgggcgtcatcggagggaagcccaacagcgcccactacttcatcggctacgttggtgaggagctcatctacctggacccccacaccacgcagccagccgtggagcccactgatggctgcttcatcccggacgagagcttccactgccagcacccgccgtgccgcatgagcatcgcggagcttgacccgtccatcgctgtggggtttttctgtaagactgaagatgacttcaatgattggtgccagcaagtcaaaaagctgtctctgcttggaggtgccctgcccatgtttgagctggtggagcagcagccttcacatctggcctgccccgacgtcctgaacctgtccctagattcttctgatgtagagcgactggaaagattcttcgactcagaagatgaagactttgaaatcctgtccctttgaaaatcctggggtcgggggtggcacctgtgagagcctggggctcctggtgccgctgcgtttcatccatcccgcccgctcgcctgccgagggctgcgccccgtgctgcctccccccagagggccacccgctgtgctcgtggactgaggctgcgctgcccgggaggccttactgcttggtgtcagactgcccagctcagagtgcccgtcagggcctgtgcatccgcacgcggagccgtctgttaggagcttccagagygttctctcgacactgccagccccgtgttagcacctgggcctcagtcccacttgctcccaggcgccggttctgtggttggtttggaattaaagtcctgtttgaagttgtcagacacagacatgaatttctggggcgctccctgagtcagagtctcagaagacctgtgcaggctggcgtgagaggagcggcagccacactgcggccccacgcccaaggactgggctgctctcgaggggggcgcgcccaccgctgtgtcctctctgcccagcctggcttaccaagggctacctcagtgggagatgaggttggaggaacgaaggcgaggttcctccttgctttggggagaaaagtattcaggaagtgggtgtgtgggaaacctgaagatggcgtgcacaggacacagcgtggtcggcctgggcagaagggcggctggctgtcctggagctgctgctggagcctgccctcagagtgtccctttccagtgctgtggcattctgtggcagcttccccaggtgtggtgacggggggggcggggcctccacctgtgacagycaggcttgagggtggacggcgtgcctctcccaggagccttccccatgtccttgccttgctgagaattgccctcccatgccgctraggtgttaggtggtttagggccaaaaggggaaaaccacttgagtcttgtggtgtgtggtgggcagacaccacagggtggcatcacctggtggcatttccagaacctcagccccgattccagcacccaccaccgcctgaccctgtgtaacctgctgtcccgggtcccagagtgcactctgccccrctgctctgctgcctgtcctgggaaagtakctttgccccactaggaaatgtaaacaggagggcttggggagcgtgggcacttttctcatgagcagctactgcggcgttggcaggactcgctgctgctgctgctgcttgtgtaggtcggggagccrgagatccccgaggacgcgcgccggacagtcggcactgaccggcccacctggtagcagaggacacccccagccccccaagcattgaagacatagtgtatttcctcgtatcctttctcccttgggtgtagttggggtggggaagcagggaaggctggtgcgatctccattccttgggctccrcgtccgagttcatggtgcgccgctgtgctgggagctgcagtggkaatgtgtgggacaccttgaccaaaggggagctttgtctcgtgtgttttgaaaaaggcttaatgaagagaatgttgttcattcttagtagtatagtttgcaattcttaatggcaaataataagtttcagtagaaaacaaaaaaaaaaaaaaaaaaaaaaaa

SEQ ID NO: 5526 - DNA, 625 bp, Homo sapiens
  misc_feature (17)..(19): n equals a,t,g, or c
  misc_feature (44)..(44): n equals a,t,g, or c
  misc_feature (365)..(365): n equals a,t,g, or c
cagtaagggaacgttcnnnttttcgttctgcaaagttttcaagncgagttttcgaggatgaaagcatgaggcgcttgcagggggtcctcggaaccaggtgccactcctcggcctgacggggagccccgccccctcccgggtctccactgtgccmcaggcatgccmaccccactccccmacagccctcttggcctgaggtcccttcggagggtgggttggcctgtgaggaagggacgtgtgggcagggcctggggatgggcagggctgtgtgaggagctccagccacaggctcccccatgtcatgaaagcaaaagggggcggggagcggtggctcatgactgtaatcccagcactttgggagggcnaagcgggcagatcacgaggtcaggagtctgagaccagcctggccaacatggtgaaaccccgtctctactaaaaatataaaaattagccgggcatggtggtgcgcgcctgtagtcccagctacacaggaggctgaggcaggagaatctcttgaacccaggaggcggagcttgcagtgacccgagatcatgccattgcactccatcctgggtgacagagtgagactccatctcaaataaaaaaaaaaaaaaagggcggccgc

SEQ ID NO: 5527 - DNA, 804 bp, Homo sapiens
  misc_feature (705)..(705): n equals a,t,g, or c
  misc_feature (766)..(766): n equals a,t,g, or c
taccggtccggaattcccgggtcgacccacgcgtccgggaatgagagtggtgtcaggtactttgtttatccactttctggtcttgatattttgattgtttgggtgggtgtttagtagtatatttggttttttggtagagtcaaaatggagtggtggtactgaagatagaatagtgcacggttccactcatcttcccctgagatctgtgtgcatttatgaagtttacaaaatggtagtcgtgatattggaattttcacttgtagaaaaaaaatgctgtgttttccaaatattttgagaggtcatcatagttaaggaaaatctgtctgttcccatatctctttttaataccaagtttatcagttatcagcattgaatagttgttcctccattttttattcatttatccaacatgtcttgagtgactaatattctgcactaatatgtgcagaagatttttttaaacacatctaaatattttttgctttgccacaattaaaaacagtgactattagctgtcctgtctctttcttacctttgacctcttacctctctccagcaaagatctcttctttacaaaaacttgtacctgaccctgctattctcactttattttattttccctattatacccataagaaaactgaggcttaragagtttaagttacttaaccaataccacaagtcagaggcagaagcaaaattcanmcmcagataatcttgcatctgagtaawgktcttacctagcactctaractgccttmagcangtggaccaagaaagaatgaagccagtgcccaaaaccct

SEQ ID NO: 5528 - DNA, 362 bp, Homo sapiens
  misc_feature (11)..(11): n equals a,t,g, or c
  misc_feature (73)..(73): n equals a,t,g, or c
  misc_feature (75)..(75): n equals a,t,g, or c
ttgtgctttgnggtttgaatttttttttttttttttttttttgagatggagcctgggcaacaaagcaagactntntcaaaaaaaaaaaaaaaaaaaaaaaacaagtgttggcaagaatatggagaattggaaccctgatacattgctggtaggattataaaatgatacagccattctagaaaacagtctagagttcctcaaaaagttaaatatagaattatttaacttttgaccaaatgacccagcagttccactgctacgtatataccccaaagaattaacatatccatataaaaacttgtactccagtgtacttagcagcattattcataatagcaaaaaaaaaaaaaaagggcggccgc

SEQ ID NO: 5529 - DNA, 763 bp, Homo sapiens
  misc_feature (1)..(1): n equals a,t,g, or c
  misc_feature (760)..(760): n equals a,t,g, or c
natagcttttgcaaaagctatttaggtgacactatagaaggtacgcctgcaggtaccggtccggaattcccgggtcgacccacgcgtccgggcagtgtggttcatgtcaggaaccttagccagagctctgtacctcctttggcctaggccccactccttggaactttggtcaacacacaaatgacagcactgatggctttggtcatgcacaggcttgcactttatgtgtgtgtcctgtctaccactgcagctctgagaggcagggatgaggctctgggaggagaagcagcctgccttgtggtcttctggggtccacactcacatgacattgaaagacaaggacaagaaggcacaggcttagatttgagacttgcccctcagtgtgcaaaggactcagtgaccgtttctcgttcctgctctgtgtgagaccctgtttcacctggtctaggcttgtagacaggtgggcattccaggcttgaggtgcggtgaccaagcagtggtgacagctggcccttgaggccagggcctgtacctgtctggttctttaactagacctctagcacctaccaaggtgtgagtggtttcccaaaaatcgattgattgacaggatcttgctctgtcacccaggctggagtactgtggtgtgatcgtactacttgggaggctgagccagaggatcgcttgacctggartgragctgatgaccttgattgacatgatctagctggarcagaaggagcccattcttttwaaaaaaaangta

SEQ ID NO: 5530 - DNA, 853 bp, Homo sapiens
  misc_feature (773)..(773): n equals a,t,g, or c
  misc_feature (830)..(830): n equals a,t,g, or c
  misc_feature (845)..(845): n equals a,t,g, or c
gacggatcaccctccgctccaacatggctagtcctcaacgcgtgactcaagcctgttgtgccagcaggcgcactcagcagcgaccctcataggtggcgaaggtccgcgagagggttccgccagctagacagtggagtgccgcacagcgcgccttccagcctcgcagccgccaccctagcggttccgacccggcgccacaggcctgcttggtcgatcttcgagccaaagatgcggcgaggctggaagatggctctgtctggggggctgcggtgctgccgccgggtactgtcctgggtgccagtgctcgttattgtcctcgtcgtgctctggtcctactatgcctacgtctttgaactctgcctggtgactgttttgagcccagcagaaaaagttatttacctcatactctaccatgccatctttgtgttctttacctggacctactggaagtctatctttacactcccacagcagccaaaccagaagttccacttgtcctacacagacaaggagcgctatgaaaatgaagaaagacctgaggtccagaagcagatgcttgttgatatggccaaaaagctaccggtttacacaagaactggaagtggagctgtacgattctgtgaccggtgtcatctgatcaagccagaccgctgccaccactgctctgtctgtgctatgtgtgtgttaaaaatggatcatcactgcccttgggttaataactgcattggattttccaactacaaattcttccttcaattcttagcttactctgntctctactgcctgkacattgctacsacagtcttcagctatttcatcaaatactgganaggggaattacccantgtcgctt

SEQ ID NO: 5531 - DNA, 668 bp, Homo sapiens
  misc_feature (31)..(31): n equals a,t,g, or c
  misc_feature (36)..(36): n equals a,t,g, or c
  misc_feature (53)..(53): n equals a,t,g, or c
  misc_feature (82)..(82): n equals a,t,g, or c
  misc_feature (653)..(653): n equals a,t,g, or c
ccctggcctagaaatccaattttggaatttnggtancagttaaattaaagccnaatttttttttggttccttcaattccccntccccccaatccatgaaagcctaatggtaaaaatatatcttttcattcatcttatcaggtaaaaggaaattcagaaaatttccttagagtctttaattcccccacaaagattattaatcacatatatagggcctttttggtgttgaagggaatcaaactacatttgctgcttgtgtgcgtgtgcatttgtgaacacgtacagcatatctatacaaaattctgctatagtgtgaaaatcagggctaaaaacctgaagcctttgtttaattatgcttttcctctaaatagcaacttaaatatttgctagactttgaatcatcgctatatcaagtatctaaaatttgggagggtgaatcagtacactgtgaccaaggtcctcaaattggaatttgaacaacaatgtaaaacctgttctgtcacaaatgttcctgaaagcaccacagctactcaagaagatcaaatwmaggacataaactttattgaacataataaccagtgttttttaaagacttttttgtcagggtgcagtaaaattctccaattacttttamaaaaaaaaaaaaaaaaaaanaaaaagggcggccgc

SEQ ID NO: 5532 - DNA, 835 bp, Homo sapiens
  misc_feature (204)..(204): n equals a,t,g, or c
  misc_feature (781)..(781): n equals a,t,g, or c
ccgctcagaggaagagtgggtatgtctgctgctgccctccgagagaacctgtgcacattcctgaagcccctcctagctcctgcaggcctagtttggtgggtggttaagctgggctcaaatacacatattcccagtgtggctttaggcgggctttgtacatctgctaagcctcagttgcttgtttgggaaatggaatgataatancaatatctcccttttggtgtggctgtgactgtggggctttaagagcacattccaggaggcagattgcccagccctgtctatctatgtggccttgggccagtcacttaagctgtccgggcctcagtttccttgtgtagaacgggacagcgatatgacctmcctccctragttgttgtraggatccagtgagtttttatgcataaagcacttaaagagttcctggcatraggtcagcaccatgtaagtgttggctattrgccaatgtttggagatcactttcctctgccttggctcctaataagctcttggtgaaaggtagttgttatttttaacttcttcgttctccttcactgtcttaattcccaccttcatttagccttgcaatttcctttaaataccttatcttctcccctcgtttgttgtcaatctgctgcactaccaataaaggcgtgcataaattatatttgtcccatgtttacattcataaaacatttcccatgcactcctgtcccaacctcacagcaaacgcgtgagcgagcagtgcagctcatgtcattgccctcattttgagagcccnggacagggtgtgatctgtccagaagcatcacctgctcaggggtgtctccaagcc

SEQ ID NO: 5533 - DNA, 516 bp, Homo sapiens
  misc_feature (2)..(2): n equals a,t,g, or c
  misc_feature (7)..(7): n equals a,t,g, or c
  misc_feature (82)..(82): n equals a,t,g, or c
tntgaanacattcacactgggagggcttaaaactctgctgcttgaatcctgtgctagggcccgcaaggaagaggaagaggancytgagaaatcggggtgcacgtgggggctgcaggtgtcattccagggctgcactccacccacatccccatgcctcctgtttcacggcccactctgttactgaactggtggccctgggcacaggggggcacccacacactctgatgcccactgcagagggcagagccacacacccctccagggactaggcacatacacccttacttctgagagtaacgtggctaggctcaggagtgtaggagggcgttctcccagcatatggtgatcatatgttaagaattattattatgttggtcaggtgcggtggctcacacctgtaatcccagctactcatgaggctgaggtgggagaatggcttgagccaagattgtgccactacactccagtctgggtgacaaagtgagaccctgtctccaaaaaaaaaaaaaaaaaaaa

SEQ ID NO: 5534 - DNA, 733 bp, Homo sapiens
  misc_feature (721)..(721): n equals a,t,g, or c
ccggaattcccggtcgacccacgcgtccgcgaagtgctgwtttctaatgactctgtgcttggtcactttcctcaccagtctcccaacgagcgtgcccgcttgtacttcctgctggcctggtttcatgcgatcatccaagaacgcttacgatacgcaccactggggtggtcaaagaagtatgaatttggagagtctgacctgcggtcagcttgcgatacggtggacacgtggctggatgacacggccaaggcaagtgtgggccatgccaggacagacagtggacgtgtatctgggaaggatgctgcagggcgtggtgctgagaggccagactctgcgtggaagagcgagstgacccctcgtgaccgccaaagcctagctggccatggggagtgaggaggaaagctgtgcccctcgaaaggaagccccgggcctgcccgcctctgaccacacacacgaaccctgcttttcctcccccagggcaggcagaacatctcaccggataagatcccgtggtctgcactaaagaccttaatggcccagtccatttatggcgggcgcgtggacaacgagtttgaccagcgtctgctcaacaccttcctggagcgcctgttcacaaccaggartttcgacagtgagtttaagctggcatgcaaggtcgacggacataaagacattcaaatgccagatggcatcaggtatgctgctgcctgctggaatgganacaggttgtgat

SEQ ID NO: 5535 - DNA, 495 bp, Homo sapiens
  misc_feature (11)..(11): n equals a,t,g, or c
ctctgtcagcntcggccttcctgccagtctccagctgctcctagctccactccgaggggaggcagaggaaagaactggctcttctctgcagcatcaactcagttctagagaaaaggcttgatatttatgtaaatgagcctagaaataacatttagatgttcatctcatattgaaaagcagttactggctgggcacactggctcacacctataatcccagcactttgggaggccaaggcgggcagatcactcgaggttaggatttccagaccagcctggtcaacatggcaaaacctcgtctctactaaaaatacaaaaattaggtgagcatggtggcaggcacctgtaatcccagctactcaggaggctgaggcaggagaattatttgaacccgggagatggaggttgcagtgagctgagatcacaccattgcactccagcctgggtgacagagggagactccgtttcaaaaaaaaaaaaaaaaaagggcggccgc

SEQ ID NO: 5536 - DNA, 944 bp, Homo sapiens
  misc_feature (889)..(889): n equals a,t,g, or c
  misc_feature (896)..(896): n equals a,t,g, or c
gaaaaagtacaagcccctctcaaatggttcaagtttcaaatattagacccacccatggcaaagacagattttagtataatactcctaaaactacactgtcttttttttttttctgtcataagtgtgcattgtgctcagtcatttatttcagtgacccaaacagagcccagtccagctgtttgtattttccctgcagtgggaagtggactagggccatgtgactaagaaagccagcctgggggctgtcttttcacctacagatgttttaatgtgcttaacattatccaatactagcaaccgagatagtctaaataccacagcaggatctgattagctttttcagatcactgcctttatttgctgtttgcaaaaaagcttaatccagtgctagagatcaggcttcctgctgagccctggggtagtttctctcattctttgtgttcacagtggcaggcgttagtgagcagattcctcctcctcctaaattaaagctgtaaagtagtaactgtagtagcaagggataaagagaaggaagaaaacccaagggaaaaaagaagactgtctattcataccaagtagtttccttgatatacacaaaagaaagagtttctaatatgaattcataaatactgacctcagtgtctcttctactcagtgcacagctattaagttttattaggtttcagttgtaactactttgtgtggatatatgttacgtttttcatatttatcctactcaatcaatctcagttttaccagaagaattacatttattagccataacagtggcccttctcttattcttttcagggctgatatcttttttattcatgagatttcaaaaagaactatcaccaccactaacaaaaaaaaaaaaaaaaaaaaaagnacggccnctctagaggatccctcgaggggcccaagcttacgcgtgcatgggacgt

SEQ ID NO: 5537 - DNA, 1551 bp, Homo sapiens
ggccggaggtctccgggtggtatcgccctttcctctttgccagcccgctggcgagccgagccagggcaagatgaggtcgtcctgtgtcctgctcaccgccctggtggcgctggccgcctattacgtctacatcccgctgcctggctccgtgtccgacccctggaagctgatgctgctggacgccactttccggggtgcacagcaagtgagtaacctgatccactacctgggactgagccatcacctgctggcactgaattttatcattgtttcttttggcmaaaaaagcgcgtggtcttctgcccaagtgaaggtgaccgacacagactttgatggtgtggaagtcagagtgtttgaaggccctccgaagcccgaagagccactgaaacgcagcgtcgtttatatccacggaggaggctgggccttggcaagtgcaaaaatcagstattatgatgagctgtgtacagcaatggctgaggaattgaatgctgcattgtttccattgaatacaggctagttccaaaggtttattttcctgagcaaattcatgatgttgtacgggccacaaagtatttcctgaagccagaagtcttacagaagtatatggttgatccaggcagaatttgcatttctggtgacagtgctggtggaaaatctggctgctgcccttggacaacagkttactyaagatgccagcctaaaaaataagctcaaactacaagctttaatttatccagttcttcaagctttagattttaacacaccatcttatcagcaaaatgtgaacaccccaatcctgccccgctatgtcatggtgaagtattgggtggactacttcaaaggcaactatgactttgtgcaggcaatgatcgttaacaatcacacttcacttgatgtggaagaggctgctgctgtcagggcccgtctaaactggacatccctcttgcctgcatccttcacaaagaactacaagcctgttgtacagaccacaggcaatgcaggattgtccaggagcttcctcagttgctggatgcccgctccgccccactcattgcagaccaggcagtgctgcagctcctcccaaagacctacattctgacgtgtgagcatgatgtcctcagagacgatggcatcatgtatgccaagcgtttggagagtgccggtgtggaggtgaccctggatcactttgaggatggctttcacggatgtatgattttcactagctggcccaccamcttctcagtgggaatccggactaggaatagttacatcaagtggctagatcaaaacctgtaaaggagcaaaacttccagaagcctcgagcccctcttgacctcctacacctgctttggaaagacatgcactttttagtygactaattcttcctcccattcccctctacttgcgagttatggaatttctattccataactgaagtctttatgataacctaatttttaaaaatgaatttgactaacttaagtgcaaaacatgtaaatttggttcccagagtgggccaatactctctgttcttgttatcttaaccaacta

SEQ ID NO: 5538 - DNA, 1540 bp, Homo sapiens
tgcaggtaccggtccggaattcccgggtcgacccacgcgtccggccggaggtctccgggtggtatcgccctttcctctttgccagcccgctggcgagccgagccagggcaagatgaggtcgtcctgtgtcctgctcaccgccctggtggcgctggccgcctattacgtctacatcccgctgcctggctccgtgtccgacccctggaagctgatgctgctggacgccactttccggggtgcacagcaagtgagtaacctgatccactacctgggactgagccatcacctgctggcactgaattttatcattgtttcttttggcmaaaaaagcgcgtggtcttctgcccaagtgaaggtgaccgacacagactttgatggtgtggaagtcagagtgtttgaaggccctccgaagcccgaagagccactgaaacgcagcgtcgtttatatccacggaggaggctgggccttggcaagtgcaaaaatcagstattatgatgagctgtgtacagcaatggctgaggaattgaatgctgcattgtttccattgaatacaggctagttccaaaggtttattttcctgagcaaattcatgatgttgtacgggccacaaagtatttcctgaagccagaagtcttacagaagtatatggttgatccaggcagaatttgcatttctggtgacagtgctggtggaaaatctggctgctggcccttggacaacagkttactyaagatgccarcctaaaaaataagctcaaactacaagctttaatttatccagttcttcaagctttagattttaacacaccatcttatcagcaaaatgtgaacaccccaatcctgccccgctatgtcatggtgaagtattgggtggactacttcaaaggcaactatgactttgtgcaggcaatgatcgttaacaatcacacttcacttgatgtggaagaggctgctgctgtcagggcccgtctaaactggacatccctcttgcctgcatccttcacaaagaactacaagcctgttgtacagaccacaggcaatgcaggattgtccaggagcttcctcagttgctggatgcccgctccgccccactcattgcagaccaggcagtgctgcagctcctcccaaagacctacattctgacgtgtgagcatgatgtcctcagagacgatggcatcatgtatgccaagcgtttggagagtgccggtgtggaggtgaccctggatcactttgaggatggctttcacggatgtatgattttcactagctggcccaccamcttctcagtgggaatccggactaggaatagttacatcaagtggctagatcaaaacctgtaaaggagcaaaacttccagmagcctcgagcccctcttgacctcctacacctgctttggaaagacatgcactttttagtcgactaattcttcctcccattcccctctacttgcgagttatggaatttctattccataactgaagtctttatgataacctaatttttaaaaatgaatttgactaacttaagtgcaaaacatgtaa

SEQ ID NO: 5539 - DNA, 341 bp, Homo sapiens
  misc_feature (51)..(51): n equals a,t,g, or c
  misc_feature (54)..(54): n equals a,t,g, or c
cctgatatctcccagtatcatgactcaacagtgccccaaagcaactcagcnccnccgaaacctcacacatggatgtgactcgccacccacagtgacaggcacagccaagtctgatttaggaagatgttttcaaagcagagtaactcgcaactttcctggatcatctctaaaccaaaaacaaattagggaatcagttttgccacctgctgaaggtgaactcgcaggtgaagccactctgaaaccttctcaggtctgagaggctccagtgccccaggagggcatcccatctgccaggaggtgcccagaagatgctaagttgtctcaaagccaagggcaaaagg

SEQ ID NO: 5540 - DNA, 804 bp, Homo sapiens
  misc_feature (20)..(20): n equals a,t,g, or c
  misc_feature (74)..(74): n equals a,t,g, or c
  misc_feature (795)..(795): n equals a,t,g, or c
ctgattggccacasscagtntggcgcctctcagtgtcagcaggcccaggtttctaagtatagaccccatgcagncccgtggctsctagtaaatccctggataccatttgatacctaactggccctgagctgccggcttacccagcatggcctgtgacgccagcctctgccagctgctgggggagggggtagcacgttgcccaaacccatcctcaccctccactggagagaatggagaccagcagtctcctgctaatgacatgactggattgtcacagactgggagtgacctcagcactcaactggccctgctctccaattattatcagaaagaataacttaatcccacctactggagaacatatctcctggtttgagagagacaggcagaggcagggagccaatgatctctgatgctgtcactctgctcctcattcctgcatccccacctgtgtgcacccatgctaaccctgagacttgtcggagctgggactgggcatctctcaagatggattgggcatctcctatgatggtctgggcatccatgtcttccgtttttggtttgtagttccatattttgktctttagacagaagctggggtgggcagtaattccttggaggcagtacggactyccagccgggttcttcagaactttggggtatgggcagagagaggggccytttgcccttggctttgagacaacttaacatcttctgggcaccttctggsagatgggatgccttctggggcactggarcctttagacctgaraaggtttcaaarggcttwactgnagttacctt

SEQ ID NO: 5541 - DNA, 1081 bp, Homo sapiens
  misc_feature (14)..(14): n equals a,t,g, or c
  misc_feature (46)..(46): n equals a,t,g, or c
  misc_feature (64)..(64): n equals a,t,g, or c
  misc_feature (89)..(89): n equals a,t,g, or c
  misc_feature (582)..(582): n equals a,t,g, or c
gaccggtcctgggnagctttcctttcttgattaagttaccattggntctcagagccagttgtanagttggaaagttgggccctttgttnccagggtgggcccctcactgagaaagcctggtcccctgaagtacttgctactggggcctgcatcctcccccgtttgcctacagaaataaagttttagatgtcactcactgatcagattaaccttggaaggcatcagattcttcccatggggtctccgcgcttaggcctggaagccccatgttcctcatggacataatttgttttgtttgcacagatttgaattagttatcaccatgtaaaagccagccatttaaaaataaaaattcagatttctttaaaaccagaagttctggtgcccctccattgcctgcccctttccccaacaccaagggaggaaagcgggggttttctgtttagcattgccattgctgccgttgggtttcttgttcagtaaaaaggcagagaagtgtgttaaatcaagtttagcctagagctacctccttagatattttaagttcagcctaaaggtttttctgtatatcatgaactatancaagtggaggtataaaaacactgtagactgcacttgtgccaatcaaatgtagccaactgttcgaatcttgttcaaataaggcaaaggagctgtaaccaatccagctgtttctgtacctcacttctattttctgaaagtaggtagaaattaatttacttcgaaaaaaataatttcccctgaaaggtagctgctgtatcccaaggctttgccaggttaacaagtggacagcatggaatatttggaggaggtttggaatcgtgcgcacgtgggtttcaattctgctcagccacttgttaagctgtgaagtctctgagcctcagtaagatggacttaactccatctacttgcggagttgattaaagataaaataatgtatacaaagccctaggcatattgttctggcaaatagtttgtaataataaatgtagttactttgagaacttgaaacttggtatgggtgaggaggagatgaataaaaaaaaaaaaaaagggcggccgc

SEQ ID NO: 5542 - DNA, 235 bp, Homo sapiens
gatacaacaccagcattttaaaaatttctttttgtctgttcagacatgataacttttctgcccatcatattttccattctagtagtggttacatttgtwattggaaattttgctaatggcttcatagcgttggtaaattccaccgagtgggtgaagagacaaaagatctcctttgctgaccaaattgtcactgctctggcggtctccagagttggtttgctctgggtgttattat

SEQ ID NO: 5543 - DNA, 1096 bp, Homo sapiens
  misc_feature (33)..(33): n equals a,t,g, or c
  misc_feature (47)..(47): n equals a,t,g, or c
  misc_feature (57)..(57): n equals a,t,g, or c
  misc_feature (253)..(253): n equals a,t,g, or c
  misc_feature (887)..(887): n equals a,t,g, or c
  misc_feature (969)..(969): n equals a,t,g, or c
aggttttaaaaattcccatggaaattgaaattnccaccatgggcttncaataatttnttgaggaatttttggccatattttgaataatctgccagttccatatgaaaaaccaaagaagagtatgttattggccaatgttcttaagtttttcaccacacacatacacacacatacatacattttttagactaggttaaagatttatctaggtatatgtttggaaattattcatacacatacattacagaaaacncagtaagaaatataaaatgtttcatacaccaccagtttgttttctgctagaagacacacaatgcccctcttctgaatctatggagatgaaggcttctctcctttcacccagtacgtcatttgccacaaaactgaaagataagtctgctttagcttcttgtttccccaaatcaggatgaacgggtgggctgaagaacagctgaatccaatagcttggcagaacatgaagacaggtttgttttccagattcttaaaactccaaactgatattattacagacacaaagtaaatggcacataacaagaggaaggagatcacagtttgcaaaacttttatgtggaccttggtactgggatcttgagatcctttgccatggaggtgcatcttcttgagatgtttacacagagaacagactaacagcagaaaagatatcagggttacagtaaagggtactaagtttgctagcatggttacagtcgtatctgaaaggtacattgcacgcctcaatttgatcttccaagtcatgtttccttcatattcttttgtccatacaatstgattcatgtttaccacaaaaagataacaagccaaaratagcaaaggccccaacagcatcaccagaatgacactcttanctstcctctttaaggcgaagaaaartaaggktggagaaattggcaatcttgagcaaataaaatatgctgaggctagtagcangccagttgctgaaatggcccggttactgcccagwtattataagcagtagttcttaattctacactacaaaaagctggattcaacacagttgaatmcaatttaataatacccccagagcaaaccaact

SEQ ID NO: 5544 - DNA, 1288 bp, Homo sapiens
  misc_feature (404)..(404): n equals a,t,g, or c
  misc_feature (1261)..(1261): n equals a,t,g, or c
  misc_feature (1263)..(1263): n equals a,t,g, or c
  misc_feature (1266)..(1266): n equals a,t,g, or c
atcatggtcttgattgctattatcggtttccatacgcagttagaaacatcatttcttccagcttttgaattaaagaaaagctgtttttgaagttgagatctgatgtaaattattttagtatttttttctaaggcacttctaagcccctgaattgctaattataycctcwtctyccwtttacaaaattccttctaaacttcagwtaagagaactcaawtcttctcttttctaaaaaaaaaaamctatcmatgtaaaaatagatagaaattatggaaaataattccagtgaamctttktggtaaatgttaaaatagtatctatgaaatctatgtattaattatgggatgtgccttaccattgtaattttgttgtcagtgatgaaagtgttttgacatattcattancaggaagttctattataagaaagaaatgtacagtcttgttcacagctaaattctatatgactacattaattcttggtgttatgaagttttaacaatgttatttaatgttatttaaaccttaagataaatcatccccacacctgatttatgtaattttttaatcatatatcttcctcagtacaatgtaagaactgtaaagaaagagatcatgtctgacttgctttctgttgactcccaggacctagaacccagcaccaagaatagatggccaaaaatgatactttaatgaacaaataaatgggtggctaaaatggataagttgatgtggtaaatcaatgaaaaggaaactcatcacaaaatctgcagttgcatgaattcccctgttctggtctcaggttgaggttkcaggcttatccaagcagaatccttcctcagaggaaaagtttggctattccacaattttaggggaaatatcacactagtgatatatatagtgatatatagtcacactatatatatatatagtgatatatagtcttgatgcagctgtgtcaggtgtctgaattggagacaaggtaaaacatcaaaattagatggcaccttggaaggctgaggcggkcggatcacgaggtcaggatatcgagaccatcccggctactatggtgaaaccccgtctccactaaaaatacaaaaaaattagctgggagtggtggtgggcacctgtattcccagctactcggaaggctgtggccagagaatggcgtgaacgtgggtggcagagcttgcagtgagccgagaccgcgccactgcattccagcctgggcgacaaacaaaaaaaaaaaaaaaagggcggccgntntanaggatccctcgaggggcccaag

SEQ ID NO: 5545 - DNA, 3319 bp, Homo sapiens
gtgacgccggggcagggccggaaggagtgcagcggctgccacggagctcgtagctgcagctttggaggagtaagcggcgtggtagcgaaggtcgccgaacccgcctggctagccggcgagttgagtggcgactcttttgaaacagatggtcaccatgtttagatattagcagtcccgtatgtgcatgtctgcatttgaaaatggaagagggaaacaacaatgaagaggtaattcacttgaacaactttcactgccatcggggacaagactttgtaattttcttctggaaaacccagattatccaaagagagaagacagaatcattataaatcccagtagcagtctgctggccagccaagatgagacaaagttgcctaaaataagacttttttgactattctaaattgactcctcttgaccagcactgcttcatccaagctgctgacctcctcatggccgacttcaaagtgctcagtagtcaggacatcawgtgggccctgcacgagctcaaaggacactatgcaatcacccgaaaggccttktctgatgccattaaaaaatggcaggagctrtcaccagaaaccagtggaaaaaggaagaagagaaaacaaatgaaccagtattcttacattgatttcaagtttgaacaaggtgacataaaaatagaaaagaggatgttctttcttgaaaataagcgacgacattgtaggtcctatgaccgacgtgctctccttccagctgtgcaacaagagcaggagttctatgagcagaaaatcaaagagatggcagagcatgaagactttttgcttgccctacagatgaatgaagaacagtatcaaaaggatggccagctgattgagtgtcgctgctgctatggggaatttccattcgaggagctgacgcatgcgcagatgctcacttgttctgcaaagagtgtctcatcagatatgcccaagaggcagtctttggwtctggaaagttggagctcagctgcatggaaggcagctgcacgtgttcgttcccaaccagtgagctggagaaggtgctcccccagaccatcctgtataagtactatgagcgaaaagccgaggaggaggttgcggcagcctacgccgacgagcttgtcaggtgcccgtcctgtagctttccggctctgttggacagtgatgtgaagaggttcagctgtcctaatcctcactgccgaaaggaaacctgtaggaagtgtcagggactctggaaagaacataatggcctcacctgtgaagagctggctgaaaaagacgacatcaagtaccgtacctctattgaagaaaaaatgactgctgcccgcattagaaaatgccacaagtgtgggactggcctcatcaaatctgaaggctgcaaccgcatgtcttgccgctgtggtgcccagatgtgctacctctgtcgagtttctattaatggatatgaccatttctgccaacatccccgctcaccaggagccccttgccaggagtgttcaagatgctctctctggaccgatcccactgaagatgatgagaagcttattgaggaaatccagaaggaggctgaagaggaacagaaaagaaagaatggagagaacaccttcaaacgcattggacccccgctggagaagcctgtggagaaggtgcagagggtggaggccctcccgaggcccgttccgcagaacctgccacagccacagatgccaccctatgccttcgcgcacccacccttccccctgcctcccgtgcggcctgtgttcaacaacttcccactcaacatggggcctatcccagccccgtacgtgccccctctgcccaacgtgcgggtcaactatgacttcggtcccatccacatgcccctggagcacaacctgcccatgcactttggcccccagccgcggcatcgcttctgatggccccgaatccccattgagcagcacaaagcccgtttggggtaggagtgtggatggagaaccctcccccaaggctggtgtctgtaccattgcatcctaagtcagcttgaagggtaggctggttttcttcccacccctttcctagaagggctactgctcctggaagagtggacggatccataataaagacgtcccaaatggtggagttcggagagagctgcgatgtgaactgcccctcscctcgcatcccccaggccaccaacggcagtccttctgccttgtccatggcataggccatagaccaggtccctgctgctcacacctgggcctctcctcggagccgacccctgggtagcaaggcagccgagagcatctccctggaggggcccacggttgggccaagggcagagggggctgcacctgcgggcctgggaagcattgctcagggtggggggctgggaccatggcccgcagaggcactgccacagctgtgagggccaagatgctgtccccccatccaaaacccgtgcgccactgcagtgagtgttgagggcacctctcctcccctcttacacctactcagatgaggcagcagcagacccatctcgcggcgggggttttgttctgttgccgcctaactttctcatcctcggtctctggaaagtcaggctgagaaatcctttcccaggccaggccgctgcggtacactggatggttctgaagctggcccattgaaagagcctcttaaggcagctgggacagaggcctggtggccctgctgggcagcccaactgctgggggagacgtttctsccaccctgggtgatgagcagcttttcccccctggctttctgggggaggagtgggcctccttagggagacaggtgaccctgggtgccacccctgccccgtgtgtgccccgggtgttctcagtggttgctgaaggcaggtagagggtgctgtccagtatcccccatgtgaaggtcacttcccttctcatggagtcagctgagcatcagctcagccctgccatgtccccactcaccctcctcgcctcctgtccggccctgggtttctagcggtgcctgaggcatcactctggcccattgacagatgagaggtctgaagccttcctggccacaggcatcactttctcctcctcctcatgccctgccttgtccttgtcgtgttgccatggggttctgagaggctgggagttcacagacctcagacacagctgagtccgacaaccattggggtggggctgcatcagtctccggagtggcccgccacctcctgaagcagggcctggcccacccaaggtgcctggggcaggcgggcaccgtcattcgctgccattggcttctcagatgtatttcaaggactaaagtgggctctaaga

SEQ ID NO: 5546 - DNA, 2114 bp, Homo sapiens
ccacgcgtccggccagatgtactgctaccccggcagccacctggcccgggcgctgacgcgggcgctggcgctggccctggtgctggccctgctggtcgggccgttcctgagcggcctggcgggggcgatcccagcgccggggggccgctgggcgcgcgatgggccggtccctccagcctcccgcagccgctcggtgctcctggacgtctcggcgggccagctgcttatggtggacggacgccaccctgacgccgtggcctgggccaacctcaccaacgccatccgcgagactgggtgggccttcctggagctgggcacaagtggccaatacaatgacagcttgcaggatcctgagcctgctggcggccagcggtcccacgtgggaccaggtgcccccgttcagtggagcacctcgcccttcagcggcctgctgcacatgggccagccagacctctggaagttcgcgcctgtcaaggtttcatgggactgaagttctgtccctgctctgctgctttcgcccctgctgaccctcgtcagggtcacccccgtcccaaggccaccggacttctaactccagcccctcctgggggcttcgttctctgatctggggtctgagtcatctcctcctagagtgggtcacgaacctgatggggctcagaactgaccccctctctcccccgaggtgggtgggcaccgtggcgtctcttctgccctgccctaaatctcccactctctgtttctgtctgtttcctactgctgctctctcaacctcattcccacctctggggccccttcctcgtgcttctccttcctgagggtttgggaaggtcctggggcagactctggggctcccatggggtggaaggagcctgttccagcacccttctcccagctgcattcccacgggtggccctggagctggtgagctttgtctgggcgttgtcttcggctggcattgctcctcccagctctggcccctctgctccctcaggaagcagtcccctcgtctccctttctgggcagcttccttgaggacagaaacttgaaaacaaacacaaaccaaagtttctggccatctgtggctggagggttctgaatgtcctctctccatgtcaggcagagggtcagcccccatgcttctgcctcaggccccaccccaccccaccccaggcctgcccctcacctcagggccatacccacagcgccctgatggaggaaccagaccgcaggctgtgccaccattaaacaagagcggctgtggccccatgctgtgcttcttggggtggcagggaaggtggggtcagcgctttttctcctctcaggtttgggttctgcgccatcccccatgcagcctcctgtgcagccctctgtctgtccttctgtccattcattcatctgccaacatactcagcctcccaaagtgctgggattataggcgtgagccactgcacctagcgatttttttccttattctcagtctggaggctctggagggatgagtgacccccgcttgcctttggtttcctgaaccagctacacagtcagactgtcctgggaggatggatggattttcggatcactgggattgagtgagatactgcagtactgagaaactagtcttgggcatcacttcagtagaatttcagctgacaatatgatgaatcattccaaagcctgtgttgccaggctgacctttcagaatcccaggagggtcaagcatcttgatttggggttcccagattaacggtgcggagagcactggttggcacagggcctccaaaagctttaccacctgttccagaaccaggaggaggaggctttgacgatggaggggtgagcatgtagggtgcagcaggagaacagtgttccatagtggccaggagctttgaagactacattcttcatccccactccctgagtgttgactaaagttagacttccgtcttctgtaggttgttagttgcacttggggcttgccaccattttgatacctagatgagcactggttgactccaaattccttggctcagagagtgctgtaaactagtggttctcaaatgaagattgcctggacccagaaagcactaggaaaaaaaaaaaaaaaaaaaaaaaaa

SEQ ID NO: 5547 - DNA, 1236 bp, Homo sapiens
  misc_feature (5)..(5): n equals a,t,g, or c
  misc_feature (7)..(7): n equals a,t,g, or c
  misc_feature (69)..(69): n equals a,t,g, or c
  misc_feature (71)..(71): n equals a,t,g, or c
  misc_feature (843)..(843): n equals a,t,g, or c
aactncnttaagatactctccccttcggaggtgagaataacgaaagtgtcagtgagtaatccaatgtcntncatttgctcaccagacagaaagaccaagagttcacctctcctgcctattagtccagtgctcgggtggcccatgagttcatgttggccctgtcagaccaaagacagtaatgaatattaaacccagaatgcaccatattatcaggccttttttgtttttgttttctattagtaacacaggtagaagaggaaacaactaaaaccccaacattagaggctcaccatccccaccttctggcccaccactggcaatgaacccaagcacaggtcactgtggtctcatgaaagaaaactgatgtgggggttgggtgggcttcagggtgttgactgccatcttcccctccagcacctgaaaagctaagttatggtgtgaagtcagaaaatgtggaatctgcaagcctgtctttaaaaaacaaaaaaactcatagaacttggactttaatcataaagatcattttaccaaagcatattttttaaaggctgtgaaatattatgcaacgtttgcatggtttaattatgagtttagaaaascctagcacgactttttcactacagtaaaacatgacggagcatgaatcatggcatagtactttatgcttagtgtggctttagacatggggttagaggtgtgaggctgtctacacaacaaggcgtgaattactgtactgcagttcacaccccggggggctttatgacagttctgaaacctctttkgtttgcttttaaaatgattaaagtattggagtactatatattcacttagtaaatgtgtgtntctagtatatacgcatgtcttatacaaaatatctaagtatatgatttttttttcacttggagcaaaatacttgcagtagcatggggatattgaaccgtctgctatttctgtttgcctttagtcattggaaacactgttagctgtaagattacacaggagcttcagccaaggttgaacatttattttctgctgagtttaaaatggaccagctccttttgttccttgccagctctttaaatcctctaaaatttggaataaaatgaagacctttctttaatattagatttcaaagattccaagttaaactatttgcctgggaactaccaggttttttaaacttaaaaaatcagttattttcactcacacacaaaaaaaaaaaaaaagggcggccgc

SEQ ID NO: 5548 - DNA, 797 bp, Homo sapiens
  misc_feature (16)..(16): n equals a,t,g, or c
  misc_feature (26)..(26): n equals a,t,g, or c
  misc_feature (751)..(751): n equals a,t,g, or c
  misc_feature (763)..(763): n equals a,t,g, or c
  misc_feature (781)..(781): n equals a,t,g, or c
gggcaaattaggcagntaatctagcngttagcccagatacagcccttgggcaccctagtagctgtaacttccagaaggcaggaaccttccattcactagtgagtccccaaaacagtggcccaagtgaagcaaaaatgtttgttgggaaatakgagygaatgammaagtaatttcatgaacatatgaatgaataaatgaatgaagcaacacccagtatgatgattaatgccacaggaagatgcctttccaagcatcacaagatcctgggatcttcactgactgtaagtgcctgtggggcagggaccatgttggtcttattcatcactctcctgccaggtaaattagcacattcctggcacactgtaaatgttcaataagcttttgttcttttagatggattgacttatcagaggcaactctttcaagaacaagtagccctgtgctctggagaatgatttacagtggttctcttcctcagcctggggccttttctggataactcccatcgtactctyctctacttcctcttcctagaatacacaaatttattattacaggcaccactcttcaccccacatctgattcttccctgactctgcttaatgtacaagtaaagcaaagaaatactgtgtaggacctattggaattagaatcctgctctgtcaccattggaaaggatttagggatcacctyccttcggaggtgagaatwaagaaagtggcargtgagtaatccaatggcacccagttgnttaaccaagacngaaagacccaagaggttnccttttctggctaata

SEQ ID NO: 5549 - DNA, 534 bp, Homo sapiens
  misc_feature (25)..(25): n equals a,t,g, or c
  misc_feature (36)..(36): n equals a,t,g, or c
  misc_feature (60)..(60): n equals a,t,g, or c
  misc_feature (64)..(64): n equals a,t,g, or c
  misc_feature (458)..(458): n equals a,t,g, or c
catcctagcaaagtattttttccanatatctttggnacacccacacttaagagaagtacnactntaaaagccagccctaacatagtgacatgaactttgacaacccatagaactcaaactgtacatgtgaatgaagttggcccgcccttctgagttaccaccatgagaatgacgtcattgccattgttcaaagcacttttgaatggtcatttatgagctatgtaataaaacctatttttttgccgggtgtggtcgttcaggcctttaccaaaaaaaattttaaaaattagccacgtgtggtgtcatgcactatagtcccagctacttgggaggctgaggtgggaggatttcttgaactgaggagttcaagtatgcagtgagctgtaactgtggcactgcagcctgggtgagagtgagagagagagagagaaagagagagaaaaaaaaaaaaaaaaggncggccgctctagaggatccctcgaggggcccaagcttacgcgtgcatgcgacgtcatagctctgtccctacgaagg

SEQ ID NO: 5550 - DNA, 643 bp, Homo sapiens
  misc_feature (514)..(514): n equals a,t,g, or c
  misc_feature (535)..(535): n equals a,t,g, or c
  misc_feature (568)..(568): n equals a,t,g, or c
  misc_feature (599)..(599): n equals a,t,g, or c
  misc_feature (607)..(607): n equals a,t,g, or c
  misc_feature (642)..(642): n equals a,t,g, or c
gcggacgcgtgggattgcttctctgatgattttcttcactctttatgactctccccacttcacagtgtctaatttgtctgctgcaggctctgtgtggcattgggcatggagccttggcttggggcagtaaccaagtgttgtttccagggggacagcaagaagatggaggatgccagcgcatacctgacccttccttcttatcgacaccatgtggaaaacaagggggccacgctgagcaggagctccagcagtgttggggggctttctgwcagctcccgggatgtgttctccatttccaccctggtgtgctccacaaagctcactcagaatggtaatcgggtcatcaagarttgtgtctgtggggartgtgtgtgtccgtgygtgtgtacatgtgtgtatgtgcttgcagacccaaggargtcctgatatggacagttaggccagtaatgatacttctgaatgtctggactctattttaatgggcttgctgggtttgctgaaatggcgtatgaanctcaactgctacaggaaaatntagaaaagttgaagattgtggatggagaagaantggtgaaatttctccaggatactctggatgncctcttcnacatcatgatggacattctcaaaatgatgaatatna

SEQ ID NO: 5551 - DNA, 600 bp, Homo sapiens
  misc_feature (18)..(18): n equals a,t,g, or c
taaggtttaggcccaggnattcccatgtgttttcaacaatggaccacatgctcagaagtccttgtgtgtgccagccctgtgagcgtggttgataaaactgatggcagattcagagggtcaacaccacacacatgtaaattagatagagctcaaaagttagtaaaagacatatggcgatgttgtgcaggccaatttgccccactctcmttacgatccatggtatttcataatgctccaatttratggcacaagtggaattaaatgaacagcttgtattgaatgacatgctctcttggccactgtgaatgccacttatgctaatgaagcccctggagtgtccaggagggcaggggactctgccatttatatccccaatgtctggaacaatggctgccacacagaaagtgctcaaatatctactgtctgaatgaatgaatgaatgaatatggctgggtgcaatggtgcatgcctgtaatcccagcactttaggaggctgaggtgagaggatctctcaagcctaggagttcaagaccaggctggggaacatagtgagaccctgtctcgacaaaaaattaaaaaaaaaaaaaaaagggcggccgc

SEQ ID NO: 5552 - DNA, 445 bp, Homo sapiens
cgacccacgcgtccgtggcaggcttccaaatttgccaaaattaagcgttcagtattttcaacacatacgctttttactggtttatactgaactatcggatgagaattcctgtgttcccaaagcaactgatgtttacaggtcttgtgtttctcctcctcctttctaaggatgagggaatccacaacagactttctctagaaaacactaatgatggacaactttttggtgtcatcaaatgagttggctactaccttgatggtaaaaatttgtaaggaaaattttcaccatttcgagtggtcaagtgtatttttaactgtctggtttgtacttttatgacttttgtactaccaaacgcggagttaaaaataaaaatgttaaacgcaaaaaaaaaaaaaaaaaaaaaaaaaaaaaaaaaaaaaaaaaaaaaaaaaaaaaaaaaaaaaaa

SEQ ID NO: 5553 - DNA, 1316 bp, Homo sapiens
  misc_feature (157)..(157): n equals a,t,g, or c
cctgcttctcatataagatgggcctgcacctacctctggcatgtttttctttgtgtatttcctgtttttcatcctgtaactaatgctcattatttaaaacactccagttacttttccctttaggcctggcaaacttttctttttctttttttttttnataactgtacattttacaaaacacctgaaaggacccagaggcataaatagtattacatgatttatggtagctctggggtgagctgtgggggaggccagttacaaggtctccaagacccgcctccatgtcagtgttggggggtgccttgagcacttcttttatttcatataggaaaatgcacatctttcatttgtctcccaaaagatgatttccataaaaatatacttcaaagtatttactgtacatagacttcaatgattttatttccagcatcaaactaaacatttctaaccttttaaataaatggggaatttagtttcatgagaatttttactgacaactaataaacactgtatgtgtacatattcatatacactgtggactggagaaagtcagtatggaaataaatttcactgagatccagaaagtagcaatataggacttttaggggtatgtattagtgtaaataatatatgtgcagtctaggctaatcattttaattaaaaacaaataagcatacttttttgctttaaaaatatgccctcaaaatggtgggggataaaatgtaagatattctttagctttaattatttttccatcttattcaagtcagagcacttttttttaaatagcaatacaacaggcaagagaatactcaaaaatatttaaaactgtattgataccaagagtatgttttaaatattttctaataaatacttgagcggtttttgtctggcaggcttccaaatttgccaaaattaagcgttcagtattttcaacacatacgctttttactggtttatactgaactatctgatgagaattcctgtgttcccaaagcaactgatgtttacaggtcttgtgtttctcctcctcctttctaaggatgagggaatccacaacagactttctctagaaaacactaatgatggacaactttttggtgtcatcaatgagttggctactaccttgatgtaaaaatttgtaaggaaaattttcaccatttcgagtgtcaagtgtatttttaactgtctggtttgtacttttatgacttttgtactaccaaagcggagttaaaaataaaaatgttaaacgcaaaaaaaaaaaaaaaaaaaaaaaaaaaaaaaaaaaaaaaaaaaaaaaaaaaaaaaaaaaaaaa

SEQ ID NO: 5554 - DNA, 579 bp, Homo sapiens
  misc_feature (553)..(553): n equals a,t,g, or c
  misc_feature (559)..(560): n equals a,t,g, or c
  misc_feature (572)..(572): n equals a,t,g, or c
taaatgctttcaccggtccggaattcccgggtcgacccacgcgtccgcagggggttgcctggtctgcccagctggtggggagctgggtgatgctgcacatatggctctaccgtgccttgctggagacccccagacgcgttcctttactcccgcagtgtgagcaggcggccaggtggctggtgtgggccagcatgcaggctggcaaaggcctggctcaggtgtggggcgtggcaacctttgtgcagctgtgtgcccacacggtcttcctgagcatgtacctgtgcatgcacatctgctttgccgccatcagctctaaggtccgtgtgagagtgaacgcaccgttctgtgtctcagtgcccttgaaggtccatgcccctctgagcctgggcatcaaagtggggctgcagggccagaagcatgggagagccacgggggaggcaggtatgcctcarggggagatgttggggaagcaggaaccccagacgtycagcagccccaagcccaccargagaagggaggtgtcacggaatgagctcaatccagtgatacccancgccgnnaacccctttttnaaaaaaa

SEQ ID NO: 5555 - DNA, 2373 bp, Homo sapiens
  misc_feature (70)..(70): n equals a,t,g, or c
  misc_feature (1830)..(1830): n equals a,t,g, or c
tataccgacggcatctccttcgaccctgccctcatccatgacaatgcctcatccacccaccccgaagagncctgctctcatgattggggcctgctggactgaggagaagaacaaagagaaggaaaaggggagacaacagtacagacaccacccaaggagaccctttgtcgatccaccactacttccatggctacctggctggtttcagcgtgcgctcaggtcgcctggagagccgcgaggtcatcgagtgcctctatgcatgtcgggaggggctggactatagggatttcgagagcctgggcaaaggcatgaaggtccacgtgaacccctcacagtccctgctcaccctggagggggatgatgtggagaccttcaaccatgccctgcagcatgtggcttacatgaacactctgcgctttgccacgcccggcgtcaggcccctgcgcctcaccactgctgtcaagtgcttcagcgaagagtcctgcgtctccatccctgaagtggagggctacgtggtcgtccttcagcctgacgscccccagatcctgctgagtggcactgytcattttgcccgcccagctgtggactttgagggaaccaacggcgtccctttgttccctgatcttcaaatcacctgctccatttctcaccaggtggaggccaaaaaggatgagagttggcagggcacagtgacagacacacgcatgtcggatgagattgtgcacaacctggatggctgtgaaatttctctggtgggggatgacctggatcccgagcgggaaagcctgctcctggacacaacctctctgcagcagcgggggctggagctcaccaacacatctgcctacctcactattgctggggtggagagcatcactgtgtatgaagagatcctgaggcaggctcgttatcggctgcgacacggagctgccctctacaccaggaagttccggctttcctgctcggaaatgaatggccgttactccagcaatgaattcatcgtggaggtcaatgtcctgcacagcatgaaccgggttgcccaccccagccacgtgctcagctcccagcagttcctgcaccgtggtcaccagcccccgcctgagatggctggacacagcytagccagctcccacagaaactccatgatacccagcgccgcaaccctcatcattgtggtgtgcgtgggcttcctggtgctcatggtcgtcctgggcctggtgcgcatccattcccttcaccgccgcgtctcaggggccggcgggcctccaggggcctccagtgaccccaaggacccagacctcttctgggatgactcagctctcaccatcattgtgaaccccatggagtcctaccagaatcggcagtcctgtgtgacgggggctgttgggggccagcaggaggatgaggacagcagtgactcggaggtggccgattcccccagcagcgacgagagacgcatcatcgagacccccccacaccgctactaaggcctacacctctccccacgcagagggggaattctgccctggtgaaacagacactccagacatgggagaaggactttctgggaacacagagaccaagagggagagaggcttcagaaccagtcctcctttcatttcaaaaccccagcgggccctctggagtccgccctgcccctcccccggccccccatccctcacttctgggctgtcatgctcctggtgtgccccttgcactggggctggctgggttggaaagtgggctggacttcagctgcctttctacccccaatggcagctgcccccttagcactcactgtgttggggagagggtgacgattgcaatggntggggctggggctggggctgggggtgggattgaaggaaaccctctcctctccccttcccttctctctcctgtccatgggaagcttttccccctctgcagggctccctcagctggaccatcgtccctgcttctcttatgatcgccccacctcatttccatttcagtctggggaccccatttctccctcctttccaacttccttcctttcttgtcctgtttcccttcctgcccttgcagtcctgaggtcctgcagccccggcccctcctccgtgacctggtgtggccaggctgcggggacgggaggggacgtgggggccccgggtgtacatatataatgtatattttttcaatgttgtcgtgagtgcagcccatgttcctgcgtgcagctcacggccttgtgtgtatgtgtgtgtgtgtgtgtgtgaggcatcgtcatgtcctggggcaggggcggggggttgggtgtggtgagggaggggacatatcctagggttttcaaataaaacaatcagaaaaaaaaaaaaaaatgccccccgggggggg

SEQ ID NO: 5556 - DNA, 1312 bp, Homo sapiens
  misc_feature (16)..(16): n equals a,t,g, or c
  misc_feature (18)..(19): n equals a,t,g, or c
  misc_feature (21)..(21): n equals a,t,g, or c
  misc_feature (25)..(25): n equals a,t,g, or c
  misc_feature (1162)..(1162): n equals a,t,g, or c
  misc_feature (1181)..(1181): n equals a,t,g, or c
  misc_feature (1275)..(1275): n equals a,t,g, or c
  misc_feature (1288)..(1288): n equals a,t,g, or c
  misc_feature (1291)..(1291): n equals a,t,g, or c
  misc_feature (1294)..(1294): n equals a,t,g, or c
gcggggggggaacggngnncnccantcggattcaagtggatggcggatgcccacagttcggccatcctgagcatgctccgtggggccccggacagtgccccggcacaggtgtgcacagcgctcagcctctgtgagccgctgcagaggcacctggccaccctgaggccactctccaaagaggacacctttgaggctgtggctccgttcatggccaatgggccccttaccttccacccccgccaggcgcctgaaggagctctgtgccaagactgtgtacggcaggtctcccgactccaggaggctgtccggtccaacttgaccttggccgacttgaacatccaggagcagtgtgagtccttggggcctggcctggccgtcctctgcaagaactacctcttccagttttttgtccctgctgaccaagcactgaggcttctccccccgcaggagctctgcaggaaggggggattctgtgaggagctaggggcacctgcccgtttgactcaagtagtggccatggacggggtcccctccctggagctggggttgccaaggaaacagagcgagatgcagatgaaggccggtgtgacctgtgaggtgtgcatgaacgtggtgcagaagctggaccactggctcatgtccaacagctctgagctcatgatcacccatgccctggagcgcgtgtgctcggtaatgcctgcctctatcacgaaggagtgcatcatcttggtggacacctacagcccctccttggtgcagcttgtggccaaaatcaccccagagaaggtgtgcaagttcatccgtctgtgtggcaaccggaggcgggcccgggcagtccatgatgcctatgccatcgtgccgtccccagagtgggatgcggagaaccagggcagcttctgcaatgggtgcaagaggctgctcacggtgtcctcccacaacctggagagcaagagcaccaagcgagacatcctggtggccttcaagggtggctgcagcatcctgccgctgcctatatgatccaagtgcaagcactttcgtcacccaatacgaagcccgtgctcattgagagtctcaaaggacatgatgggaccccgtggctgtgtgcaagaaggtggggggcctggcacggccccaagaccccacttgttgggcaccgaccaangtggcctggcccaagcttntggtgcaagaaccaagaaggccgccagctttggcaacgctttgcaacactggcagaaacatggatgggaaagagatgcccttcacccttggggnaacacgccgggancgnggnttggcaaaaaaacccaaa

SEQ ID NO: 5557 - DNA, 2620 bp, Homo sapiens
  misc_feature (20)..(20): n equals a,t,g, or c
  misc_feature (26)..(27): n equals a,t,g, or c
  misc_feature (2599)..(2599): n equals a,t,g, or c
  misc_feature (2609)..(2609): n equals a,t,g, or c
cgggggggggggggaagatnaagcannaatttacgtgacactatagaaggtacgcctgcaggtaccggtccggaattcccgggtcgacccacgcgtccggggtgtccgagggccacaagagtatgacggggctgtacgagctggtgtggcgggtgctgcacgcgctgctctgtctgcaccgcacgctcacctcctggctccgcgttcggttcggcacctggaactggatctggcggcgctgctgccgcgccgcctctgccgcggtcctagcgccgctcggcttcacgctccgcaagcccccggcagtcggcaggaaccgccgtcaccaccggcacccgcgcggggggtcgtgcctggcagccgcacaccaccggatgcgctggcgcgcggacggtcgttccttggagaagctgcctgtgcatatgggcctggtgatcaccgaggtggagcaggaacccagcttctcggacatcgcgagcctcgtggtgtggtgtatggccgtgggcatctcctacattagcgtctacgaccaccaaggtattttcaaaagaaataattccagattgatggatgaaattttaaaacaacagcaagaacttctgggcctagattgttcaaaatactcaccagaatttgcaaatagtaatgacaaagatgatcaagttttaaattgccatttggcagtgaaggtgctgtctgccggaagatggaaaagcagatattgtaagagctgctcaggacttttgccagtkagtagcccagaagcaaargagacccacagatttggatgtagatacgttagccagtttacttagttcaaatggttgtcctgatcctgatttagtaytgaagttcggtcctgtggacagcacaykaggctttcttccctggcacatcagattgactgagattgtctctttgccttcccayctaaacatcagttatgaggactttttctctgcccttcgtcaatatgcagcctgtgaacagcgtctgggaaagtagtggtcattggttgcataatttgatttgaggcttgtggaggaaaggaaccaagtgactctgatgtttacaaagcacctatgaaaccctgtacacacctagttcataatcctcataatttatcaacaaacacaaaaaagtgtcttacttgagagtgagtgtgtgtgtgtgcgtgtgcacgtgcacacatgtgcacgtttgtatgtatggaaataaacttataaatggggacgtattggagaaggaaatacatagacctacaactttgagcaaatagcagtgatgttttaggaactgaaatgtcacacttaaagtcttcagcccagctacttccctatttttgtggggagaagagggcctgattagaactgttctggttgtgtttggcgggaggggaataatttttgttcagtccttcttagtgaccaaactttaatttttaagaataatatattgacttactgaactgaagcattctgagttgaaaggagctycagaggagtggagttctgtgttgctcacatgttaaaatcttgctcaccttcagagcagagggaatacctatcttcagatatccgtccattttcatctcttaattgtagtcaaaagtatgacttgagagtgttgctctggtattctgggttctgaagtctggtattctggtattctgggttcaaaagtatgacttgagagtgttgctctggtattctgagagttgctctgtattctgggttctgaagattatttgaaaaataactcctactacattgaaatgcagacttaaaaatttaaacattggattaggcagtcaaaaaaaccaagcaagcataaaaggtcaataagttgtaatcttgatagtaaaggtggaaaactyattataaatggaaagaaagttttatttccttttttgtttgatgggcagtatgccatattatacccaaagttsktttaaaaaatayttccatcaacyatttttatttaaaataaacatttgagggaagttaccaaggcagcttttttcctcaaaagtaacctgttcctctttggaayagcacattttaggggcatggttaatacctgagatttttactcagtaaatcctgatggttacygtgtgtaaaatatctttaagtaggattgaaggcctctgtgggggaataaaatattaccaaagtctataaaaataaattttacatgttctcttttatgacagagagcagcactggttctgttatttttaaaatgaataattgatttcttgataggtgtttaatatttcttccctcactgctgattcttagatagaaaccattctttatatttgatagactgctttcagaaaacccttatcaacaagtgtacaatacttatctaaaactatacatttagaatggagcagtttaatactagatctcagaagttttgaaaaatagcaaagaagactggatttggaaagcatggtctacaattggttgttaaattctgaagctatgaagaataaatgtttcaactttggattatgaaaccccatttatgattttttaaatacacttgaaataaaaatgattaaactaaaaaaaaaaaaaaaaaaaaattnctgcggccgncaagggaattc

SEQ ID NO: 5558 - DNA, 804 bp, Homo sapiens
  misc_feature (798)..(798): n equals a,t,g, or c
ccactaggcttttgcaaaaagctatttaggtgacactatmgaakgtacgcctgcaggtaccggtccggaattcccgggtcgacccacgcgtccgcggacagcgtcagccccccaccctctgtcatcacccaggaaaacctaggcagggtgaagcgtctcggatgctttgaccatgctcagcggcagcttggggagcgctgtctgtatgtcttcccagccaaggtagagccagccaagattgcctgggaatgtccagaaaaaaactgcgcccagggggagggctctatggccaagaaggtgaagcgcctgttgaagaagcaggttgtgcggatcatgtcatgctccccagacacccagtgttcccgggaccattccatggaagacccagacaagaagggggaatccraaaccaagagcgaagcggagtctgccagccctgaggagacgcccgatggctctgccagtccagtggagatgcaggacgagggtgcagaggagccccacgaggcaggagagcagctgcccccattcctgctaaaagaaggcagagatgacaggctgcactcggcagagcaggacgcagatgatgaggctgctgatgacacggacgacaccagttcggtgacctcctctgccagctccaccacttcctcccagagcggcagcggcacgagtcgcaaaaagagcatccccttgtccatcaagaacttaaagcgcaaacacaagaggaagaagaataaaatcactcgagacttcaagccaggggacagggtggcagtggaggtggtgaccacgatnacctca

SEQ ID NO: 5559 - DNA, 846 bp, Homo sapiens
  misc_feature (190)..(190): n equals a,t,g, or c
ggcccagcgaaaccccggtgctgtgccagcagtgtggcggcaagctggcgtcaccttcaccagcgccaaggggaggtcttctccgtactggagtttgcaccctcaaatcattcttttaagaaaattgagttccagcytccaraagccaagaagttcttcagcacagtgcggaaggaatgccgctgctggnttacctcactgcctgagggcatcatggtcaagacttttgaagatagaatggcaagtaggcttggcatgggcaggtgcagatgtgctgtgtgggcacccagtgcccaagaggccaccaaccttgggtccccaaacctccggggctgactggcacctgcgaggacactcacccacccaccttttacagtgacggctcagggctgtagtcccagctactctggaggctgaggcaggagaatggcgtgaacctgggaggtggagcttgcagtgagccgagatcacgccactgcactccagcctgggtgacagagcgagattctgtctcaaaaaaaaaaattactttgaaataggccgggtgcggtggctcacgactgtaatcccagcacttcgggaagccgaggcaggtggatcacctgaggtcagaagtttgagaccagcctgaccaacccggtgaaaccctgtctctacttaaaaatacaaaaattagccggatgtggtggcgggtgccagtaatcccagctactcgggagactgaggcaggagaatcacttgaacctgggaggcagaggttgtagtgagccaagatcgcaccattgcactccagcctgggcaacagagcgagacttcatctcaaaaaaaaaaaaaaagggcggccgc

SEQ ID NO: 5560 - DNA, 140 bp, Homo sapiens
tccccagccaggcctgaggacatgaggcggccggcggcggtgccgctcctgctgctgctgtgttttgggtctcagagggccaaggcagcaacagcctgtggtcgccccaggatgctgaaccgaatggtgggcgggcagga

SEQ ID NO: 5561 - DNA, 774 bp, Homo sapiens
  misc_feature (678)..(678): n equals a,t,g, or c
  misc_feature (688)..(688): n equals a,t,g, or c
ggccctggagacactttgactgtggacttcaggcctccagagctgaaggagaatgaacacccactttggggtcacgtgttacagaagctgcaggaggatcccgcaatggccagcatggcacacgcctcagggcctcagtttccccagctgtgaaatgaggatgatgacaggacctgcctcacaggcttgcagtgaggataaaatgagttgatatgcatggaatgcacgcagcagggaccggcacggaactgacattgagtggatgtcagcctctgtcaacattactattactattactgtattattgcccttcgttcgttcattccataaatatgtgcaaagcggctgctctgagccttccgtgggcagcagggcagcacagaggaggcctgagcggtggtgctggggagaggatggcgtagggcaggcctcgtggacgcagccgggggcctcaccatcagcataagcgaccacggtgggcttcagaaggagcgatgagacaggattcaccccattgccatttgsttttcyatcggatcaggaagaagcatgggatgaagctggggtgtcaaggagggtctcccttcctcggtggtcaccttgaggtgctggggccccacctttaactctctctgctggacctggaagcttttgcccagktccctgggaccgtcgcgnttcacaggcntwccaccgaggctctcgctgggtacattgacttgacccacttcagattttgttttcttaaaactcatccccaagtacactttggct

SEQ ID NO: 5562 - DNA, 821 bp, Homo sapiens
  misc_feature (710)..(710): n equals a,t,g, or c
  misc_feature (809)..(809): n equals a,t,g, or c
gagatggcgctacgtctgctgcggagggcggcgcgcggagctgcggcggcggcgctgctgaggctgaaagcgtctctagcagctgatatccccagacttggatatagttcctcatcccatcacaagtacatcccccggagggcagtgctttatgtacctggaaatgatgaaaagaaaataaagaagattccatccctgaatgtagattgtgcagtgctcgactgtgaggatggagtggctgcaaacaaaaagaatgaagctcgactgagaattgtaaaaactcttgaagacattgatctgggccctactgaaaaatgtgtgagagtcaactcagtttccagtggtctggcggaagaagacctagagacccttttgcaatcccgggtccttccttccagcctgatgctaccaaaggtggaaagtcctgaagaaatccagtggtttgcagacaaattttcattccacttaaaaggccgaaaacttgaacaaccaatgaatttaatcccttttgtggaaactgcaatgggtttgctcaattttaaggcagtgtgtgaagaaaccctgaaggtcgggcctcaagtaggtctctttctagatgcagtcgtttttggaggagaagactttcgagccagcataggtgcaacaagtagtaaagaaaccctgggatattctytacgcccggcaaaagwttkttgtcatagcgaaacctnttgggtctccaagccgtagatctgggtgtacattgactttcgagatgggagctggggcttgcttaggacagttcacggaggaagggagccgccatgggnttttcactgggt

SEQ ID NO: 5563 - DNA, 2203 bp, Homo sapiens
gcgagaggcgggggcgctagggccgagatcatgtctgactgggagaggtttccttggcagcagaggacgctaggtttgggatgaaagaagctgggcagatgcaaaatctggagagcgcgagggccgggcggtcagtcagcacccagactggcagcatgaccggtcagataccaaggctttctaaagtcaaccttttcactctgctcagcctctggatggagctctttccagcagaagcccagcggcaaaaatctcagaaaaatgaagagggaaagcatggacccttaggagataatgaagagaggaccagagtatctactgacaaaagacaggtaaagagaactggtcttgtggtggtgaaaaacatgaaaattgttggtctccactgttctagtgaagatttacatgccgggcagattgctcttattaaacatgggtcaaggctgaaaaactgtgatctttatttttccagaaaaccatgttctgcttgtttgaaaatgattgtaaatgctggagttaaccgaatttcatactggcctgctgatccagaaataagtttgcttacggaggcttctagttctgaagatgcaaagttagatgccaaagcagtggaaagattgaagtcaaacagtcgggcccatgtgtgtgtcttacttcaacctttggtgtgttatatggtgcagtttgtagaggagacctcttacaaatgtgactttattcaaaaaattacaaaaacattgccggatgctaacactgacttttattatgaatgtaaacaagaaagaataaaagaatatgaaatgttatttttggtttcaaatgaagaaatgcataagcaaatactgatgactataggtttggagaacctgtgtgaaaatccatactttagcaatctaaggcaaaacatgaaagaccttatcctacttttggccacagtagcttccatgtgccgactttaacacttcggattttaccgtagcaatccagaacagattaatgaaattcacaatcaaagkttgccacaggaaattgcaaggcactgcatggttcaggccaggttattggcatatcgaactgaggatcataaaacaggagttggggcagtcatttgggcagaagggaaatctagaagttgtgatggaacaggtgccatgtactttgtaggatgtggttacaatgcttttcctgttggatctgagtatgctgacttcccacacatggatgacaagcagaaagacagagaaataaggaaattcagatacatcatacatgcggaacagaatgccttgacatttaggtgtcaagaaataaaaccagaagaaagaagcatgatttttgtgacaaagtgcccatgtgatgagtgtgtacctttaattaaaggtgcaggcataaaacaaatctatgcaggagatgtagatgttggaaaaaagaaggcagacatctcttacatgaggttcggggarcttgaaggtgttagcaaatttacgtggcagctgaatccatcaggagcttatggtcttgamcaaaatgagcytgaaaggagagaaaatggtgtgttgagacctgtcccacagaaggaagagcagcaccaggacaagaagctgcgcctcggaatccactaagaaggcctgtcttacactgcaggggaacctcaagaacttttcattgcacttctaaaattcagccttgttcattcagaaaataaggatggattttgtgaataattgaaaagattttttaaggaagctaatttatttctaggatacaaatggtgttaataagaatatttgtcttttagatttatgtgtgggttttccataatgtagtagtgtgttattttattacacgaaatgagggagcaataacttcaaccaatgtaatcaccaacagggactgatttctatttatcttgactttatattagccaatttgaaagggtctgcttcacaagaggtcatgcctctgcagggaatcacacaccttttgagaaatattaattcttttgaattacaagagtgacagttagtaaactgctccagggaaataagtgtcatcttttaagagtcagtgtatagcaaaccaaaagatcacatttatacccaaagctttctagtaatcagaatttacttaattagaattgactcataaaaataaagttagtggactttgtctccatttttaaagtatattttgtaaatgttat

SEQ ID NO: 5564 - DNA, 834 bp, Homo sapiens
tgctgagaggaggcgagaggcgggggcgctagggccgagatcatgtctgactgggagaggtttccttggcagcagaggacgctaggtttgggatgaaagaagctgggcagatgcaaaatctggagagcgcgagggccgggcggtcagtcagcacccagactggcagcatgaccggtcagataccaaggctttctaaagtcaaccttttcactctgctcagcctctggatggagctctttccagcagaagcccagcggcaaaaatctcagaaaaatgaagagggaaagcatggacccttaggagataatgaagagaggaccagagtatctactgacaaaagacaggtaaagagaactggtcttgtggtggtgaaaaacatgaaaattgttggtctccactgttctagtgaagatttacatgccgggcagattgctcttattaaacatgggtcaaggctgaaaaactgtgatctttatttttccagaaaaccatgttctgcttgtttgaaaatgattgtaaatgctggagttaaccgaatttcatactggcctgctgatccagaaataagtttgcttacggaggcttctagttctgaagatgcaaagttagatgccaaagcagtggaaagattgaagtcaaacagtcgggcccatgtgtgtgtcttacttcaacctttggtgtgttatatggtgcagtttgtagaggagacctcttacaaatgtgactttattcaaaaaattacaaaaacattgccggatgctaacactgacttttattatgaatgtaaacaagaaagaataaaagaatatgaaatgttaaaaaaaaaaaaaaaaa

SEQ ID NO: 5565 - DNA, 1263 bp, Homo sapiens
  misc_feature (16)..(16): n equals a,t,g, or c
  misc_feature (39)..(39): n equals a,t,g, or c
  misc_feature (64)..(64): n equals a,t,g, or c
ccttaattagaaatgncccccataaaaataaagttaagnggaccttgtcccccccccatttttnaaaagtaataattttgtaaaatgttaaatcctgtggtccctgtttatccacagacctttgggtagcaataggaagagagtgttatyctgagacagtgtcgcctgccttgatatcactgactcttgaaatcactaacagtgaacctcaaatttggttatgatgttaacagagaagaaatatttgagtctggaatattgaaactagctttcctagaattccattaataaatgctgctcccccatatagtcttcccttctgtataattaacataggttgtctcatggctttgatcttcaaaaggaagagccttttaaaaacatttgccaacctcaagaataaatactgaaagtcttgaaagtatggtcatttcagctattccagattgctgtctgtgatttctcacatttttatttgctgagaaacattcacaaaattattccaaaaatgaaggtacattttctgttctctcctaggttagagaggggtggcctggggtgcttcatgagaaatgtcttcctggatctgcggtggtcaggtttgcctctgctttwgttccctgcctttccgccacatcacacggcctcactgggcttcctaccagtttctcagaattacacgcacgaccatccaaacattggctccatgccarggctgtgactgcagcctgtgtaggaccatggggagttcagagtcatcatacaaggcagccaagaactgccataaacactacacagatggagggcatgggataggacaggagaggaggtgatgtacacttagaggtaactaaggctagtttgaaaaccgtgaattaagatattmttatcagtataaaaacactgagattgcytacctcccaaattgctttattgtattaactctcatgcttcagctcttggatttgttgtttctaactaacatgtcatgtacaccaaacattttataaatcaatcagtaaatattttgtaagacccaaaatcctggcatattgccaggtctgtggatttgcctgttgggtgttgggatgggatatcagaggaagaagcatacaagtgggaaaaactgtgattagaaagggaaaaataggcatttccacagtactattaagagaggcatgataatgccattttttttcttctgtacaactggtcagatttcaataaataatcattgatggtttaaaaaaaaaaaaaaaaaaa

SEQ ID NO: 5566 - DNA, 647 bp, Homo sapiens
  misc_feature (523)..(523): n equals a,t,g, or c
  misc_feature (566)..(566): n equals a,t,g, or c
  misc_feature (569)..(569): n equals a,t,g, or c
  misc_feature (626)..(626): n equals a,t,g, or c
  misc_feature (647)..(647): n equals a,t,g, or c
ggcttccccttcgtcttcctcctgggcctcctgccccaggtcaacacctgcctcatgtacctgctggagcaaatagatatgcacggcttcgggggcacagctgccaccagcccgctcacggcagtcttcagcctctcccgcagcctgctggctgctgccctgctctacggtttctgccttggggccatcaagactccgtggccagagcagcacgtccctgtcctcttctcagtcttctgtggccttctggtggcactgtcctaccacctgagccggcagagcagcgaccccaccgtgctctggtctctgatccggagcaagctgttccctgagctggaggagcgcagcttggagacagcccgggccgagcccccggaccccttgccggacaagatgcgccagtcggtgcgtgaggtcttgcactccgacctggtgatgtgtgtggtgatcgccgtgctcaccttcgccatcagcgccagcaccgtctttattgccctgaagtcggtgctgggtttcgtgttgnacgcactggctgggggccgkgggcttcttcacacawtacctgntgncacaamtccgcaaaacagctkccctggttctgcctgtcacagccgtgctgaaacccntggaatacagcccggatgaan

SEQ ID NO: 5567 - DNA, 781 bp, Homo sapiens
  misc_feature (5)..(5): n equals a,t,g, or c
  misc_feature (73)..(73): n equals a,t,g, or c
  misc_feature (162)..(162): n equals a,t,g, or c
  misc_feature (765)..(765): n equals a,t,g, or c
tgagntaacatataatatctgctcatgtcagtttcactcgaaaactcatactatattcaaatacgtggcagtntgccggcagcagggccttgcgggtgacgctcgctgaccagagccccataccccctttctgggttgttgggagcctgttttgtccaaggnaagctgaggcctcagagagtttaagtgtcccctgaggtgccactgccagacctcaggttgcaggggcctctgtgcccatatggctctgataggtgcccaggcaaggaaggcttgctttgggcagtgagtatggggcaggtgggcagttgcagaggccagcctttgaaaccaccagcccctgcccccagctcacccagcacagagcagtggtagagctaacagttgtcacgttaacgatcatcatgggagcagctgcttgagcagtaacatttaccacgggtgggcgctatgctgggcatctctcctgagctgggtggagtcccccaccctttgagaggggccctgctatctcacagatgtggaagttggcttgcagaggttccagaatctgaagaaaatggccaagccaggccttgaacccaggctggccctgagccacagagctttcctgccttagcctgggggctctgagccaggcctgaggatcttgagacctcttgggggtgggagggggttggtgaggcaatgtggggtacataaggagccctggaatgggggttctgatcagcctgggcaacagagcaagactgtctcaaaaaaaanaaaaaagggcggccgc

SEQ ID NO: 5568 - DNA, 1011 bp, Homo sapiens
  misc_feature (4)..(4): n equals a,t,g, or c
  misc_feature (19)..(19): n equals a,t,g, or c
  misc_feature (62)..(62): n equals a,t,g, or c
  misc_feature (944)..(944): n equals a,t,g, or c
taanccaaagtatggatangaagttactttattcatcaagcattttgagccaagtcagaccngaatcaaagccaaaccagttcaaacccaaaagtcaatmcttgaaatytaacccaaaccagtgcaaatctagtcaaaatcaaacccaaaaccaaggtgccaaaaaggcacgccatgggtgatcaggccacacttccactcagatggagtggcaagttcgaagaccggtcttaccgtgttccagatgtctggactccaagcgccaattccttcccggtgttcagccgctgcattaatcctccgcgggggcctaccgtgcactcctctggaggcgttccactggggcaattgcctgccggggagcgctctcaggattcgcatcgctaaagctggccagagtctcccacagggatgctccactgggcaggcctaagccgcctaaggggctgcctcgaccatccgcttatcaccttgcttccagatcagggaaccaagaaatgtagcaggacaagccacagacaaaacccctcagacaccgagttgaggaaggaaagggctttattggccaggagcatcagcagacctatgtctcaaaaaaaccgagctcccctagtgagcaattcctgtcccttttaagggcttacaactctaaggaggtcgagtgagagggtcatgatcgattgagcaagcagggggtacctgactgggggctgcatgcaccggtaatcagaatggaacagaacargacagggattttcacgatgcttttccatacaatgtctgggacacaagcagttaagtcaggagttgattgttaactactaggcccaaggcacgttgctgggctgcctgcctgtggatttcatttctgcccttcagtttttaattcttttttctttggaggcagaaattgggcataagacaataagaggggtgttctcctnccttactatgactcctgcttctcaggatactccacaaccaatcatgagccccactgagtcaacaaag

SEQ ID NO: 5569 - DNA, 779 bp, Homo sapiens
ggtcggcgcgcgtgtctacgcggacgcaccggctaagctgcttctgccgccgccggccgcctgggaccttgcggtgaggctgcgcggggccgaggccgcctccgagcgccaggtttattcagtcaccatgaagctgctgctgctgcacccagccttccagagctgcctcctgctgaccctgcttggcttatggagaaccacccctgaggctcacgcttcatccccgggtgcaccagctatcagcgctgcctccttcctgcaggatctaatacatcggtatggcgagggtgacagcctcactctgcagcagctgaaggccctgctcaaccacctggatgtgggagtgggccggggtaatgtcacccagcacgtgcaaggacacaggaacctctccacgtgctttagttctggagacctcttcactgcccacaatttcagcgagcagtcgcggattgggagcagcgagctccaggagttctgccccaccatcctccagcagctggattcccgggcctgcacctcggagaaccaggaaaacgaggagaatgagcagacggaggasggscggccaagcgctgttgaagtgtggggatacggtctcctctgtgtgaccgtatctccctctgctccctcctgggggccagcgtggkgcccttcatgaagaagacgctttacaagaggctkctgctctacttyagagctctkscgattggaaccctcttactcaagcgcctcttccagctcatcccgggagcagtttggtttcagcctctggaaga

SEQ ID NO: 5570 - DNA, 1387 bp, Homo sapiens
  misc_feature (4)..(4): n equals a,t,g, or c
  misc_feature (11)..(11): n equals a,t,g, or c
  misc_feature (1333)..(1333): n equals a,t,g, or c
cgcncacagcncgattccgtgtgggcagagctgcagctatcgaggcaagcacaaccgcgggtcggacgggcaacatgtaagaagacgcctcttgcatgcccagctagggctctggcaaaccactggmcagaccaggcacatggtaagaggaacaacccatratgrggtmcggtgcgctcacccatgagctctytggggtgttggraagaggcctggccagccatgccaaggtgccacgtggaagcttccagcaggcctggcaagaccagaggggctgcagcatgtgaggcccatggcccctgtgcaaggcccagcggtgtgcgcccgaccagccctcagggctgccctgggccaggctgggggtccgtgtagctcactggggtggtggggggttggccaggcacagcaccttggctggtggcccctcccagcgggagccctgcaggttgaggtggagctggcccttggctggctgcccaggaagtgcaccccctctgcagggaccaagccggaacctcctgctcaacgggaagtcctaccccaccaaagtgcgcctgatccgggggggctccctgcccccagtcaagcggcggcggatgaactggatcgacgccccggatgacgtgttctacatggccacagaggagaccaggaagatccgcaagctgctctcatcctcggaaaccaagcgtgctgcccgccggccctacaagcccatcgccctgcgccagagccaggccctgccgccgcggccaccgccacctgcgcccgtcaacgacgagcccatcgtcatcgaggactaggggccgcccccacctgcggccgccccccgcccctcgcccgcccacacggccccttcccagccagcccgccgcccgcccctcagtttggtagtgccccacctcccgccctcacctgcagagaaacgcgctccttggcggacactgggggaggagaggaagaagcgcggctaacttattccgagaatgccgaggagttgtcgtttttagctttgtgtttactttttggctggagcggagatgaggggccaccccgtgcccctgtgctgcggggccttttgcccggaggccgggccctaaggttttgttgtgttctgttgaaggtgccattttaaattttatttttattactttttttgtagatgaacttgagctctgtaacttacacctggaatgttaggatcgtgckgccgcggccggccgagctgcctggcggggttggcccttgtcttttcaagtaattttcatattaaacaaaaacaaagaaaaaaaatcttataaaaaggaaaaaaaccaaaaaaaactcgtgccgntcgtgccggtctcgagtttttcttatttttttattattgtacagtttctttacc

SEQ ID NO: 5571 - DNA, 2278 bp, Homo sapiens
  misc_feature (3)..(3): n equals a,t,g, or c
tangcttttgtaaaaagctatttaggtgacactatagaaggtacgcctgcaggtaccggtccggaattcccgggtcgacccacgcgtccgcagggtatgaatgcagaggtcttcctgttggctcacatatcagatcttcaacgtcaacattaaatgcgagtgatgcttccccctctgtgaatgtggctttgggtatggctaatccacaccctgcactctggccttcagaagcccagggagagaagcctcccagaagcaaccttccagaaccttctccatcctcccaccgacctccccagcccctgtcctctctttgaatctcgttgtcaagttcttcccgcagacacctggctccttgaggggaggtgcagctttcatctgaccatgcaggcgtgctttgcagtgggtagagcagtgctttcctcctcccagctgcacactggaatcacctggagagtccagaaacttcccgcctcagtgaaagaacatcagtgtatcagcacagcaaatattccaaatgccaggctggattccctccaattaccaggacctccaggcttctcctcctttcaagaactttctgaccctggatccagtctaaatgttggttataaactcacctgacatccacagggcccttccaaaatactgtcaaggctgactgctggtgcctggaacctgcacaccctcctgggactctgcatctctgctggggctggtttctcctctgagccaccttaaggaatcccaccctgacccggtcagagctcaccatgcctccctctcctacttgctcagcattttgtgtctatctagactraagcctttgctttctctctgtgattgtggtgaaagttcagtttgctttcctatctctagaatgtcagcacgaaggcagaggcatggtctcctgagttccataaccccaaagcctaamtccctgcctgccacactgaggggcttagtagacattgacttactaaattgaatagttgagtaataatgctctttgaaataatttggagttagatcttgagccttgtgtggccagaggatgggtgaggacacatcataaaaactaaaggtaactgagcatgccagtggttggggtgagaaatttgcatggagcactccagacacagaggcagcaaaacccaagtgctgggaagtcagagtgagagagtgaaggggcagtgagtgcttctttaggagctggatcaaaacctaagatgatctggccacatggtgcagactgagcacacacttgggagagaaatgggccaggaggagaggagagaggttcaccacaggacagtggatgactgggaatagaagccctccccatggtggaccaagaagtctgtgaagctgagagaaagacaaaagaaatcacgacttctgtaggtagctgggatggaaacctcaggggtgacagggtctttaaaggaaatctcaaggaaggcatcatgttctgggtgtgctccagggatgctgagtaagaaaagaccagcctttctgtgtgtgtctttactctgccacaaggcacctgggctcctaaatgaccaatacacatgtgctatactggtgccaagaaagaagggtgttttgtaggaaagtcaaggtgagaggaggtgcccaggacttggctcctttctttgaagggtgacggtgtaaattctccatgctggggatcctactgatggatggaggcatgtcgatctcatcatttcacagagtggggagctatggccacaacgtgcctatcacacaagtccagcctcacgtcagctggacaccarctgttctgacacttgtcagcacatggggcacccggaagttcatggtgttctgcaaagaacgccacaaaacagtgagctcaacttcttgaaagtcataatgtgttgctaagtccgatcccagatcctaaaaataatatgaggtagtggccattgaacagaaaaaatttacatcttaaacttgaagataagtacaagtgtacctttttctaccactgttgttcagttttattatattgacaagcacctctgcccaccctgtggggtaaaactgtttgaaagtgtttatgaaagttttatataaatattggytgatcaaatgtacaaaatatgcatgatggcaccatattgtgtataatagtgacaaatacagtctatgtgggtggagaaacaaaaaaaaaaaaaaaaaaagggcggccgctctagaggatccctcgaggggcctcaagttacgcgtgcatgcgacgtcatagctctctccc

SEQ ID NO: 5572 - DNA, 1581 bp, Homo sapiens
  misc_feature (1486)..(1486): n equals a,t,g, or c
  misc_feature (1511)..(1511): n equals a,t,g, or c
  misc_feature (1521)..(1521): n equals a,t,g, or c
  misc_feature (1559)..(1559): n equals a,t,g, or c
gcagggtatgaatgcagaggtcttcctgttggctcacatatcagatcttcaacgtcaacattaaatgcgagtgatgcttccccctctgtgaatgtggctttgggtatggctaatccacaccctgcactctggccttcagaagcccagggagagaagcctcccagaagcaaccttccagaaccttctccatcctcccaccgacctccccagcccctgtcctctctttgaatctcgttgtcaagttcttcccgcagacacctggctccttgaggggaggtgcagctttcatctgaccatgcaggcgtgctttgcagtgggtagagcagtgctttcctcctcccagctgcacactggaatcacctggagagtccagaaacttcccgcctcagtgaaagaacatcagtgtatcagcacagcaaatattccaaatgccaggctggattccstccaattaccaggacctccaggcttctcctcctttcaagaactttctgaccctggatccagtctaaatgttggttataaactcacctgacatccacagggcccttccaaaatactgtcaaggctgactgctggtgcctggaacctgcacaccctcctgggactctgcatctctgctggggctggtttctcctytgagccaccttaaggaatcccaccctgacccggtcagagctcaccatgcctccctctcmtacttgctcagcattttgtgtctatctagactraagcctttgctttctctctgtgattgtggtgaaagttcagtttgctttcctatctctagaatgtcagcacgaaggcagaggcatggtctcctgagttccataaccccaaagcctaamtccctgcctgccacactgargggcttagtagacattgacttactaaattgaatagttgagtaataatgctctttgaaataatttggagttagatcttgagccttgtgtkgccagaggwtgggtgaggacacatcataaaaactaaaggtaactgagcatgccagtggttggggtgagaaatttgcatggagcactccagacacagaggcagcaaaacccaagtgctgggaagtcagagtgagagagtgaaggggcagtgagtgcttctttaggagctggatcaaaacctaagatgatctggccacatggtgcagactgagcacacacttgggagagaaatgggccaggaggagaggagagaggttcaccacaggacagtggatgactgggaatagaagccctccccatggtggaccaagaagtctgtgaagctgagagaaagacaaaagaaatcacgacttctgtaggtagctgggatggaaacctcaggggtgacagggtctttaaaggaaatctcaaggaaggcatcatgttctgggtgtgctccagggatgctgagtaagaaaagaccagcctttctgtgtgtgtctttactctgccacaaggcacctgggctcctaaatgaccaatacacatgngctatactggtgccaaagaaagaanggtggtttgnaggaaagtcaaggtgaaaggaagtgcccaggacttggnttccttctttgaagggtgacgg

SEQ ID NO: 5573 - DNA, 1507 bp, Homo sapiens
  misc_feature (486)..(486): n equals a,t,g, or c
  misc_feature (1237)..(1237): n equals a,t,g, or c
ggggtcaaccacgagagctggcgtgacagtggccagactgacggcctgacctttggccacctgaagatggtgctgctgtgggcctctgtgctcttcccggcgcccgaggactgggcagagctgcagggcgccgtgtaccgcctgctggtggtgctgctctgttgcctggccacgcggaagctgccccacttcctccacccgcagcgcaacctgctgcagggcagcggcctggaccttggtgccatctaccagcgcgtggagggcttcgccagccagcccgaggcggccctgcgcatccacgccacccacctgggccgcagccccccgccgcgcatcggctccgggctcaaggcgctcctgcagctgccagccagtgaccccacttactgggccactgcctacttcgacgtcctgctggacaagttccaggtcttyaacatccaggataaggaccggatctctgccatgcagagcatcttccagaanaccaggactctgggaggcgaggagagctgagctgggccacctggtctcagccacctgttcttggctccccaacagactctgcactgcaccatgggaggctcctgggatgtttggaagaagaaacgggcttctccttgagggggtagtggagggattttgtccccagcagtggcctctgagagtctttcagtgcctggtggggcagggcaggcctcttggagcacctcctccctgggtcagggcctggatgcaggtgccaagctctccatgtggtgcatgttgacccagccacgtggtgttgtcaagcaaacagcatcggcaggagacctggagctgaggacttggccctgcctgcactgtatgccattccttggtgacraaatgctgtatatttggttttgaaaaaatgaatgtgctgggtatacacagcagaaagggtactgtccactttttgtatatcagtgtggaaaatatttcccctagaagtagaaaaggctcatgtgctgatggataattttgagtcttctccattctctgtgaatgacccccttccccaggcatccccacctcctacctcgttcttagagcaaactaaagccaactgagggtgcacacacagccatgagcccacctgcccaggactactcccatctgcttcttcccgtccccgtggaagtggcccctgatatggattgtatctgtatccccacccaaatctcaggtagaattggatctgtgtccccacccaagntytcaggtagacttgtaatccccagtgttggaggaggggcccagtggaggtgattggatcatgggggtggatttctcccttactggtctcatgatagtgagtgagttctcagagatctggktttttgagtgtgtggccatcccgtctcttttgcctcttctctttctcggcatgtagaatgctcatctcttcacttcaccagatgcaagtccgagctccagcaagttccgatagctcggatggagcaataaccctgaggataaaaaagaa

SEQ ID NO: 5574 - DNA, 1104 bp, Homo sapiens
gcaggtaccggtccggaattcccgggtcgacccacgcgtccgggcctyctccactgggtccgaatcagtaggtgaccccgcccctggattctggaagacctcaccatgggacgcccccgacctcgtgcggccaagacgtggatgttcctgctcttgctggggggagcctgggcagcgtgtggaagcctggacctcctcactaagttgtatgcggagaacttgccgtgtgtccatttgaacccacagtggccttcccagccctcgcactgccccagagggtggcgatccaaccctctccctcctgctgcaggacactccagggcacaggaggacaaggtgctggggggtcatgagtgccaaccccattcgcagccttggcaggcggccttgttccagggccagcaactactctgtggcggtgtccttgtaggtggcaactgggtccttacagctgcccactgtaaaaaaccgaaatacacagtacgcctgggagaccacagcctacagaataaagatggcccagagcaagaaatacctgtggttcagtccatcccacacccctgytacaacagcagcgatgtggaggaccacaaccatgatctgatgcttcttcaactgcgtgaccaggcatccctggggtccaaagtgaagcccatcagcctggcagatcattgcacccagcctggccagaagtgcaccgtctcaggctggggcactgtcaccagtccccgagagaattttcctgacactctcaactgtgcagaagtaaaaatctttccccagaagaagtgtgaggatgcttacccggggcagatcacagatggcatggtctgtgcaggcagcagcaaaggggctgacacgtgccagggcgattctggaggccccctggtgtgtgatggtgcactccagggcatcacatcctggggctcagacccctgtgggaggtccgacaaacctggcgtctataccaacatctgccgctacctggactggatcaagaagatcataggcagcaagggctgattctaggataagcactagatctcccttaataaactcacaactctctggttcaaaaaaaaaaaaaaaaaaaagggcggccgc

SEQ ID NO: 5575 - DNA, 1005 bp, Homo sapiens
  misc_feature (1)..(1): n equals a,t,g, or c
  misc_feature (14)..(14): n equals a,t,g, or c
  misc_feature (941)..(941): n equals a,t,g, or c
  misc_feature (977)..(977): n equals a,t,g, or c
naacgaaatccctnagctkgtwcgcctgcaggtaccggtccggaattcccgggtcgacccacgcgtccgcaggcctagcagcctccctcgggctccctctgttcctgagctccgagtgtggcccacctgctccacgctgtttcctgtaactccggcccgtggctgcctctcttctccaactgcaagtctgctccgtccccacccctgctggtgctgtgatgggtgtggccctgccctctcccctcctgtgttctctgcctctgttcctcctctttggggatgtttcaggctcctcatccctccttgctttgctccccttcctccatccctggcatcatccttctctgtcttagccacactctggccctggaacccgcctcctctctggcttccctgatgcaacctgtgcctcccataggtgacacaggggagatcaagtcagaagtccgtgagcagatcaatgccaaggtggctgagtggcgcgaggagggcaaggcggagatcatccctggagtgaggacccaggacatggccggggcgggtggtggggtgaggtgggccggggaagtggggacgcgggtggtgactctcacacacaccccaatccaaggtgctgttcatcgacgaggtccacatgctggacatcgagagcttctccttcctcaaccgggccctggagagtgacatggcgcctgtcctgatcatggccaccaaccgtggcatcacgcggtgagccggctacaggggcctctggggaaaacaggatgctctgggcagtgggtgtggtcagagggtcaatgggagcctgtggtgacaccgggtcagggagggacgcgtgactgcagtgtgcgctctttgcttacaaaaggcgggtgggaggcagctctgctttccgaggaaagcccagagactggggtcttgctggctttctggcttgctgnttcctttagccccaaggcttgaagttttcaaactgnattgcccgagggaaccccagggtgcttg

SEQ ID NO: 5576 - DNA, 675 bp, Homo sapiens
  misc_feature (16)..(16): n equals a,t,g, or c
  misc_feature (39)..(39): n equals a,t,g, or c
  misc_feature (62)..(62): n equals a,t,g, or c
  misc_feature (91)..(91): n equals a,t,g, or c
  misc_feature (661)..(661): n equals a,t,g, or c
cttggatccccagaanaagctcagaaggtagatatcacntcagcccattttataggccaggncagtaggcccagtgactttgcccaggtcncaagtctagaaggtagcaggcccgtaatttggtctctgaatggctggacactgaaagagacccccagggctgatggtgttttcacagaaactgcaggtcagggcytggggactgcccaggggcacctcctgtggraggcagcagctacgggcagccctgattgttcgtagactctgtatctgagaatctcgcttgctaagatttatykgtaatccccaaataaatatctgccctgctttcggcaacaaattcaagtcacctgacacccactttcccagctgagtgtgaatgaggcaacactgcctgctcccttagcgctcatgctgtaaataagtgttcttgttgtattctatttagtgctacgtttgtcacttttgttctttgagacagggtcttgctctgtcgcccaggctggagtgcagaggcacgatcatggcacactgcagcctcagtgcccaccacacacactgcactccagcctgggtgacagaacgagactccatctcaaaaaaaaaaaaaaaaaaaaagggcggccgctctagaggatccaagcttacgtacgcgtgcatncgacgtcatgggct

SEQ ID NO: 5577 - DNA, 2383 bp, Homo sapiens
  misc_feature (2383)..(2383): n equals a,t,g, or c
ggggaagcctgcaacaagttaagctgaagaccgaagcaagagctggttcagagcctgccagtggagacactgggcccggcatccaggatggacccagaatctgagagagccctgcaggcccctcacagcccctccaagacagatgggaaagaattagctgggaccatggatggagaagggacgctcttccagactgaaagccctcagtctggcagcattctaacagaggagactgaggtcaagggcaccctggaaggtgatgtttgtggtgtggagcctcctggcccaggagacacagtagtccagggagacctgcaggagaccaccgtggtgacaggcctgggaccagacacacaggacctggaaggccagagccctycacagagcctgccttcaacccccaaagcagcttggatcagggaggagggccgctgctccagcagtgacgatgacaccgacgtggacatggagggtctgcggagacggcggggccgggaggccggcccacctcagcccatggtgcccctggctgtggagaaccaggctgggggtgagggtgcaggcggggagctgggcatctccctcaacatgtgcctccttggggccctggttctgcttggcctgggggtcctcctcttctcaggtggcctctcagagtctgagactgggcccatggaggaagtggagcggcaggtcctcccagaccccgaggtgctggaagctgtgggggacaggcaggatgggctaagggaacagctgcaggccccagtgcctcctgacagtgtccccagcctgcaaaacatgggtcttctgctggacaagctggccaaggagaaccaggacatccggctgctgcaggcccagctgcaggcccaaaaggaagagcttcagagcctgatgcaccagcccaaagggctagaggaggagaatgcccagctccggggggctctgcagcagggcgaagccttccagcgggctctggagtcagagctgcagcagctgcgggcccggctccaggggctggaggccgactgtgtccggggcccagatggggtgtgcctcagtgggggtagaggcccacagggtgacaaggccatcagggagcaaggccccagggagcaggagccagaactcagcttcctgaagcagaaggaacagctggaggctgaggcacaggcattaagcttggaggaggtggctgtgcaacagacaggtgatgatgatgaagtagatgactttgaggacttcatcttcagccacttctttggagacaaagcactgaagaagaggtcagggaagaaggacaagcactcacagagcccaagagctgcggggcccagggaggggcacagccatagccaccaccaccaccaccggggctgacaccctgccccacagggaatggccttggcctggcccagcccaagatcccagcgttatctaactcctggagggtggactctgtcctggcttgtttggtgtcctcagatatctttcacacagtagagcaaaatcaccagccctgcactgatgtcactttatgtagaaaaaggccttagctggacctgcgttgccgtctatgcaaatgcatgcaaatactccaggccctgggatgtgggcttgtgttttgtcactgtgaagggggagatgggagaggagcctgttttggggtggggtctggggaaggcaatctgattctgaagctaaagagctttcatcctcttgagtgtatgtccccatagtgggccccttgacccacatgctgaccggtgccttgggatttgactagagttgctggctcgaggcccagcacgaggacttaccctggggttttgttaggtttggaagcagctgtccctagggggtgaagtcccccccctttttttttttacccctgcttctcccacggcttcacctccctatgtgaactgtagactcagatcccaataaagtgctgttgcagctatgatgctaggtggtttctaagcacaggggacaccccacaccccctgcctgaatggatgggtccatcccaggcactggtacttgcccccttgttctgtatccccctttgcccttgccttgcccttccaacaaaccctaggcccttgagaagctgatacttctccttttgctcacagctgccttggccccacccctgggagatgtagcaaattgagtgtgggttttggagtctgagcctcaggctcaaatccaggccaagtgatcttgggcaagttaatctctgggaactttgggtttcttatcctcaaaaaaggcgatggaagggctggggaagtgattaaataaaagcaacgcaagaaaaatgcctctcctgttttgggcactcaaaaaaaaaaaaaaaaaaaaaaaaaaaaaaaan

SEQ ID NO: 5578 - DNA, 661 bp, Homo sapiens
  misc_feature (610)..(610): n equals a,t,g, or c
  misc_feature (624)..(624): n equals a,t,g, or c
gcgccagacccgctcagaccctcctgccaggtgacagccgccaagatggggtcttgggccctgctgtggcctcccctgctgttcaccgggctgctcgtccgacccccggggaccatggcccaggcccagtactgctctgtgaacaaggacatctttgaagtakaggagaacacaaatgtcaccgagccgctggtggacatccacgtcccggagggccaggaggtgaccctcggagccttgtccaccccctttgcatttcggatccagggaaaccagctgtttctcaacgtgactcctgattacgaggagaagtcactgcttgaggctcagctgctgtgtcagagcggaggcacattggtgacccagctaagggtgttcgtgtcagtgctggacgtcaatgacaatgcccccgaattcccctttaagaccaaggagataagggtggaggaggacacgaaagtgaactccaccgtcatycccgagacgcaactgcaggctgaggaccgcgacaaggacgacattctggtctacacccttcaggaaatgacagcaggtgccagtggactacttctcctggtgagtgtaaaccgtccgcctgagctggaccggnccctgacttctacnagcggcgaacatgaccttctgcttgctggtgcggaca

SEQ ID NO: 5579 - DNA, 2913 bp, Homo sapiens
  misc_feature (2908)..(2908): n equals a,t,g, or c
gatttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgatgattatttccgcacttggagtccaggaaaacccttcgatcaggctttagatccagctaaggatccatgcttaaagatgaaatgtagtcgccataaagtatgcattgctcaagattctcagactgcagtctgcattagtcaccggaggcttacacacaggatgaaagaagcaggagtagaccataggcagtggaggggtcccatattatccacctgcaagcagtgcccagtggtctatcccagccctgtttgtggttcagatggtcatacctactcttttcagtgcaaactagaatatcaggcatgtgtcttaggaaaacagatctcagtcaaatgtgaaggacattgcccatgtccttcagataagcccaccagtacaagcagaaatgttaagagagcatgcagtgacctggagttcagggaagtggcaaacagattgcgggactggttcaaggcccttcatgaaagtggaagtcaaaacaagaagacaaaaacattgctgaggcctgagagaagcagattcgataccagcatcttgccaattwgcaaggactcacttggctggatgtttaacagacttgatacaaactatgacctgctattggaccagtcagagctcagaagcatttaccttgataagaatgaacagtgtaccaaggcattcttcaattcttgtgacacatacaaggacagtttaatatctaataatgagtggtgctactgcttccagagacagcaagacccaccttgccagactgagctcagcaatattcagaagcggcaaggggtaaagaagctcctaggacagtatatccccctgtgtgatgaagatggttactacaagccaacacaatgtcatggcagtgttggacagtgctggtgtgttgacagatatggaaatgaagtcatgggatccagaataaatggtgttgcagaytgtgctatagattttgagatctccggagattttgctagtggcgattttcatgaatggactgatgatgaggatgatgaagacgatattatgaatgatgaagatgaaattgaagatgatgatgaagaygaaggggatgatgatgatggtggtgatgaccatgatgtatacatttaattgatgacagttgaaatcaataaattctacatttctaatatttacaaaaatgatagcctatttaaaattatcttcttccccaataacaaaatgattctaaacctcacatatattttgtataattatttgaaaaattgcagctaaagttatagaactttatgtttaaataagaatcatttgctttgagtttttatattccttacacaaaaagaaaatacatatgcagtctagtcagacaaaataaagttttgaagtgctactataataartttttcacgagaacaaactttgtaaatcttccataagcaaaatgacagctagtgcttgggatcgtacatgttaattttctgaaagataattctaagtgaaatttaaaataaataaatttttaatgacctgggtcttaaggatttaggaaaaatatgcatgctttaattgcatttccaaagtagcatcttgctagacctagttgagtcaggataacagagagataccacatggcaagaaaaacaaagtgacaattgtagagtcctcaattgtgtttacattaatagtggtgtttttacctatgaaattattctggatctaataggacattttacaaaatggcaagtatggaaaaccatggattctgaaagttaaaaatttagttgttctccccaatgtgtattttaatttggatggcagtctcatgcagattttttaaaagattctttaataacatgatttgtttgcctttctagatttctttatctttctgaccagcaacttagggagcagaatttaaattaggaagacaaagggaaagattcatttaaaccatatttttacaaagtttgtcatttgccccaaggtcaaattttaaattcttaattttcattttatttcccattttaggtaaaagtttgcatttaatcttagaattatgttatttttgttagtagtgtggaaacttagagaacttattgtatggtgccttgcaaaaatagagatagaaagattttagcatgcataccaatatagtatattacgcaatatataagcacacctaattaacagattaatatcagtaaaggtattgctgctggaatgaagaaaatgggatacgtttgtttctttttttctattgttacataattgccatgtggacttgtttatgattattgtgtagagtagcatttaagatttaactgtagcaaaaattactttaaccgctgtatttaagttagcatgttaattaattgtgtagacattttggcacaccatcacttttaactatatcataccaatggttttgtgcccataataaaaatggaaaaacctgttgaatgttacgtattggtatctttaatttcaacagtgggtaaactggtttcccagtatacaattcattgaaagcaaaattgattaattatttccatttaatttatacacactcaatacaaaatttaatgttgactttacgtaataaagtataatgcattttcttttttactgtttatgtatagtttacaaaataaagaatcttgtaaccaaaaaaaaaaaaaaaaaaactcgagggnggctt

SEQ ID NO: 5580 - DNA, 673 bp, Homo sapiens
ggcggccctgggcggggtgctgggtgcgctgctgctgctggctctccttggcctcgccgtccttgtccacaagcactatggcccccgctcaagtgctgctctggcaaagctccggagccccagccccaaggctttgacaaccaggcgttcctccctgaccacaaggccaactgggcgcccgtccccagccccacgcacgaccccaagcccgcggaggcaccgatgcccgcagagcccgcaccccccggccctgcctccccaggcggtgccctgagccccccgcagcggcccgagctggcggaagccccacggcggtgaggtccatcctgaccaaggagcggcggccagagggcgggtacaaggctgtctggtttggcgaggacatcgggacggaggcagacgtggtcgttctcaacgcgcccaccctggacgtggatggcgccagtgactccggcagcggcgatgagggcgagggcgcggggaggggtgggggtccctacgatgcgcccggtggtgatgactcctacatctaagtggcccctccaccctctcccccagccgcacgggcactggaggtctcgctcccccagcctccgacccgaggcagaataaagcaaggctcccgaaaaaaaaaaaaaaaaaaaaaaaaaaaaaaaaaaaaaaaaaaaaaaaa

SEQ ID NO: 5581 - DNA, 2076 bp, Homo sapiens
  misc_feature (1349)..(1349): n equals a,t,g, or c
  misc_feature (2039)..(2039): n equals a,t,g, or c
aacgctccactatagggtwmgctggtacgycygcaggtaccggtccggaattcccgggtcgacccacgcgtccgcggacgcgtgggtctgaagcttctgtcgaaccagttgtaaggagaatggagagagcagtgagagtggagtccggggtcctggtcggggtggtctgtctgctcctggcatgccctgccacagccactgggcccgaagttgctcagcctgaagtagacaccaccctgggtcgtgtgcgaggccggcaggtgggcgtgaagggcacagaccgccttgtgaatgtctttctgggcattccatttgcccagccgccactgggccctgaccggttctcagccccacacccagcacagccctgggagggtgtgcgggatgccagcactgcgcccccaatgtgcctacaagacgtggagagcatgaacagcagcagatttgtcctcaacggaaaacagcagatcttctccgtttcagaggactgcctggtcctcaacgtctatagcccagctgaggtccccgcagggtccggtaggccggtcatggtatgggtccatggaggcgctctgataactggcgctgccacctcctacgatggatcagctctggctgcctatggggatgtggtcgtggktacagtccagtaccgscttggggtccttggcttcttcagcactggagatgagcatgcacctggcaaccagggcttcctagatgtggtagctgctttgcgctgggtgcaagaaaacatcgcccccttcgggggtgacctcaactgtgtcactgtctttggtggatctgccggtgggagcatcatctctggcctggtcctgtccccagtggctgcagggctgttccacagagccatcacacagagtggggtcatcaccactccagggatcatcgactctcacccttggcccctagctcagaaaatcgcaaacaccttggcctgcagctccagctccccggctgagatggtgcagtgccttcagcagaaagaaggagaagagctggtccttagcaagaagctgaaaaatactatctatcctctcaccgttgatggcactgtcttccccaaaagccccaaggaactcctgaaggagaagcccttccactctgtgcccttcctcatgggtgtcaacaaccatgagttcagctggctcatccccaggggctggggtctcctggatacaatggagcagatgagccgggaggacatgctggccatctcaacacccgtcttgaccagtctggatgtgccccctgagatgatgcccaccgtcatagatgaatacctaggaagcaactcggacgcacaagccaaatgccaggcgttccanggaattcatgggtgacgtattcatcaatgttcccaccgtcagtttttcaagataccttcgagattctggaagccctgtctttttctatgagttccagcatcgacccagttcttttgcgaagatcaaacctgcctgggtgaaggctgatcatggggccgagggtgcttttgtgttcggaggtcccttcctcatggacgagagctcccgcctggcctttccagaggccacagaggaggagaagcagctaagcctcaccatgatggcccagtggacccactttgcccggacaggggaccccaatagcaaggctctgcctccttggccccaattcaaccaggcggaacaatatctggagatcaacccagtgccacgggccggacagaagttcagggaggcctggatgcagttctggtcagagacgctccccagcaagatacaacagtggcaccagaagcagaagaacaggaaggcccaggaggacctctgaggccaggcctgaaccttcttggctggggcaaaccactcttcaagtggtggcagagtcccagcacggcagcccgcctctccccctgctgagactttaatctccaccagcccttaaagtgtcggccgctctgtgactggagttatgctcttttgaaatgtcacaaggccgcctcccayctctggggcattgtacaagttcttccntctcccttgaagkgcctttcctgctttcttcgtggaa

SEQ ID NO: 5582 - DNA, 1032 bp, Homo sapiens
  misc_feature (2)..(2): n equals a,t,g, or c
  misc_feature (12)..(12): n equals a,t,g, or c
  misc_feature (966)..(966): n equals a,t,g, or c
tngactctgatntcgywtgcacgcgtacgyaagcttggatcctctagagcggccgccctttttttttttttttgtctygccccacccacatcctgctgattggtccattttacagagagtcaagtggtctgttttgacagggtgctgattggtgcgtttacgatccctgagctagacacaaaggttctccacatccccactagattagctagatacagagtgtggacacaaaggttctcmaagtccccaccagagtagccagatacagagtgtggattggtgcattcacaaacactgagctagacacagggtgctgattggtgtgtttacaaaccttgagctagatacagagtgcccatcggtgtatttacaatcccttagctagacataaaggttctccaagtccccaccagactcaggagcccagctggcttcacccagtggatccagcactggggcagcaggtggagctgcctgccagtcccgcgctgtgcacccgcactcctcagcccttgggtggtcgatgggactgggcgctgtggagcagggggcggcgctccttggggaggctccggccgcacaggagcccacggggggtggggggagggtcaggcatggagggctgcaggtcccgagccctgccccgcggkgaggcagctaaggcccagcgagaaatcgagcacagcagctgctggcccaggtgctaaggccctcactgcctggggccggccagctgctctgagtggggccccgccgagcccacgcccacccggaactcactctggaccgcaagcgctgcgcgcagccccggttcctgcccgcccctctccctccgcacctccccgcaagctgagggagctggctccggccttggccagcccagaaaggggctcctacartgcagcggcgggttgaagggctcctcaagtgctgccaaagtggagcccaggcagagkcggcaggganagcaagcgagggctgtgagggctgccagcacactgtcacctctcacttccatctgaaaacctcttg

SEQ ID NO: 5583 - DNA, 2112 bp, Homo sapiens
ccacgcgtccgcggcagcggaggcaaagttatttcccctcccaggcagcgggattccgactggcaagatggtgcccagctctccgcgcgcgctcttccttctgctcctgatcctcgcctgccccgagccgcgggcttcccagaactgtctcagcaaacagcagctcctctcggccatccgccagctgcagcagctgctgaagggccaggagacacgcttcgccgagggcatccgccacatgaagagccggctggccgcgctgcagaactctgtgggcagggtgggcccagatgcccttccagtttcctgcccggctctgaacacccccgcagacggcagaaagtttggaagcaagtacttagtggatcacgaagtccattttacctgcaaccctgggttccggctggtcgggcccagcagcgtggtgtgtcttcccaatggcacctggacaggggagcagccccactgtagaggtatcagtgaatgctccagccagccttgtcaaaatggtggtacatgtgtagaaggagtcaaccagtacagatgcatttgtcctccaggaaggactgggaaccgctgtcagcatcaggcccagactgccgcccccgagggcagcgtggccggcgactccgccttcagccgcgcgccgcgctgtgcgcaggtggagcgggctcagcactgcagctgcgaggccggattccacctgagcggcgccgccggcgacagcgtctgccaggacgtgaacgagtgtgagctctacgggcaggaggggcgcccccggctctgcatgcacgcctgcgtgaacaccccgggctcttaccgttgcacctgccccggtggataccgaactctggctgacgggaagagctgtgaggatgtggatgaatgtgtgggcctgcagccggtgtgcccccaggggaccacatgcatcaacaccggtggaagcttccagtgtgtcagccctgagtgccccgagggcagcggcaatgtgagctacgtgaagacgtctccattccagtgtgagcggaacccctgccccatggacagcaggccctgccgccatctgcccaagaccatctccttccattacctctctctgccttccaacctgaagacgcccatcacgctcttccgcatggccacagcctctgcccccggccgagctgggcccaacagcctgcggtttgggatcgtgggtgggaacagccgcggccactttgtgatgcagcgttcagaccggcagactggggatctgatccttgtgcagaacctggaggggcctcagacgctggaggtggacgtcgacatgtcggaatacctggaccgctccttccaggccaaccacgtgtccaaggtcaccatctttgtatccccctatgacttctgagggtacacaggggcactggggtgtggagagctgacctcatttctcttccccgaaggctcagcttcgggcaccgactgcgtggagcctcccgcctgttcccgccctctcaccagtgcacccaggcttctagggcagcattgcacggcgcccccatggaatagcacggaagagcagccacaaaactcaactgctgccatcactctttttttttttctgctttgaggcccttcccttagattatgcactaactttcttaaaactttttcatccaggggatgggtggctttccaaaatgctgtgcaaatggccttgtgagtttgaactagctggggagagaaaaggtggcaatgtgtgtcaggtgactatcagcccttctgcctttttgtagccaggcttgctatgaatgaaacggttctagtcgtgcggggggccctagtcatgcctctgcgcatgtggcataggaagtggagtctcctcccatgacccagcacgttgttcttatctgccttttcctctgtgacatgcctgcctgcctgccttctcatcagagagtcacaggagggccttaaaccccacgcagatccttctagaccaaggacccattgttaaaagcatggattctgcctgagttacttcccttttgagaaatcatatctcaaatacataacctggtaatataactgaaaaaataaaagtgattgctccttcaaaaaaaaaaaaaaaaa

SEQ ID NO: 5584 - DNA, 2243 bp, Homo sapiens
  misc_feature (3)..(3): n equals a,t,g, or c
tangaccctgatcacgccaagctctaatacgactcactatagggaaagctggtacgcctgcaggtaccggtccggaattcccgggtcgacccacgcgtccgcggcagcggaggcaaagttatttcccctcccaggcagcgggattccgactggcaagatggtgcccagctctccgcgcgcgctcttccttctgctcctgatcctcgcctgccccgagccgcgggcttcccagaactgtctcagcaaacagcagctcctctcggccatccgccagctgcagcagctgctgaagggccaggagacacgcttcgccgagggcatccgccacatgaagagccggctggccgcgctgcagaactctgtgggcagggtgggcccagatgcccttccagtttcctgcccggctctgaacacccccgcagacggcagaaagtttggaagcaagtacttagtggatcacgaagtccattttacctgcaaccctgggttccggctggtcgggcccagcagcgtggtgtgtcttcccaatggcacctggacaggggagcagccccactgtagaggtatcagtgaatgctccagccagccttgtcaaaatggtggtacatgtgtagaaggagtcaaccagtacagatgcatttgtcctccaggaaggactgggaaccgctgtcagcatcaggcccagactgccgcccccgagggcagcgtggccggcgactccgccttcagccgcgcgccgcgctgtgcgcaggtggagcgggctcagcactgcagctgcgaggccggattccacctgagcggcgccgccggcgacagcgtctgccaggacgtgaacgagtgtgagctctacgggcaggaggggcgcccccggctctgcatgcacgcctgcgtgaacaccccgggctcttaccgttgcacctgccccggtggataccgaactctggctgacgggaagagctgtgaggatgtggatgaatgtgtgggcctgcagccggtgtgcccccaggggaccacatgcatcaacaccggtggaagcttccagtgtgtcagccctgagtgccccgagggcagcggcaatgtgagctacgtgaagacgtctccattccagtgtgagcggaacccctgccccatggacagcaggccctgccgccatctgcccaagaccatctccttccattacctctctctgccttccaacctgaagacgcccatcacgctcttccgcatggscacagcctctgcccccggccgagctgggcccaacagcctgcggtttgggatcgtgggtgggaacagccgcggccactttgtgatgcagcgttcagaccggcagactggggatctgatccttgtgcagaacctggargggcctcagacgctggaggtggacgtcgacatgtcggaatacctggaccgctccttccaggccaaccacgtgtccaaggtcaccatctttgtatccccctatgacttctgagggtacacaggggcactggggtgtggagagctgacctcatttctcttccccgaaggctcagcttcgggcaccgactgcgtggagcctcccgcctgttcccgcccwctcaccagtgcacccaggcttctagggcagcrttgcacggcgccccatggaatagcacggaagagcagccacaaaactcaactgctgccatcactcttttttttttctgctttgaggcccttcccttagattatgcactaactttcttaaaactttttcatccargggatgggtggctttccaaaatgctgtgcaaatggccttgtgagtttgaactagctggggagagaaaaggtggcaatgtgtgtcaggtgactatcagcccttctgcctttttgtagccaggcttgctatgaatgaaacggttctagtcgtgcggggggccctagtcatgcctctgcgcatgtggcataggaagtggagtctcctcccatgacccagcacgttgttcttatctgccttttcctctgtgacatgcctgcctgcctgccttctcatcagagagtcacaggagggccttaaaccccacgcagatccttctagaccaaggacccattgttaaaagcatggattctgcctgagttacttcccttttgagaaatcatatctcaaatacataacctggtaatataactgaaaaaataaaagtgattgctccttmaaaaaaaaaaaaaaaagggcggccgctctagaggatccaagcttacgtacgcgtgcatgc

SEQ ID NO: 5585 - DNA, 655 bp, Homo sapiens
  misc_feature (4)..(5): n equals a,t,g, or c
  misc_feature (7)..(7): n equals a,t,g, or c
  misc_feature (10)..(10): n equals a,t,g, or c
cggnnanacnctactataggttaagctggtacgcctgcaggtaccggtccggaattcccgggtcgacccacgcgtccggacttatgctactgtcatggacagtgctaataataatactgccttttgctggagatgttagttctcacttatgcattttaagaccttttgctggaagtgttagttcttgcttatctaattttaaacgaatatgaaagacaatttaagtgattttgtacattttaatttactcatctacattttcttgtattttttggattaaagtgtacctgtatgctctttctttctgtggaacacttcatttgtagtgtccaatttttaaaaagaaaacattttgataacagtttcagagtaatgacaaaccaaacacacattctaattgtctacttgtacaatttgttgggtaggtactatagggggaagaattaaatatacatgaggaagagaaaaaatctttgccaagaatttcagttattatcacttatggtttacccatattgtcataaaagtaagaaaatgggaattctaattttctgtcacaaaataaagattatataaaaataaaaaaaaaaaaaaaaaaaaaaaaaaawtaaaaaaaaaaaaaaaaaaaaaaaaaaaaaaaaaaaaaaaaaaaaaa

SEQ ID NO: 5586 - DNA, 2086 bp, Homo sapiens
  misc_feature (10)..(10): n equals a,t,g, or c
  misc_feature (2070)..(2070): n equals a,t,g, or c
  misc_feature (2075)..(2075): n equals a,t,g, or c
  misc_feature (2079)..(2079): n equals a,t,g, or c
  misc_feature (2083)..(2083): n equals a,t,g, or c
tggaacgccngcaggtaccggtccggaattcccgggtcgacccacgcgtccggggggaataaaggacccgcgaggaagggcccgcggatggcgcgtccctgagggtcgtggcgagttcgcggagcgtgggaaggagcggaccctgctctccccgggctgcgggccatggccacggcggagcggagagccctcggcatcggcttccagtggctctctttggccactctggtgctcatctgcgccgggcaagggggacgcagggaggatgggggtccagcctgctacggcggatttgacctgtacttcattttggacaaatcaggaagtgtgctgcaccactggaatgaaatctattactttgtggaacagttggctcacaaattcatcagcccacagttgagaatgtcctttattgttttctccacccgaggaacaaccttaatgaaactgacagaagacagagaacaaatccgtcaaggcctagaagaactccagaaagttctgccaggaggagacacttacatgcatgaaggatttgaaagggccagtgagcagatttattatgaaaacagacaagggtacaggacagccagcgtcatcattgctttgactgatggagaactccatgaagatctctttttctattcagagagggaggctaataggtctcgagatcttggtgcaattgkttactgtgttggtgtgaaagatttcaatgagacacagctggcccggattgcggacagtaaggatcatgtgtttcccgtgaatgacggctttcaggctctgcaaggcatcatccactcaattttgaagaagtcctgcatcgaaattctagcagctgaaccatccaccatatgtgcaggagagtcatttcaagttgtcgtgagaggaaacggcttccgacatgcccgcaacgtggacagggtcctctgcagcttcaagatcaatgactcggtcacactcaatgagaagcccttttctgtggaagatacttatttactgtgtccagcgcctatcttaaaagaagttggcatgaaagctgcactccaggtcagcatgaacgatggcctctcttttatctccagttctgtcatcatcaccaccacacactgttctgacsgttccatcctggccatcgccctgctgatcctgktcctgctcctagccctggctctcctctggtggttctggcccctctgctgcactgtgattatcaaggaggtccctccaccccctgccgaggagagtgaggtaagtgaccacwgcaggatggcagtgggtgggcagggtggcagagtagggtggagagctggctgggcagctggacacttagccccctgcagagcagagctaagtcaagctcaaaggatttaatgtacctgcctgtgaagcagaagggaggaaactgtctggcctttcctaaccagggatgaacaagaaactgaactaaactgccagaaaagacaatgagttttggaggttkttctccctgcagagataaaatgtgagatggaaataaatgtttttatcagtacagttatttggagctttgagatactgacttttcctctcaaacaaaccctaagattctcttctcctgcagagacttaatgctttatgtgtgtagatcaggcacagtttgctacattctccaatcattggttctaggaataacctgatgcccaattcttcatttttctttcatttaaaaacaatattacctaaagatgggccaggcagtaatgaaaatacgctggagagggatatgttaatatcctggccttcctctcaaattctcgtcatctaaagaaaaaaattcttggactctaccactgaatcggccagtaaactgttctgatgcaagggtggcctggagtagaatacagtggaggcattaaaggctaatcatgagaaaggcaagagtgcctagcaagtggctttgctaatctgatcactcttagtacagctggagtctctagaagtaacatccacccattcagaagccagggttacatatctaaacactcaatgagaccaaaagatagakkgataaggaccaaattcggnggcgngccnccgnccc

SEQ ID NO: 5587 - DNA, 722 bp, Homo sapiens
  misc_feature (30)..(30): n equals a,t,g, or c
  misc_feature (53)..(53): n equals a,t,g, or c
  misc_feature (63)..(63): n equals a,t,g, or c
  misc_feature (114)..(114): n equals a,t,g, or c
  misc_feature (116)..(116): n equals a,t,g, or c
  misc_feature (222)..(222): n equals a,t,g, or c
aaaaaaaaatttctgggcttctcccttgantggcccagtaacttgttttaatncaaggtgccntgaagtagaatccagtgagccattaaggcctatcatgagaaggcaagagtncntagcaagtgcttttgctattctgatcacttttagacagctgaagtctctagaagtaccatccacccattcagaagccagggttacatatctaaccactcaatgagnccaaaagatagattgataaggtttcaagttcttgtcctcaatccctaacgtctgttgtgtgcaaatcaagtgccagttcctcacccttccccttccaatgcatttgtcaagtttcctacatacagaaagagtaatgattaaattaaaaattccatgtggctcttatatcctgaaccatacgcatgtaagccaagggatttaatagctgcaatcaattaaagtgcatcttgttggaatgctaactttctgcccagaaatcaagggaggaaattacattgctgtgcaaagaagaagaaaaaaccttctttacatacattaaaacctttccttaatccttcaagagaaagtaccgtggctagttccacgactgcaattggctttgcttctgttatgtgcagctatctcttagacttccaaaacataaaaaaaaaaaaaagggcggccgctctagaggatccaagcttacgtacgcgtgcatgcgacaacatagctcgaagatt

SEQ ID NO: 5588 - DNA, 1971 bp, Homo sapiens
  misc_feature (416)..(416): n equals a,t,g, or c
  misc_feature (458)..(458): n equals a,t,g, or c
gcccaggctgacaaaaaggagaaacagcttttacttgcatccagggccaatcatcgcagacccagacgtctgcagaggggaaaataaaagaagcaaaaacaggccctgctgtgagggaccacgaggcagtgccaggatgaaagagttggagtaacctaggtgattctgagtgaatcagtcaggaggccttcctggaggggaccattgcaggtactgtgccttctgcctgaaatgtgctcacctcgcctcgctgactcctactcgccagttagtgttcggcccatttctgcccccgtgagatttcttcacagatgttgccctcccccatttgctgagtttcctgcatgccggctccttcagcactcaagggtacctctttgattctgcttctcacagggctgaggccccagcttggnggccaccacaacgtatcaagctatcttcagggttgggctcangactcagagctgacgcagctggggtgccccttggttctggaggatgaggctcctccgcagacgccacatgcccctgcgcctggccatggtgggctgcgcctttgtgctcttcctcttcctcctgcatagggatgtgagcagcagagaggaggccacagagaagccgtggctgaagtccctggtgagccggaaggatcacgtcctggacctcatgctggaggccatgaacaaccttagagattcaatgcccaagctccaaatcagggctccagaagcccagcagactctgttctccataaaccagtcctgcctccctgggttctataccccagctgaactgaagcccttctgggaacggccaccacaggaccccaatgcccctggggcagatggaaaagcatttcagaagagcaagtggacccccctggagacccaggaaaaggaagaaggctataagaagcactgtttcaatgcctttgccagcgaccggatctccctgcagakgtccctggggccagacacccgaccacctgagtaagtagcacccagagtccttgtggggagaccagggctttgctaaaggcatggctagtatggccagggccatagatcaagggccagagaaagagttgaagggaattttataatatgggcaaggatctcctctatgcctcacttctttcccagaacaactgtgctgatcccaggggttgtgattcaagggtattatggtcaggccagaggcccagggagacctgtgagagtgaaatgcaattatgaaagtgagatgatgtggaagaaggaaytcagcytggcaccaggacytggcacgggktgactggggagacctgataccaagctgtggtttcagtagctttctcctctactgaggcctgytccagagactgtgggactctaatgctgagctgtttggggggggggtgggcatttcttaacagcaaccctggtggttaggaatatcctcacacctggtttcctccagtgaaggcccacaaggccggaattgattccaacctttatctgaagttgtttatagcctcaatcttgcacaatgagatctcacttagatctttgagtggcagccccctccctctaacgcccccatggctgcattcccatgatcctcaagttaaagacagtgtgtcttccccacttagcctttgtcttttccaggtcaagtgttataccctatttggccttttctcaaatggcagccctcatccccagatttcgtgagtctttagggctgtgaacctgaggttcttgagacttgagccaagtatgatagccctagaacaaggggccacttgaagctatcaggaattcctcagcagagaagggcactggggccaggcacagtggctcatgcctataatcccagcactatggaaggctgaggtgggtggatctcttgaggccaggagttcaagaccagcctggccaacatggtgaaagcctgtctctactaaaaaaaaaaaaaaagggcggccgc

SEQ ID NO: 5589 - DNA, 2178 bp, Homo sapiens
  misc_feature (704)..(704): n equals a,t,g, or c
  misc_feature (1337)..(1337): n equals a,t,g, or c
  misc_feature (1357)..(1357): n equals a,t,g, or c
  misc_feature (1408)..(1408): n equals a,t,g, or c
  misc_feature (1641)..(1641): n equals a,t,g, or c
  misc_feature (1649)..(1649): n equals a,t,g, or c
cgggcgcgtggaggggccccccgcatgggaagcagccccatggccctcactgccctgtgggccctgcatccccatcatgctggtcctggccaccctggctgcgctcttcatcctcaccaccgctgtgttggctgaacgcctgttccgccgtgctctccgcccagaccccagccaccgtgcacccaccctggtgtggcgcccaggaggagagctgtggattgarcccatgggcaccgcccgaaagcgctctgaggactggtatggctctgcrgtccccctgctgacagatcgggcccctgagcctcccacccaggtgggcactttggaggcccgagcaacagccccacctgccccctcagccccaaattctgctcccagcaacttgggcccccagaccgtactggaggtcccagcccggagcaccttctgggggccccagccctgggaggggaggccccccgccacaggcctggtgagctgggctgaacccgagcagaggccagaggccagcgtccagtttgggagcccccaggccaggargcagcggccagggagcccggatcctgagtggggcctccagccacgggtcaccttggagcagatctcagctttctgraagcgtgaaggccggaccagtgtggggttctgaatccccagggttccccagagatccccgaggcaggccttgcctcagtgggaccggngaccccaggatccagcattaggattgagactgccccagcgaagatgcccttcccaggctccttccacctggagtccccctccccgggtctgggtggtggccaggctatgtggactaggggaagcccagcagtgcctctgctcagctacctgggctgtggctcagagacctgggggtggagccaatgccaggccagaagccttcaagatcgcatccagatgaagaacccaaggtactagatagtcaggaaatggcatcgaccagccacctccaccttctttcagtgtttaccgaagccaccaataccaaagagaacgggtcctgcggtgctgaacagcctcggtgtggcgatgacagctggcaggagatgacaggaatccagtttcccagagccacaaatcctgttctccttggccactcacccactgtgaggtcctctaggaaaatacacaaagagaggaccagaccaggcagaggaacattttgtttcatatgaactgggctttgacccccaaactgcaaggaggaacttgctgggccaaagctgcagcggcgctgkcttgctggagtggggacctagagtcagagaaaacccmcaggctcctctgcccattctcctccatctgcacacgtntcagcctcggaccctcaccnctccatggtgaggaaggccatggccaggggaaactgagtttcatccaatgnggagaggagcgttgtcctagagcagggcaactcccaaactgkgacctctgatcatcgtcccttccagcttgctggagtgtccagagagacagatttgccacaagctaggcttacttataatgctccaccctacagaaatgggaccccaagtacccaatcttccctttaggagaggcaggcaggtgggtgagcagcagatgtagtttccatttccctgggggtttaattttccnaactttgnctttttttttttttttttttttttttttttgagacagaatctcaactctgtcacccagactggagtgcagtggcacaatctcaactcactacagcctcgaactcctaggctcaagcgatcctcccacctcaacctctagaatagctgggactgcaggtgcataccaccacgcccagctaatttttgtattttttttgtagagacacggtctcaccatactgcctgggcaggtttccaactcctgggctcaagtgatccagcagccttagcctcccaaaatgctgggattacaggtatgagcactgcacccggccacttttttttgtttttgaaacagggtctcactctgttgcccaggctggactacagtggcacaatctcagctcactgcggccttgaactcctgggcttaagtgatcctcccacctcagtctccctagtaggtggaactacaggcatgtaccaccacacctgggcaacatagcaagagcccatctctaccagaaaaaaaaaaaaaaagggcggccgc

SEQ ID NO: 5590 - DNA, 2127 bp, Homo sapiens
ccacgcgtccgcagcaacacccactgagcacgctgggagctgagtatggcgtccctggtctcgctggagctggggctgcttctggctgtgctggtggtgacggcgacggcgtccccgcctgctggtctgctgagcctgctcacctctggccagggcgctctggatcaagaggctctgggcggcctgttaaatacgctggcggaccgtgtgcactgcgccaacgggccgtgtggaaagtgcctgtctgtggaggacgccctgggcctgggcgagcctgaggggtcagggctgcccccgggcccggtcctggaggccaggtacgtcgcccgcctcagtgccgccgccgtcctgtacctcagcaaccccgagggcacctgtgaggacgctcgggctggcctctgggcctctcatgcagaccacctcctggccctgctcgagagccccaaggccctgaccccgggcctgagctggctgctgcagaggatgcaggcccgggctgccggccagacccccaagacggcctgcgtagatatccctcagctgctggaggaggcggtgggggcgggggctccgggcagtgctggcggcgtcctggctgccctgctggaccatgtcaggagcgggtcttgcttccacgccttgccgagccctcagtacttcgtggactttgtgttccagcagcacagcagcgaggtccctatgacgctggccgagctgtcagccttgatgcagcgcctgggggtgggcagggaggcccacagtgaccacagtcatcggcacaggggagccagcagccgggaccctgtgcccctcatcagctccagcaacagctccagtgtgtgggacacggtatgcctgagtgccagggacgtgatggctgcatatggactgtcggaacaggctggggtgaccccggaggcctgggcccaactgagccctgccctgctccaacagcagctgagtggagcctgcacctcccagtccaggccccccgtccaggaccagctcagccagtcagagaggtatctgtacggctccctggccacgctgctcatctgcctctgcgcggtctttggcctcctgctgctgacctgcactggctgcaggggggtcacccactacatcctgcagaccttcctgagcctggcagtgggtgcactcactggggacgctgtcctgcatctgacgcccaaggtgctggggctgcatacacacagcgaagagggcctcagcccacagcccacctggcgcctcctggctatgctggccgggctctacgccttcttcctgtttgagaacctcttcaatctcctgctgcccagggacccggaggacctggaggacgggccctgcggccacagcagccatagccacgggggccacagccacggtgtgtccctgcagctggcacccagcgagctccggcagcccaagcccccccacgagggctcccgcgcagacctggtggcggaggagagcccggagctgctgaaccctgagcccaggagactgagcccagagttgaggctactgccctatatgatcactctgggcgacgccgtgcacaacttcgccgacgggctggccgtgggcgccgccttcgcgtcctcctggaagaccgggctggccacctcgctggccgtgttctgccacgagttgccacacgagctgggggacttcgccgccttgctgcacgcggggctgtccgtgcgccaagcactgctgctgaacctggcctccgcgctcacggccttcgctggtctctacgtggcactcgcggttggagtcagcgaggagagcgaggcctggatcctggcagtggccaccggcctgttcctctacgtagcactctgcgacatgctcccggcgatgttgaaagtacgggacccgcggccctggctcctcttcctgctgcacaacgtgggcctgctgggcggctggaccgtcctgctgctgctgtccctgtacgaggatgacatcaccttctgataccctgccctagtcccccacctttgacttaagatcccacacctcacaaacctacagcccagaaaccagaagcccctatagaggccccagtcccaactccagtaaagacactcttgtccttggaaaaaaaaaaaaaaa

SEQ ID NO: 5591 - DNA, 1570 bp, Homo sapiens
  misc_feature (650)..(650): n equals a,t,g, or c
  misc_feature (1514)..(1514): n equals a,t,g, or c
  misc_feature (1535)..(1535): n equals a,t,g, or c
  misc_feature (1563)..(1564): n equals a,t,g, or c
cgaccctgattacgccaagctctaatacgactcactatagggaaagctggtacgcctgcaggtaccggtccggaattcccgggtcgacccacgcgtccgcagcaacacccactgagcacgctgggagctgagtatggcgtccctggtctcgctggagctggggctgcttctggctgtgctggtggtgacggcgacggcgtccccgcctgctggtctgctgagcctgctcacctctggccagggcgctctggatcaagaggctctgggcggcctgttaaatacgctggcggaccgtgtgcactgcgccaacgggccgtgtggaaagtgcctgtctgtggaggacgccctgggcctgggcgagcctgaggggtcagggctgcccccgggcccggtcctggaggccaggtacgtcgcccgcctcagtgccgccgccgtcctgtacctcagcaaccccgagggcacctgtgaggacgctcgggctggcctctgggcctctcatgcagaccacctcctggccctgctcgagagccccaaggccctgaccccgggcctgagctggctgctgcagaggatgcaggcccgggctgccggccagacccccaagacggcctgcgtagatatccctcagctgctgragraggcggtggggncgggggctccgggcagtgctgscggcgtcctggctgccctgctggaccatgtcargagcgggtcttgcttccacgccttgccgagccctcagtacttcgtggactttgtgttccagcagcacagcagcgaggtccctatgacgctggccgagctgtcagccttgatgcagcgcctgggggtgggcagggaggcccacagtgaccacagtcatcggcacaggggagccagcagccgggaccctgtgcccctcatcagctccagcaacagctccagtgtgtgggacacggtatgcctgagtgccagggacgtgatggctgcatatggactgtcggaacaggctggggtgaccccggaggcctgggcccaactgagccctgccctgctccaacagcagctgagtggagcctgcacctcccagtccaggccccccgtccaggaccagctcagccagtcagagaggtatctgtacggctccctggccacgctgctcatctgcctctgcgcggtctttggcctcctgctgctgacctgcactggctgcaggggggtcacccactacatcctgcagaccttcctgagcctggcagtgggtgcactcactggggacgctgtcctgcatctgacgcccaaggtgctggggctgcatacacacagcgaagagggcctcagcccacagcccacctggcgcctcctggctatgctggccgggctctacgccttcttcctgtttgagaacctcttcaatctcctgctgcccagggacccggaggacctggaggacggccctgcggccacagcagcatagcacgggggccacagcacggtgtgtcctgcaactggcacccacgagctccggagccaancccccacgaggcttccgcganactgtgcgaagaagccgactgtgacctnncagaat

SEQ ID NO: 5592 - DNA, 712 bp, Homo sapiens
  misc_feature (2)..(2): n equals a,t,g, or c
  misc_feature (8)..(8): n equals a,t,g, or c
  misc_feature (23)..(23): n equals a,t,g, or c
  misc_feature (25)..(25): n equals a,t,g, or c
  misc_feature (182)..(182): n equals a,t,g, or c
  misc_feature (213)..(213): n equals a,t,g, or c
tnaacggntgttccgaaatgacngngaacaaaaatggttttggcctgaacagacaaaytaccgaaagcggaaattgccagccggktcaatgagatgytsggcctggtgcatatgcaggatttcgcccaaacgcaaaccgcatcagttttccggtgttcaggaacaacgtgtgcccctggccngaagccttgcgaagcgccccgaaactattantgctcgatgagccgatgggcgcgctggataaaaagctgcgtgacaggatgcagcttgaagtggtggatattctggagcgcgtcggtgtgacttgtgtgatggtcacccacgatcaggaagaggcgatgaccatggcggggcgcatcgccattatgaatcgtgggaaatttgtccagattggcgaaccggaagagatctacgagcatccgactacccgctatagcgccgaatttattggctcggtaaacgtctttgaaggcgtactcaaagagcgtcaggaagatggcctggtgcttgattcgccggggctggtgcatccactgaaagtcgacgcggatgcctcggtggtcgataacgtgccggtacatgtggcgctgcgcccggaaaaaatcatgctttgcgaagagccgcccgccaatggttgtaacttcgcggtgggggaggtgatacacattgcctatctcggcgatctttcggtgtatcacgttcgtctgaaaag

SEQ ID NO: 5593 - DNA, 806 bp, Homo sapiens
  misc_feature (17)..(17): n equals a,t,g, or c
  misc_feature (19)..(19): n equals a,t,g, or c
  misc_feature (708)..(708): n equals a,t,g, or c
  misc_feature (801)..(801): n equals a,t,g, or c
ctttggatccctttaanancggccgcccttttttttttttttttccaaggacaagagtgtctttactggagttgggactggggcctctataggggcttctggtttctgggctgtaggtttgtgaggtgtgggatcttaagtcaaaggtgggggactagggcagggtatcagaaggtgatgtcatcctcgtacagggacagcagcagcaggacggtccagccgcccagcaggcccacgttgtgcagcaggaagaggagccagggccgcgggtcccgtactttcaacatcgccgggagcatgtcgcagagtgctacgtagaggaacaggccggtggccactgccaggatccaggcctcgctctcctcgctgactccaaccgcgagtgccacgtagagaccagcgaaggccgtgagcgcggaggccaggttcagcagcagtgcttggcgcacggacagccccgcgtgcagcaaggcggcgaagtcccccagctcgtgtggcaactcgtggcagaacacggccagcgaggtggccagcccggtcttccaggaggacgcgaaggcggcgcccacggccagcccgtcggcgaagttgtgcacggcgtcgcccagagtgatcatatagggcagtagcctcaactctgggctcagtctcctgggctcagggttcagcagctccgggctctcctccgccaccaggtctkcgcggganccctcgtgggggggcttkggctgccggrrctcgckgggttccaactgcaaggacacacctggctktggccccgtggctatgcttctttgccgnaggcc

SEQ ID NO: 5594 - DNA, 537 bp, Homo sapiens
  misc_feature (399)..(399): n equals a,t,g, or c
  misc_feature (453)..(453): n equals a,t,g, or c
  misc_feature (496)..(496): n equals a,t,g, or c
  misc_feature (518)..(518): n equals a,t,g, or c
  misc_feature (532)..(532): n equals a,t,g, or c
ggactcactgctcttcatggtggaggagcctgggaggttcctgcctctctggctgcacattctcctaattacggtgctgctggtgctgtcgggcatattttctggcctcaacctcgggcttatggccctggaccccatggagctgcgcatcgtgcagaactgtggcaccgagaaggagaggcgctatgcccgcaagattgagcccatccggcgcaagggcaactaccttctctgctcgttgctcctagggaacgtgctggtcaacacctycctcacaatccttctagacaacctcatcgggtccggcctcatggcggtggcctcctccaccattggcattgtcatctttggggagatcctacctcaggccctgtgctcccgacatgggctggctgtggntgccaacaccatccttctcaccaaattctttatgctactcaccttccccctcanttttcccattagcaagctcctggacttttttctgggccagganattcgcactgtttacaaccggnagaagctgatgganatgtt

SEQ ID NO: 5595 - DNA, 4224 bp, Homo sapiens
  misc_feature (42)..(42): n equals a,t,g, or c
  misc_feature (528)..(528): n equals a,t,g, or c
  misc_feature (535)..(535): n equals a,t,g, or c
ccggccacgagaagaaatcagggtgctcagctatctgcaggngtggacccagggcccaagcctgtggcttccagtcagtccagcccgcacctctcccatgggagggcctgaragcgcgggaacatcctgggcccctgggatctcagaggctggaccttcctgggagactcattgagtaagatgcagaggactccttcttgggtggtgggagtccctggtctgctctggggcccctggcttttccccatgagaaaaagcagctggagctgggaagtcccacctggccatcgtgcagaaggtaaacaacgagggtgagggtgaccccttctacgaggtcctgggcctggtcaccctggaggacgtgatcgaggagatcatcaagtcggagatcctggacgagtccgacatgtacactgacaaccgaagccggaagcgggtgtctgagaagaacaagcgtgacttctctgccttcaaggatgcggacaatgagctcaaagtgaaaatctccccgcagctcctcctggccgntcatcgnttcctagccacagaggtctctcagtttagcccctccctgatatcagagaagatcctgctgcggctactcaagtacccagatgtcattcaggaactcaagtttgacgagcacaataagtactacgcccgccattacctgtacacccgaaataagccggccgactacttcatcctcatcctgcaggggaaggtggaggtggaggcagggaaggagaacatgaagtttgagacgggcgccttctcctactatgggactatggccctgacctcggtcccctccgaccgttccccagcacaccccaccccactcagccgctcagcctccctcagttacccagaccgcacagacgtctcaactgcagcaaccttggcaggcagcagcaaccagtttggcagctctgtcctgggccagtacatctctgacttcagcgtccgggcactcgtggacttgcagtacatcaagatcactcggcagcagtaccagaacgggctgctggcttctcgcatggagaacagccctcagtttcccatagacgggtgcaccacccacatggagaacttggccgagaagtctgagctgcctgtggtggacgagaccacaactcttctcaacgagcgtaactccttgctgcacaaagcctcccacgagaatgccatctgacaggagggcccggggccccctgcccacctgcgggggcctccccagtgggcccacatgaagagagggaacctgttagtccagaaaggatacggatagatagcctgtctgactgaacagccagatggcccccagcctatgggggatctggcctctgccagggacctctgagtagctctgaggtggcactgtccagccctggatagggggggcagtgggccagctaccgtaagcaaaggctgttttttactgagagaatttctaaagtaggctcatcacttttttttaaatatcattttgggaagggaagacagggttaaggaactttatttaaaaaaaaaatatttttttcctaaaaactataaaagaggaagggtttcttgtcccgggaagcaacggacataatctgttcccagccatggccttccagcttgtgtccctgattcagggagctctcccttcctcctcctcctcctcctccggaggtgggatcccagagcctgccagtggaggcttatctgttgggaggaagacagctcttcacagaagcaaagaacaaaatggcatggagatcagctgcctgagcacctgcgctgtagcttatctgacaacgctgaggccacgagctcctgggtagctgtgatcagggacatgataatctgagctatgcagaggagcacatctgttgtcaactgctgtacccagaaatctagaactctgccgacagcctctcctggtgagtcgggactcagctgaggacacatccccaccctgcctcccatctggccctttggacaactggccctttgtgacagggctgactcaagtgttaggcagggtctcaggcctttgattgctcacccctgctccccaggccctgccctcacttttaccaaaggttctccctcggcgggagggcatctgtgttggaggtgatttgtctgggttcttccttttggttccagaaggaactgtcagtcatcagcatctgcgttgttagcagtcagtaccacccccgccccacaatgacagtcaaggctgacttgttgactgaagcctttttcccagaccccttatttcgaatccccaagcttcagtccctcttgggggtggagacaagaggacatgtgggaagccacggaagcaggttctttatgtcctctcctctgtggctggcaaggctcacctggccttatccacccacttatggaacctcaggagaggagggctcctcctaaaggcatgcagcttgcagcccctctttctcacacgtgtgatcctagcgtgagaggtcatcctgcccttgctgaagttagtastactgtactaagagctctgccctcatgtgaattcctgccctggcgcctcttccctggggctgaatcaggccctgctgcaaaactccaggcttcccagggttggggaggctgtgggaccaargtccatgttggtccttccactgggtgcagcaggagctgggtcccgagagcctggcaggtgaaactctgcaggccttccgcctgattattatttattcactcctttcctcaccccaagtgccctgctctccaggtgcctagagtatcctaactcttaggaccagggattgtcttgcaccaagtatgcctacccctggccagtctgaggtctcctagccatagaactgactcctggaagcctggagagaaggtggtgacacccatgggttctcaactgtaaggaaaaaagacaccagacttttgttccctagtgggggaaagcccttagtcttgtacaggagcagcttgctcccaagtccttttggaagctggcagagctatattcctgacagccctgactgccaggtagagcaaaagacattggtgggggtatgtgaagcaaaaggggcaggtgcacacacctccacagtgacctctgtgcacacggttaccaccaactggctggccctcctcctcttccctggcccattgatcatcccttctcacagagggtcatcattatttccaaatattgtttgtctgatgacttcctcttcccagtgcaatttttcccttcctatttcaacctctggttcctgggatgagccataccctggaactggcccacccactgtgtcttccacgtaagggagacctttgcaaagggcatccaaatgggtaggcaggtgacagccgccgtatttattttgcataatattttaatttgtatatttttgtgatttattttggcgttatgagtttgactctcggggagttttgttgttatgactcttgtgtcttttgtcacaaaacaatgatatttgctaaacgatatatggaatttatttttgattggtaataaaaaatcaaatatgtataaatcctggtgaatctacaacttgcctgtttgttctgtcagtattcagtatgttgttgagataaaagtggctgtggctggctgtctcttgtgatgggacaagggcaataaaggattctaggaccattcagcagtgaaatgcaatcagaaatggaatttctaaatatagtcaaggctgtcgtcacaggagtgagagggacgtggctgctggcagacatacaggacagatgtgctcagctgccataagcatgagtcctgtgaaacagatcccatagsgcccttggcttgtgagtactggaagggcagtgggcttcagcaaattgcccctcctccctacccatgggactgaaagaagcttgatccaaaagtatgagtaatattgttttataacatgcagctgccttttcgtccacacctacaggctagkggtttcaaagttggagtgttcatcccttgaagaacctgagttacgtcactatacccactctcaaagttgcagctctgcaggggactcccatggtgctgtacaggtgctgcaggctggcttgtgcgattgagtgtgctgaggccaggggctccaagcatgcaaagttcaatggagtagacaaactgggggcatgttttccaagtttgatccaattgttcttccacctgaagctttactcccagaaagttag

SEQ ID NO: 5596 - DNA, 624 bp, Homo sapiens
  misc_feature (6)..(6): n equals a,t,g, or c
  misc_feature (12)..(13): n equals a,t,g, or c
  misc_feature (19)..(19): n equals a,t,g, or c
  misc_feature (54)..(54): n equals a,t,g, or c
  misc_feature (540)..(540): n equals a,t,g, or c
  misc_feature (583)..(583): n equals a,t,g, or c
  misc_feature (605)..(605): n equals a,t,g, or c
  misc_feature (619)..(619): n equals a,t,g, or c
accccnaacggnnaacccntcactataggtacagctggtacgcctgcaggtacncggtccggaattcccgggtcgacccacgcgtccggactcactgctcttcatggtggaggagcctgggaggttcctgcctctctggctgcacattctcctaattacggtgctgctggtgctgtcgggcatattttctggcctcaacctcgggcttatggccctggaccccatggagctgcgcatcgtgcagaactgtggcaccgagaaggagaggcgctatgcccgcaagattgagcccatccggcgcaagggcaactaccttctctgctcgttgctcctagggaacgtgctggtcaacacctccctcacaatccttctagacaacctcatcgggtccggcctcatggcggtggcctcctccaccattggcattgtcatctttggggagatcctacctcaggccctgtgctcccgacatgggctggctgtgggtgccaacaccatccttctcaccaaattctttatgctactcaccttccccctcanttttcccattagcaagctcctggacttttttctgggccagganattcgcactgtttacaaccggnagaagctgatgganatgtt

SEQ ID NO: 5597 - DNA, 1451 bp, Homo sapiens
ccacgcgtccgggaagaagccgagatggcggcagccagcgctggggcaacccggctgctcctgctcttgctgatggcggtagcagcgcccagtcgagcccggggcagcggctgccgggccgggactggtgcgcgaggggctggggcggaaggtcgagagggcgaggcctgtggcacggtggggctgctgctggagcactcatttgagatcgatgacagtgccaacttccggaagcggggctcactgctctggaaccagcaggatggtaccttgtccctgtcacagcggcagctcagcgaggaggagcggggccgactccgggatgtggcagccctgaatggcctgtaccgggtccggatcccaaggcgacccggggccctggatggcctggaagctggtggctatgtctcctcctttgtccctgcgtgctccctggtggagtcgcacctgtcggaccagctgaccctgcacgtggatgtggccggcaacgtggtgggcgtgtcggtggtgacgcaccccatggccccatgcagccccaggggcttcccccctgcccatggagtagagcccgagatcctggccactatgccagttctgacctcgcatccccctaccccgagcccatgcagtctgggaacatgccgccttctctccagcctctgtgcctttgttccaggtggtctcaccctcctgtccctggctgggctaggtggtcctgtccaggctcctgcagcgcccccctcactttgacactggactaggatgcagcctcccttctgtgtccccttgagggtaccctgggtcccctcatcaggggcagaggcatgaaagagtcggggctgtatggccaggggcttctgggcccgacgcctagtgcagcccctggggtcgtggtttgacatttgtctgcctggtgcaaacaaggaatccttgcctttaaggtgacaggccctccacaggcttccagacttgaaggaaaaggtttaagaaagaaaacaaaaccaacagttagtggagtcaaagcccagacactgtaaatagaaccccctccaccaccccccgccgcccagcatcctacctggactgcggtgctacgagggcctgcgggcctttgctgtgtgccaccctccctgtaagtctatttaaaaacatcgacgatacattgaaatgtgtgaacgttttgaaaagctacagcttccagcagccaaaagcaactgttgttttggcaagacggtcctgatgtacaagcttgattgaaattcactgctcacttgatacgttattcagaaacccaaggaatggctgtccccatcctcatgtggctgtgtggagctcagctgtgttgtgtggcattttattaaactgtcccccagatcgaaaaaaaaaaaaaaaaaaaaaaaaaaaaaaaaaaaaaaaaaaaaaaaaaaaaaaaaaaaaaaaaaaaaaaaaaa

SEQ ID NO: 5598 - DNA, 1452 bp, Homo sapiens
ccacgcgtccgggaagaagccgagatggcggcagccagcgctggggcaacccggctgctcctgctcttgctgatggcggtagcagcgcccagtcgagcccggggcagcggctgccgggccgggactggtgcgcgaggggctggggcggaaggtcgagagggcgaggcctgtggcacggtggggctgctgctggagcactcatttgagatcgatgacagtgccaacttccggaagcggggctcactgctctggaaccagcaggatggtaccttgtccctgtcacagcggcagctcagcgaggaggagcggggccgactccgggatgtggcagccctgaatggcctgtaccgggtccggatcccaaggcgacccggggccctggatggcctggaagctggtggctatgtctcctcctttgtccctgcgtgctccctggtggagtcgcacctgtcggaccagctgaccctgcacgtggatgtggccggcaacgtggtgggcgtgtcggtggtgacgcaccccatggccccatgcagccccaggggcttcccccctgcccatggagtagagcccgagatcctggccactatgccagttctgacctcgcatccccctaccccgagcccatgcagtctgggaacatgccgccttctctccagcctctgtgcctttgttccaggtggtctcaccctcctgtccctggctgggctaggtggtcctgtccaggctcctgcagcgcccccctcactttgacactggactaggatgcagcctcccttctgtgtccccttgagggtaccctgggtcccctcatcaggggcagaggcatgaaagagtcggggctgtatggccaggggcttctgggcccgacgcctagtgcagcccctggggtcgtggtttgacatttgtctgcctggtgcaaacaaggaatccttgcctttaaggtgacaggccctccacaggcttccagacttgaaggaaaaggtttaagaaagaaaacaaaaccaacagttagtggagtcaaagcccagacactgtaaatagaaccccctccaccaccccccgccgcccagcatcctacctggactgcggtgctacgagggcctgcgggcctttgctgtgtgccaccctccctgtaagtctatttaaaaacatcgacgatacattgaaatgtgtgaacgttttgaaaagctacagcttccagcagccaaaagcaactgttgttttggcaagacggtcctgatgtacaagcttgattgaaattcactgctcacttgatacgttattcagaaacccaaggaatggctgtccccatcctcatgtggctgtgtggagctcagctgtgttgtgtggcattttattaaactgtcccccagatcgaaaaaaaaaaaaaaaaaaaaaaaaaaaaaaaaaaaaaaaaaaaaaaaaaaaaaaaaaaaaaaaaaaaaaaaaaaa

SEQ ID NO: 5599 - DNA, 790 bp, Homo sapiens
  misc_feature (553)..(553): n equals a,t,g, or c
  misc_feature (649)..(649): n equals a,t,g, or c
  misc_feature (660)..(660): n equals a,t,g, or c
  misc_feature (668)..(668): n equals a,t,g, or c
  misc_feature (723)..(723): n equals a,t,g, or c
gggaagaagccgagatggcggcagccagcgctggggcaacccggctgctcctgctcttgctgatggcggtagcagcgcccagtcgagcccggggcagcggctgccgggccgggactggtgcgcgaggggctggggcggaaggtcgagagggcgaggcctgtggcacggtggggctgctgctggagcactcatttgagatcgatgacagtgccaacttccggaagcggggctcactgctctggaaccagcaggatggtaccttgtccctgtcacagcggcagctcagcgaggaggagcggggccgactccgggatgtggcagccctgaatggcctgtaccgggtccggatcccaaggcgacccggggccctggatggcctggaagctggtggctatgtctcctcctttgtccctgcgtgctccctggtggagtcgcacctgtcggaccagctgaccctgcacgtggatgtggccggcaacgtggtgggcgtgtcggtggtgacgcaccccatggccccatkcagccccargggcttccccctgccatggagtanagccgagatcctggccactatccagttctgacctcgcatccccctaccccgagcccatgcagtctgggaacatgccgcctcttcttcagcctcttngccttttgttncaagtggncttacccttctggtccctggctgggctaagtggtcctggtcccggcttctggaanggccccccttaacttttgacacttggactaaggatgcaaccctccctttttggggccccctttaagg

SEQ ID NO: 5600 - DNA, 855 bp, Homo sapiens
cgagatggytggcagccagcgctggggcaacccggctgctcctgctcttgctgatggcggtagcagcgcccagtcgagcccggggcagcggctgccgggccgggactggtgcgcgaggggctggggcggaaggtcgagagggcgaggcctgtggcacggtggggctgctgctggagcactcatttgagatcctggccactatgccagttctgacctcgcatccccctaccccgagcccatgcagtctgggaacatgccgccttctctccagcctctgtgcctttgttccaggtggtctcaccctcctgtccctggctgggctaggtggtcctgtccaggctcctgcagcgcccccctcactttgacactggactaggatgcagcctcccttctgtgtccccttgagggtaccctgggtcccctcatcaggggcagaggcatgaaagagtcggggctggatggccaggggcttctgggcccgacgcctagtgcagcccctggggtcgtggtttgacatttgtctgcctggtgcaaacaaggaatccttgcctttaaggtgacaggccctccacaggcttccagacttgaaggaaaagggtttaagaaagaaaacaaaaccaacagttagtggccggtgagggcccaggctggtcagcgtcccgtcttgcacacccaggggcctccctttctgctggagtcccctgtgtcctccaccaccccccgccgcccagcatcctacctggactgcggtgctacgagggcctgcgggcctttgctgtgtgccaccctccctgtaagtctatttaaaaacatcgacgatacattgaaaaaaaaaaaaaaaaaaagggcggccac

SEQ ID NO: 5601 - DNA, 1292 bp, Homo sapiens
  misc_feature (71)..(71): n equals a,t,g, or c
  misc_feature (697)..(697): n equals a,t,g, or c
  misc_feature (1280)..(1280): n equals a,t,g, or c
  misc_feature (1287)..(1287): n equals a,t,g, or c
  misc_feature (1291)..(1291): n equals a,t,g, or c
aaacctcttctataggtaaagctggtacgcctgcaggtaccggtccggaattcccgggtcgacccacgcgnccggaaagaggaaacatagaggtgccaaaggaacaaagacataatgatgtcatccaagccaacaagccatgctgaagtaaatgaaaccatacccaacccttacccaccaagcagctttatggctcctggatttcaacagcctctgggttcaatcaacttagaaaaccaagctcagggtgctcagcgtgctcagccctacggcatcacatctccgggaatctttgctagcagtcaaccgggtcaaggaaatatacaaatgataaatccaagtgtgggaacagcagtaatgaactttaaagaagaagcaaaggcactaggggtgatccagatcatggttggattgatgcacattggttttggaattgttttgtgtttaatatccttctcttttagagaagtattaggttttgcctctactgctgktattggtggatacccattctggggtggcctttcttttattatctctggctctctctctgtgtcagcatccaaggagctttcccgttgtctggtgaaaggcagcctgggaatgaacattggtaggtctatcttggccttcattggagtgattctgctgctggtggatatgtgcatcaatggggtarctggccaagactactggnccgtgctttctggaaaaggcatttcagccacgctgatgatcttctccytcttggagttcttcgtagcttgtgccacagcccattttgccaaccaagcaaacaccacaaccaatatgtctgtcctggttattccaaatatgtatgaaagcaaccctgkgacaccagcgtcttcttcagctcctcccagatgcaacaactactcagctaatgcccctaaaagaaaaaggggtatcagtctaatctcatggagaaaaactacttgcaaaaacttcttaagaagatgtcttttattgtctacaatgatttctagtctttaaaaactgtgtttgagatttgtttttaggttggtcgctaatgatggctgtatctcccttcactgtctcttcctacattaccactactacatgctggcaaaggtgaaggatcagaggactgaaaaatgattctgcaactctcttaaagttagaaatgtttctgttcatattactttttccttaataaaatgtcattagaaacaaaaaaaaaaaaaaaaaaaaaaaaaaaaaaaaagggcggccgctctagaggatccaagcttacgtangcgtgcntgcna

SEQ ID NO: 5602 - DNA, 1308 bp, Homo sapiens
  misc_feature (1146)..(1146): n equals a,t,g, or c
  misc_feature (1161)..(1161): n equals a,t,g, or c
  misc_feature (1169)..(1169): n equals a,t,g, or c
  misc_feature (1183)..(1183): n equals a,t,g, or c
  misc_feature (1239)..(1239): n equals a,t,g, or c
  misc_feature (1245)..(1245): n equals a,t,g, or c
  misc_feature (1249)..(1249): n equals a,t,g, or c
  misc_feature (1302)..(1302): n equals a,t,g, or c
caccaatgttgataaactggtgaaggacatttacggaggagactatgaacgatttggccttcaaggatctgctgtagcatcaagctttggcaacatgatgagtaaagaaaagcgagattccatcagcaaggaagacctcgcccgggccacattggtcaccatcaccaacaacattggctccattgctcggatgtgtgcgttgaatgagaacatagacagagttgtgtttgttggaaattttctcagaatcaatatggtctccatgaagctgctggcatatgccatggatttttggtccaaaggacaactgaaagctctgtttttggaacatgagggttattttggagccgttggggcactgttggaactgttcaaaatgactgatgayaagtagagacgagcagtggaggaaacagcctcccaaaaggacagagaactaaaaaattgctgctggagaaggtgaaagtcgctttgggacggaagccaagccattatggcagatgaacctgctggatttgtaaataatttaaaatccttccagatgatcttttactcttaggttttgagctaatgattcaaaacgggggaatataaaaggttttttttctgtatactgtatttttttaaaaaaatggtgcagcgtggccaaacctaccaattgtatgcattaactttgaaaagttgtttgatgtttaagaaggacctgatatgtaagcgctggtcatttttcttctggggtttactgatcagtgtggtgattttaacttcatttagtaattactctaggagattttaccttgacttatatttttcatgacgtttcatgatttgctgttggtttcaaatgaaactacaaatctggcatgttttactgtgaacacttttgwtatttgktttgtacccttttttgtcttgkttttctgktttagttgkcttctgaaaaaagagtcgttccctctgtttctgtcctcagatgatgtccctycccctacctgtaacctttctttgacataattgktcatatcaatgaaggtgctgaccagytcaatacaaagttaagcacaagatctaaagctcttgaaaatgcccgtgaagagaagactgaatggggtaatgaatttaatgagtctggcaaaagttgcaaantatatgcaagtttgncctatcgntttataaatgtagnggttcattgggattatttatgctagggtatattaaagttgaaaaagtctggggatnaaaggncctnatccatggcccagaatatgaatggcaagcaaatctttgggcaagaaaatttgnaacttc

SEQ ID NO: 5603 - DNA, 1121 bp, Homo sapiens
  misc_feature (4)..(4): n equals a,t,g, or c
  misc_feature (1114)..(1114): n equals a,t,g, or c
ctcncagctttgstttgaaccccattyagtaattactctaggagattttaccttgacttatatttttyatgacgtttcatgatttgctgttggtttcaaatgaaactacaaatctggcatgttttactgtgaacacttttgktatttgttttgyacccttttttgtcttgtttttctgttttagttgtcttctgaaaaaagagtcgttccctctgtttctgtcctcagatgatgtccctccccctacctgtaacctttctttgacataattgttcatatcaatgaaggygctgaccagctcaatacaaagttaagcacaagatctaaagctcttgaaaatgcccgtgaagagaagactgaatgtgttaatgaatttaatgagtctggcaaaagttgcaaattatatgcaagtttgtcctatcgcttataaatgtagtgtttcattggatttattttatgctaggttatattaagttgaaatagtctgtgattaaatgtcctcatccatgcacagaatatgaatggcagcaaatctttgtgcaagaaatttgaaacttattgggaaaagcctcccagtagattaattgttcatatcaggagatttagggtaagtcatgggttgaggtgtcagatagtaatatctatttgttttgtacatgtatatatctaggaactttgtaacaacacatctttaataatgttaaaggttttttcatttttaatattttaaactaaaaactgtacttcaatctcagtttctaaaattaaaaataatttatactgatctatatattttttctttttgaaagatttcattaagactgatgggtaactttcaaatgagggtcatgtacaaatattgggatgcatgagatcccatgatcttgtgtattgagcttattgttgaaagggatttttgaaggacagaacaattactccatgatgaatcttcctttctctgccttctgagcaccgtctttaatttccatatcttcaagtcttgaagaagttgatgttaattgaagaattcacttgtctggttgaaataaagcctgtttctgttgtgawraaaaaaaaaaaaaactsgtggggggcccggacccaattgccctangggagcc

SEQ ID NO: 5604 - DNA, 1673 bp, Homo sapiens
gggacccggcggactcccagcagggtcgccgcggggtccgggggccgggctccccttgcccctccgggaagcccgcggggcggggcggtgcgggccggaacctgccgggcgagctgggccctcgcccytccctcgggcggtcacctgrgcacgggcgctgcaggtgtcgrggcctcaaccttgcggagccgacagccatcgatcctcgggtggcctcgaggtggtggcagggccgccccctgcagtccggagacgaacgcacggaccgggcctccggaggcaggttcggctggaaggaaccgctctcgcttcgtcctacacttgcgcaaatgtctccgagcttactcacatagcatattggtatatcaaaatgaaatgcaaggaaccaaaaataacataattgaaggcagtaaaagtgaaattaaataggaagatcatcagtcaaggaagacccactggagaggacagaaaatgaagcagtgttttatcatgtgtatttcagcaggtcttcttgaaatttaactaaaaatatgactgctctctcttcagagaactgctcttttcagtaccagttacgtcaaacaaaccagcccctagatgttaactatctgctattcttgatcatacttgggaaaatattattaaatatccttacactaggaatgagaagaaaaaacacctgtcaaaattttatggaatatttttgcatttcactagcattcgttgatcttttacttttggtaaacatttccattatattgtatttcagggattttgtacttttaagcattaggttcactaaataccacatctgcctatttactcaaattatttcctttacttatggctttttgcattatccagttttcctgacagcttgtatagattattgcctgaatttctctaaaacaaccaagctttcatttaagtgtcaaaaattattttatttctttacagtaattttaatttggatttcagtccttgcttatgttttgggagacccagccatctaccaaagcctgaaggcacagaatgcttattctcgtcactgtcctttctatgtcagcattcagagttactggctgtcatttttcatggtgatgattttatttgtagctttcataacctgttgggaagaagttactactttggtacaggctatcaggataacttcctatatgaatgaaactatcttatattttcctttttcatcccactccagttatactgtgagatctaaaaaaatattcttatccaagctcattgtctgttttctcagtacctggttaccatttgtactacttcaggtaatcattgttttacttaaagttcagattccagcatatattgagatgaatattccctggttatactttgtcaatagttttctcattgctacagtgtattggtttaattgtcacaagcttaatttaaaagacattggattacctttggatccatttgtcaactggaagtgctgcttcattccacttacaattcctaatcttgagcaaattgaaaagcctatatcaataatgatttgttaatattattaattaaaagttacagctgtcataagatcataattttatgaacagaaagaactcaggacatattaaaaaataaactgaactaaaacaacttttgccccctgactgatarcattcagaatg

SEQ ID NO: 5605 - DNA, 700 bp, Homo sapiens
ccacgcgtccggtccttgcttatgttttgggagacccagccatctaccaaagcctgaaggcacagaatgcgtattctcgtcactgtcctttctatgtcagcattcagagttactggctgtcatttttcatggtgatgattttatttgtagctttcataacctgttgggaagaagttactactttggtacaggctatcaggataacttcctatatgaatgaaactatcttatattttcctttttcatcccactccagttatactgtgagatctaaaaaaatattcttatccaagctcattgtctgttttctcagtacctggttaccatttgtactacttcaggtaatcattgttttacttaaagttcagattccagcatatattgagatgaatattccctggttatactttgtcaatagttttctcattgctacagtgtattggtttaattgtcacaagcttaatttaaaagacattggattacctttggatccatttgtcaactggaagtgctgcttcattccacttacaattcctaatcttgagcaaattgaaaagcctatatcaataatgatttgttaatattattaattaaaagttacagctgtcataagatcataattttatgaacagaaagaactcaggacatattaaaaaataaactgaactaaaacaaaaaaaaaaaaaaaaaaaaaaaaaaa

SEQ ID NO: 5606 - DNA, 771 bp, Homo sapiens
  misc_feature (751)..(751): n equals a,t,g, or c
  misc_feature (758)..(758): n equals a,t,g, or c
  misc_feature (767)..(767): n equals a,t,g, or c
gcggccgcccttttttttttttttttttaaaaaacttttttaatattttaaacgagcatcagaaccaggcatggtatagtcattcttcatgaatgattctcttggttttgcatcccttatcagttgtcattgtccttacatagccttcctccccaaacagattcttttaaatttattttccttagttcctaaaatgagtaaaacttactttacaatacatgtgggattatgtgcagagattggttcctagtgattttgtatagtatttatcccttagcaaatgtagtttaagaacatgttaatctgatttccaatcacatgatcaggtgggtggatagtgtcagtgccatatgcaatggtcatgtcccaggcatcaatgatgcccacgttgaggtctttgaaaatatccttcatgataagatagtgaatataaccatggaagtctccaaacctctctgtctctatgtgcatctccctgatgttttctgtcttaataatcactttagtggctgggcttcttaggaacagtctttcaatagccttttgaacaccgatggccctgcgaataaaaatgtcaatgggaaatggtctaaagtgctggccaaaggtgatgacgatggctgtgtttttgtcacctgatagccggtcaatttcccgagggatataatcatgatytatcagagagtagrgctggaaagtgacgaagggatagctatgttttttccattgaattctgagtgtgtctttctgnatccagnaagcaaaanggtt

SEQ ID NO: 5607 - DNA, 1177 bp, Homo sapiens
  misc_feature (1172)..(1172): n equals a,t,g, or c
  misc_feature (1176)..(1177): n equals a,t,g, or c
ctctaatacgastcactatagggaaagctggtacgcctgcaggtaccggtccggaattcccgggtcgacccacgcgtccgagaactcacaggtacttttccagccacccagataggagagatcattaaaacagtgcattctgtgctacctgacacctattgggacattcgtcatgtcctcaaatacaatgcttcaaaaaacgctgctgatcttgatctctttttcagtagtaacctggatgatttttataatttctcagaacttcacaaagctttggtctgctctaaacttatccatctctgtccattactggaacaactccgcaaagtccttattccctaaaacatcactgataccattaaagccactaacagagactgaactcagaataaaggaaatcatagagaaactagatcagcagatcccacccagacctttcacccatgtgaacaccaccaccagtgccacacacagcacagccaccatcctcaaccctcgagatacatactgcaggggagaccagctggacatcctactggaggtgagggaccacttgggacagaggaagcaatatggtggggatttcctgagggccaggatgtcctccccagcactgacggcaggtgcttcaggaaaggtgatggacttcaacaatggcacctacctggtcagcttcactctgttctgggagggccaggkctycctgkctctgctgctyatycaccccagtgaaggggcgtcggctytctggagggcaaggaaccaaggctatgataaaattattttcaaaggcaaatttgttaatggcacctctcatgtcttcactgaatgtggcctgaccctaaactcaaatgctgaactctgtgaatatctggatgacagagaccaagaagccttctattgtatgaagcctcaacacatgccctgtgaggctctgacctacatgaccacccggaatagagaggtatcttatcttacagacaaggaaaacagccttttccacaggtccaaagtgggagttgaaatgatgaaggatcgtaaacacattgatgkcactaattgkaacaagagagaaaamatatgaagagacatgccaagttggaatgaagcctyctgtccctggtggttatactttacaaggaaaatggataacmacattttggaaaccaggnttann

SEQ ID NO: 5608 - DNA, 684 bp, Homo sapiens
  misc_feature (648)..(648): n equals a,t,g, or c
  misc_feature (651)..(651): n equals a,t,g, or c
  misc_feature (678)..(679): n equals a,t,g, or c
  misc_feature (682)..(682): n equals a,t,g, or c
gtcgacccacgcgtccgagaactcacaggtacttttccagccacccagataggagagatcattaaaacagtgcattctgtgctacctgacacctattgggacattcgtcatgtcctcaaatacaatgcttcaaaaaacgctgctgatcttgatctctttttcagtagtaacctggatgatttttataatttctcagaacttcacaaagctttggtctgctctaaacttatccatctctgtccattactggaacaactccgcaaagtccttattccctaaaacatcactgataccattaaagccactaacagagactgaactcagaataaaggaaatcatagagaaactagatcagcagatcccacccagacctttcacccatgtgaacaccaccaccagtgccacacacagcacagccaccatcctcaaccctcgagatacatactgcaggggagaccagctggacatcctactggaggtgagggaccacttgggacagaggaagcaatatggtggggatttcctgagggccaggatgtccttcccagcactgacggcaggtgcttcaggaaaggtgatggacttcacaatggcacctacctggcagcttcactctggtctgggagggccagggcttcctggctctgntgnttattcaccccaagtggaaggggccgnnggntt

SEQ ID NO: 5609 - DNA, 771 bp, Homo sapiens
  misc_feature (5)..(5): n equals a,t,g, or c
  misc_feature (14)..(14): n equals a,t,g, or c
  misc_feature (21)..(21): n equals a,t,g, or c
aaccnttttgcttnctggatncagaaagacacactcagaattcaatggaaaaaacatagctatcccttcgtcactttccagcyctactctctgataratcatgattatatccctcgggaaattgaccggctatcaggtgacaaaaacacagccatcgtcatcacctttggccagcactttagaccatttcccattgacatttttattcgcagggccatcggtgttcaaaaggctattgaaagactgttcctaagaagcccagccactaaagtgattattaagacagaaaacatcagggagatgcacatagagacagagaggtttggagacttccatggttatattcactatcttatcatgaaggatattttcaaagacctcaacgtgggcatcattgatgcctgggacatgaccattgcatatggcactgacactatccacccacctgatcatgtgattggaaatcagattaacatgttcttaaactacatttgctaagggataaatactatacaaaatcactaggaaccaatctctgcacataatcccacatgtattgtaaagtaagttttactcattttaggaactaaggaaaataaatttaaaagaatctgtttggggaggaaggctatgtaaggacaatgacaactgataagggatgcaaaaccaagagaatcattcatgaagaatgactataccatgcctggttctgatgctcgtttaaaatattaaaaaagttttttaaaaaaaaaaaaaaaaaagggcggccgc

SEQ ID NO: 5610 - DNA, 773 bp, Homo sapiens
  misc_feature (503)..(503): n equals a,t,g, or c
  misc_feature (671)..(671): n equals a,t,g, or c
  misc_feature (694)..(694): n equals a,t,g, or c
  misc_feature (722)..(722): n equals a,t,g, or c
  misc_feature (731)..(731): n equals a,t,g, or c
  misc_feature (755)..(755): n equals a,t,g, or c
  misc_feature (764)..(764): n equals a,t,g, or c
ggggacctggccagccgtgcagctgcccaggcgctatggcgagtgcggtcagggggtcgaggccgtggccccggctggggctccagctccagttcgcggcgctgctgctcgggacgctgagtycacaggttcatactctcaggccagagaacctcctgctggtgtccaccttggatggaagtctccacgcactaagcaagcagacaggggacctgaagtggactctgagggatgatcccgtcatcgaaggaccaatgtacgtcacagaaatggcctttctctctgacccagcagatggcagcctgtacatcttggggacccaaaaacaacagggattaatgaaactgccattcaccatccctgagctggttcatgcctctccctgccgcagctctgatggggtcttctacacaggccggaagcaggatgcctggtttgtggtggaccctgagtcaggggagacccagatgacactgaccacagagggtccctccaccccccgnctctacattggccgaacacagtatacggtcaccatgcatgacccaagagccccagccctgcgctggaacaccacctaccggcgctactcaacgccccccatggatggctcaactgggaaatacatgagccaacttggcgtcctgcgggaagggcctgctgctcactgngggaccccaggaagcgggacggngcttttggacacaaggaacctgggccgngcccttggnaatgggccggctacacccttgggnaccaaggancgggcctgg

SEQ ID NO: 5611 - DNA, 813 bp, Homo sapiens
gcatttacaagcacttcagcgccactttggcatatgtgaaactctccaaggtactgaacttctatgtggctaatgcagatgactccagcaagactgaactgctttttgctgcgttgaaagccttgaagtacttgtttagattcatcatccaatcccgagtgctctacttgaggtaatgttaactgcagtgaagatgtttagattatcagctgtcactctgtgtgctttttccctcactctgcacagtggtgttcagctctgtgagcagttagttcttagaattgccttatttcagaactgcagggctgaagatggatttgggctgcgtgtctgttggagaagactcatgagaagtttttgtagatcagcaaaattctggggcagtaatgacctcaggacttggggaagcagattcctgtggaaagattgtacctaatacagcagatgacttcatgacaatattgagtgtgcaaatctaggatcatgatctgctgtcgctagcagaagcagcagtcatctcaggggaggtgttgcctgagatgagtgkttccttgttgacactgtgcttagctacctgggcaactaagcactagagacaggaytattccctgtttggatttctagcataacagktccatcaaaaacagaagaaactgcamaagagcaagtacctttgcagggaacattcacaaccccagtgactttcctacccttcagaaatagctgtattyccaaactgttaamatttttttctaaggaagaaagaaaaggtttgtagaattgagcatatgtatttttaaaagaaactttatt

SEQ ID NO: 5612 - DNA, 1747 bp, Homo sapiens
  misc_feature (1584)..(1584): n equals a,t,g, or c
  misc_feature (1625)..(1625): n equals a,t,g, or c
  misc_feature (1643)..(1643): n equals a,t,g, or c
  misc_feature (1681)..(1681): n equals a,t,g, or c
  misc_feature (1683)..(1683): n equals a,t,g, or c
  misc_feature (1687)..(1687): n equals a,t,g, or c
  misc_feature (1706)..(1706): n equals a,t,g, or c
cgggtcgacccacgcgtccggagggacacggaccaggaacctgagctaggtcaaagacgcccgggccaggtgccccgtcgcaggtgcccctggccggagatgcggtaggaggggcgagcgcgagaagccccttcctcggcgctgccaacccgccacccagcccatggcgaaccccgggctggggctgcttctggcgctgggcctgccgttcctgctggcccgctggggccgagcctgggggcaaatacagaccacttctgcaaatgagaatagcactgttttgccttcatccaccagctccagctccgatggcaacctgcgtccggaagccatcactgctatcatcgtggtcttctccctcttggctgccttgctcctggctgtggggctggcactgttggtgcggaagcttcgggagaagcggcagacggagggcacctaccggcccagtagcgaggagcaggtgggtgcccgcgtgccaccgacccccaacctcaagttgccgccggaagagcggctcatctgaacgctggggcctgctgcagccaccaacactgcccaggactgcgggttgctggcttgtacaccgcagctgccaccgagacaccagcctctgatggctcaggaggacttgtggggagaggctgggggcacccatgtggtgggctctgtgcagcatgttgcctctgcttggctgtgcctgcagctcagggtgctggggctcgggacccacccccctgcttgcggaaccaacttttctctgtgtgtccagcaggccccacaaccccctctcctttctttcagttctcccatgcagccgaggcccgggcccctcaggactccaaggagacggtgcagggctgcctgcccatctaggtcccctctcctgcatctgtctcccttcattgctgtgtgaccttggggaaaggcagtgccctctctgggcagtcagatccacccagtgcttaatagcagggaagaaggtacttcaaagactctgcccctgaggtcaagagaggatggggctattcacttttatatatttatataaaattagtagtgagatgtaacaaaaaaaaaaaaaaaaaagggcggccgctcgcttaaacatgcccaggactcakatccccgctctcctactcttggtattgcacggacacctatgaagaccagcagtggagaccccccaagcccactggtgaaacagctgagtgaagtatttgaaactgaagactctaaatcaaatcttccccmaragcctgttytgcccccagaggcacctttatcttctgaatttggacttgcctctgggtacccagttatctgttgaggaacagatgccaccttggaaccagactgagttcccctccaaacaggtgttttccaaggaggaagcaagacagcccacagaaacccctgtggccagccagagctccgacaagccctcaagggaccctgagactcccagatcttcagggtaagcggccttcacccctaagtgaaaatgttagtgaactaaaggaaggagccattcttggaactggacgacttctgaaaactggaggacgagcatgggagcaaggncaggaccatgacaaggaaaatcagcactttccttggtgganaactaggccctgcatggncccagcaatgcagtcacccaaggcctggtgatatctgngncctnttaccccttcttttccaanggatactgaggaatggcttggtttcttaaactcctcctcag

SEQ ID NO: 5613 - DNA, 1982 bp, Homo sapiens
cgccagctctaatacgactcactatagggaaagctggtacgcctgcaggtaccggtccggaattcccgggtcgacccacgcgtccggagggacacggaccaggaacctgagctaggtcaaagacgcccgggccaggtgccccgtcgcaggtgcccctggccggagatgcggtaggaggggcgagcgcgagaagccccttcctcggcgctgccaacccgccacccagcccatggcgaaccccgggctggggctgcttctggcgctgggcctgccgttcctgctggcccgctggggccgagcctgggggcaaatacagaccacttctgcaaatgagaatagcactgttttgccttcatccaccagctccagctccgatggcaacctgcgtccggaagccatcactgctatcatcgtggtcttctccctcttggctgccttgctcctggctgtggggctggcactgttggtgcggaagcttcgggagaagcggcagacggagggcacctaccggcccagtagcgaggagcaggtgggtgcccgcgtgccaccgacccccaacctcaagttgccgccggaagagcggctcatctgaacgctggggcctgctgcagccaccaacactgcccaggactgcgggttgctggcttgtacaccgcagctgccaccgagacaccagcctctgatggctcaggaggacttgtggggagaggctgggggcacccatgtggtgggctctgtgcagcatgttgcctctgcttggctgtgcctgcagctcagggtgctggggctcgggacccacccccctgcttgcggaaccaacttttctctgtgtgtccagcaggccccacaaccccctctcctttctttcagttctcccatgcagccgaggcccgggcccctcaggactccaaggagacggtgcagggctgcctgcccatctaggtcccctctcctgcatctgtctcccttcattgctgtgtgaccttggggaaaggcagtgccctctctgggcagtcagatccacccagtgcttaatagcagggaagaaggtacttcaaagactctgcccctgaggtcaagagaggatggggctattcacttttatatatttatataaaattagtagtgagatgtaacaaaaaaaaaaaaaaaaaagggcggccgctcgcttaaacatgcccaggactcakatccccgctctcctactcttggtattgcacggacacctatgaagaccagcagtggagaccccccaagcccactggtgaaacagctgagtgaagtatttgaaactgaagactctaaatcaaatcttcccccagagcctgttctgcccccagaggcacctttatcttctgaattggacttgcctctgggtacccagttatctgttgaggaacagatgccaccttggaaccagactgagttcccctccaaacaggtgttttccaaggaggaagcaagacagcccacagaaacccctgtggccagccagagctccgacaagccctcaagggaccctgagactcccagatcttcagggtaagcggccttcacccctaagtgaaaatgttagtgaactaaaggaaggagccattcttggaactggacgacttctgaaaactggaggacgagcatgggagcaaggccaggaccatgacaaggaaaatcagcactttcccttggtggagagctaggccctgcatggccccagcaatgcagtcacccagggcctggtgatatctgtgtcctctcaccccttctttcccagggatactgaggaatggcttgttttcttagactcctcctcagctaccaaactgggactcacagctttattgggctttctttgtgtcttgtgtgtttcttttatattaaaggaagtaattttaaatgttactttaaaaaggtaaaaaaaaaaaaagggcggccgctctagaggatccaagcttacgtacgcgtgcatgcgacgtcatagctct

SEQ ID NO: 5614 - DNA, 740 bp, Homo sapiens
gccttgctcctggctgtggggctggcactgttggtgcggaagcttcgggagaagcggcagacggagggcacctaccggcccagtagcgaggagcaggtgggtgcccgcgtgccaccgacccccaacctcaagttgccgccggaagagcggctcatctgaacgctggggcctgctgcagccaccaacactgcccaggactgcgggttgctggcttgtacaccgcagctgccaccgagacaccagcctctgatggctcaggaggacttgtggggagaggctgggggcacccatgtggtgggctctgtgcagcatgttgcctctgcttggctgtgcctgcagctcagggtgctggggctcgggacccacccccctgcttgcggaaccaacttttctctgtgtgtccagcaggccccacaaccccctctcctttctttcagttctcccatgcagccgaggcccgggcccctcaggactccaaggagacggtgcagggctgcctgcccatctaggtcccctctcctgcatctgtctcccttcattgctgtgtgaccttggggaaaggcagtgccctctctgggcagtcagatccacccagtgcttaatagcagggaagaaggtacttcaaagactctgcccctgaggtcaagagaggatggggctattcacttttatatatttatataaaattagtagtgagatgtaamaaaaaaaaaaaaaaaaaaaaaaaaaaaaaaaaaaaa

SEQ ID NO: 5615 - DNA, 817 bp, Homo sapiens
  misc_feature (644)..(644): n equals a,t,g, or c
  misc_feature (747)..(747): n equals a,t,g, or c
  misc_feature (756)..(756): n equals a,t,g, or c
  misc_feature (772)..(772): n equals a,t,g, or c
  misc_feature (798)..(798): n equals a,t,g, or c
accagtataggtgcaaagctggtacgcctgcaggtaccggtccggaattcccgggtcgacccacgcgtccgggttgtgtcacggaacggcagggccgcctttaggcttacatccctggaactcccacctccacagacccgtccgggtgctgaaagtccacggatgctatccctggtcaaatcagaggcttgtccagccggaagccctgagggcagctgttcccactggctctgctgaccttgtgccttggacggctgtcctcagcgaggggccgtgcacccgctcctgagcagcgccatgggcctgctggccttcctgaagacccagttcgtgctgcacctgctggtcggctttgtcttcgtggtgagtggtctggtcatcaacttcgtccagctgtgcacgctggcgctctggccggtcagcaagcagctctaccgccgcctcaactgccgcctcgcctactcactctggagccaactggtcatgctgctggagtggtggtcctgcacggagtgtacactgttcacggaccaggccacggtagagcgctttgggaaggagcacgcaatcatcatcctyaaccacaacttcgagatcgacttcctctgtgggtggaccatgtgtgagcgcttcggaatgctggngagctccaagggtcctcgctaagaaggagcttgctctacgtgccccttaatcgggcctggacgtggtacttttctgggaagattggggttctggcaaagcggnaaattgggnaaggagggacccgggnacaaccggggggtccgaaagggcctngaaaggcgccctggtccgg

SEQ ID NO: 5616 - DNA, 643 bp, Homo sapiens
gaacttcagaggaaacaagaacccgtccctgctggggatcctctacgggaagaagtacgaggcggacatgtgcgtgaggagatttcctctggaagacatcccgcgtggatgaaaaggaagcagctcagtggcttcataaactgtaccaggagaaggacgcgctccaggagatatataatcagaagggcatgtttccaggggagcagtttaagcctgcccggaggccgtggaccctcctgaacttcctgtcctgggccaccattctcctgtctcccctcttcagttttgtcttgggcgtctttgccagcggatcacctctcctgatcctgactttcttggggtttgtgggagcagcttcctttggagttcgcagactgataggagtaactgagatagaaaaaggctccagctacggaaaccaagagtttaagaaaaaggaataattaatggctgtgactgaacacacgcggcctgacggtggtatccagttaactcaaaaccaacacacagagtgcaggaaaagacaattagaaactatttttcttattaactggtgactaatattaacaaaacttgagccaagagtaaagaattcagaaggccaaaaaaaaaaaaaaaaaaaaaaaaaaaaaagggcggccgc

SEQ ID NO: 5617 - DNA, 707 bp, Homo sapiens
  misc_feature (1)..(1): n equals a,t,g, or c
  misc_feature (705)..(707): n equals a,t,g, or c
ngcgcgcctgcagtcgacactagtggatccaaagaattcggcacgagggcaggtccagggctcagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcgctcttcatcacggtcatggacaagctgcgcctggagatccgcgccatggatgagatccagcccgacctgcgagagctgatggagaccatgcaccgcatgagccacctcccacccgactttgagggccgccagacggtcagccagtggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccgccacacaggccgtggtcatccacacaactcactgtctgcagctgcctgtctggtgtctgtctttggtgtcagaacttttgggccgggcccctccccacaataaagatgctctccgaccttcaaaaaaaaaaaaaaaaaaactcrgggggggcccggtcccaatccccccnnn

SEQ ID NO: 5618 - DNA, 1406 bp, Homo sapiens
  misc_feature (16)..(16): n equals a,t,g, or c
  misc_feature (31)..(31): n equals a,t,g, or c
  misc_feature (41)..(41): n equals a,t,g, or c
gaaatactgtaaaaancgcctgaaaatgacntaaacaagtnatgaatgtaaacacctggccaaacaagccarctgtggacctgctcarcgacctgaggccaagtgcgagaaggtgtctgagtttgtggcgtctaagccaggcacgtgtgtgaaggtgctgaccatcgagcccccacctgcagacccccgcctccgggaggacatggcgctgctggccgattgtgccctgccccccgagctccgaggtgatctttgggagctgcccttcccttgtcctgacggcttcaacagctgccctgacatctgcttccgagtggctggctgcagcttcctctgccacaaggcctttttctgtggccgcagtgactacttccgagccctgctggatgaccacttccgagagagcgaggagccagcgacctcagggggccccccagccgtcaccctgcatggcatctcacccgacgtcttcactcacgtgctctactacatgtacagcgaccacactgagctgtcccccgaggcagcctatgatgtgctgagcgtcgccgacatgtacctgctgccaggcctgaagaggctgtgcggccgcagcctggctcagatgctagacgaggacactgtggtgggtgtgtggcgcgtggccaagctcttccgcctggcgcggcttgaggaccagtgcactgagtacatggccaaggtcattgagaagctggtggagcgggaggacttcgtggaggcggtgaaggaggaggcagcggctgtggcagcccggcaggagacggactctatcccgctggtggacgacatccgcttccacgtggccagcacggtgcagacctacagcgccatagaggaggcgcagcagcgtctgcgggcactcgaggacctgctcgtgtccatcggtctggactgttgagcccctggctgggcagccccaggggccaggagctctcttggagacaagcatgtgtatgcgtttgtgtgcagctcttcttcctgctccctgcacattgagggcttcatggggggtgcgaggggctcagtggggcttctcttccctccatgagcctggagaccccaggggaggatccatttgggatgagccccctccccccaatgcacaagccagcccccaagaccctgggggtggacaccactcagggaaacctggggtgggggtgggctttggtcttagcactttccttctccagatcccccctacccaccccagtcccaaatccagtcctctggcccttgcctagccctgaattgcttctctaagctggtgttcccatgcacagggccattcaggaagggctgggggagtgtgtgtggcaataaagcttgaaggcmccgtgrraaaaaaaaaaaaaaaaaaaaaaaaaaaaaaaaaaaaaaaaaaa

SEQ ID NO: 5619 - DNA, 1881 bp, Homo sapiens
  misc_feature (6)..(6): n equals a,t,g, or c
  misc_feature (8)..(8): n equals a,t,g, or c
  misc_feature (48)..(48): n equals a,t,g, or c
gtaagncngacgtcactatagggaaagctggtacgcctgcaggtaccnggtccggaattcccgggcttttccatgtgtcttcattctgcctgaagaaggctttcccaggatgcacgtcctcagagggagcagcctatctcccccaagctggaggcggcagaggactggccaagccccaacctgcctcccagccaggctcctccaggcctctggtttagcggagccccctgagcccaggcctgtgtctagccccagtggctcactgaactttcagggcagtcagggggtcctgcttagaagccagtcaccagccctctgcctgcagccatggaagggggtgtgcacgtgcctctgtgtgtgtggctgagtgtattctgcgcgtgtgtgtggagggagggagggaggggagcatggtgtctcccgctccaccgccctttgttgagccccatcagctgcccccttttactttgcattgaacggcctgtccaaagatcctctctctagggcagcagagagctttttgcactttaaaaaaaaaaaraaagaaagaaaggtcggaatttcttttgggtcaatatttttaagtgtgtgaggagatgctcagtagcagcagcctatggcaagagcttataaatgattgatgcaaatttgcactctgctccccctctgtaaggatactgatagcacaacctcttccccccaccccgccccgccttttggtcgtccatccctgtccctttctggccctcttcctgtagcccagtctcaggctttcctcttcctgaagccctacagagttagggaatggagcccaggcaccaggggtctaaagtgtgagccactgagaagagagacgccaactgcacccttgccacttccaaagcaatagaggcagagtggtcccctctttgccacctaggccagttttgaccctggcattaactggccttagaagaaactggatcctggtagggggtggcattttgtttgtttcttccaatctgctgaatcttttgactgcaccttacaaacagcagtctgctcccatgaccctctgcccacttccattggtctccaggccccaataatctggggttgaaactttgaggaaatgccagtgacttattccagagtgcctcagttaggggaacttctctgtaaagaaccctgggtattgagcaaaaaccttattatcgttaatgacctataattggaagcttcctgcctttttctttggttgctcctgtggaaaatactgaaaagattactttgttttattttgttgtctttttataaaaggggaggtggagagaccccttcagagcagggattgtgccgggagagtgcctctgactttgggacatttcatccacagaaatttccaagccaatggtttcttttgggttttggtttttatgtttgttttttggggtttggaaaaacatgcatttttaccgtgcacgtaaattggtcagcagaaaagggagcccagaaaaggcagcagatggaccatgcccttgctgggttttccttttctttgggactgtgaggggaaatggtttttagaggtgagggttggtccatgtggaggaaagaagtgtctctgttgggggacagaggaacctggggagtccatcgcatgtcctacaatctgctcttagacacggccttgccaggagagcctgccctcagactgcaggaccagaacccctgcctccatctttccaagcaccggggcgaaaaaccacaaaggaaaggaagaaaatttatatatatataatataaaatcacttggtgattaaaaaaataactgctccataaataaaactcctaaagtcacttatgtttaaaaaaaaaaaaaaaaaaaaaaagggcggccgc

SEQ ID NO: 5620 - DNA, 60 bp, Homo sapiens
ggggatgggaacccaaggctgtccacatcccagctggctgmtmcttctggggctgtcttg

SEQ ID NO: 5621 - protein, 45 aa, Homo sapiens
MEKMGQGLLSSTYLTVLHLIQLVGCGLLTEEIKESKYLIKTLGSG

SEQ ID NO: 5622 - protein, 207 aa, Homo sapiens
MIKHVAWLIFTNCIFFCPVAFFSFAPLITAISISPEIMKSVTLIFFPLPACLNPVLYVFFNPKFKEDWKLLKRRVTKKSGSVSVSISSQGGCLEQDFYYDCGMYSHLQGNLTVCDCCESFLLTKPVSCKHLIKSHSCPALAVASCQRPEGYWSDCGTQSAHSDYADEEDSFVSDSSDQVQACGRACFYQSRGFPLVRYAYNLPRVKD

SEQ ID NO: 5623 - protein, 72 aa, Homo sapiens
MPSIRLGLSHLFLTAGIYCLLLCARCCALGRGTAWAACPGGACGLMGEADPSPPHCQQGQGKSTHRGLIPYV

SEQ ID NO: 5624 - protein, 100 aa, Homo sapiens
MTKARLFRLWLVLGSVFMILLIIVYWDSAGAAHFYLHTSFSRPHTGPPLPTPGPDRDRELTADSDVDEFLDKFLSAGVKQSDLPRKETEQPPAPGSMEET

SEQ ID NO: 5625 - protein, 114 aa, Homo sapiens
  SITE (13): Xaa equals any amino acid
MAGPRASTGPRPXCLVLFLFNFIFCFMSVCPPTPTPFSVKWGALGESLLPPSLSQDLPPRHQPSLWTRQRADRVGRGLRVARASPPANGPLLRPPVSPCPFLKQNALVCKPLDA

SEQ ID NO: 5626 - protein, 131 aa, Homo sapiens
  SITE (43): Xaa equals any amino acid
  SITE (44): Xaa equals any amino acid
  SITE (49): Xaa equals any amino acid
  SITE (66): Xaa equals any amino acid
  SITE (78): Xaa equals any amino acid
  SITE (94): Xaa equals any amino acid
  SITE (102): Xaa equals any amino acid
MWSVIRSLCPSRLQSLHVCFCPRLCLAVPCVFHLSSPWFHVRXXFFSGXPGCIWGICFVGLLLGAXRPRSGCLCSPSXCLWSLVVCESICLPRXGPNQAPPXPLFLSLNLPFLFQPLQMRWLSAVGWREAM

SEQ ID NO: 5627 - protein, 414 aa, Homo sapiens
MTKARLFRLWLVLGSVFMILLIIVYWDSAGAAHFYLHTSFSRPHTGPPLPTPGPDRDRELTADSDVDEFLDKFLSAGVKQSDLPRKETEQPPAPGSMEENVRGYDWSPRDARRSPDQGRQQAERRSVLRGFCANSSLAFPTKERAFDDIPNSELSHLIVDDRHGAIYCYVPKVACTNWKRVMIVLSGSLLHRGAPYRDPLRIPREHVHNASAHLTFNKFWRRYGKLSRHLMKVKLKKYTKFLFVRDPFVRLISAFRSKFELENEEFYRKFAVPMLRLYANHTSLPASAREAFRAGLKVSFANFIQYLLDPHTEKLAPFNEHWRQVYRLCHPCQIDYDFVGKLETLDEDAAQLLQLLQVDRQLRFPPSYRNRTASSWEEDWFAKIPLAWRQQLYKLYEADFVLFGYPKPENLLRD

SEQ ID NO: 5628 - protein, 62 aa, Homo sapiens
MVAVTGGVGVAAALCLCSLLLWPTRLRRSRGGEHRTPSEGEGISTAPPPCWNETQPQGGAKL

SEQ ID NO: 5629 - protein, 49 aa, Homo sapiens
MRLCSFTKVPMNLFLNVILLKFYNFLFSLILGKSCLASLGLCKNNKCLS

SEQ ID NO: 5630 - protein, 218 aa, Homo sapiens
MGSAALEILGLVLCLVGWGGLILACGLPMWQVTAFLDHNIVTAQTTWKGLWMSCVVQSTGHMQCKVYDSVLALSTEVQAARALTVSAVLLAFVALFVTLAGAQCTTCVAPGPAKARVALTGGVLYLFCGLLALVPLCWFANIVVREFYDPSVPVSQKYELGAALYIGWAATALLMVGGCLLCCGAWVCTGRPDLSFPVKYSAPRRPTATGDYDKKNYV

SEQ ID NO: 5631 - protein, 44 aa, Homo sapiens
  SITE (34): Xaa equals any amino acid
MTKLLSLSHLLVTFFNIIAIKCKKQHLRHSKCNXDTTFKNKMLN

SEQ ID NO: 5632 - protein, 142 aa, Homo sapiens [sequence omitted]

SEQ ID NO: 5633 - protein, 30 aa, Homo sapiens
MALSVLVLLLLAVLYEGIKVGKASCSTRYW

SEQ ID NO: 5634 - protein, 44 aa, Homo sapiens
MQCDTFSKATCCKILLLSCCVLYLVFSRLRGLDQRSKRYSLPDH

SEQ ID NO: 5635 - protein, 91 aa, Homo sapiens
MVLRGWGLAWSLSPVVCGYSGDMKGVCWGRSDHSLLPSEILLPPAPCPSSAVLHNPPPTPHLPSPVLVRIQEAPTWAQRSSLGASPLHKGD

SEQ ID NO: 5636 - protein, 62 aa, Homo sapiens
  SITE (16): Xaa equals any amino acid
  SITE (54): Xaa equals any amino acid
MVTGFFFILMTVLWFXREPGFVPGWDSFFEKKGYRTDATVSVFLGFLLFLIPAXEALLWEKE

SEQ ID NO: 5637 - protein, 49 aa, Homo sapiens
GRKGGLSGTSFFTWFMVIALLGVWTSVPVVWFDLVVDEQITSQSKGLPL

SEQ ID NO: 5638 - protein, 66 aa, Homo sapiens
MLLAAFLALFPLHDSRGLKHTGAGHVNSVALLPIPLKAVSLSPVSSLQVPCCCSSFQLLLTFLSVS

SEQ ID NO: 5639 - protein, 122 aa, Homo sapiens
MCYLLLLLIQTAELLIHPQGLQAVSNGESALKGTRPTFSSPFILVTEGRKEWEGVFLSSGWKGNTLSNYYISLVFYYSRILQPYFYCLWGKLEMVTLIRSVWRGINGGDKIQLVLENVKVLK

SEQ ID NO: 5640 - protein, 43 aa, Homo sapiens
MEHLIRSGVKILFLNLLLTSCTTLNEWLNFLVTLNCSRYKMTG

SEQ ID NO: 5641 - protein, 91 aa, Homo sapiens
MRLCVTGPPVFFFFLNFFFFLCVGACLGDLKISRLVYLCKACLRLEYLGKESDSMLSEFLKGQKKNWRLLKCRFEVIFLKYYFGFCDIVKN

SEQ ID NO: 5642 - protein, 50 aa, Homo sapiens
MLTYLPRWCFLSLPPPCCGAASCTMMHIQIILNTHILIERFLGFLLNQVY

SEQ ID NO: 5643 - protein, 181 aa, Homo sapiens
MTSRRSSTLSMTSSLLSLGCALTSAFPASTMSWVPLLQMLDQSPRRVMRKSVSQLCPLLRPHPPLSSKHPLVLPLQLPPTFLHLLPGPGCPGQTVAYWLLEFLSRATLKLYPGDRPLWLQPTRLNFKDHWTIFSVASAALFCVHRMATDRHASFPTHWKAHRQGERGHRRCQHCRYSKDLK

SEQ ID NO: 5644 - protein, 66 aa, Homo sapiens
  SITE (12): Xaa equals any amino acid
MNLSIILPNSFXHLCNFSLFLLPLPVPSQPLICSGNYQSSFCHYRLICIFKEIYIHGTIHHLCFVV

SEQ ID NO: 5645 - protein, 317 aa, Homo sapiens
  SITE (207): Xaa equals any amino acid
MPGLGRPRQARWTLMLLLSTAMYGAHAPLLALCHVDGRVPFRPSSAVLLTELTKLLLCAFSLLVGWQAWPQGPPPWRQAAPFALSALLYGANNNLVIYLQRYMDPSTYQVLSNLKIGSTAVLYCLCLRHRLSVRQGLALLLLMAAGACYAAGGLQVPGNTLPSPPPAAAASPMPLHITPLGLLLLILYCLISGLSSVYTELLMKRQXLPLALQNLFLYTFGVLLNLGLHAGGGSGPGLLEGFSGWAALVVLSQALNGLLMSAVMKHGSSITRLFVVSCSLVVNAVLSAVLLRLQLTAAFFLATLLIGLAMRLYYGSR

SEQ ID NO: 5646 - protein, 113 aa, Homo sapiens
MHPPLTPPTPLCLWLRLLKAQILSYPVPRFETHSLISRCSQVPPTFLWDIKKGVRGQREPSGPLLPYTLHCPFSPHQNAQRRCDDATEDYATWSNRSGQHDQLSRGCLLPFLL

SEQ ID NO: 5647 - protein, 446 aa, Homo sapiens [sequence omitted]

SEQ ID NO: 5648 - protein, 140 aa, Homo sapiens
  SITE (129): Xaa equals any amino acid
  SITE (132): Xaa equals any amino acid
  SITE (134): Xaa equals any amino acid
MFFSLPGLWQIASFTHNLIFHLWVWGSESGEHLQSHNDPDTRQGGHIPIRLLGESSASVPGSSEGHTGGPAPPRVGGSAGIIRTHVVFLVSWPLLQREQHRLSWKLPSVMWGDSREPHLARLDQSKWPXATXAXQYLGRG

SEQ ID NO: 5649 - protein, 94 aa, Homo sapiens [sequence omitted]

SEQ ID NO: 5650 - protein, 563 aa, Homo sapiens
MWAVLRLALRPCARASPAGPRAYHGDSVASLGTQPDLGSALYQENYKQMKALVNQLHERVEHIKLGGGEKARALHISRGKLLPRERIDNLIDPGSPFLELSQFAGYQLYDNEEVPGGGIITGIGRVSGVECMIIANDATVKGGAYYPVTVKKQLRAQEIAMQNRLPCIYLVDSGGAYLPRQADVFPDRDHFGRTFYNQAIMSSKNIAQIAVVMGSCTAGGAYVPAMADENIIVRKQGTIFLAGPPLVKAATGEEVSAEDLGGADLHCRKSGVSDHWALDDHHALHLTRKVVRNLNYQKKLDVTIEPSEEPLFPADELYGIVGANLKRSFDVREVIARIVDGSRFTEFKAFYGDTLVTGFARIFGYPVGIVGNNGVLFSESAKKGTHFVQLCCQRNIPLLFLQNITGFMVGREYEAEGIAKDGAKMVAAVACAQVPKITLIIGGSYGAGNYGMCGRAYSPRFLYIWPNARISVMGGEQAANVLATITKDQRAREGKQFSSADEAALKEPIIKKFEEEGNPYYSSARVWDDGIIDPADTRLVLGLSFSAALNAPIEKTDFGIFRM

SEQ ID NO: 5651 - protein, 53 aa, Homo sapiens
MVQFEVIFLLFGLCFSSSSSRLVGSQVENFSPTPCIFQAFRCSSLAIISMSLS

SEQ ID NO: 5652 - protein, 607 aa, Homo sapiens
  SITE (242): Xaa equals any amino acid
MRTPQLALLQVFFLVFPDGVRPQPSSSPSGAVPTSLELQRGTDGGTLQSPSEATATRPAVPGLPTVVPTLVTPSAPGNRTVDLFPVLPICVCDLTPGACDINCCCDRDCYLLHPRTVFSFCLPGSVRSSSWVCVDNSVIFRSNSPFPSRVFMDSNGIRQFCVHVNNSNLNYFQKLQKVNATNFQALAAEFGGESFTSTFQTQSPPSFYRAGDPILTYFPKWSVISLLRQPAGVGAGGLCAEXNPAGFLESKSTTCTRFFKNLASSCTLDSALNAASYYNFTVLKVPRSMTDPQNMEFQVPVILTSQANAPLLAGNTCQNVVSQVTYEIETNGTFGIQKVSVSLGQTNLTVEPGASLQQHFILRFRAFQQSTAASLTSPRSGNPGYIVGKPLLALTDDISYSMTLLQSQGNGSCSVKRHEVQFGVNAISGCKLRLKKADCSHLQQEIYQTLHGRPRPEYVAIFGNADPAQKGGWTRILNRHCSISAINCTSCCLIPVSLEIQVLWAYVGLLSNPQAHVSGVRFLYQCQSIQDSQQVTEVSLTTLVNFVDITQKPQPPRGQPKMDWKWPFDFFPFKVAFSRGVFSQKCSVSPILILCLLLLGVLNLETM

SEQ ID NO: 5653 - protein, 421 aa, Homo sapiens
MTVFFKTLRNHWKKTTAGLCLLTWGGHWLYGKHCDNLLRRAACQEAQVFGNQLIPPNAQVKKATVFSILQLAKEKPGLYLKKMLPDFTFIWHGCDYCKTDYEGQAKKLLELMENTDVIIVAGGDGTLQEVVTGVLRRTDEATFSKIPIGFIPLGETSSLSHTLFAESGNKVQHITDATLAIVKGETVPLDVLQIKGEKEQPVFAMTGLRWGSFRDAGVKVSKYWYLGPLKIKAAHFFSTLKEWPQTHQASISYTGPTERPPNEPEETPVQRPSLYRRILRRLASYWAQPQDALSQEVSPEVWKDVQLSTIELSITTRNNQLDPTSKEDFLNICIEPDTISKGDFITIGSRKVRNPKLHVEGTECLQASQCTLLIPEGAGGSFSIDSEEYEAMPVEVKLLPRKLQFFCDPRKREQMLTSPTQ

SEQ ID NO: 5654 - protein, 79 aa, Homo sapiens [sequence omitted]

SEQ ID NO: 5655 - protein, 55 aa, Homo sapiens [sequence omitted]

SEQ ID NO: 5656 - protein, 242 aa, Homo sapiens [sequence omitted]

SEQ ID NO: 5657 - protein, 41 aa, Homo sapiens
MATLQITTAMKITMMITMVMIITTIVEAMKIPTTAMMMAMQ

SEQ ID NO: 5658 - protein, 129 aa, Homo sapiens
MHVLPLLLSLLLLLLLLSASFVTFSTPTSSRNSSCPDCESLNTGLPSLMMFGGSLLKWVQNTHGVESLLSSAKVRLLPPALGVLFPRLHPGTLTLVFLLIPFLTVSSSTSDVLSSLESPKLSVTIFHYC

SEQ ID NO: 5659 - protein, 50 aa, Homo sapiens
MYIFELSLYLEGTSFVVVLLFLLISVSLDSPPTTKGWDSVLHIWVPLIVQ

SEQ ID NO: 5660 - protein, 189 aa, Homo sapiens
  SITE (94): Xaa equals any amino acid
MALLSRPALTLLLLLMAAVVRCQEQAQTTDWRATLKTIRNGVHKIDTYLNAALDLLGGEDGLCQYKCSDGSKPFPRYGYKPSPPNGCGSPLFGXHLNIGIPSLTKCCNQHDRCYETCGKSKNDCDEEFQYCLSKICRDVQKTLGLTQHVQACETTVELLFDSVIHLGCKPYLDSQRAACRCHYEEKTDL

SEQ ID NO: 5661 - protein, 264 aa, Homo sapiens
MLRCGGRGLLLGLAVAAAAVMAARLMGWWGPRAGFRLFIPEELSRYRGGPGDPGLYLALLGRVYDVSSGRRHYEPGSHYSGFAGRDASRAFVTGDCSEAGLVDDVSDLSAAEMLTLHNWLSFYEKNYVCVGRVTGRFYGEDGLPTPALTQVEAAITRGLEANKLQLQEKQTFPPCNAEWSSARGSRLWCSQKSGGVSRDWIGVPRKLYKPGAKEPRCVCVRTTGPPSGQMPDNPPHRNRGDLDHPNLAEYTGCPPLAITCSFPL

SEQ ID NO: 5662 - protein, 72 aa, Homo sapiens
MTSYILISFVLLIGVGCIEKDQSCPVFGGRKRLHLLFVGGQLRQVRMLRGELSCACYRPHVQALQLGGCTCF

SEQ ID NO: 5663 - protein, 140 aa, Homo sapiens [sequence omitted]

SEQ ID NO: 5664 - protein, 110 aa, Homo sapiens
MVLLCLLLVPLLLSLFVLGLFLWFLKRERQEEYIEEKKRVDICRETPNICPHSGENTEYDTIPHTNRTILKEDPANTVYSTVEIPKKMENPHSLLTMPDTPRLFAYENVI

SEQ ID NO: 5665 - protein, 53 aa, Homo sapiens
MAGQHLACLASCVMSLIWFFFFCSCFICSAPAPPQQLVAYGFFKRKVDFMLYI

SEQ ID NO: 5666 - protein, 248 aa, Homo sapiens
MGPVRLGILLFLFLAVHEAWAGMLKEEDDDTERLPSKCEVCKLLSTELQAELSRTGRSREVLELGQVLDTGKRKRHVPYSVSETRLEEALENLCERILDYSVHAERKGSLRYAKGQSQTMATLKGLVQKGVKVDLGIPLELWDEPSVEVTYLKKQCETMLEEFEDIVGDWYFHHQEQPLQNFLCEGHVLPAAETACLQETWTGKEITDGEEKTEGEEEQEEEEEEEEEEGGDKMTKTGSHPKLDREDL

SEQ ID NO: 5667 - protein, 64 aa, Homo sapiens
MPLFLFVAHLISLLLAFRRPPASQITPRAWTTEIASCESVEMVKALSSLRSRAQVNADFPGHLC

SEQ ID NO: 5668 - protein, 56 aa, Homo sapiens
MLVAPFNLLFEMAPFNIFLFPQWGLLWLMLYLLYVFQASLRTPELTWERVRSQVDQ

SEQ ID NO: 5669 - protein, 182 aa, Homo sapiens
MMVCSIMMYFLLGITLLRSYMQSVWTEESQCTLLNASITETFNCSFSCGPDCWKLSQYPCLQVYVNLTSSGEKLLLYHTEETIKINQKCSYIPKCGKNFEESMSLVNVVMENFRKYQHFSCYSDPEGNQKSVILTKLYSSNVLFHSLFWPTCMMAGGVAIVAMVKLTQYLSLLCERIQRINR

SEQ ID NO: 5670 - protein, 68 aa, Homo sapiens [sequence omitted]

SEQ ID NO: 5671 - protein, 53 aa, Homo sapiens
MLVFLLLFSTVTVLCLKVVFSLKAVAYIVKNEGLCLKFIALQRVVSLKSCTIK

SEQ ID NO: 5672 - protein, 49 aa, Homo sapiens
MNLLGMIFSMCGLMLKLKWCAWVAVYCSFISFANSRSSEDTKQMMSSFM

SEQ ID NO: 5673 - protein, 110 aa, Homo sapiens
MTVSYFWWLRVGAWAEDVEALASLPEDRLRWNLLALPASPCAVTALVARHRRAGLQRSIQCLLGRQGGGGCNCELTKPQVGSKWVGHRKKSDLQSGDLGSGLCLMTGSVM

SEQ ID NO: 5674 - protein, 258 aa, Homo sapiens [sequence omitted]

SEQ ID NO: 5675 - protein, 59 aa, Homo sapiens
MNSTLCVVLSLMCMNSTLCVVLSLTHSCPSPQVPKVHYMIFMPLHLHSLALTQLIIIYK

SEQ ID NO: 5676 - protein, 48 aa, Homo sapiens
MVVNDRLVSTCILCTLHIPLFFLIFLVYEVHLVFQIVANLQKIFQYIY

SEQ ID NO: 5677 - protein, 202 aa, Homo sapiens
MSLLVDGDMNLSIIMTISSTLLALVLMPLCLWIYSWAWINTPIVQLLPLGTVTLTLCSTLIPIGLGVFIRYKYSRVADYIVKVSLWSLLVTLVVLFIMTGTMLGPELLASIPAAVYVIAIFMPLAGYASGYGLATLFHLPPNCKRTVCLETGSQNVQLCTAILKLAFPPQFIGSMYMFPLLYALFQSAEAGIFVLIYKMYGR

SEQ ID NO: 5678 - protein, 240 aa, Homo sapiens
MGNCQAGHNLHLCLAHHPPLVCATLILLLLGLSGLGLGSFLLTHRTGLRSPDIPQDWVSFLRSFGQLTLCPRNGTVTGKWRGSHVVGLLTTLNFGDGPDRNKTRTFQATVLGSQMGLKGSSAGQLVLITARVTTERTAGTCLYFSAVPGILPSSQPPISCSEEGAGNATLSPRMGEECVSVWSHEGLVLTKLLTSEELALCGSRLLVLGSFLLLFCGLLCCVTAMCFHPRRESHWSRTRL

SEQ ID NO: 5679 - protein, 185 aa, Homo sapiens
MSPSGRLCLLTIVGLILPTRGQTLKDTTSSSSADSTIMDIQVPTRAPDAVYTELQPTSPTPTWPADETPQPQTQTQQLEGTDGPLVTDPETHKSTKAAHPTDDTTTLSERPSPSTDVQTDPQTLKPSGFHEDDPFFYDEHTLRKRGLLVAAVLFITGIIILTSGKCRQLSRYAGIIGGESIRNRS

SEQ ID NO: 5680 - protein, 23 aa, Homo sapiens
ELLFLLIIILGESLSDVILLICF

SEQ ID NO: 5681 - protein, 197 aa, Homo sapiens
MAGPWTFTLLCGLLAATLIQATLSPTAVLILGPKVIKEKLTQELKDHNATSILQQLPLLSAMREKPAGGIPVLGSLVNTVLKHIIWLKVITANILQLQVKPSANDQELLVKIPLDMVAGFNTPLVKTIVEFHMTTEAQATIRMDTSASGPTRLVLSDCATSHGSLRIQLLHKLSFLVNALAKQVMNLLVPSMPRWPN

SEQ ID NO: 5682 - protein, 39 aa, Homo sapiens
MLLLLKTLFVTFWSTNLSITFSNYNVKLYQWQSYIVNGS

SEQ ID NO: 5683 - protein, 38 aa, Homo sapiens
MKNMNSRYYLRAIFCLYTLACILFLQIILKARCGGSRL

SEQ ID NO: 5684 - protein, 174 aa, Homo sapiens [sequence omitted]

SEQ ID NO: 5685 - protein, 40 aa, Homo sapiens
MPFSSSVKCLFGVLLRFCFVVFSVVVFTFFLSIPKRTLGY

SEQ ID NO: 5686 - protein, 40 aa, Homo sapiens
MIACQYISLAIMLAFVRWAAFLLFPFLCGDNGGNIQQKYV

SEQ ID NO: 5687 - protein, 46 aa, Homo sapiens
MEMLSSKWSKRVAASLAHLISLFIGLLFLLLGSSVYPGTETLFPKS

SEQ ID NO: 5688 - protein, 244 aa, Homo sapiens [sequence omitted]

SEQ ID NO: 5689 - protein, 74 aa, Homo sapiens [sequence omitted]

SEQ ID NO: 5690 - protein, 245 aa, Homo sapiens
MEGPRGWLVLCVLAISLASMVTEDLCRAPDGKKGEAGRPGRRGRPGLKGEQGEPGAPGIRTGIQGLKGDQGEPGPSGNPGKVGYPGPSGPLGARGIPGIKGTKGSPGNIKDQPRPAFSAIRRNPPMGGNVVIFDTVITNQEEPYQNHSGRFVCTVPGYYYFTFQVLSQWEICLSIVSSSRGQVRRSLGFCDTTNKGLFQVVSGGMVLQLQQGDQVWVEKDPKKGHIYQGSEADSVFSGFLIFPSA

SEQ ID NO: 5691 - protein, 61 aa, Homo sapiens
MYLFLKTLLSFSTLMMTTALSFMVITVLWVLLLHLLANICIPRKCSFACFYINGILLHAVF

SEQ ID NO: 5692 - protein, 250 aa, Homo sapiens
MRGTPKTHLLAFSLLCLLSKVRTQLCPTPCTCPWPPPRCPLGVPLVLDGCGCCRVCARRLGEPCDQLHVCDASQGLVCQPGAGPGGRGALCLLAEDDSSCEVNGRLYREGETFQPHCSIRCRCEDGGFTCVPLCSEDVRLPSWDCPHPRRVEVLGKCCPEWVCGQGGGLGTQPLPAQGPQFSGLVSSLPPGVPCPEWSTAWGPCSTTCGLGMATRVSNQNRFCRLETQRRLCLSRPCPPSRGRSPQNSAF

SEQ ID NO: 5693 - protein, 54 aa, Homo sapiens
MVLSPWACLFVVFFPYIQSSLRSDKHLQLSNILPTPSHHIHLPASICIQLRAGN

SEQ ID NO: 5694 - protein, 83 aa, Homo sapiens
MLSLFFCFWKPSFLVSRLVIWLGLVCGGRSLSWVALGEDYLGTPILIPNIHQTCPHPPLWELVPEHPCRLVLIFSLCEHTHIR

SEQ ID NO: 5695 - protein, 81 aa, Homo sapiens
MSILTMISSWPFSRVVRFWFLHQMVLDLCLGQGVPQQNLENPRERKSFLLFVRNLIIDSSLKILSQEPSNLWQRIPKMMTT

SEQ ID NO: 5696 - protein, 30 aa, Homo sapiens
MVSLLSLTFHQFVSSLKYFKLLSTSRQEIL

SEQ ID NO: 5697 - protein, 88 aa, Homo sapiens
MWAVLPAWFPFPGTCHCLPVSLRGHFWEVRPWPPGPLFRSEAPTCLGSGSSGVRPCPPQDIPSKPAMSGDGPLPGKVLFLLVTEKNLP

SEQ ID NO: 5698 - protein, 319 aa, Homo sapiens
MSWCCLWLCLSSVGRTGSAGPSLPFSELCSLGLLRLRPVFSPLHSGPGKPAQFLAGEAEEVNAFALGFLSTSSGVSGEDEVEPLHDGVEEAEKKMEEEGVSVSEMEATGAQGPSRVEEAEGHTEVTEAEGSQGTAEADGPGASSGDEDASGRAASPESASSTPESLQARRHHQFLEPAPAPGAAVLSSEPAEPLLVRHPPRPRTTGPRPRQDPHKAGLSHYVKLFSFYAKMPMERKALEMVEKCLDKYFQHLCDDLEVFAAHAGRKTVKPEDLELLMRRQGLVTDQVSLHVLVERHLPLEYRQLLIPCAYSGNSVFPAQ

SEQ ID NO: 5699 - protein, 336 aa, Homo sapiens [sequence omitted]

SEQ ID NO: 5700 - protein, 272 aa, Homo sapiens
MWGNKFGVLLFLYSVLLTKGIENIKNEIEDASEPLIDPVYGHGSQSLINLLLTGHAVSNVWDGDRECSGMKLLGIHEQAAVGFLTLMEALRYCKVGSYLKSPKFPIWIVGSETHLTVFFAKDMALVAPEAPSEQARRVFQTYDPEDNGFIPDSLLEDVMKALDLVSDPEYINLMKNKLDPEGLGIILLGPFLQEFFPDQGSSGPESFTVYHYNGLKQSNYNEKVMYVEGTAVVMGFEDPMLQTDDTPIKRCLQTKWPYIELLWTTDRSPSLN

SEQ ID NO: 5701 - protein, 89 aa, Homo sapiens
MFKDYPPAIKPSYDVLLLLLLLVLLLQAGLNTGTAIQCVRFKVSARLQGASWDTQNGPQERLAGEVARSPLKEFDKEKAWRAVVVQMAQ

SEQ ID NO: 5702 - protein, 31 aa, Homo sapiens
MFSSKSLLVLPFCFRSAAHLELSVWCVCGVR

SEQ ID NO: 5703 - protein, 187 aa, Homo sapiens
MACKGLLQQVQGPRLPWTRLLLLLLVFAVGFLCHDLPVTQLLPGWLGETLPLWGSHLLTVVRPSLQLAWAHTNATVSFLSAHCASHLAWFGDSLTSLSQRLQIQLPDSVNQLLRYLRELPLLFHQNVLLPLWHLLLEALAWAQEHCHEACRGEVTWDCMKTQLSEAVHWTWLCYRTLQWLSWTGHLP

SEQ ID NO: 5704 - protein, 52 aa, Homo sapiens
MYLMSFSIHFVKIICMCTILVLSPPVLLKYQDSTPRPLWSQCKIPINYLKGK

SEQ ID NO: 5705 - protein, 106 aa, Homo sapiens
MPGVLGALLGVLVAGLATHEAYGDGLESVFPLIAEGQRSATSQAMHQLFGLFVTLMFASVGGGLGGIILVLCLLDPCALWHWVAPSSMVGGREASQILPYHHQGSC

SEQ ID NO: 5706 - protein, 51 aa, Homo sapiens
  SITE (23): Xaa equals any amino acid
MAQHHLLSILLAILSCSSQPRQXRGSGALPCEVCSAVLLTCLRKISGSLCV

SEQ ID NO: 5707 - protein, 97 aa, Homo sapiens [sequence omitted]

SEQ ID NO: 5708 - protein, 58 aa, Homo sapiens
MSSFPGPQCVQLINLLHLICPVSGLVCSAITIALRQKSIPHQQGREAVIKTPPPGSLP

SEQ ID NO: 5709 - protein, 43 aa, Homo sapiens
  SITE (26): Xaa equals any amino acid
MSNTLLSQWLLLLTLFKCIILPLNLXPIIRTIPDWSPELGTNT

SEQ ID NO: 5710 - protein, 63 aa, Homo sapiens
MLRGWALSTFLVCILQWVRSLTIRLASALSVRGPSSIPASLAIIYTLFIFSFKFLKIVKSIYI

SEQ ID NO: 5711 - protein, 74 aa, Homo sapiens
MLHLAAMWWACVTTLVFTLVSKLFIPLKSSMDGEMSLDPHSCVLVCICFPLRFVFVSCFELYLVQSIVKLSQQL

SEQ ID NO: 5712 - protein, 169 aa, Homo sapiens
MLAGAGRPGLPQGRHLCWLLCAFTLKLCQAEAPVQEEKLSASTSNLPCWLVEEFVVAEECSPCSNFRAKTTPECGPTGYVEKITCSSSKRNEFKSLPLSFDGTTLILEVRRGCRVCGPDLRLSCHHSSATIGQKGSGKGPEANRVHIATFHPCILGLRDPISDSESEMD

SEQ ID NO: 5713 - protein, 88 aa, Homo sapiens [sequence omitted]

SEQ ID NO: 5714 - protein, 47 aa, Homo sapiens
MPTLGDALILYLHLVLGVAGVLQPPGPRPSQALGPTGDRAPGKWNRS

SEQ ID NO: 5715 - protein, 123 aa, Homo sapiens
  SITE (71): Xaa equals any amino acid
MTHWSGCAALYLIFLSLKLAFQAGAGRGAQVGSVLPPSGGAVVVDQILLPPVCTNIFLSSSPSEVYWNMSXTIMMVVKMMMMWVILATLLGPSSPQFVAQSTLHTFSLVLIKPPFRVGFSVLF

SEQ ID NO: 5716 - protein, 127 aa, Homo sapiens [sequence omitted]

SEQ ID NO: 5717 - protein, 43 aa, Homo sapiens
MSALSFTSYFLLLLRVKPVEVSGSIPHPEQPNVLCLVLPTFGY

SEQ ID NO: 5718 - protein, 46 aa, Homo sapiens
MDLLQVCFFLFFSHLWSWTEGKLPCNFPGPVGRVFLSPFQMLGFKQ

SEQ ID NO: 5719 - protein, 158 aa, Homo sapiens [sequence omitted]

SEQ ID NO: 5720 - protein, 2 aa, Homo sapiens
LQ

SEQ ID NO: 5721 - protein, 38 aa, Homo sapiens
MHLFLFIWAFGLPLHISRDLAFFFLLYFLFFYLLCVLL

SEQ ID NO: 5722 - protein, 60 aa, Homo sapiens [sequence omitted]

SEQ ID NO: 5723 - protein, 64 aa, Homo sapiens [sequence omitted]

SEQ ID NO: 5724 - protein, 44 aa, Homo sapiens
MMPLKLHAKCLYLLKCVFFVGVGGMTFYQILTGFKIQKSLDLVG

SEQ ID NO: 5725 - protein, 79 aa, Homo sapiens [sequence omitted]

SEQ ID NO: 5726 - protein, 47 aa, Homo sapiens
MFYPPCPFFPQLCFCIFFLGKCKLSLSFMTCEISVSLEFVRRRGNHA

SEQ ID NO: 5727 - protein, 100 aa, Homo sapiens
  SITE (36): Xaa equals any amino acid
  SITE (47): Xaa equals any amino acid
  SITE (51): Xaa equals any amino acid
  SITE (83): Xaa equals any amino acid
MGMILVLASFLAHPVEALAQAVALGQQQLALLGVQXHAVEGFLQLQXCFAXLFVFEGALLAHLGHFFVEPGAAQGQLLDLGLXRRELGFQFALLARFVLQ

SEQ ID NO: 5728 - protein, 343 aa, Homo sapiens
MRAPFNTLFGRLFGLLLVAIVLAHVLAFFWFHHYGPPPPPRAAFVEQPDGSLTPLRKAPRPWFGGPVVPLTFQFISLIIAAWYGAKLLSRPIQRLSAAAERLSVDLDSPPLVETGPREARQAASTFNLMQKRIREQVSQRARMLGAVSHDLRTPLSRLKLRLEQIEDPKLQGQMRQDLDDMIGMLDATLSYLHEQRTSETRHWLDVQALVESLSENAQDQGRDVQFAGTCTPLQVQPMALRSCLNNLIDNALRYAGTARVELADSRGALVIRVIDHGPGIAADKREAVFEPFFRLEGSRNRNSGGVGLGMTIAREAVERLGGHLSLEDTPGGGLTAVMWLPRV

SEQ ID NO: 5729 - protein, 10 aa, Homo sapiens
MGLFLFLVSS

SEQ ID NO: 5730 - protein, 40 aa, Homo sapiens
MIILHIVVCLFTISIIEEQKEEILCSTKSQAEKTVTHIEQ

SEQ ID NO: 5731 - protein, 65 aa, Homo sapiens [sequence omitted]

SEQ ID NO: 5732 - protein, 45 aa, Homo sapiens
MQKKKLVCYLMLRQYFFLVVVSLPWPCVLFQMHYPRTVTPTLTEY

SEQ ID NO: 5733 - protein, 146 aa, Homo sapiens
MWKLWRAEEGAAALGGALFLLLFALGVRQLLKQRRPMGFPPGPPGLPFIGNIYSLAASSELPHVYMRKQSQVYGEVQPRRAPGREGRQAGPGWPGPSWLDLWPPLGRLVGTSPCAGCPLRDTRFPGLEGRSPRRRAPLQGEPRPCR

SEQ ID NO: 5734 - protein, 108 aa, Homo sapiens
  SITE (62): Xaa equals any amino acid
  SITE (63): Xaa equals any amino acid
MGAAKVWGEVGRWLVIALIQLAKAVLRMLLLLWFKAGLQTSPPIVPLDRETRHSPRMVTTAXXTMSSPTWGSGQTGWCEPSRTRRPCTPGTGELPSSGRDGSSSITRS

SEQ ID NO: 5735 - protein, 168 aa, Homo sapiens
  SITE (60): Xaa equals any amino acid
  SITE (64): Xaa equals any amino acid
  SITE (132): Xaa equals any amino acid
MVTFASSTLWIAAFSYMMVWMVTIIGYTLGIPDVIMGITFLAAGTSVPDCMASLIVARQXMGDXAVSNSIGSNVFDILIGLGLPWALQTLAVDYGSYIRLNSRGLIYSVGLLLASVFVTVFGVHLNKWQLDXKLGCGCLLLYGVFLCFSIMTEFNVFTFVNLPMCGDH

SEQ ID NO: 5736 - protein, 315 aa, Homo sapiens
MESLYDLWEFYLPYLYSCISLMGCLLLLLCTPVGLSRMFTVMGQLLVKPTILEDLDEQIYIITLEEEALQRRLNGLSSSVEYNIMELEQELENVKTLKTKLDPWSSFSVLQSPVWHFAAQTPADIVSPDSHFMLSTQGMSWAQLVFLLPASRPGNSQDKRRKKASAWERNLVYPAVMVLLLIETSISVLLVACNILCLLVDETAMPKGTRGPGIGNASLSTFGFVGAALEIILIFYLMVSSVVGFYSLRFFGNFTPKKDDTTMTKIIGNCVSILVLSSALPVMSRTLGLHKLHLPNTSRDSETAKPSVNGHQKAL

SEQ ID NO: 5737 - protein, 81 aa, Homo sapiens
MNQLMFQDLLCCLCLFVIGLISLLRKTYSCVNLCKVMLPVKKYSTVSTVLCRNMKLNGKNVLMFVVMLLGQWMGKLPKLSP

SEQ ID NO: 5738 - protein, 76 aa, Homo sapiens
MVVDLFFYLLCIFLVLWVLEAMIKHLMYSDMSALIASFSSFLNCIHYFQNRYRYSVPPFELLACSCFPLSPKQGFF

SEQ ID NO: 5739 - protein, 941 aa, Homo sapiens [sequence omitted]

SEQ ID NO: 5740 - protein, 316 aa, Homo sapiens
MTQGKLSVANKAPGTEGQQQVHGEKKEAPAVPSAPPSYEEATSGEGMKAGAFPPAPTAVPLHPSWAYVDPSSSSSYDNGFPTGDHELFTTFSWDDQKVRRVFVRKVYTILLIQLLVTLAVVALFTFCDPVKDYVQANPGWYWASYAVFFATYLTLACCSGPRRHFPWNLILLTVFTLSMAYLTGMLSSYYNTTSVLLCLGITALVCLSVTVFSFQTKFDFTSCQGVLFVLLMTLFFSGLILAILLPFQYVPWLHAVYAALGAGVFTLFLALDTQLLMGNRRHSLSPEEYIFGALNIYLDIIYIFTFFLQLFGTNRE

SEQ ID NO: 5741 - protein, 222 aa, Homo sapiens
MALAGSVFVLGGVLVLCVERNGEGEMGWPQHLPKSQPLSPPVAVRRLQLREELDRSSCGNVLFNGYLPPPVFPVKRRNRHSLVGPQQLGGRPAPVRRSNTMPPNLGNAGLLGRMLDEKTPPSPSGQPEEPGMVRLVCGHHNWIAVAYTQFLVCYRLKEASGWQLVFSSPRLDWPIERLALTARVHGGALGEHDKMVAAATGSEILLWALQAEGGGSEIENYP

SEQ ID NO: 5742 - protein, 612 aa, Homo sapiens
MAAAGRLPSSWALFSPLLAGLALLGVGPVPARALHNVTAELFGAEAWGTLAAFGDLNSDKQTDLFVLRERNDLIVFLADQNAPYFKPKVKVSFKNHSALITSVVPGDYDGDSQMDVLLTYLPKNYAKSELGAVIFWGQNQTLDPNNMTILNRTFQDEPLIMDFNGDLIPDIFGITNESNQPQILLGGNLSWHPALTTTSKMRIPHSHAFIDLTEDFTADLFLTTLNATTSTFQFEIWENLDGNFSVSTILEKPQNMMVVGQSAFADFDGDGHMDHLLPGCEDKNCQKSTIYLVRSGMKQWVPVLQDFSNKGTLWGFVPFVDEQQPTEIPIPITLHIGDYNMDGYPDALVILKNTSGSNQQAFLLENVPCNNASCEEARRMFKVYWELTDLNQIKDAMVATFFDIYEDGILDIVVLSKGYTKNDFAIHTLKNNFEADAYFVKVIVLSGLCSNDCPRKITPFGVNQPGPYIMYTTVDANGYLKNGSAGQLSQSAHLALQLPYNVLGLGRSANFLDHLYVGIPRPSGEKSIRKQEWTAIIPNSQLIVIPYPHNVPRSWSAKLYLTPSNIVLLTAIALIGVCVFILAIIGILHWQEKKADDREKRQEAHRFHFDAM

SEQ ID NO: 5743 - protein, 51 aa, Homo sapiens
MSHSVFAHYIFNILLLLLLLLLIGFLYSMPFIYKDTKKTHVCNFNNIFPIL

SEQ ID NO: 5744 - protein, 267 aa, Homo sapiens
  SITE (172): Xaa equals any amino acid
  SITE (175): Xaa equals any amino acid
MSEIRGKPIESSCMYGTCCLWGKTYSIGFLRFCKQATLQFCVVKPLMAVSTVVLQAFGKYRDGDFDVTSGYLYVTIIYNISVSLALYALFLFYFATRELLSPYSPVLKFFMVKSVIFLSFWQGMLLAILEKCGAIPKIHSARVSVGEGTVAAGYQDFIICVEMFFAALALRXAFXYKVYADKRLDAQGRCAPMKSISSSLKETMNPHDIVQDAIHNFSPAYQQYTQQSTLEPGPTWRGGAHGLSRSHSLSGARDNEKTLLLSSDDEF

SEQ ID NO: 5745 - protein, 53 aa, Homo sapiens
MLVLMTTCILAAVCVHTAQCAPDSRMDNDCPSHQAQIHFRASEVRRGWTFNHD

SEQ ID NO: 5746 - protein, 578 aa, Homo sapiens
  SITE (326): Xaa equals any amino acid
  SITE (342): Xaa equals any amino acid
  SITE (444): Xaa equals any amino acid
MPFRLLIPLGLLCALLPQHHGAPGPDGSAPDPAHYRERVKAMFYHAYDSYLENAFPFDELRPLTCDGHDTWGSFSLTLIDALDTLLILGNVSEFQRVVEVLQDSVDFDIDVNASVFETNIRVVGGLLSAHLLSKKAGVEVEAGWPCSGPLLRMAEEAARKLLPAFQTPTGMPYGTVNLLHGVNPGETPVTCTAGIGTFIVEFATLSSLTGDPVFEDVARVALMRLWESRSDIGLVGNHIDVLTGKWVAQDAGIGAGVDSYFEYLVKGAILLQDKKLMAMFLEYNKAIRNYTRFDDWYLWVQMYKGTVSMPVFQSLEAYWPGLQSLXGDIDNAMRTFLNYYTXWKQFGGLPEFYNIPQGYTVEKREGYPLRPELIESAMYLYRATGDPTLLELGRDAVESIEKISKVECGFATIKDLRDHKLDNRMESFFLAETVKYLYLLFDPXNFIHNNGSTFDAVITPYGECILGAGGYIFNTEAHPIDPAALHCCQRLKEEQWEVEDLMREFYSLKRSRSKFQKNTVSSGPWEPPARPGTLFSPENHDQARERKPAKQKVPLLSCPSQPFTSKLALLGQVFLDSS

SEQ ID NO: 5747 - protein, 196 aa, Homo sapiens [sequence omitted]

SEQ ID NO: 5748 - protein, 72 aa, Homo sapiens
MARGCVCSLCASVCIFLSSLFPLLPSVHSVNIISCLLLSKCFEGLELMCEHLYQLSQLHVLHHIFSYLLCTP

SEQ ID NO: 5749 - protein, 119 aa, Homo sapiens
MKWRRKSAYWKALKVFKLPVEFLLLLTVPVVDPDKDDQNWKRPLNCLHLVISPLVVVLTLQSGTYGVYEIGGLVPVWVVVVIAGTALASVTFFATSDSQPPRLHWLFAFLGFLTSALWI

SEQ ID NO: 5750 - protein, 74 aa, Homo sapiens
MGVRWYLIVLVCISLIISDVQYFFTCLLVICISSLEKYLFNSFAHFKIRLFGFLLLMLSCRSSLYILDIHPSYI

SEQ ID NO: 5751 - protein, 87 aa, Homo sapiens
MGLHLRPYRVGLLPDGLLFLLLLLMLLADPALPAGRHPPVVLVPGDLGNQLEAKLDKPTVVHYLCSKKTESYFTIWLNLELLLPVHH

SEQ ID NO: 5752 - protein, 40 aa, Homo sapiens
MGPSQREVTVQWHRALFLLPLLLLSTRTETKNFGFKWLKD

SEQ ID NO: 5753 - protein, 57 aa, Homo sapiens
MHPWRLSMCPACVLAALPALCSCLCSPDARPPHGWMSMPFTPHPLVSRAMPTCHPCS

SEQ ID NO: 5754 - protein, 525 aa, Homo sapiens
  SITE (210): Xaa equals any amino acid
MLAFPLLLTGLISFREKRLQDVGTPAARARAFFTAPVVVFHLNILSYFAFLCLFAYVLMVDFQPVPSWCECAIYLWLFSLVCEEMRQLFYDPDECGLMKKAALYFSDFWNKLDVGAILLFVAGLTCRLIPATLYPGRVILSLDFILFCLRLMHIFTISKTLGPKIIIVKRMMKDVFFFLFLLAVWVVSFGVAKQAILIHNERRVDWLFRXAVYHSYLTIFGQIPGYIDGVNFNPEHCSPNGTDPYKPKCPESDATQQRPAFPEWLTVLLLCLYLLFTNILLLNLLIAMFNYTFQQVQEHTDQIWKFQRHDLIEEYHGRPAAPPPFILLSHLQLFIKRVVLKTPAKRHKQLKNKLEKNEEAALLSWEIYLKENYLQNRQFQQKQRPEQKIEDISNKVDAMVDLLDLDPLKRSGSMEQRLASLEEQVAQTARALHWIVRTLRASGFSSEADVPTLASQKAAEEPDAEPGGRKKTEEPGDSYHVNARHLLYPNCPVTRFPVPNEKVPWETEFLIYDPPFYTAERKDAA

SEQ ID NO: 5755 - protein, 94 aa, Homo sapiens
MLLSFYCLPMVSIHIFFPCAHCVYLLHISCSLGEESFNRDTCKKDFCFSIQNVNSTFLLSLAVFRFSERFSDSNFLFTTPPICSEKNGLLYHWI

SEQ ID NO: 5756 - protein, 484 aa, Homo sapiens
  SITE (322): Xaa equals any amino acid
  SITE (345): Xaa equals any amino acid
  SITE (374): Xaa equals any amino acid
MVATVCGLLVFLSLGLVPPVRCLFALSVPTLGMEQGRRLLLSYSTATLAIAVVPNVLANVGAAGQVLRCVTEGSLESLLNTTHQLHAASRALGPTGQAGSRGLTFEAQDNGSAFYLHMLTVTQQVLEDFSGLESLARAAALGTQRVVTGLFMLGLLVESAWYLHCYLTDLRFDNIYATQQLTQRLAQAQATHLLAPPPTWLLQAAQLRLSQEELLSCLLRLGLLALLLVATAVAVATDHVAFLLAQATVDWAQKLPTVPITLTVKYDVAYTVLGFIPFLFNQLAPESPFLSVHSSYQWELRLTSARCPLLPARRPRAAAPLXAGGLQLLAGSTVLLEGYARRLRXAIAASFFTAQEARRIRHLHARLQRRHDRXQGQQLPLGDPSCVPTPRPACKPPAWIAYRLDALRTESSEGEGKELWSCRDLSCHLGPVPPPCVTLGKSLHLSEPRFLHLHNDSIFTIDVTYFPRRDVVRMEGNTGHDRPG

SEQ ID NO: 5757 - protein, 151 aa, Homo sapiens
MFLMLGCALPIYNKYWPLFVLFFYILSPIPYCIARRLVDDTDAMSNACKELAIFLTTGIVVSAFGLPIVFARAHLMGRLPFFSKMGTAESEGRETLTQQLPLPAAAMRRLLPASRVSTQPVLRLADSAESLLGRPALWALGFLLCPPSQAQ

SEQ ID NO: 5758 - protein, 242 aa, Homo sapiens
  SITE (88): Xaa equals any amino acid
  SITE (139): Xaa equals any amino acid
MEQARKSSTVSLLITVLFAVAFSVLLLSCKDHVGYIFTTDRDIINLVAQVVPIYAVSHLFEALACTSGGVLRGSGNQKVGAIVNTIGXYVVGLPIGIALMFATTLGVMGLWSGIIICTVFQAVCFLGFIIQLNWKKACXQAQVHANLKVNNVPRSGNSALPQDPLHPGCPENLEGILTNDVGKTGEPQSDQQMRQEEPLPEHPQDGAKLSRKQLVLRRGLLLLGVFLILLVGILVRFYVRIQ

SEQ ID NO: 5759 - protein, 122 aa, Homo sapiens
MIGGITCILSLICALALAYLDQRAERILHKEQGKTGEVIKLTDVKDFSLPLWLIFIICVCYYVAVFPFIGLGKVFFTEKFGFSSQAASAINSVVYVISAPMSPVFGLLVDKTGKNIIWVLCA

SEQ ID NO: 5760 - protein, 567 aa, Homo sapiens
MAPLALHLLVLVPILLSLVASQDWKAERSQDPFEKCMQDPDYEQLLKVVTWGLNRTLKPQRVIVVGAGVAGLVAAKVLSDAGHKVTILEADNRIGGRIFTYRDQNTGWIGELGAMRMPSSHRILHKLCQGLGLNLTKFTQYDKNTWTEVHEVKLRNYVVEKVPEKLGYALRPQEKGHSPEDIYQMALNQALKDLKALGCRKAMKKFERHTLLEYLLGEGNLSRPAVQLLGDVMSEDGFFYLSFAEALRAHSCLSDRLQYSRIVGGWDLLPRALLSSLSGLVLLNAPVVAMTQGPHDVHVQIETSPPARNLKVLKADVVLLTASGPAVKRITFSPPLPRHMQEALRRLHYVPATKVFLSFRRPFWREEHIEGGHSNTDRPSRMIFYPPPREGALLLASYTWSDAAAAFAGLSREEALRLALDDVAALHGPVVRQLWDGTGVVKRWAEDQHSQGGFVVQPPALWQTEKDDWTVPYGRIYFAGEHTAYPHGWVETAVKSALRAAIKINSRKGPASDTASPEGHASDMEGQGHVHGVASSPSHDLAKEEGSHPPVQGQLSLQNTTHTRTSH

SEQ ID NO: 5761 - protein, 283 aa, Homo sapiens
MIFLLLMLSLELQLHQIAALFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTWLLHIFIPSCIIAFIFIATVIALRKQLCQKLYSSKDTTKRPVTTTKREVNSAVNLNLWSWEPG

SEQ ID NO: 5762 - protein, 540 aa, Homo sapiens
  SITE (10): Xaa equals any amino acid
  SITE (469): Xaa equals any amino acid
MATSGAASAXLVIGWCIFGLLLLAILAFCWIYVRKYQSRRESEVVSTITAIFSLAIALITSALLPVDIFLVSYMKNQNGTFKDWANANVSRQIEDTVLYGYYTLYSVILFCVFFWIPFVYFYYEEKDDDDTSKCTQIKTALKYTLGFVVICALLLLVGAFVPLNVPNNKNSTEWEKVKSLFEELGSSHGLAALSFSISSLTLIGMLAAITYTAYGMSALPLNLIKGTRSAAYERLENTEDIEEVEQHIQTIKSKSKDGRPLPARDKRALKQFEERLRTLKKRERHLEFIENSWWTKFCGALRPLKIVWGIFFILVALLFVISLFLSNLDKALHSAGIDSGFIIFGANLSNPLNMLLPLLQTVFPLDYILITIIIMYFIFTSMAGIRNIGIWFFWIRLYKIRRGRTRPQALLFLCMILLLIVLHTSYMIYSLAPQYVMYGSQNYLIETNITSDNHKGNSTLSVPKRCDAXAPEDQCTVTRTYLFLHKFWFFSAAYYFGNWAFLGVFLIGLIVSCCKGKKSVIEGVDEDSDISDDEPSVYSA

SEQ ID NO: 5763 - protein, 46 aa, Homo sapiens
MPWLKSLLHFSLFLVVFSTLAVKSLGVPVAAGSPFCIVDVLHFILL

SEQ ID NO: 5764 - protein, 66 aa, Homo sapiens
MSWVIVVIIWGYLLEGHGVPFCKSYGPSPWKLHTHHAAYNSGSSQVYRILETLMSGSTHCSFSGTF

SEQ ID NO: 5765 - protein, 90 aa, Homo sapiens
MPRAPWRIPLCALPTLCLGSPLPSQPTHPIFYDHRAPTWKMAHPGGPRSSHSPRTWRTPSSQTKAALPAGGARNSPLQLCTRSRFCGTPM

SEQ ID NO: 5766 - protein, 710 aa, Homo sapiens
MPVPWFLLSLALGRSPVVLSLERLVGPQDATHCSPGLSCRLWDSDILCLPGDIVPAPGPVLAPTHLQTELVLRCQKETDCDLCLRVAVHLAVHGHWEEPEDEEKFGGAADLGVEEPRNASLQAQVVLSFQAYPTARCVLLEVQVPAALVQFGQSVGSVVYDCFEAALGSEVRIWSYTQPRYEKELNHTQQLPDCRGLEVWNSIPSCWALPWLNVSADGDNVHFGLSLYWNQVQGPPKPRWHKNLTGPQIITLNHTDLVPCLCIQVWPLEPDSVRTNICPFREDPRAHQNLWQAARLRLLTLQSWLLDAPCSLPAEAALCWRAPGGDPCQPLVPPLSWENVTVDKVLEFPLLKGHPNLCVQVNSSEKLQLQECLWADSLGPLKDDVLLLETRGPQDNRSLCALEPSGCTSLPSKASTRAARLGEYLLQDLQSGQCLQLWDDDLGALWACPMDKYIHKRWALVWLACLLFAAALSLILLLKKDHAKGWLRLLKQDVRSGAAARGRAALLLYSADDSGFERLVGALASALCQLPLRVAVDLWSRRELSAQGPVAWFHAQRRQTLQEGGVVVLLFSPGAVALCSEWLQDGVSGPGAHGPHDAFRASLSCVLPDFLQGRAPGSYVGACFDRLLHPDAVPALFRTVPVFTLPSQLPDFLGALQQPRAPRSGRLQERAEQVSRALQPALDSYFHPPGTPAPGRGVGPGAGPGAGDGT

SEQ ID NO: 5767 - protein, 48 aa, Homo sapiens [sequence omitted]

SEQ ID NO: 5768 - protein, 114 aa, Homo sapiens
MPIHKTKISCVFLLLSLKWHWMTNGKLDAALNVPLGFRGFQSQWTGGGLCQCLSGVCLCHCGAAWATDLGRTLGDGAPVWWVCVGSAVPVHVRKALLLYTESCSLSTTDRSPLP

SEQ ID NO: 5769 - protein, 200 aa, Homo sapiens
  SITE (144): Xaa equals any amino acid
  SITE (149): Xaa equals any amino acid
  SITE (160): Xaa equals any amino acid
  SITE (173): Xaa equals any amino acid
  SITE (177): Xaa equals any amino acid
  SITE (189): Xaa equals any amino acid
MFFLLCLVALEIKGFTFSARGARDRFLNKSGPQPGKKMKTTHCKQPLFSKPGQVRGALRKARGRQEEREAVGMWGGRGHSYPEYIKTSEVTEVRDSPKHPQVQPFLTTRVTCRVPGHLQVLEALCGAWGSMFKHALVVVQVPRXRGRAXLGSEWQVGQLXLILLHGTQHWAAXLVPXLPQESILPAQSXRVTNTPGTEET

SEQ ID NO: 5770 - protein, 369 aa, Homo sapiens
MLGAFVWPSLLLLAAACICLLTFINCAYVKWGTLVQDIFTYAKVLALIAVIVAGIVRLGQGASTHFENSFEGSSFAVGDIALALYSALFSYSGWDTLNYVTEEIKNPERNLPLSIGISMPIVTIIYILTNVAYYTVLDMRDILASDAVAVTFADQIFGIFNWIIPLSVALSCFGGLNASIVAASRLFFVGSREGHLPDAICMIHVERFTPVPSLLFNGIMALIYLCVEDIFQLINYYSFSYWFFVGLSIVGQLYLRWKEPDRPRPLKLSVFFPIVFCLCTIFLVAVPLYSDTINSLIGIAIALSGLPFYFLIIRVPEHKRPLYLRRSWGLPQGTSRSCVCQLLQKWIWKMEERCPSNGIPSLTKHHLES

SEQ ID NO: 5771 - protein, 526 aa, Homo sapiens
  SITE (466): Xaa equals any amino acid
MAALTIATGTGNWFSALALGVTLLKCLLIPTYHSTDFEVHRNWLAITHSLPISQWYYEATSEWTLDYPPFFAWFEYILSHVAKYFDQEMLNVHNLNYSSSRTLLFQRFSVIFMDVLFVYAVRECCKCIDGKKVGKELTEKPKFILSVLLLWNFGLLIVDHIHFQYNGFLFGLMLLSIARLFQKRHMEGAFLFAVLLHFKHIYLYVAPAYGVYLLRSYCFTANKPDGSIRWKSFSFVRVISLGLVVFLVSALSLGPFLALNQLPQVFSRLFPFKRGLCHAYWAPNFWALYNALDKVLSVIGLKLKFLDPNNIPKASMTSGLVQQFQHTVLPSVTPLATLICTLIAILPSIFCLWFKPQGPRGFLRCLTLCALSSFMFGWHVHEKAILLAILPMSLLSVGKAGDASIFLILTTTGHYSLFPLLFTAPELPIKILLMLLFTIYSISSLKTLFRKEKPLFNWMETFYLLXLGPLEVCCEFVFPFTSWKVKYPFIPLLLTSVYCAVGITYAWFKLYVSVLIDSAIGKTKKQ

SEQ ID NO: 5772 - protein, 549 aa, Homo sapiens [sequence omitted]

SEQ ID NO: 5773 - protein, 467 aa, Homo sapiens
MLLLLLLPLLWGRERVEGQKSNRKDYSLTMQSSVTVQEGMCVHVRCSFSYPVDSQTDSDPVHGYWFRAGNDISWKAPVATNNPAWAVQEETRDRFHLLGDPQTKNCTLSIRDARMSDAGRYFFRMEKGNIKWNYKYDQLSVNVTALTHRPNILIPGTLESGCFQNLTCSVPWACEQGTPPMISWMGTSVSPLHPSTTRSSVLTLIPQPQHHGTSLTCQVTLPGAGVTTNRTIQLNVSYPPQNLTVTVFQGEGTASTALGNSSSLSVLEGQSLRLVCAVDSNPPARLSWTWRSLTLYPSQPSNPLVLELQVHLGDEGEFTCRAQNSLGSQHVSLNLSLQQEYTGKMRPVSGVLLGAVGGAGATALVFLSFCVIFIVVRSCRKKSARPAADVGDIGMKDANTIRGSASQGNLTESWADDNPRHHGLAAHSSGEEREIQYAPLSFHKGEPQDLSGQEATNNEYSEIKIPK

SEQ ID NO: 5774 - protein, 51 aa, Homo sapiens [sequence omitted]

SEQ ID NO: 5775 - protein, 802 aa, Homo sapiens [sequence omitted]

SEQ ID NO: 5776 - protein, 325 aa, Homo sapiens
MGSQVSSMLKLALQNCCPQLWQRHSARDRQCARVLADERSPQPGASPQEDIANFQVLVKILPVMVTLVPYWMVYFQMQSTYVLQGLHLHIPNIFPANPANISVALRAQGSSYTIPEAWLLLANVVVVLILVPLKDRLIDPLLLRCKLLPSALQKMALGMFFGFTSVIVAGVLEMERLHYIHHNETVSQQIGEVLYNAAPLSIWWQIPQYLLIGISEIFASIPGLEFAYSEAPRSMQGAIMGIFFCLSGVGSLLGSSLVALLSLPGGWLHCPKDFGNINNCRMDLYFFLLAGIQAVTALLFVWIAGRYERASQGPASHSRFSRDRG

SEQ ID NO: 5777 - protein, 98 aa, Homo sapiens
MHCCQLPWRCAQAPQEAFLLCLLFLILVLVLLGCSRGLPGHTPWRLHPAAAALLAPLLHDALGACGFQGPEYLLPCLLPLPKPGQLQGPWGPLWALLP

SEQ ID NO: 5778 - protein, 331 aa, Homo sapiens
MLTGIAVGALLALALVGVLILFMFRRLRQFRQAQPTPQYRFRKRDKVMFYGRKIMRKVTTLPNTLVENTALPRQRARKRTKVLSLAKRILRFKKEYPALQPKEPPPSLLEADLTEFDVKNSHLPSEVLYMLKNVRVLGHFEKPLFLELCKHIVFVQLQEGEHVFQPREPDPSICVVQDGRLEVCIQDTDGTEVVVKEVLAGDSVHSLLSILDIITGHAAPYKTVSVRAAIPSSILRLPAAAFHGVFEKYPETLVRVVQIIMVRLQRVTFLALHNYLGLTTELFNAESQAIPLVSVASVAAGKAKKQVFYGEEERLKKPPRLQESCDSDHGG

SEQ ID NO: 5779 - protein, 219 aa, Homo sapiens
MKLLLWACIVCVAFARKRRFPFIGEDDNDDGHPLHPSLNIPYGIRNLPPPLYYRPVNTVPSYPGNTYTDTGLPSYPWILTSPGFPYVYHIRGFPLATQLNVPPLPPRGFPFVPPSRFFSAAAAPAAPPIAAEPAAAAPLTATPVAAEPAAGAPVAAEPAAEAPVGAEPAAEAPVAAEPAAEAPVGVEPAAEEPSPAEPATAKPAAPEPHPSPSLEQANQ

SEQ ID NO: 5780 - protein, 608 aa, Homo sapiens
  SITE (265): Xaa equals any amino acid
  SITE (597): Xaa equals any amino acid
MVGTKLRQTKDALFTILHDLRPQDRFSIIGFSNRIKVWKDHLISVTPDSIRDGKVYIHHMSPTGGTDINGVLQRAIRLLNKYVAHSGIGDRSVSLIVFLTDGKPTVGETHTLKILNNTREAARGQVCIFTIGIGNDVDFRLLEKLSLENCGLTRRVHEEEDAGSQLIGFYDEIRTPLLSDIRIDYPPSSVVQATKTLFPNYFNGSEIIIAGKLVDRKLDHLHVEVTASNSKKFIILKTDVPVRPQKAGKDVTGSPRPGGDGEGDXNHIERLWSYLTTKELLSSWLQSDDEPEKERLRQRAQALAVSYRFLTPFTSMKLRGPVPRMDGLEEAHGMSAAMGPEPVVQSVRGAGTQPGPLLKKPYQPRIKISKTSVDGDPHFVVDFPLSRLTVCFNIDGQPGDILRLVSDHRDSGVTVNGELIGAPAPPNGHKKQRTYLRTITILINKPERSYLEITPSRVILDGGDRLVLPCNQSVVVGSWGLEVSVSANANVTVTIQGSIAFVILIHLYKKPAPFQRHHLGFYIANSEGLSSNCHGLLGQFLNQDARLTEDPAGPSQNLTHPLLLQVGEGPEAVLTVKGHQVPVVWKQRKIYNGEEQXDCWFARNMPPN

SEQ ID NO: 5781 - protein, 56 aa, Homo sapiens
MFYKLTLILCELSVAGVTQAASQRPLQRLPRHICSQRSSSWEMPPQGPAPDHVGRA

SEQ ID NO: 5782 - protein, 83 aa, Homo sapiens
GHVLAYSSWPSLAPGLSVQYFVSRVEVPNPGCTLEAPGKLSEFLRPEPHPKPISSESLGGTEPGFCQLKPAMVTSVSSYTENS

SEQ ID NO: 5783 - protein, 85 aa, Homo sapiens
MKKVLLLITAILAVAVGFPVSQDQEREKRSISDSDELASGFFVFPYPYPFRPLPPIPFPRFPWFRRNFPIPIPESAPTTPLPSEK

SEQ ID NO: 5784 - protein, 29 aa, Homo sapiens
MYVWVSGALVLVLSPHPASRTLCLMAQAV

SEQ ID NO: 5785 - protein, 49 aa, Homo sapiens
MSRAPCASSILVLTLIVTLLVLLCSVKICNWLRITVGVHSYSTKSPQVF

SEQ ID NO: 5786 - protein, 297 aa, Homo sapiens
MTISKKIEQNEGKRGSVLAHSCDQPAVCGVPSWPGLGTCSFLWLLPGQATLQGCFSTHPFACLPVPGVVKGFWVRVGTPFSKAPCKAGLSLVGLTASFSPCQAAQAPEVTYEAEEGSLWTLLLTSLDGHLLEPDAEYLHWLLTNIPGNRVAEGQVTCPYLPPFPARGSGIHRLAFLLFKQDQPIDFSEDARPSPCYQLAQRTFRTFDFYKKHQETMTPAGLSFFQCRWDDSVTYIFHQLLDMREPVFEFVRPPLTTPSRSASPTGSPCATWTGTGTVMSPPMASTKEPECAHFRAWD

SEQ ID NO: 5787 - protein, 51 aa, Homo sapiens
MELLQAKKLLLLLGLFVSCCSNIRKTEPCFGLDSITFRDPKKKCLCNLKSC

SEQ ID NO: 5788 - protein, 540 aa, Homo sapiens
  SITE (137): Xaa equals any amino acid
MVRTDGHTLSEKRNYQVTNSMFGASRKKFVEGVDSDYHDENMYYSQSSMFPHRSEKDMLASPSTSGQLSQFGASLYGQQSALGLPMRGMSNNTPQLNRSLSQGTQLPSHVTPTTGVPTMSLHTPPSPSRGILPMNPXNMMNHSQVGQGIGIPSRTNSMSSSGLGSPNRSSPSIICMPKQQPSRQPFTVNSMSGFGMNRNQAFGMNNSLSSNIFNGTDGSENVTGLDLSDFPALADRNRREGSGNPTPLINPLAGRAPYVGMVTKPANEQSQDFSIHNEDFPALPGSSYKDPTSSNDDSKSNLNTSGKTTSSTDGPKFPGDKSSTTQNNNQQKKGIQVLPDGRVTNIPQGMVTDQFGMIGLLTFIRAAETDPGMVHLALGSDLTTLGLNLNSPENLYPKFASPWASSPCRPQDIDFHVPSEYLTNIHIRDKLAAIKLGRYGEDLLFYLYYMNGGDVLQLLAAVELFNRDWRYHKEERVWITRAPGMEPTMKTNTYERGTYYFFDCLNWRKVAKEFHLEYDKLEERPHLPSTFNYNPAQQAF

SEQ ID NO: 5789 - protein, 58 aa, Homo sapiens
MCSGSFKELYLVPISLFSTCVLGFYFHNFLLLIILFSILLRKITGKLFFTYYHFSCGV

SEQ ID NO: 5790 - protein, 19 aa, Homo sapiens
MAAHSVLSFLLWTPYALKS

SEQ ID NO: 5791 - protein, 42 aa, Homo sapiens
  SITE (28): Xaa equals any amino acid
MHCFFLWLLLFGLLGISGFLGYISVAGXSIYVMWKVEKEMNT

SEQ ID NO: 5792 - protein, 99 aa, Homo sapiens
MLFFLSLFLSLLLTLSLPSFLPFSFFFFSLFPHLSACLLPSLPSPPFPLPPSLPSFLPSFLPSFLPSLLSPSFPAFFPSFCQLARRSPRKSTQMLQSTS

SEQ ID NO: 5793 - protein, 171 aa, Homo sapiens
MKKCLLPVLITCMQTAICKDRMMMIMILLVNYRPDEFIECEDPVDHVGNATASQELGYGCLKFGGQAYSDVEHTSVQCHALDGIECASPRTFLRENKPCIKYTGHYFITTLLYSFFLGCFGVDRFCLGHTGTAVGKLLTLGGLGIWWFVDLILLITGGLMPSDGSNWCTVY

SEQ ID NO: 5794 - protein, 66 aa, Homo sapiens
MNYIFLLMALPHLIAIALTWGRYSFSCLANKETEFQRCQVTCLLHTLGVLMFNFELRSIWLESSLH

SEQ ID NO: 5795 - protein, 83 aa, Homo sapiens [sequence omitted]

SEQ ID NO: 5796 - protein, 34 aa, Homo sapiens
MQMFTVSLLLSLLLRSTDQNHLQLLVGREDHYGG

SEQ ID NO: 5797 - protein, 72 aa, Homo sapiens
MRHTCIVNIAASLLVANTWFIVVAAIQDNRYILCKTACVAATFFIHFFYLSVFFWMLTLGPHAVLSPGFHSA

SEQ ID NO: 5798 - protein, 116 aa, Homo sapiens [sequence omitted]

SEQ ID NO: 5799 - protein, 80 aa, Homo sapiens
  SITE (11): Xaa equals any amino acid
MTHCLLHGMGXAGAASLTPKPMSLISAYCGGLWLAAVAVMVQMAALCGAQDIQDKFSSILSRGQEAYERLLWNGEFGEPK

SEQ ID NO: 5800 - protein, 309 aa, Homo sapiens
  SITE (129): Xaa equals any amino acid
  SITE (178): Xaa equals any amino acid
  SITE (187): Xaa equals any amino acid
  SITE (262): Xaa equals any amino acid
  SITE (308): Xaa equals any amino acid
MFTIKLLLFIVPLVISSRIDQDNSSFDSLSPEPKSRFAMLDDVKILANGLLQLGHGLKDFVHKTKGQINDIFQKLNIFDQSFYDLSLQTSEIKEEEKELRRTTYKLQVKNEEVKNMSLELNSKLESLLXEKILLQQKVKYLEEQLTNLIQNQPETPEHPEVTSLKTFVEKQDNSIKDXLQTVEDQYXQLNQQHSQIKEIENQLRRTSIQEPTEISLSSKPRAPRTTPFLQLNEIRNVKHDGIPAECTTIYNRGEHTSGMYAXRPSNSQVFHVYCDVISGSPWTLIQHRIDGSQNFNETWENYKYGFGXA

SEQ ID NO: 5801 - protein, 41 aa, Homo sapiens
MLQRGQHLYLVVFLMVSFIPLLNPKQDLKKLKKNRTVRNHF

SEQ ID NO: 5802 - protein, 41 aa, Homo sapiens
MINFWPVTHVCIWLLWLQALEARGQGSNIDCTRNSKTVFTS

SEQ ID NO: 5803 - protein, 201 aa, Homo sapiens
MTLRPSLLPLHLLLLLLLSAAVCRAEAGLETESPVRTLQVETLVEPPEPCAEPAAFGDTLHIHYTGSLVDGRIIDTSLTRDPLVIELGQKQVIPGLEQSLLDMCVGEKRRAIIPSHLAYGKRGFPPSVPADAVVQYDVELIALIRANYWLKLVKGILPLVGMAMVPALLGLIGYHLYRKANRPKVSKKKLKEEKRNKSKKK

SEQ ID NO: 5804 - protein, 41 aa, Homo sapiens
MPPKQIPLTSLSLLALLLFFFFKIFCLLFLFYPLPDESEHF

SEQ ID NO: 5805 - protein, 355 aa, Homo sapiens
  SITE (331): Xaa equals any amino acid
  SITE (338): Xaa equals any amino acid
  SITE (345): Xaa equals any amino acid
MAQLEGYYFSAALSCTFLVSCLLFSAFSRALREPYMDEIFHLPQAQRYCEGHFSLSQWDPMITTLPGLYLVSIGVIKPAIWIFGWSEHVVCSIGMLRFVNLLFSVGNFYLLYLLFCKVQPRNKAASSIQRVLSTLTLAVFPTLYFFNFLYYTEAGSMFFTLFAYLMCLYGNHKTSAFLGFCGFMFRQTNIIWAVFCAGNVIAQKLTEAWKTELQKKEDRLPPIKGPFAEFRKILQFLLAYSMSFKNLSMLLLLTWPYILLGFLFCAFVVVNGGIVIGDRSSHEACLHFPQLFYFFSFTLFFSFPHLLSPSKIKTFPFLSLGNVEFCFLVVXLVLCGFXVWEIPIXGSRNTCLADQ

SEQ ID NO: 5806 - protein, 354 aa, Homo sapiens
MAPAKATNVVRLLLGSTALWLSQLGSGTVAASKSVTAHLAAKWPETPLLLEASEFMAEESNEKFWQFLETVQELAIYKQTESDYSYYNLILKKAGQFLDNLHINLLKFAFSIRAYSPAIQMFQQIAADEPPPDGCNAFVVIHKKHTCKINEIKKLLKKAASRTRPYLFKGDHKFPTNKENLPVVILYAEMGTRTFSAFHKVLSEKAQNEEILYVLRHYIQKPSSRKMYLSGYGVELAIKSTEYKALDDTQVKTVTNTTVEDETETNEVQGFLFGKLKEIYSDLRDNLTAFQKYLIESNKQMMPLKVWELQDLSFQAASQIMSAPVYDAIKLMKDISQNFPIKARVQMIGNVLIG

SEQ ID NO: 5807 - protein, 42 aa, Homo sapiens
MINCVCVHACVRACGLLHSLVLLLSLSLSSALFIPWDTEIFK

SEQ ID NO: 5808 - protein, 42 aa, Homo sapiens
MRIHPIFRLGNVYSLLSFLILGRVSTKNSIEEKQYNIKIKKI

SEQ ID NO: 5809 - protein, 53 aa, Homo sapiens [sequence omitted]

SEQ ID NO: 5810 - protein, 68 aa, Homo sapiens
MALAIFIPVLIISLLLGGAYIYITRCRYYSNLRLPLMYSHPYSQITVETEFDNPIYETGETREYEVSI

SEQ ID NO: 5811 - protein, 139 aa, Homo sapiens
MEAVVFVFSLLDCCALIFLSVYFIITLSDLECDYINARSCCSKLNKWVIPELIGHTIVTVLLLMSLHWFIFLLNLPVATWNIYRYIMVPSGNMGVFDPTEIHNRGQLKSHMKEAMIKLGFHLLCFFMYLYSMILALIND

SEQ ID NO: 5812 - protein, 46 aa, Homo sapiens [sequence omitted]

SEQ ID NO: 5813 - protein, 125 aa, Homo sapiens
  SITE (101): Xaa equals any amino acid
MLSQPRMESLDTPAAYSLGLALLGLGVVLVLSSFFALGFAGTFLGDYFGILKEARVTVFPFNILDNPMYWGSTANYLGWAIMHASPTGLLLTVLVALTYIXALLYEEPFTAEIYRQKASGSHKRS

SEQ ID NO: 5814 - protein, 147 aa, Homo sapiens
MLGLPWKGGLSWALLLLLLGSQILLIYAWHFHEQRDCDEHNVMARYLPATVEFAVHTFNQQSKDYYAYRLGHILNSWKEQVESKTVFSMELLLGRTRCGKFEDDIDNCHFQESTELNNTFTCFFTISTRPWMTQFSLLNKTCLEGFH

SEQ ID NO: 5815 - protein, 111 aa, Homo sapiens
MKSLLFTLAVFMLLAQLVSGNWYVKKCLNDVGICKKKCKPEEMHVKNGWAMCGKQRDCCVPADRRANYPVFCVQTKTTRISTVTATTATTTLMMTTASMSSMAPTPVSPTG

SEQ ID NO: 5816 - protein, 121 aa, Homo sapiens
MMLPQWLLLLFLLFFFLFLLTRGSLSPTKYNLLELKESCIRNQDCETGCCQRAPDNCESHCAEKGSEGSLCQTQVFFGQYRACPCLRNLTCIYSKNEKWLSIAYGRCQKIGRQKLAKKMFF

SEQ ID NO: 5817 - protein, 161 aa, Homo sapiens [sequence omitted]

SEQ ID NO: 5818 - protein, 344 aa, Homo sapiens
  SITE (53): Xaa equals any amino acid
MDFLVLFLFYLASVLMGLVLICVCSKTHSLKGLARGGAQIFSCIIPECLQRAXHGLLHYLFHTRNHTFIVLHLVLQGMVYTEYTWEVFGYCQELELSLHYLLLPYLLLGVNLFFFTLTCGTNPGIITKANELLFLHVYEFDEVMFPKNVRCSTCDLRKPARSKHCSVCNWCVHRFDHHCVWVNNCIGAWNIRYFLIYVLTLTASAATVAIVSTTFLVHLVVMSDLYQETYIDDLGHLHVMDTVFLIQYLFLTFPRIVFMLGFVVVLSFLLGGYLLFVLYLAATNQTTNEWYRGDWAWCQRCPLVAWPPSAEPQVHRNIHSHGLRSNLQEIFLPAFPCHERKKQE

SEQ ID NO: 5819 - protein, 79 aa, Homo sapiens
MLRLTQTFFFISQTLLDWFLAAALALPNLCSPLASNFKSRQISSVPIQPSQGTSRVALQIWCGSCRMRMSSSTIHILAL

SEQ ID NO: 5820 - protein, 291 aa, Homo sapiens [sequence omitted]

SEQ ID NO: 5821 - protein, 190 aa, Homo sapiens
  SITE (29): Xaa equals any amino acid
  SITE (31): Xaa equals any amino acid
MKASQCCCCLSHLLASVLLLLLLPELSGXLXVLLQAAEAAPGLGPPDPRPRTLPPLPPGPTPAQQPGRGLAEAAGPRGSEGGNGSNPVAGLETDDHGGKAGEGSVGGGLAVSPNPGDKPMTQRALTVLMVVSGAVLVYFVVRTVRMRRRNRKTRRYGVLDTNIENMELTPLEQDDEDDDNTLFDANHPRR

SEQ ID NO: 5822 - protein, 47 aa, Homo sapiens
MLISVDSNVPVVFLLLFILVILCHMECKGHIYICVCVCVYMYIFKNI

SEQ ID NO: 5823 - protein, 123 aa, Homo sapiens
MKLLLLALPMLVLLPQVIPAYSGEKKCWNRSGHCRKQCKDGEAVKDTCKNLRACCIPSNEDHRRVPATSPTPLSDSTPGIIDDILTVRFTTDYFEVSSKKDMVEESEAGRGTETSLPNVHHSS

SEQ ID NO: 5824 - protein, 121 aa, Homo sapiens
MHRSEPFLKMSLLILLFLGLAEACTPREVNLLKGIIGLMSRLSPDEILGLLSLQVLHEETSGCKEEVKPFSGTTPSRKPLPKRKNTWNFLKCAYMVMTYLFVSYNKGDWFTFSSQVLLPLL

SEQ ID NO: 5825 - protein, 163 aa, Homo sapiens
  SITE (2): Xaa equals any amino acid
MXGLLLAAFLALVSVPRAQAVWLGRLDPEQLLGPWYVLAVASREKGFAMEKDMKNVVGVVVTLTPENNLRTLSSQHGLGGCDQSVMDLIKRNSGWVFENPSIGVLELWVLATNFRDYAIIFTQLEFGDEPFNTVELYSLTETASQEAMGLFTKWSRSLGFLSQ

SEQ ID NO: 5826 - protein, 44 aa, Homo sapiens
  SITE (41): Xaa equals any amino acid
MILFDLTFFLFAPRILASGACSCSIYPKITLPTKYFAFIIXTSF

SEQ ID NO: 5827 - protein, 129 aa, Homo sapiens
MARGSLRRLLRLLVLGLWLALLRSVAGEQAPGTAPCSRGSSWSADLDKCMDCASCRARPHSDFCLGCAAAPPAPFRLLWPILGGALSLTFVLGLLSGFLVWRRCRRREKFTTPIEETGGEGCPAVALIQ

SEQ ID NO: 5828 - protein, 98 aa, Homo sapiens
MGWLGRTCLAHSHLDFISGALLLTFAYFLVFQVCPVINKWLYNLDQHVVKELISKCWRWEGTGTLQKKAQNPPSPFVFHFPLPHSGTSPRPKISFLLK

SEQ ID NO: 5829 - protein, 45 aa, Homo sapiens
MVSFHFQCTSYFVRLFFQLQLFVGLVIVLALLISHSLTYSFHKHL

SEQ ID NO: 5830 - protein, 71 aa, Homo sapiens
  SITE (19): Xaa equals any amino acid
  SITE (22): Xaa equals any amino acid
  SITE (57): Xaa equals any amino acid
  SITE (70): Xaa equals any amino acid
MSLLLPPLALLLLLAALVXPAXAATAYRPDWNRLSGLTRARVETCGGMTAEPPKGEXRLSSRRTFHSITXW

SEQ ID NO: 5831 - protein, 179 aa, Homo sapiens
MACKGLLQQVQGPRLPWTRLLLLLLVFAVGFLCHDLRSHSSFQASLTGRLLRSSGFLPASQQACAKLYSYSLQGYSWLGETLPLWGSHLLTVVRPSLQLAWAHTNATVSFLSAHCASHLAWFGDSLTSLSQRLQIQLPDSVNQLLRYLRELPLLFHQNVLLPLWHLLLEALAWAQGALP

SEQ ID NO: 5832 - protein, 64 aa, Homo sapiens
  SITE (61): Xaa equals any amino acid
MAVLLITILLFLCLGYYRVITEISRKTPACRMFTSSLSSWYIMRKLYDTPGEVFLSHAIVXFLK

SEQ ID NO: 5833 - protein, 153 aa, Homo sapiens
MAATQTGTCLMVAALCFVLVLGSLVPCLPEFSSGSQTVKEDPLAADGVYTASQMPSRSLLFYDDGAGLWEDGRSTLLPMEPPDGWEINPGGPAEQRPRDHLQHDHLDSTHETTKYLSEAWPKDGGNGTSPDFSHSKEWFHDRDLGPNTTIKLS

SEQ ID NO: 5834 - protein, 229 aa, Homo sapiens
  SITE (206): Xaa equals any amino acid
MYKLLLFDLLTVLAVALLIQFPRKLLCGLCPGALGRLAGTQEFQVPDEVLGLIYAQTVVWVGSFFCPLLPLLNTVKFLLLFYLKKLTLFSTCSPAARTFRASAANFFFPLVLLLGLAISSVPLLYSIFLIPPSKLCGPFRGQSSIWAQIPESISSLPETTQNFLFFLGTQAFAVPLLLISSILMAYTVALANSYGRLISELKRQRXTEAQNKVFLARRAVALTSTKPAL

SEQ ID NO: 5835 - protein, 87 aa, Homo sapiens
MTAWILLPVSLSAFSITGIWTVYAMAVMNHHVCPVENWSYNESCPPDPAEQGGPKTCCTLDDVPLISGPDLPPALRAAPGAESALLG

SEQ ID NO: 5836 - protein, 116 aa, Homo sapiens
  SITE (46): Xaa equals any amino acid
MPGGTRCRVLLLSLTFGTSMACGNVGLRLCPWTWHNWLLPPHLCSXWPCRRCCWAAATTHFSWPPWVRSAWGPPAAWLESSGHPLPAVASCSQPPASADSSRFSKVPCCRRRGWTR

SEQ ID NO: 5837 - protein, 86 aa, Homo sapiens
MPWHVCFFLSGLLFPSPQTSLQHLCLLTSLILGVTISAYEHAINLPSLQNSLLTSHPSVAALSLLSSSLQQNSLKELLAGHSGSLL

SEQ ID NO: 5838 - protein, 61 aa, Homo sapiens
MFCWILVCLAYLKVPLLFFFFFFLSALFCRTCSNMENKSRRLSSDCYLCPKPPQTFMLMFY

SEQ ID NO: 5839 - protein, 352 aa, Homo sapiens
MLCRLCWLVSYSLAVLLLGCLLFLRKAAKPAETPRPTSLSGAPPTPRHSRCPPNHTVSSASLSLPSRHRLFLTYRHCRNFSILLEPSGCSKDTFLLLAIKSQPGHVERRAAIRSTWGRWGDGLGPALKLVFLLGVAGSAPPAQLLAYESREFDDILQWDFTEDFFNLTLKELHLQRWVVAACPQAHFMLKGDDDVFVHVPNVLEFLDGWDPAQDLLVGDVIRQALPNRNTKVKYFIPPSMYRATHYPPYAGGGGYVMSRATVRRLQAIMEDAELFPIDDVFVGMCLRRLGLSPMHHAGFKTFGIRRPLDPLDPCLYRGLLLVHRLSPLEMWTMWALVTDEGLKCAAGPIPQR

SEQ ID NO: 5840 - protein, 30 aa, Homo sapiens
MGTQPPVVAGFTIPMLGYTVRVLTFHLSCS

SEQ ID NO: 5841 - protein, 10 aa, Homo sapiens
GLLYIMYCNI

SEQ ID NO: 5842 - protein, 45 aa, Homo sapiens
MVKWIILSCLILKGKRTLNSSTFYAANKSSTINRNLSWQALPFTH

SEQ ID NO: 5843 - protein, 56 aa, Homo sapiens
MRSYFPFSVCPFPFCSPVFFFVFTDVYLCFFFVFAVGRHLSDPFPILFFTHKCPDV

SEQ ID NO: 5844 - protein, 38 aa, Homo sapiens
MLKLATILLTLLLKNLDAGLTDKLSRSNFITDFILTKY

SEQ ID NO: 5845 - protein, 43 aa, Homo sapiens
MFNLSFFTLYGLCMLKLHSASSWFTLLLLISLFLSVVYCQSTN

SEQ ID NO: 5846 - protein, 74 aa, Homo sapiens [sequence omitted]

SEQ ID NO: 5847 - protein, 53 aa, Homo sapiens
MAALLLAGICILLNGVIPQDQSIVRTSLAVLGKGCLAASFNCIFLYTGNCIPQ

SEQ ID NO: 5848 - protein, 45 aa, Homo sapiens
MTIHALLVYACNSKCLWFSISHLHFCLVTLLILTNMTESSFSLKG

SEQ ID NO: 5849 - protein, 54 aa, Homo sapiens
MSPCAHICLYVLVFLCNVTRCKCVRAFTTWDTEKVKYFMAHWSKLKRVRGTRVE

SEQ ID NO: 5850 - protein, 88 aa, Homo sapiens [sequence omitted]

SEQ ID NO: 5851 - protein, 549 aa, Homo sapiens [sequence omitted]

SEQ ID NO: 5852 - protein, 46 aa, Homo sapiens
MLSPLNHLYFPFRFLCMLCSLPRVVFQLTPIKEAFPSQELTFPCTH

SEQ ID NO: 5853 - protein, 87 aa, Homo sapiens [sequence omitted]

SEQ ID NO: 5854 - protein, 54 aa, Homo sapiens
MLLGFLCLWYQVYVCMYVCTYLFIYLLFSLFSLPHMICKKSVKFIMSSPKPPSG

SEQ ID NO: 5855 - protein, 34 aa, Homo sapiens
MQARWFHILGMMMFIWSSAHQYKCPCYSRQSQEK

SEQ ID NO: 5856 - protein, 222 aa, Homo sapiens
  SITE (86): Xaa equals any amino acid
MHFQRQKLMAVTEYIPPKPAIHPSCLPSPPSPPQEEIGLIRLLRREIAAVFQDNRMIAVCQNVALSAEDKLLMRHQLRKHKILMKXFPNQVLKPFLEDSKYQNLLPLFVGHNMLLVSEEPKVKEMVRILRTVPFLPLLGGCIDDTILSRQGFINYSKLPSLPLVQGELVGGLTCLTAQTHSLLQHQPLQLTTLLDQYIREQREKDSVMSANGKPDPDTVPDS

SEQ ID NO: 5857 - protein, 519 aa, Homo sapiens
  SITE (205): Xaa equals any amino acid
  SITE (207): Xaa equals any amino acid
  SITE (213): Xaa equals any amino acid
  SITE (225): Xaa equals any amino acid
MQGGQRPHLLLLLLAVCLGAQSRNQEERLLADLMRNYDPHLRPAERDSDVVNVSLKLTLTNLISLNEREEALTTNVWIEMQWCDYRLRWDPKDYEGLWILRVPSTMVWRPDIVLENNVDGVFEVALYCNVLVSPDGCIYWLPPAIFRSSCSISVTYFPFDWQNCSLIFQSQTYSTSEINLQLSQEDGQAIEWIFIDPEAFTENGXWXIRHRPXKMLLDSVAPAEXAGHQKVVFYLLIQRKPLFYVINIIAPCVLISSVAILIYFLPAKAGGQKCTVATNVLLAQTVFLFLVAKKVPETSQAVPLISKYLTFLMVVTILIVVNSVVVLNVSLRSPHTHSMARGVRKVFLRLLPQLLRMHVRPLAPAAVQDARFRLQNGSSSGWPIMAREEGDLCLPRSELLFRQRQRNGLVQAVLEKLENGPEVRQSQEFCGSLKQASPAIQACVDACNLMARARRQQSHFDSGNEEWLLVGRVLDRVCFLAMLSLFICGTAGIFLMAHYNQVPDLPFPGDPRPYLPLPD

SEQ ID NO: 5858 - protein, 68 aa, Homo sapiens
MVHNCLLLLKFLLLFCFPLISYQLMNGSLQSLQRLRMIQNVQCIVLNKQEAEFLMGISFQIYDWSLGF

SEQ ID NO: 5859 - protein, 79 aa, Homo sapiens
  SITE (23): Xaa equals any amino acid
  SITE (45): Xaa equals any amino acid
MGCCSKKYWQLLLGAAPWGVIPXLLLWMGTRAPHFKDSVSQGLPXKAEESRANFNQFLVLLMPKEMIVLTIVHPIVRRA

SEQ ID NO: 5860 - protein, 79 aa, Homo sapiens
MMSSCLVVVITLRAYFSWLQAIRSQVVWSRMKRLQSASRQSGLSIPRSEMSALHRLQDWSDKSHILFFIFLPRVCRFPL

SEQ ID NO: 5861 - protein, 162 aa, Homo sapiens [sequence omitted]

SEQ ID NO: 5862 - protein, 41 aa, Homo sapiens
MVKVGAWRAVQILMLFANPGHAEGACISPGPAGKREPLKLG

SEQ ID NO: 5863 - protein, 53 aa, Homo sapiens
MILLISQCPLSIFAAPFALPPKGHCGSFSDFHSQVTLHKNSKLIFRSHKSILL

SEQ ID NO: 5864 - protein, 85 aa, Homo sapiens
MGFWCGCPFCLLVVLLTDRTLSCRSVGVPCNVRCQCAPAGGCLPVRLLAGQGSGTHLRRQSARSQISSCMLGEPLLSSKLSDRDI

SEQ ID NO: 5865 - protein, 64 aa, Homo sapiens
MEKLLTLYLLLYVSYWSVSPTGQGAGLFIAQSSAPGLRQTHSRHLGNAWERKEGRREEGLHGHV

SEQ ID NO: 5866 - protein, 128 aa, Homo sapiens
MYECFLSLSLLKSCKAVSGLMCLLLPRLGLLLLLPSERCFCWIPVYSLITCLAECSVVLRDPGFAGAFQVHRRQACFSTLRWSCLLLWWVSRVSAGRPLIGSPHMMAPSTFCPTVRGPGTCASSDPDG

SEQ ID NO: 5867 - protein, 67 aa, Homo sapiens
MQPACLAPCLDALTSFCLGLLKLTFCLAFFPSGVLEGECSFFTMSRSLSHPRTLHRYTTERPAHSRH

SEQ ID NO: 5868 - protein, 47 aa, Homo sapiens
MLLFSSRFIMFLWPPVSGVCLSFIRDRSFLPMCHFIYVLILCNSIAL

SEQ ID NO: 5869 - protein, 41 aa, Homo sapiens
MSYKWNSRVCFLWSRTFHLMLLRLICLVAYISTEVISFIAE

SEQ ID NO: 5870 - protein, 58 aa, Homo sapiens
MTAMSIHLFCTALSCGSSGQCNKAIKRNKISNDWKDVNVSSFIENMIHRYTYTNALNS

SEQ ID NO: 5871 - protein, 49 aa, Homo sapiens
  SITE (27): Xaa equals any amino acid
MRPGSFSFIAFLATEVSSCFPGRPDCXTGMWLLQLQKKQRTLLAMAPRR

SEQ ID NO: 5872 - protein, 68 aa, Homo sapiens [sequence omitted]

SEQ ID NO: 5873 - protein, 292 aa, Homo sapiens
MLRVLCLLRPWRPLRARGCASDGAAGGSEIQVRALAGPDQGITEILMNRPSARNALGNVFVSELLETLAQLREDRQVRVLLFRSGVKGVFCAGADLKEREQMSEAEVGVFVQRLRGLMNDIAAFPAPTIAAMDGFALGGGLELALACDLRVAASSAVMGLIETTRGLLPGAGGTQRLPRCLGVALAKELIFTGRRLSGTEAHVLGLVNHAVAQNEEGDAAYQRARALAQEILPQAPIAVRLGKVAIDRGTEVDIASGMAIEGMCYAQNIPTRDRLEGMAAFREKRTPKFVGK

SEQ ID NO: 5874 - protein, 377 aa, Homo sapiens
  SITE (164): Xaa equals any amino acid
  SITE (213): Xaa equals any amino acid
MATAMDWLPWSLLLFSLMCETSAFYVPGVAPINFHQNDPVEIKAVKLTSSRTQLPYEYYSLPFCQPSKITYKAENLGEVLRGDRIVNTPFQVLMNSEKKCEVLCSQSNKPVTLTVEQSRLVAERITEDYYVHLIADNLPVATRLELYSNRDSDDKKKESDIKWXSRWDTYLTMSDVQIHWFSIINSVVVVFFLSGILSMIIIRTLRKDIANYXKEDDIEDTMEESGWKLVHGDVFRPPPVPHDPQLPAGLRHSAVLYDPHRHLCSHAWDAVALQPGSSHDHSLLPLHVHGGVWRIFCWPSVPHFKRPSVEERSLLYGNSVPWCGFWHLLRIELLHLGKALIRSGALSHHGGSAVHVVRDLPAPRLLGLLLRLPKAAI

SEQ ID NO: 5875 - protein, 121 aa, Homo sapiens
MIMAQKIGGLTWWAIMFIILFEITGTSSSFLRINALPHFSMNRCGEAYFPFSYLYTSLQKQFLMKVSGIVKNLRGNDDWRCFGVFFCIHFLMRKVLNVVQVRPNYYLTIIGRFYVSVKVFK

SEQ ID NO: 5876 - protein, 26 aa, Homo sapiens
MFHSSLLVFLSLLSQEIFTEYDCMHK

SEQ ID NO: 5877 - protein, 55 aa, Homo sapiens
MWFLHWTLLGYGPAQILGMWAVAPLKHQWAEDESWYPPGTPPSALHFTCDPGTSY

SEQ ID NO: 5878 - protein, 166 aa, Homo sapiens [sequence omitted]

SEQ ID NO: 5879 - protein, 79 aa, Homo sapiens
MLSLDFLDDVRRMNKRQVSLSVLFFSWLFLSLRGCCCGARRTPGFWCEGLSWSDTRVIRFLWRLWPEAALSASLFLTPN

SEQ ID NO: 5880 - protein, 99 aa, Homo sapiens [sequence omitted]

SEQ ID NO: 5881 - protein, 76 aa, Homo sapiens
  SITE (22): Xaa equals any amino acid
MNRGQRLCLAFVSLFPPCNSLXPPPTLFPSPLLPLSLTSPTPHSLSSLAVSCVCVGVCVFGCVNVGSSTTGFCNLG

SEQ ID NO: 5882 - protein, 84 aa, Homo sapiens [sequence omitted]

SEQ ID NO: 5883 - protein, 74 aa, Homo sapiens
MGFHHVSQAALVLLLLLLLLLLFDTESRSSLATERDSISKKKNKKTKKKNRKETKNVVLILINSNSFMWLAAAL

SEQ ID NO: 5884 - protein, 282 aa, Homo sapiens
MGSPGMVLGLLVQIWALQEASSLSVQQGPNLLQVRQGSQATLVCQVDQATAWERLRVKWTKDGAILCQPYITNGSLSLGVCGPQGRLSWQAPSHLTLQLDPVSLNHSGAYVCWAAVEIPELEEAEGNITRLFVDPDDPTQNRNRIASFPGFLFVLLGVGSMGVAAIVWGAWFWGRRSCQQRDSGNSPGNAFYSNVLYRPRGAPKKSEDCSGEGKDQRGQSIYSTSFPQPAPRQPHLASRPCPSPRPCPSPRPGHPVSMVRVSPRPSPTQQPRPKGFPKVGEE

SEQ ID NO: 5885 - protein, 58 aa, Homo sapiens
MVLPFVLLFRPNFISVLHPLFYSHCLFLYLISPVHSSSIIYYKPDHCHYTPFIPGLLQ

SEQ ID NO: 5886 - protein, 50 aa, Homo sapiens
MYIYLIHLCMCVYIYIYILLIIYTLDPEPPSWSPKLDSHLSLRQPSNDRF

SEQ ID NO: 5887 - protein, 27 aa, Homo sapiens
MLTQNGLFVFFFFFGFQSSCKHAKKKK

SEQ ID NO: 5888 - protein, 82 aa, Homo sapiens
MNRSTRSYRCWATWPRLGWALPCCMNSLRKGRKFSQITTSLMASVSSASMVSRRRRPLPKHPVTTTSTATALLGTSSTWSKS

SEQ ID NO: 5889 - protein, 36 aa, Homo sapiens
MVFLLLLLFGFFFDGSLRSPLLLIIHLGPAPTFLQI

SEQ ID NO: 5890 - protein, 163 aa, Homo sapiens
MGSTWGSPGWVRLALCLTGLVLSLYALHVKAARARDRDYRALCDVGTAISCSRVFSSRWGRGFGLVEHVLGQDSILNQSNSIFGCIFYTLQLLLGCLRTRWASVLMLLSSLVSLAGSVYLAWILFFVLYDFCIVCITTYAINVSLMWLSFRKVQEPQGKAKRH

SEQ ID NO: 5891 - protein, 64 aa, Homo sapiens
MFMWTISIVTFSIPLTLPLPLRGENKTLNGSNSYVFYFVSEVSKLLLLASFSLGQMDVSYFPVS

SEQ ID NO: 5892 - protein, 184 aa, Homo sapiens
MKALGAVLLALLLCGRPGRGQTQQEEEEEDEDHGPDDYDEEDEDEVEEEETNRLPGGRSRVLLRCYTCKSLPRDERCNLTQNCSHGQTCTTLIAHGNTESGLLTTHSTWCTDSCQPITKTVEGTQVTMTCCQSSLCNVPPWQSSRVQDPTGKGAGGPRGSSETVGAALLLNLLAGLGAMGARRP

SEQ ID NO: 5893 - protein, 106 aa, Homo sapiens [sequence omitted]

SEQ ID NO: 5894 - protein, 390 aa, Homo sapiens
MISLPGPLVTNLLRFLFLGLSALAPPSRAQLQLHLPANRLQAVEGGEVVLPAWYTLHGEVSSSQPWEVPFVMWFFKQKEKEDQVLSYINGVTTSKPGVSLVYSMPSRNLSLRLEGLQEKDSGPYSCSVNVQDKQGKSRGHSIKTLELNVLVPPAPPSCRLQGVPHVGANVTLSCQSPRSKPAVQYQWDRQLPSFQTFFAPALDVIRGSLSLTNLSSSMAGVYVCKAHNEVGTAQCNVTLEVSTGPGAAVVAGAVVGTLVGLGLLAGLVLLYHRRGKALEEPANDIKEDAIAPRTLPWPKSSDTISKNGTLSSVTSARALRPPHGPPRPGALTPTPSLSSQALPSPRLPTTDGAHPQPISPIPGGVSSSGLSRMGAVPVMVPAQSQAGSLV

SEQ ID NO: 5895 - protein, 112 aa, Homo sapiens
  SITE (69): Xaa equals any amino acid
MPVLPGRTTALLSLTLAFAVPCSGVEAGPCVPRSHGCSSWEASVCVTSSTPGGSWRARALFPSAAWHRXAAWDSPWTQTGDFARGAMGGAGALPGGCVCISGRPRAQKLPAL

SEQ ID NO: 5896 - protein, 235 aa, Homo sapiens
MSPRYPGGPRPPLRIPNQALGGVPGSQPLLPSGMDPTRQQGHPNMGGPMQRMTPPRGMVPLGPQNYGGAMRPPLNALGGPGMPGMNMGPGGGRPWPNPTNANSIPYSSASPGNYVGPPGGGGPPGTPIMPSPADSTNSGDNMYTLMNAVPPGPNRPNFPMGPGSDGPMGGLGGMESHHMNGSLGSGDMDSISKNSPNNMSLSNQPGTPRDDGEMGGNFLNPFQSESYSPSMTMSV

SEQ ID NO: 5897 - protein, 82 aa, Homo sapiens
MRTWASLALGLTRALGGMGSFLLRILGWSWAMGSRSRARWPRGRLGFTSMLSCMRQCSVCRMIMSLVEVLVATSQVVKLWSR

SEQ ID NO: 5898 - protein, 49 aa, Homo sapiens
MIDICHSLRREHFLLWSFLGLFYWAVNGKSVCVSLLHPKHLGKNESLLI

SEQ ID NO: 5899 - protein, 44 aa, Homo sapiens
  SITE (11): Xaa equals any amino acid
  SITE (34): Xaa equals any amino acid
MVLHCIAWLQXGISFLFLFLCVIAIGATNFASPXFYKLVSSGVA

SEQ ID NO: 5900 - protein, 89 aa, Homo sapiens
  SITE (12): Xaa equals any amino acid
  SITE (13): Xaa equals any amino acid
  SITE (72): Xaa equals any amino acid
MSGGLSFLLLVXXGTQSPLHLAGSCPGQTHLSFPLGQDRGQQLQQKQQDLEQEGLEATQGLLAGEWAPPLWXLGSLFQAFVKRESQAYA

SEQ ID NO: 5901 - protein, 51 aa, Homo sapiens
MERLVLSLWSLTCRASPANTHPRTTSRTRTLDVKTKCPVEAVKLSEMLPPV

SEQ ID NO: 5902 - protein, 52 aa, Homo sapiens
MLYDSNLCSVWHLYLILHLCKTFVYCGCVHSSYLISGTVNTQYFIVQTVLLF

SEQ ID NO: 5903 - protein, 44 aa, Homo sapiens
MLFFCLLMKMLGPSRLPFLALTLCRFILYFQFCYLISDSSPDHS

SEQ ID NO: 5904 - protein, 66 aa, Homo sapiens
MLLISAVQVFILLSPSFYLILYLLRPGGTGRGLEPICPAAEWGGWRDGYLWLQYQEPTVSLDNWGN

SEQ ID NO: 5905 - protein, 508 aa, Homo sapiens [sequence omitted]

SEQ ID NO: 5906 - protein, 295 aa, Homo sapiens
MSWPHGALLFLWLFSPPLGAGGGGVAVTSAAGGGSPPATSCPVACSCSNQASRVICTRRDLAEVPASIPVNTRYLNLQENGIQVIRTDTFKHLRHLEILQLSKNLVRKIEVGAFNGLPSLNTLELFDNRLTTVPTQAFEYLSKLRELWLRNNPIESIPSYAFNRVPSLRRLDLGELKRLEYISEAAFEGLVNLRYLNLGMCNLKDIPNLTALVRLEELELSGNRLDLIRPGSFQGLTSLRKLWLMHAQVATIERNAFDDLKSLEELNLSHNNLMSLPHDLFTPLHRLEGGPGTQF

SEQ ID NO: 5907 - protein, 48 aa, Homo sapiens
  SITE (17): Xaa equals any amino acid
  SITE (18): Xaa equals any amino acid
MLPLMTYIIQYIYTYIXXVRVLAILFLRRVLSQTLLHAVYGVSCVLIF

SEQ ID NO: 5908 - protein, 56 aa, Homo sapiens
MCFTQFSRIFFLTSSLTLAACANHILAAYSSSLADRCVGEKSLIVIVPERSFQTHF

SEQ ID NO: 5909 - protein, 55 aa, Homo sapiens
MESSTGKASPRCHIHCVPPFPPPCPVKRVGRLFLFFQHFPQGTVIIPLMPSPPLD

SEQ ID NO: 5910 - protein, 111 aa, Homo sapiens
MGGLEPCSRLLLLPLLLAVGLRPVQAQAQSDCSCSTVSPGVLAGIVMGDLVLTVLIALAVYFLGRLVPRGRGAAEATRKQRITETESPYQELQGQRSDVYSDLNTQRPYYK

SEQ ID NO: 5911 - protein, 44 aa, Homo sapiens
MRKTAWLCFFFQLCGLGQVTSLQYRNCNVEIKPSLVRGTHRSIP

SEQ ID NO: 5912 - protein, 68 aa, Homo sapiens [sequence omitted]

SEQ ID NO: 5913 - protein, 44 aa, Homo sapiens
MRLRNGTVATALAFITSFLTLSWYTTWQNGKGKENDSENVHEMY

SEQ ID NO: 5914 - protein, 58 aa, Homo sapiens
MPRDASLARRACLSLLLHLSWFPPCSAPGVIFSHSGYQGFYHIGFPKPHSNSPLSGKP

SEQ ID NO: 5915 - protein, 176 aa, Homo sapiens
MSRGDNCTDLLALGIPSITQAWGLWVLLGAVTLLFLISLAAHLSQWTRGRSRSHPGQGRSGESVEEVPLYGNLHYLQTGRLSQDPEPDQQDPTLGGPARAAEEVMCYTSLQLRPPQGRIPGPGTPVKYSEVVLDSEPKSQASGPEPELYASVCAQTRRARASFPDQAYANSQPAAS

SEQ ID NO: 5916 - protein, 327 aa, Homo sapiens [sequence omitted]

SEQ ID NO: 5917 - protein, 80 aa, Homo sapiens
  SITE (34): Xaa equals any amino acid
MNVTSVILVLILWNVIGVATWVHQNTFLYKRQMXELKRLKDRVFCFFVLIWLLGIKIRPRSLKISNRGRPLIDLKSVNSL

SEQ ID NO: 5918 - protein, 112 aa, Homo sapiens
  SITE (41): Xaa equals any amino acid
  SITE (109): Xaa equals any amino acid
MAALLLLPWLMLLTGRVSLAQFALAFVTDTCVAGALLCGAXLLFHGMLLLRGQTTWEWARGQHSYDLGPCHNLQAALGPRWALVWLWPFLASPLPGDGITFQTTADVGXTAS

SEQ ID NO: 5919 - protein, 42 aa, Homo sapiens
MFLVFWLLGIYFCHLLVITVLTKWILAPPYLMAQTTTPQSLY

SEQ ID NO: 5920 - protein, 42 aa, Homo sapiens
MGSWFYLFLAPLFKGLAGSLPFGCLSLLQPTEKTALQSGGSS

SEQ ID NO: 5921 - protein, 91 aa, Homo sapiens
MGDKLGMARAPSVALAQLWLICLCPESLASFVQAVPWKVLQPSSNRSTDCSPHMRPTCETLGSRKAQDLVLDTMCLSTDDCQGLICRGHRS

SEQ ID NO: 5922 - protein, 223 aa, Homo sapiens
AWYLLRVQVLQLVAAYLSLPSNNLSHSLWEQLCAQGWQTPEIALIDSHKLLRSIILLLMGSDILSTQKAAVETSFLDYGENLVQKWQVLSEVLSCSEKLVCHLGRLGSVSEAKAFCLEALKLTTKLQIPRQCALFLVLKGELELARNDIDLCQSDLQQVLFLLESCTEFGGVTQHLDSVKKVHLQKGKQQAQVPCPPQLPEEELFLRGPALELVPLWPRSLAP

SEQ ID NO: 5923 - protein, 136 aa, Homo sapiens
  SITE (84): Xaa equals any amino acid
MLFSLRELVQWLGFATFEIFVHLLALLVFSVLLALRVDGLVPGLSWWNVFVPFFAADGLSTYFTTIVSVRLFQDGEKRLAVLRXFWVLTVLSLKFVFEMLLCQKLAEQTRELWFGLITSPLFILLQLLMIRACRVN

SEQ ID NO: 5924 - protein, 293 aa, Homo sapiens
MATARPPWMWVLCALITALLLGVTEHVLANNDVSCDHPSNTVPSGSNQDLGAGAGEDARSDDSSSRIINGSDCDMHTQPWQAALLLRPNQLYCGAVLVHPQWLLTAAHCRKKVFRVRLGHYSLSPVYESGQQMFQGVKSIPHPGYSHPGHSNDLMLIKLNRRIRPTKDVRPINVSSHCPSAGTKCLVSGWGTTKSPQVHFPKVLQCLNISVLSQKRCEDAYPRQIDDTMFCAGDKAGRDSCQGDSGGPVVCNGSLQGLVSWGDYPCARPNRPGVYTNLCKFTKWIQETIQANS

SEQ ID NO: 5925 - protein, 196 aa, Homo sapiens [sequence omitted]

SEQ ID NO: 5926 - protein, 47 aa, Homo sapiens
MGVLLLFSFFFPNGSFSPVVLPSYFPNSSSYFVFCTSFWRPLSFQKG

SEQ ID NO: 5927 - protein, 243 aa, Homo sapiens
MGTLPWLLAFFILGLQAWDTPTIVSRKEWGARPLACRALLTLPVAYIITDQLPGMQCQQQSVCSQMLRGLQSHSVYTIGWCDVAYNFLVGDDGRVYEGVGWNIQGLHTQGYNNISLGIAFFGNKISSSPSPAALSAAEGLISYAIQKGHLSPRYIQPLLLKEETCLDPQHPVMPRKVCPNIIKRSAWEARETHCPKMNLPAKYVIIIHTAGTSCTVSTDCQTVVRNIQSFHMDTRNFCDIGYQ

SEQ ID NO: 5928 - protein, 80 aa, Homo sapiens
MKLSGMFLLLSLALFCFLTGVFSQGGQVDCGEFQDTKVYCTRESNPHCGSDGQTYGNKCAFCKAIVKSGGKISLKHPGKC

SEQ ID NO: 5929 - protein, 301 aa, Homo sapiens
MARHGLPLLPLLSLLVGAWLKLGNGQATSMVQLQGGRFLMGTNSPDSRDGEGPVREATVKPFAIDIFPVTNKDFRDFVREKKYRTEAEMFGWSFVFEDFVSDELRNKATQPMKSVLWWLPVEKAFWRQPAGPGSGIRERLEHPVLHVSWNDARAYCAWRGKRLPTEEEWEFAARGGLKGQVYPWGNWFQPNRTNLWQGKFPKGDKAEDGFHGVSPVNAFPAQNNYGLYDLLGNVWEWTASPYQAAEQDMRVLRGASWIDTADGSANHRARVTTRMGNTPDSASDNLGFRCAADAGRPPGEL

SEQ ID NO: 5930 - protein, 44 aa, Homo sapiens
MASGSWTSAPGIGVILVMTVCLSHCYTHEWGLWGGGGTQGLTDS

SEQ ID NO: 5931 - protein, 692 aa, Homo sapiens
MGTVSSRRSWWPLPLLLLLLLLLGPAGARAQEDEDGDYEELVLALRSEEDGLAEAPEHGTTATFHRCAKDPWRLPGTYVVVLKEETHLSQSERTARRLQAQAARRGYLTKILHVFHGLLPGFLVKMSGDLLELALKLPHVDYIEEDSSVFAQSIPWNLERITPPRYRADEYQPPDGGSLVEVYLLDTSIQSDHREIEGRVMVTDFENVPEEDGTRFHRQASKCDSHGTHLAGVVSGRDAGVAKGASMRSLRVLNCQGKGTVSGTLIGLEFIRKSQLVQPVGPLVVLLPLAGGYSRVLNAACQRLARAGVVLVTAAGNFRDDACLYSPASAPEVITVGATNAQDQPVTLGTLGTNFGRCVDLFAPGEDIIGASSDCSTCFVSQSGTSQAAAHVAGIAAMMLSAEPELTLAELRQRLIHFSAKDVINEAWFPEDQRVLTPNLVAALPPSTHGAGWQLFCRTVWSAHSGPTRMATAIARCAPDEELLSCSSFSRSGKRRGERMEAQGGKLVCRAHNAFGGEGVYAIARCCLLPQANCSVHTAPPAEASMGTRVHCHQQGHVLTGCSSHWEVEDLGTHKPPVLRPRGQPNQCVGHREASIHASCCHAPGLECKVKEHGIPAPQEQVTVACEEGWTLTGCSALPGTSHVLGAYAVDNTCVVRSRDVSTTGSTSEEAVTAVAICCRSRHLAQASQELQ

SEQ ID NO: 5932 - protein, 70 aa, Homo sapiens
MKPKHLEWCLAHSWCVIWLSFVSPPTSHLECDGFPGSLLPPCEEGRCFPFTFHHHDCHGCSPLQSSPGQH

SEQ ID NO: 5933 - protein, 79 aa, Homo sapiens
MCRPLLPLLFPWGHCLSIPLCKWPQIMSQPPRLHRLLASGPSTKKHSKLQTHSWENSNGLTLPFEPARSHGLWRAAFES

SEQ ID NO: 5934 - protein, 438 aa, Homo sapiens
MPCTCTWRNWRQWIRPLVAVIYLVSIVVAVPLCVWELQKLEVGIHTKAWFIAGIFLLLTIPISLWVILQHLVHYTQPELQKPIIRILWMVPIYSLDSWIALKYPGIAIYVDTCRECYEAYVIYNFMGFLTNYLTNRYPNLVLILEAKDQQKHFPPLCCCPPWAMGEVLLFRCKLGVLQYTVVRPFTTIVALICELLGIYDEGNFSFSNAWTYLVIINNMSQLFAMYCLLLFYKVLKEELSPIQPVGKFLCVKLVVFVSFWQAVVIALLVKVGVISEKHTWEWQTVEAVATGLQDFIICIEMFLAAIAHHYTFSYKPYVQEAEEGSCFDSFLAMWDVSDIRDDISEQVRHVGRTVRGHPRKKLFPEDQDQNEHTSLLSSSSQDAISIASSMPPSPMGHYQGFGHTVTPQTTPTTAKISDEILSDTIGEKKEPSDKSVDS

SEQ ID NO: 5935 - protein, 43 aa, Homo sapiens
MLTCIDMDWKVLTWLRYTLWIPLYPLGMFGGSCLSDSVHSNIQ

SEQ ID NO: 5936 - protein, 107 aa, Homo sapiens
MVRYTYSMLSVIGISYAVLTWLSQTLWMPIYPLCVLAEAFAIYQSLPYFESFGTYSTKLPFDLSIYFPYVLKIYLMMLFIGMYFTYSHLYSERRDILGIFPIKKKKM

SEQ ID NO: 5937 - protein, 234 aa, Homo sapiens
MRIRFTSPHPKDFPDEVLQLIHERDNICKQIHLPAQSGSSRVLEAMRRGYSREAYVELVHHIRESIPGVSLSSDFIAGFCGETEEDHVQTVSLLREVQYNMGFLFAYSMRQKTRAYHRLKDDVPEEVKLRRLEELITIFREEATKANQTSVGCTQLVLVEGLSKRSATDLCGRNDGNLKVIFPDAEMEDVNNPGLRVRAQPGDYVLVKITSASSQTLRGHVLCRTTLRDSSAYC

SEQ ID NO: 5938 - protein, 222 aa, Homo sapiens
MLWLLFFLVTAIHAELCQPGAENAFKVRLSIRTALGDKAYAWDTNEEYLFKAMVAFSMRKVPNREATEISHVLLCNVTQRVSFWFVVTDPSKNHTLPAVEVQSAIRMNKNRINNAFFLNDQTLEFLKIPSTLAPPMDPSVPIWIIIFGVIFCIIIVAIALLILSGIWQRRRKNKEPSEVDDAEDKCENMITIENGIPSDPLDMKGGHINDAFMTEDERLTPL

SEQ ID NO: 5939 - protein, 470 aa, Homo sapiens
MWFTYLLLYLHSVRAYSSRGAGLLLLLGQVADGLCTPLVGYEADRAASCCARYGPRKAWHLVGTVCVLLSFPFIFSPCLGCGAATPEWAALLYYGPFIVIFQFGWASTQISHLSLIPELVTNDHEKVELTALRYAFTVVANITVYGAAWLLLHLQGSSRVEPTQDISISDQLGGQDVPVFRNLSLLVVGVGAVFSLLFHLGTRERRRPHAEEPGEHTPLLAPATAQPLLLWKHWLREPAFYQVGILYMTTRLIVNLSQTYMAMYLTYSLHLPKKFIATIPLVMYLSGFLSSFLMKPINKCIGRNMTYFSGLLVILAFAAWVALAEGLGVAVYAAAVLLGAGCATILVTSLAMTADLIGPHTNSGAFVYGSMSFLDKVANGLAVMAIQSLHPCPSELCCRACVSFYHWAMVAVTGGVGVAAALCLCSLLLWPTRLRRSRGGEHRTPSEGEGISTAPPPCWNETQPQGGAKL

SEQ ID NO: 5940 - protein, 99 aa, Homo sapiens
MLSPQLHPLQVPLPCLLLLFTLWLVVPGSSTDISEDWEKDFDLDMTEEEVQMALSKVDASGEVSGPGGSEGSEPNGPGCESSPQPAQLSPQEGPCSCLR

SEQ ID NO: 5941 - protein, 93 aa, Homo sapiens
  SITE (59): Xaa equals any amino acid
  SITE (61): Xaa equals any amino acid
  SITE (84): Xaa equals any amino acid
MGHLPHILSLGLFLTLLMFCITKSDGQNKIYRCFKKASPQVIVTHTKMRIAAIICSYWXGXANLGTRIKLQLNSAVYKIFVSLXRKRKRTLSW

SEQ ID NO: 5942 - protein, 260 aa, Homo sapiens
MAGSPLLWGPRAGGVGLLVLLLLGLFRPPPALCARPVKEPRGLSAASPPLAETGAPRRFRRSVPRGEAAGAVQDLARALAHLLEAERQERARAEAQEAEDQQARVLAQLLRVWGAPRNSDPALGLDDDPDAPAAQLARALLRARLDPAALAAQLVPAPVPAAALRPRPPVYDDGPAGPDAEEAGDETPDVDPELLRYLLGRILAGSADSEGVAAPRRLRRAADHDVGSELPPEGVLGALLRVKRLETPAPQVPARRLLPP

SEQ ID NO: 5943 - protein, 95 aa, Homo sapiens
MHLCICAVWVLVALLRMHGASPAQTSGTRSGNGGCRRHGAGQGRGAATQPLRPPRGTASGQLMALLSALLPRLSGSSTPMMAHGRPAPPQWSRVS

SEQ ID NO: 5944 - protein, 54 aa, Homo sapiens
MFIVICKILLFLILVARPFRTHSCIKYFALFKETHMDEVRMCNMMASQCSSLYL

SEQ ID NO: 5945 - protein, 80 aa, Homo sapiens
MSLIWRDVYLYGCGCICHGRCCAGFPQHSRHVWRTNAGLILPGNRVPFCELEGCTRRSSYWNHLVILGGHWGLHLPCTSL

SEQ ID NO: 5946 - protein, 49 aa, Homo sapiens
MFPWCVCVIACISAVTPLIQGFTFCSFSYPQYSTVRYFERETTLTLLLL

SEQ ID NO: 5947 - protein, 41 aa, Homo sapiens
MNLSFLSFFLFFYLLWSPAESVYKKGMVKKNLSHSIVEKIK

SEQ ID NO: 5948 - protein, 50 aa, Homo sapiens [sequence omitted]

SEQ ID NO: 5949 - protein, 80 aa, Homo sapiens
MLTGSHPQTHTCWLGTRLWVVLSCLASLTVSDCPEHQVSSCISSWPGEHSVSFQPFPPFPHSLGGTEVGVEESQMAGVGI

SEQ ID NO: 5950 - protein, 110 aa, Homo sapiens
MYVTLVFRVKGSRLVKPSLCLALLCPAFLVGVVRVAEYRNHWSDVLAGFLTGAAIATFLVTCVVHNFQSRPPSGRRLSPQSAYPRLPGPQFPHLHNGGDHPCPAGCQERL

SEQ ID NO: 5951 - protein, 318 aa, Homo sapiens
MAKRTFSNLETFLIFLLVMMSAITVALLSLLFITSGTIENHKDLGGHFFSTTQSPPATQGSTAAQRSTATQHSTATQSSTATQTSPVPLTPESPLFQNFSGYHIGVGRADCTGQVADINLMGYGKSGQNAQGILTRLYSRAFIMAEPDGSNRTVFVSIDIGMVSQRLRLEVLNRLQSKYGSLYRRDNVILSGTHTHSGPAGYFQYTVFVIASEGFSNQTFQHMVTGILKSIDIPHTNMKPGKIFINKGNVDGVQINRSPYSYLQNPQSERARYSSNTDKEMIVLKMVDLNGDDLGLISFSFSKSALGTYYEPRNTSLE

SEQ ID NO: 5952 - protein, 55 aa, Homo sapiens
MPGGRDGLLYLYHGYSALLLWPVAFLHLLFLILLGMCFACCIPTSSAPLHTPWLA

SEQ ID NO: 5953 - protein, 163 aa, Homo sapiens; identical to SEQ ID NO: 5890

SEQ ID NO: 5954 - protein, 113 aa, Homo sapiens
  SITE (38): Xaa equals any amino acid
MRPLLLGGYWVLCLSVLGHAALYHFWLREEGKGPPQVXSVLALALPAGSCAPGLPFPGPLIPTQLLFALEWGTPTPLRDHPPHSMHSAPQNPPVFLGTHTCPPSWYFRLIPQA

SEQ ID NO: 5955 - protein, 275 aa, Homo sapiens
MTITSFYAVCFYLLMLVMVEGFGGKEAVLRTLRDTPMMVHTGPCCCCCPCCPRLLLTRKKLQLLMLGPFQYAFLKITLTLVGLFLIPDGIYDPADISEGSTALWINTFLGVSTLLALWTLGIISRQARLHLGEQNMGAKFALFQVLLILTALQPSIFSVLANGGQIACSPPYSSKTRSQVMNCHLLILETFLMTVLTRMYYRRKDHKVGYETFSSPDLDLNSKPKVDGLDNERMLYSLEYKIPLLSLNLDQMGSIPPCQHKLADTFDSTDEGEQC

SEQ ID NO: 5956 - protein, 87 aa, Homo sapiens
MDLTVEGFQSWMWRGLTFLLPFLFFGHFWQLFNALTLFNLAQDPQCKEWQVLMCGFPFLLLFLGNFFTTLRVVHHKFHSQRHGSKKD

SEQ ID NO: 5957 - protein, 161 aa, Homo sapiens
MALSLTLCFVMFWTPNVSEKILIDIIGVDFAFAELCVVPLRIFSFFPVPVTVRAHLTGWLMTLKKTFVLAPSSVLRIIVLIASLVVLPYLGVHGATLGVGSLLAGFVGESTMVAIAACYVYRKQKKKMENESATEGEDSAMTDMPPTEEVTDIVEMREENE

SEQ ID NO: 5958 - protein, 348 aa, Homo sapiens
MNMTQARVLVAAVVGLVAVLLYASIHKIEEGHLAVYYRGGALLTSPSGPGYHIMLPFITTFRSVQTTLQTDEVKNVPCGTSGGVMIYIDRIEVVNMLAPYAVFDIVRNYTADYDKTLIFNKIHHELNQFCSAHTLQEVYIELFDQIDENLKQALQKDLNLMAPGLTIQAVRVTKPKIPEAIRRNFELMEAEKTKLLIAAQKQKVVEKEAETERKKAVIEAEKIAQVAKIRFQQKVMEKETEKRISEIEDAAFLAREKAKADAEYYAAHKYATSNKHKLTPEYLELKKYQAIASNSKIYFGSNIPNMFVDSSCALKYSDIRTGRESSLPSKEALEPSGENVIQNKESTG

SEQ ID NO: 5959 - protein, 151 aa, Homo sapiens
MRRLLLVTSLVVVLLWEAGAVPAPKVPIKMQVKHWPSEQDPEKAWGARVVEPPEKDDQLVVLFPVQKPKLLTTEEKPRGQGRGPILPGTKAWMETEDTLGRVLSPEPDHDSLYHPPPEEDQGEERPRLWVMPNHQVLLGPEEDQDHIYHPQ

SEQ ID NO: 5960 - protein, 41 aa, Homo sapiens
MQVACVMKVSAQWVCFFVVFSPLCSSVKCASSGQNRGRGDQ

SEQ ID NO: 5961 - protein, 44 aa, Homo sapiens
MPLCGLYCLRILMFPLRSANSVPLQCLPPSSLANKDSHFRAPRK

SEQ ID NO: 5962 - protein, 116 aa, Homo sapiens
MTPLLTLILVVLMGLPLAQALDCHVCAYNGDNCFNPMRCPAMVAYCMTTRTYYTPTRMKVSKSCVPRCFETVYDGYSKHASTTSCCQYDLCNGTGLATPATLALAPILLATLWGLL

SEQ ID NO: 5963 - protein, 50 aa, Homo sapiens
MPGILAGIPVKDLCLSLLQGFRLLLLCVCPGWLSGWMGGQKGSPRIVDIG

SEQ ID NO: 5964 - protein, 206 aa, Homo sapiens
  SITE (143): Xaa equals any amino acid
MASHGLCPCLLMGTGWGLWTLLPDLEVMAGKGRMPFAGISVTSGFLRSLKRAPLPHTGSPDPRPSGIWSGVRTTSEEAGATSTQISTAAPRFHSRRKGPKRNLAPQLRVLVHRTVPPGQLVYAPQTVDSLRGTLLRPPAWLLXQVPCFYSGQPLLVSASVLCRDLMQFLFLLKSYLLPFLEVCRIGWEQIQRILGAGLWRQKEGNG

SEQ ID NO: 5965 - protein, 38 aa, Homo sapiens
MWLSPVPGVCAAVLALSFWIAKFPGEGTAIAKALGRLK

SEQ ID NO: 5966 - protein, 107 aa, Homo sapiens
  SITE (7): Xaa equals any amino acid
  SITE (9): Xaa equals any amino acid
  SITE (13): Xaa equals any amino acid
  SITE (95): Xaa equals any amino acid
MAVVLSXKXHRGXYCGRTSLLLSLLSCLLLLLLLLLLLLWSLSEIKTLKLICILSARDADGSRAKSHGFQIRYSAHSFQGHRFLKGPGFEEMANXEPSENLIWKTCM

SEQ ID NO: 5967 - protein, 63 aa, Homo sapiens
MLTSSSNLISWVLPELSSLLWVFLFWKRQCGDWAGRKTRSRVSGVVTNFPLHSPSLRYSSFLE

SEQ ID NO: 5968 - protein, 181 aa, Homo sapiens [sequence omitted]

SEQ ID NO: 5969 - protein, 190 aa, Homo sapiens
MPVPTLCLLWALAMVTRPASAAPMGGPELAQHEELTLLFHGTLQLGQALNGVYRTTEGRLTKARNSLGLYGRTIELLGQEVSRGRDAAQELRASLLETQMEEDILQLQAEATAEVLGEVAQAQKVLRDSVQRLEVQLRSAWLGPAYREFEVLKAHADKQSHILWALTGHVQRQRREMVAQQHRLRQIQER

SEQ ID NO: 5970 - protein, 144 aa, Homo sapiens
MEIYLSLGVLALGTLSLLAVTSLPSIANSLNWREFSFVQSSLGFVALVLSTLHTLTYGWTRAFEESRYKFYLPPTFTLTLLVPCVRSSWAKALFLLPCISRRLARIRRGWERESTIKFTLPTDHALSPLGFLFLVVQSGITVCK

SEQ ID NO: 5971 - protein, 62 aa, Homo sapiens
MKSQSPLRSMLLVGGLVSVLAEHLQHPQSRQPPLSHLSSHLTWDAQVELDRIFLSIRPPEVP

SEQ ID NO: 5972 - protein, 64 aa, Homo sapiens
MYLYLGVFFHLIYPGALSITTLGKHSHPFFTAEQNSTVWMEHTLFHQSPVASHLVCFQSFAFSE

SEQ ID NO: 5973 - protein, 28 aa, Homo sapiens
  SITE (3): Xaa equals any amino acid
MLXQFFLFVCFHFITYGFLCHTTRNFEK

SEQ ID NO: 5974 - protein, 55 aa, Homo sapiens
MLPSNWSGTWALIQLSIPFTLAFHQPNKNQLTQKKRKAPQGSFDPDIYIDAIGVP

SEQ ID NO: 5975 - protein, 43 aa, Homo sapiens
MFCFYLHFIFHVLSYKLNPLLFFSCSCFCFILVFLFPDYHLGM

SEQ ID NO: 5976 - protein, 319 aa, Homo sapiens
  SITE (264): Xaa equals any amino acid
  SITE (303): Xaa equals any amino acid
MNTDHLRLTVPNGIGALKLREMEHYFSQGLSVQLFNDGSKGKLNHLCGADFVKSHQKPPQGMEIKSNERCCSFDGDADRIVYYYHDADGHFHLIDGDKIATLISSFLKELLVEIGESLNIGVVQTAYANGSSTRYLEEVMKVPVYCTKTGVKHLHHKAQEFDIGVYFEANGHGTALFSTAVEMKIKQSAEQLEDKKRKAAKMLENIIDLFNQAAGDAISDMLVIEAILALKGLTVQQWDALYTDLPNRQLKVQVADRRVISTTXAERQAVTPPGLQEAINDLVKKYKLSRAFVRPSGTEDVVXSICRSRLTRKCRSPCT

SEQ ID NO: 5977 - protein, 75 aa, Homo sapiens [sequence omitted]

SEQ ID NO: 5978 - protein, 97 aa, Homo sapiens [sequence omitted]

SEQ ID NO: 5979 - protein, 187 aa, Homo sapiens
  SITE (167): Xaa equals any amino acid
MGFFLVLVMEQITLAYKEQSGPSPLEETRALLGTVNGGPQHWHDGPGVPQASGAPATPSALRACVLVFSLALHSVFEGLAVGLQRDRARAMELCLALLLHKGILAVSLSLRLLQSHLRAQVVAGCGILFSCMTPLGIGLGAALAESAGPLHQLAQSVLEGMAAGTFXYITFLEILLFHPKFKGVSRR

SEQ ID NO: 5980 - protein, 113 aa, Homo sapiens
MILSLLFSLGGPLGWGLLGAWAQASSTSLSDLQSSRTPGVWKAEAEDTSKDPVGRNWCPYPMSKLVTLLALCKTEKFLIHSQQPCPQELQTARKSKSCTAWPTSQCTRSSRRC

SEQ ID NO: 5981 - protein, 140 aa, Homo sapiens
  SITE (36): Xaa equals any amino acid
MFLFGGFLMTLFGLFVSLVFLGQAFTIMLVYVWSRXNPYVRMNFFGLLNFQAPFLPWVLMGFSLLLGNSIIVDLLGIAVGHIYFFLEDVFPNQPGGIRILKTPSILKAIFDTPDEDPNYNPLPEERPGGFAWGEGQRLGG

SEQ ID NO: 5982 - protein, 278 aa, Homo sapiens
MQWLRVRESPGEATGHRVTMGTAALGPVWAALLLFLLMCEIPMVELTFDRAVASDCQRCCDSEDPLDPAHVSSASSSGRPHALPEIRPYINITILKGDKGDPGPMGLPGYMGREGPQGEPGPQGSKGDKGEMGSPGAPCQKRFFAFSVGRKTALHSGEDFQTLLFERVFVNLDGCFDMATGQFAAPLRGIYFFSLNVHSWNYKETYVHIMHNQKEAVILYAQPSERSIMQSQSVMLDLAYGDRVWVRLFKRQRENAIYSNDFDTYITFSGHLIKAEDD

SEQ ID NO: 5983 - protein, 354 aa, Homo sapiens
MWRLWPGSPLVPLSWLWPARAAFLSGPWTLPPCLPDPLLAVPKCCLTLGIHLLPAWPGPPVGGGCSQLHRGCCYPGMGCLNRDLCPPSLVSRRWGDQLLWSPDGSKILATTPSAVFRVWEAQMWTCERWPTLSGRCQTGCWSPDGSRLLFTVLGEPLIYSLSFPERCGEGKGCVGGAKSATIVADLSETTIQTPDGEERLGGEAHSMVWDPSGERLAVLMKGKPRVQDGKPVILLFRTRNSPVFELLPCGIIQGEPGAQPQLITFHLPSTKGPCSVWAGPQAELPTSRCTLSMPSFHVLAQCLGGPRNPLLGVEALFMTCPSLLRHPQPLPLGTLSQGHHLFCPTPHIPTSKNK

SEQ ID NO: 5984 - protein, 338 aa, Homo sapiens
MRKPAAGFLPSLLKVLLLPLAPAAAQDSTQASTPGSPLSPTEYERFFALLTPTWKAETTCRLRATHGCRNPTLVQLDQYENHGLVPDGAVCSNLPYASWFESFCQFTHYRCSNHVYYAKRVLCSQPVSILSPNTLKEIEASAEVSPTTMTSPISPHFTVTERQTFQPWPERLSNNVEELLQSSLSLGSQEQAPEHKQEQGVEHRQEPTQEHKQEEGQKQEEQEEEQEEEGKQEEGQGTKEGREAVSQLQTDSEPKFHSESLSSNPSSFAPRVREVESTPMIMENIQELIRSAQEIDEMNEIYDENSYWRNQNPGSLLQLPHTEPCWCCAIRSWRIPAS

SEQ ID NO: 5985 - protein, 60 aa, Homo sapiens
MIRIQFLHLFLWVGFIFRQPPSSYPQDGRDSPWSFPCRDRSPGNNTSIPSHETVLNFILT

SEQ ID NO: 5986 - protein, 63 aa, Homo sapiens [sequence omitted]

SEQ ID NO: 5987 - protein, 298 aa, Homo sapiens
  SITE (87): Xaa equals any amino acid
MFFFFDSVQVVFTICTAVLATIAFAFLLLPMCQYLTRPCSPQNKISFGCCGRFTAAELLSFSLSVMLVLIWVLTGHWLLMDALAMGXCVAMIAFVRLPSLKVSCLLLSGLLIYDVFWVFFSAYIFNSNVMVKVATQPADNPLDVLSRKLHLGPNVGRDVPRLSLPGKLVFPSSTGSHFSMLGIGDIVMPGLLLCFVLRYDNYKKQASGDSCGAPGPANISGRMQKVSYFHCTLIGYFVGLLTATVASRIHRAAQPALLYLVPFTLLPLLTMAYLKGDLRRMWSEPFHSKSSSSRFLEV

SEQ ID NO: 5988 - protein, 232 aa, Homo sapiens
  SITE (36): Xaa equals any amino acid
  SITE (67): Xaa equals any amino acid
  SITE (70): Xaa equals any amino acid
  SITE (71): Xaa equals any amino acid
  SITE (82): Xaa equals any amino acid
  SITE (92): Xaa equals any amino acid
MAISIPNRIFPITALTLLALVYSLVLLLPFYNCTEXTKYRRFPDWLDHWMLCRKQLGLVALGFAFLXVLXXLVIPIRYYVRXRLGNLTVTQXILKKENPFSTSSAWLSDSYVALGILGFFLFVLLGITSLPSVSNAVNWREFRFVQSKLGYLTLILCTAHTLVYGGKRFLSPSNLRWYLPAAYVLGLIIPCTVLVIKFVLIMPCVDNTLTRIRRAGKGTQNTRKSIEWKINI

SEQ ID NO: 5989 - protein, 58 aa, Homo sapiens
MEPWSWFFFFFFFFPQRTCGCALCVLFLFSIWGPHGKELLNSFLYELPLCSYKGPFLS

SEQ ID NO: 5990 - protein, 46 aa, Homo sapiens
MTLSLQLAELVHFVCAFQSQWTGVYPMMPPLKPTEPLCFACVPCRV

SEQ ID NO: 5991 - protein, 47 aa, Homo sapiens
MQSGRSWALKMVLLCNSCLGLGVGSVGPSMSSLFGAVLSETPGSSVY

SEQ ID NO: 5992 - protein, 77 aa, Homo sapiens
MSVWPRSTLLFCLLSLSTGLFLDKLGIIIPILLCGWKVKCDNDVCEMPAQCLEVLKNYLLPFLFLPTTYPLPPGATC

SEQ ID NO: 5993 - protein, 83 aa, Homo sapiens
MASPGWHLSCRPTGLVSIFLLCAPAYLHSFVMTSITLISTKICSPTKLRHRTHFLYGSIMELYPTLTFPMTTDVENLNLDSSR

SEQ ID NO: 5994 - protein, 70 aa, Homo sapiens
MFSRLHFLTHSLSLLHLPSQVFGEVHSSCVSSLPCPDTPALPYCPSFLRYDDHIEAQPLKHINTNDHISI

SEQ ID NO: 5995 - protein, 73 aa, Homo sapiens
  SITE (24): Xaa equals any amino acid
MGFWCGCPFCLLVFLLTVRTRSFXSVGVCWRSTPDPLCLGISSRSCRTADIGEQQMLLPDRSSGSFVSEYPAM

SEQ ID NO: 5996 - protein, 152 aa, Homo sapiens
  SITE (66): Xaa equals any amino acid
  SITE (77): Xaa equals any amino acid
  SITE (81): Xaa equals any amino acid
  SITE (84): Xaa equals any amino acid
  SITE (86): Xaa equals any amino acid
  SITE (87): Xaa equals any amino acid
  SITE (93): Xaa equals any amino acid
  SITE (103): Xaa equals any amino acid
  SITE (110): Xaa equals any amino acid
MDHSPTTGVVTVIVILIAIAALGAFDPGLLVLPAAAAHQPVRGRGEHRGGWGDQGTLPAGAVFGQXTVRGEKGQADXSQTXRKXTXXPGCKGXLVPVCKPAKXGLGGAKXIRMRCCLRGRADTCWHGLCGFRPSHALMPGDLAVLGFPSASR

SEQ ID NO: 5997 - protein, 88 aa, Homo sapiens
MVAGFVFYLGVFVVCHQLSSSLNATYRSLVAREKVFWDLAATRAVFGVQSTAAAVGSAGGPCAACRQGAWPAELVLVSHHDSNGILLL

SEQ ID NO: 5998 - protein, 713 aa, Homo sapiens
MLLATLLLLLLGGALAHPDRIIFPNHACEDPPAVLLEVQGTLQRPLVRDSRTSPANCTWLILGSKEQTVTIRFQKLHLACGSERLTLRSPLQPLISLCEAPPSPLQLPGGNVTITYSYAGARAPMGQGFLLSYSQDWLMCLQEEFQCLNHRCVSAVQRCDGVDACGDGSDEAGCSSDPFPGLTPRPVPSLPCNVTLEDFYGVFSSPGYTHLASVSHPQSCHWLLDPHDGRRLAVRFTALDLGFGDAVHVYDGPGPPESSRLLRSLTHFSNGKAVTVETLSGQAVVSYHTVAWSNGRGFNATYHVRGYCLPWDRPCGLGSGLGAGEGLGERCYSEAQRCDGSWDCADGTDEEDCPGCPPGHFPCGAAGTSGATACYLPADRCNYQTFCADGADERRCRHCQPGNFRCRDEKCVYETWVCDGQPDCADGSDEWDCSYVLPRKVITAAVIGSLVCGLLLVIALGCTCKLYAIRTQEYSIFAPLSRMEAEIVQQQAPPSYGQLIAQGAIPPVEDFPTENPNDNSVLGNLRSLLQILRQDMTPGGGPGARRRQRGRLMRRLVRRLRRWGLLPRTNTPARASEARSQVTPSAAPLEALDGGTGPAREGGAVGGQDGEQAPPLPIKAPLPSASTSPAPTTVPEAPGPLPSLPLEPSLLSGVVQALRGRLLPSLGPPGPTRSPPGPHTAVLALEDEDDVLLVPLAEPGVWVAEAEDEPLLT

SEQ ID NO: 5999 - protein, 340 aa, Homo sapiens
MALRLLRRAARGAAAAALLRLKASLAADIPRLGYSSSSHHKYIPRRAVLYVPGNDEKKIKKIPSLNVDCAVLDCEDGVAANKKNEARLRIVKTLEDIDLGPTEKCVRVNSVSSGLAEEDLETLLQSRVLPSSLMLPKVESPEEIQWFADKFSFHLKGRKLEQPMNLIPFVETAMGLLNFKAVCEETLKVGPQVGLFLDAVVFGGEDFRASIGATSSKETLDILYARQKIVVIAKAFGLQAVDLVYIDFRDGAGLLRQSREGAAMGFTGKQVIHPNQIAVVQEQFSPSPEKIKWAEELIAAFKEHQQLGKGAFTFQGSMIDMPLLKQAQNTVTLATSIKEK

SEQ ID NO: 6000 - protein, 64 aa, Homo sapiens
MVRHIRERRRQPLAFQRVLLSLCLLEGIWHSPAAAAGGGSHCSSWPSLYTTFQRVSLLELDLGL

SEQ ID NO: 6001 - protein, 44 aa, Homo sapiens
  SITE (16): Xaa equals any amino acid
MCLPLLHCTGALWGKXVLLFLYCLAQSFAYSRHQTVGLVVHDYW

SEQ ID NO: 6002 - protein, 77 aa, Homo sapiens
MGLWFPMLILTQRFVSCDSHPDPKHTHTHAHINTHTHRHVHTQTHMHTHIHTPWFEEKRDGNRHSTHAYSAPLCIGN

SEQ ID NO: 6003 - protein, 20 aa, Homo sapiens
MACCNPYKYYFYLSCSVCFL

SEQ ID NO: 6004 - protein, 50 aa, Homo sapiens
MFNFFKNPLLTCLFISCYLYLSLLVNKVLFAEEGLCCTYCTTSNTGEGGV

SEQ ID NO: 6005 - protein, 82 aa, Homo sapiens
MKKVARLSSLGHVVWRLYARVLALITCIFWVLALIICIFTPQIFFKHLLHARPCSRYRRYNSKNTDLALMKLKLLRQADSDK

SEQ ID NO: 6006 - protein, 88 aa, Homo sapiens
  SITE (71): Xaa equals any amino acid
MSGSSLPRALALSLLLVSGSLLPGPGAAQNVKSTIWTGSEVENEVVKRKGKDRRKAAVVQGEKQDARLKEXNLCLRSIPENYKLFRKG

SEQ ID NO: 6007 - protein, 54 aa, Homo sapiens
MYRFFLCVDLSFQLLWVIPRSTVTGTYGKDIFSLAGNHHTVFQSSCTILHTHQH

SEQ ID NO: 6008 - protein, 221 aa, Homo sapiens
  SITE (184): Xaa equals any amino acid
MAGGVRPLRGLRALCRVLLFLSQFCILSGGESTEIPPYVMKCPSNGLCSRLPADCIDCTTNFSCTYGKPVTFDCAVKPSVTCVDQDFKSQKNFIINMTCRFCWQLPETDYECTNSTSCMTVSCPRQRYPANCTVRDHVHCLGNRTFPKMLYCNWTGGYKWSTALALSITLGGFGADRFYLGQWXEGLGKLFSFGGLGIWTLIDVLLIGVGYVGPADGSLYI

SEQ ID NO: 6009 - protein, 266 aa, Homo sapiens
MWWFQQGLSFLPSALVIWTSAAFIFSYITAVTLHHIDPALPYISDTGTVAPEKCLFGAMLNIAAVLCIATIYVRYKQVHALSPEENVIIKLNKAGLVLGILSCLGLSIVANFQKTTLFAAHVSGAVLTFGMGSLYMFVQTILSYQMQPKIHGKQVFWIRLLLVIWCGVSALSMLTCSSVLHSGNFGTDLEQKLHWNPEDKGYVLHMITTAAEWSMSFSFFGFFLTYIRDFQKISLRVEANLHGLTLYDTAPCPINNERTRLLSRDI

SEQ ID NO: 6010 - protein, 39 aa, Homo sapiens
MWLTQPESLSLCVSVSQDWAHILALSITMLWDFREFPHL

SEQ ID NO: 6011 - protein, 62 aa, Homo sapiens [sequence omitted]

SEQ ID NO: 6012 - protein, 334 aa, Homo sapiens
MGIFPGIILIFLRVKFATAAVIVSGVSKHLHCISHQKSTTVSHEMSGLNWKPFVYGGLASIVAEFGTFPVDLTKTRLQVQGQSIDARFKEIKYRGMFHALFRICKEEGVLALYSGIAPALLRQASYGTIKIGIYQSLKRLFVERLEDETLLINMICGVVSGVISSTIANPTDVLKIRMQAQGSLFQGSMIGSFIDIYQQEGTRGLWRGVVPTAQRAAIVVGVELPVYDITKKHLILSGMMGDTILTHFVSSFTCGLAGALASNPVDVVRTRMMNQRAIVGHVDLYKGTVDGILKMWKHEGFFALYKGFWPNWLRLGPWNIIFFITYEQLKRLQI

SEQ ID NO: 6013 - protein, 49 aa, Homo sapiens
MNVFVGPLSVAIVIFCWITMYWVSIVMGQGRGQYTWRTILSTSTPSVCS

SEQ ID NO: 6014 - protein, 50 aa, Homo sapiens
MVCCGFFLLWSRVRSYMKLSGHRWSSSCPHHCYSKCGLHTSNGKSSVHTV

SEQ ID NO: 6015 - protein, 142 aa, Homo sapiens
MPGPCLSQQHPFLSLSLFPFCLWICLARVPGVRNICKTQPAPSQPSLLGLGLSHPAAGTTDAGTQSLPRSQHKCTSALWGLCPAQRPLLLPAHIHSSGHGAPQELQSHLSHRLPASASLSMMSPFSEAWTHPSLSLGPAPSH

SEQ ID NO: 6016 - protein, 57 aa, Homo sapiens [sequence omitted]

SEQ ID NO: 6017 - protein, 64 aa, Homo sapiens
MVSPLISALFHVPFLWLGMFFPHSLSGPFPSHLRRASSSRKPLVKPPRARQYPPLASSGYRGRI

SEQ ID NO: 6018 - protein, 62 aa, Homo sapiens
MKNSTSLLYKLFSSLSVFIFKFLLLFYTLHIALGVKIQYKPLAHFIDHSCIQQVSQVQWSIP

SEQ ID NO: 6019 - protein, 37 aa, Homo sapiens
MSSFTLGLLFLFIFTTAENYLILFQRKYCLVIFWGEF

SEQ ID NO: 6020 - protein, 77 aa, Homo sapiens
MQLCVIWFTVIFLSQSSRLVKEKISNTSGEKGRWPAIDVVALCPSRTAGISFPRHFLYVSCIVGCTNIICSFGFPGQ

SEQ ID NO: 6021 - protein, 92 aa, Homo sapiens [sequence omitted]

SEQ ID NO: 6022 - protein, 120 aa, Homo sapiens
MLNLGSWPGLVAASLFLLKGVFSLFVQLLKNPLQHPRNRATHLLATPGARVLQEHLSIHPVCHQSHPPEAPLLPPSTRASLQASPPPPPSSQHPGGTPAACLQSKLPITHRRSPLRRPRH

SEQ ID NO: 6023 - protein, 45 aa, Homo sapiens
  SITE (43): Xaa equals any amino acid
MSDKLSPSTVPLLLPVLFKVTILLQRVCPEDSPSSSVLPESVXRE

SEQ ID NO: 6024 - protein, 103 aa, Homo sapiens
MAFLLERSGTLLICSMWWHHGYSNITGTEGERRNLKRNKTNFRRFQDGRIGTAPVYSSQCERCRRWVISAFPTEQTAHQKIISHAWLGGSHAHGASLIASTAV

SEQ ID NO: 6025 - protein, 77 aa, Homo sapiens
MMLQIIHLNTLIKFFQCLKLFLHGTAGSGQKCLAYKFSQFPSIIPAAHKKVHHLLSPKCLPTECSQADNSSWDSAVW

SEQ ID NO: 6026 - protein, 49 aa, Homo sapiens
MAPRNQGSFSFGNFMLFLVLIERRYLPFLSPILFCCSTHNRSAVTATNL

SEQ ID NO: 6027 - protein, 73 aa, Homo sapiens
MHAYACVCACMLVCVCVCVCRALVIPTEQRHRRVAHGRTSDSTLPCTVKIWPSERGDGRGERGERRRGTDWRG

SEQ ID NO: 6028 - protein, 957 aa, Homo sapiens [sequence omitted]

SEQ ID NO: 6029 - protein, 221 aa, Homo sapiens
  SITE (51): Xaa equals any amino acid
MALALAALAAVEPACGSRYQQLQNEEESGEPEQAAGDAPPPYSSISAESAXYFDYKDESGFPKPPSYNVATTLPSYDEAERTKAEATIPLVPGRDEDFVGRDDFDDADQLRIGNDGIFMLTFFMAFLFNWIGFFLSFCLTTSAAGRYGAISGFGLSLIKWILIVRFSTYFPGYFDGQYWLWWVFLVLGFLLFLRGFINYAKVRKMPETFSNLPRTRVLFIY

SEQ ID NO: 6030 - protein, 48 aa, Homo sapiens
MCHFSALSFTFCVLPLAFSFLQKHCYFTHKFGQNVQYSHFRVSFQWKK

SEQ ID NO: 6031 - protein, 139 aa, Homo sapiens
MALGIQKRFSPEVLGLCASTALVWVVMEVLALLLGLYLATVRSDLSTFHLLAYSGYKYVGMILSVLTGLLFGSDGYYVALAWTSSALMYFIVRSLRTAALGPDSMGGPVPRQRLQLYLTLGAAAFQPLIIYWLTFHLVR

SEQ ID NO: 6032 - protein, 42 aa, Homo sapiens
MRKEEGIAHLSIAFFVQVLCLYQLLPVILPQFNLGSGKNMNR

SEQ ID NO: 6033 - protein, 91 aa, Homo sapiens
  SITE (89): Xaa equals any amino acid
MMDFLRCVTAALIYFAISITAIAKYSDGASKAAGGSVPDTRAVCPSRSEMGRELGAAASREQGVSPVMHPIHPVHRCLASLLPSCLQLXST

SEQ ID NO: 6034 - protein, 68 aa, Homo sapiens [sequence omitted]

SEQ ID NO: 6035 - protein, 121 aa, Homo sapiens
  SITE (30): Xaa equals any amino acid
  SITE (32): Xaa equals any amino acid
  SITE (87): Xaa equals any amino acid
  SITE (101): Xaa equals any amino acid
  SITE (115): Xaa equals any amino acid
MCSHSTLIHLYLVLPFFFLFLPSSFPFPSXSXSSILPSLRLPPFFPPSLFLHSSLPPSLSHPLGLSITSSRQSFLDYHHLCTKHLSXTLCGLIYHCLNIFXTRAVMWHMQVSFLXIHWLLP

SEQ ID NO: 6036 - protein, 490 aa, Homo sapiens
MRPAFALCLLWQALWPGPGGGEHPTADRAGCSASGACYSLHHATMKRQAAEEACILRGGALSTVRAGAELRAVLALLRAGPGPGGGSKDLLFWVALERRRSHCTLENEPLRGFSWLSSDPGGLESDTLQWVEEPQRSCTARRCAVLQATGGVEPAGWKEMRCHLRANGYLCKYQFEVLCPAPRPGAASNLSYRAPFQLHSAALDFSPPGTEVSALCRGQLPISVTCIADEIGARWDKLSGDVLCPCPGRYLRAGKCAELPNCLDDLGGFACECATGFELGKDGRSCVTSGEGQPTLGGTGVPTRRPPATATSPVPQRTWPIRVDEKLGETPLVPEQDNSVTSIPEIPRWGSQSTMSTLQMSLQAESKATITPSGSVISKFNSTTSSATPQAFDSSSAVVFIFVSTAVVVLVILTMTVLGLVKLCFHESPSSQPRKESMGPPGLESDPEPAALGSSSAHCTNNGVKVGDCDLRDRAEGALLAESPLGSSDA

SEQ ID NO: 6037 - protein, 105 aa, Homo sapiens
MTHRRHCGLARWILMKIFCWRVSTVTSTAGALTNPHSCYTSVLKVGATGVGQSLSVWTMPGLLLEQFSTGVELLLSSSRFSNSMEYKNRLSSVEDRSSVVTCLKA

SEQ ID NO: 6038 - protein, 57 aa, Homo sapiens [sequence omitted]

SEQ ID NO: 6039 - protein, 71 aa, Homo sapiens
MRIHFKILVLVIYFILLGSFSDRCSLLDCKSRIQRIFICNILNLSLVSCHLCRYSFDCLTRGKCFPLSFPA

SEQ ID NO: 6040 - protein, 68 aa, Homo sapiens [sequence omitted]

SEQ ID NO: 6041 - protein, 143 aa, Homo sapiens
MSPFHLLGLKVFLTWALTLAQICLYFFEVQPLGLLALNFFCTATAGLKELCMHPPSLAFTPEFHTSLSPLAIPSFCGTSVSLSNSHTIPLSLYLPFPSKSRMPDTLHLLVHSLPLVHSQVLPVKDVTIEWPLCQRCLGSTCHQ

SEQ ID NO: 6042 - protein, 233 aa, Homo sapiens
  SITE (173): Xaa equals any amino acid
MHRGKLDCAGGALLSSYLIVLMILLAVVICTVSAIMCVSMRGTICNPGPRKSMSKLLYIRLALFFPEMVWASLGAAWVADGVQCDRTVVNGIIATVVVSWIIIAATVVSIIIVFDPLGGKMAPYSSAGPSHLDSHDSSQLLNGLKTAATSVWETRIKLLCCCIGKDDHTRVAXSSTAELFSTYFSDTDLVPSDIAAGLALLHQQQDNIRNNQDLPRWSAMPQGAPRKLIWMQN

SEQ ID NO: 6043 - protein, 66 aa, Homo sapiens [sequence omitted]

SEQ ID NO: 6044 - protein, 67 aa, Homo sapiens
MPLEGFCLVLDIGFLLVMLISLASECFTTCLDSFSTTEPGCKFYKLLHSVSLLNINFNVKSLLCSHI

SEQ ID NO: 6045 - protein, 40 aa, Homo sapiens
MSVYVNIMHIVIYIYLCVYMCVAQSHTHTQICIQMLPGLQ

SEQ ID NO: 6046 - protein, 33 aa, Homo sapiens
  SITE (21): Xaa equals any amino acid
MCLLAHLFCHHLLILLPVIEXLLCTRHWARGIL

SEQ ID NO: 6047 - protein, 249 aa, Homo sapiens
  SITE (147): Xaa equals any amino acid
  SITE (150): Xaa equals any amino acid
  SITE (196): Xaa equals any amino acid
  SITE (222): Xaa equals any amino acid
MVCVFMCIVGVCVACCACVYCGCLLSRAVERTSGKQPQHQGQARSAECMEAGQVGAWDEGSTEMQGCQGPWNQEPMIKATVHTALEAKDIFISQGLKSMGQGWAPGQDWGYRVDQSPSLPPGAYPHPFTSQVSPPQPLGELLLIPQXVAXVTLLPEASPHPLKHPLPAAHLQHSQRAPWPVSTGLSLLGGAGAEQXPGLGVPAPRSTPSPTASLFNLRQAVXLLSLTFPLCKMREGTAPSKPSFSLKPL

SEQ ID NO: 6048 - protein, 104 aa, Homo sapiens
MPLQLSGQYWISLLVFLSLQPFPQAAIPCALTDVGGSCVICHILLNCLCILFTLTAPSLSHVLLIKMSLSVCYEPGADLSDRAATGNKKLTRSTCLLMHSNKLC

SEQ ID NO: 6049 - protein, 127 aa, Homo sapiens
MQGSDAGHGGTHIYRALVQWPLAWVFYLSHAKTHWGEELRFSFRRKNLRLREAMRHETCQVTQLVAGKADSNLCLRDSETWFWPPLWAACSSLQATACRLSSPSKGLGASRECPWLASGRAALVSFL

SEQ ID NO: 6050 - protein, 113 aa, Homo sapiens
MGSWCICTLLLLLTDGQQGFYPQPFQAAPGRQQLWGGTNPWAVLIPESFLPYTLTVNYSPSCNFEFYLPKMRLAYICMSHSHCPYLGRDIIITLLNYCSSFLAELLAHLVYIA

SEQ ID NO: 6051 - protein, 51 aa, Homo sapiens [sequence omitted]

SEQ ID NO: 6052 - protein, 66 aa, Homo sapiens
MQNDGLKFMEMVLHVLQASIGVLLLMVDVLEHFLAMLIGNAGAPLPLLDVLGKDVIDVAERRESKK

SEQ ID NO: 6053 - protein, 82 aa, Homo sapiens
  SITE (51): Xaa equals any amino acid
MLIALFCILFQILFSIPTRIFYIFLINKRVHIFTTYLMSEQKNHDWVRRTXKLHRVWLISGKMLLVADIKALIRWLWGPNPE

SEQ ID NO: 6054 - protein, 90 aa, Homo sapiens
  SITE (29): Xaa equals any amino acid
  SITE (30): Xaa equals any amino acid
  SITE (65): Xaa equals any amino acid
MLRCSFSSFLLCHTILLFLGSSAHLLVEXXVWGLYEYRIGDMVDQKATFCVQKQECLFPLGSWVXRVEGGAFAREPPSSTQYFPVSCLYQ

SEQ ID NO: 6055 - protein, 41 aa, Homo sapiens
MVCVRCVWYVWHVFGVYGNILWIRTCGLFKDLSFCALKSEM

SEQ ID NO: 6056 - protein, 40 aa, Homo sapiens [sequence omitted]

SEQ ID NO: 6057 - protein, 36 aa, Homo sapiens
MGCTALLLLFHLCVPCEPYGTHEKELVPGLYFLVYR

SEQ ID NO: 6058 - protein, 46 aa, Homo sapiens
MCIPEALGKNSLFLSSTFLWLLAFFGLWSHHSYLEGQHLQICFFFT

SEQ ID NO: 6059 - protein, 52 aa, Homo sapiens
MIFKLLIFRIFFHELALALCISNLVSLPWLSYFWCPEMQNLFLLDTHIWVLM

SEQ ID NO: 6060 - protein, 34 aa, Homo sapiens
  SITE (27): Xaa equals any amino acid
MSVFLLITLALAILYIIRSIVFSLALXQNGSLQG

SEQ ID NO: 6061 - protein, 82 aa, Homo sapiens
MAISCWASLTVKSLYCLLGFWWEAVISSNELPLPWICQEADGNLANSGRYQAPSSAPVTLFYTCGSTTVCSEGQSLPLLCFS

SEQ ID NO: 6062 - protein, 57 aa, Homo sapiens
MPPHRQTDGQMGLPAPALWVWGLLLSSSFQTLLPAFPKPPALNLGCSTRPIPSFLKI

SEQ ID NO: 6063 - protein, 55 aa, Homo sapiens
MPRWLSLLALTSLTGILSGTLGFSPHGWSSPRRHLSPRPECPAASQTTCKSLGQH

SEQ ID NO: 6064 - protein, 59 aa, Homo sapiens
MTPSLLSEKLCSLFFVLLGIASAAFVSALWAWSSHTERLTAEPSSSITCLSPPWFFFPF

SEQ ID NO: 6065 - protein, 54 aa, Homo sapiens
MWPFLHLLNMPFTLTQVVASPSSCSNWKPQHPEMPPPQIHCTHVCLCMRVCARV

SEQ ID NO: 6066 - protein, 54 aa, Homo sapiens
  SITE (38): Xaa equals any amino acid
MPHIFVSGNFSLLALFLLSANFIVEVQSWLLLLLFFIXLGRSYNFYLLCDSIIF

SEQ ID NO: 6067 - protein, 21 aa, Homo sapiens
MQLVLFHRLIMPLFFARTLVD

SEQ ID NO: 6068 - protein, 44 aa, Homo sapiens
MCLGHAFCLLLSHSCRMHCTCYLCLFTVQVLPGKYNEGGEGQRN

SEQ ID NO: 6069 - protein, 48 aa, Homo sapiens
MFPGCILLCNLCMFFVLSFSMGIFAFYSLIRAMHVSRLDFNFATYFVA

SEQ ID NO: 6070 - protein, 46 aa, Homo sapiens [sequence omitted]

SEQ ID NO: 6071 - protein, 71 aa, Homo sapiens
  SITE (58): Xaa equals any amino acid
MKAIARACLLLSLLVLPHVVSEHLFWHHNPRHPVIWPFPPFHLISCSVSASTWHLGEXLLLLVPIAPSVWS

SEQ ID NO: 6072 - protein, 51 aa, Homo sapiens
MRHVAIVTMIVVLSPPVLASSLKPPLFIDTYFMFGKRCSRWDTLPAPNNSY

SEQ ID NO: 6073 - protein, 36 aa, Homo sapiens
MAGHPTLILLCKWAFHLTGAICEPYLNQTLPTQACL

SEQ ID NO: 6074 - protein, 81 aa, Homo sapiens
  SITE (44): Xaa equals any amino acid
MRMRVAVAPRPHQHLVVSVSWILAILISVSGYHCFHLQFSYMVXNIFPHVYLSSAYLLRPVICSDLLPVFVCLHVCLCLIF

SEQ ID NO: 6075 - protein, 80 aa, Homo sapiens
MCVVCVCVWCMCVCGVCVCLCVCGVCMCISLNEKLAPMIMELTTPKVCRQQAGGPGGPVVWLQPVSEGLRTRRAGGAAAV

SEQ ID NO: 6076 - protein, 78 aa, Homo sapiens
  SITE (40): Xaa equals any amino acid
  SITE (46): Xaa equals any amino acid
  SITE (60): Xaa equals any amino acid
MMGNDLLHLVFLQLSLGVASGGWILWPLRRLGGAHTSKDXNKNGHXVHCLVITNEPLVSXKKIGLSSPHTCPSTLQQF

SEQ ID NO: 6077 - protein, 52 aa, Homo sapiens
MYYLGKWDIWQPVSLLYIILFAACPSLLISIPAKASGEGWRCGDIQLTVVTD

SEQ ID NO: 6078 - protein, 53 aa, Homo sapiens
MSTFVCVCVFCFVLRSEARAKRKQDQRNTKRCLLTKGQRDLSVNQSKINRTAN

SEQ ID NO: 6079 - protein, 80 aa, Homo sapiens
MALWVTCILSLCTWFSCLYGADSLANKCLSAGATRKAFPFCVLFRDLEVGLGFEGFVTHLACKLFCYCELSDSALSLGHE

SEQ ID NO: 6080 - protein, 51 aa, Homo sapiens [sequence omitted]

SEQ ID NO: 6081 - protein, 320 aa, Homo sapiens
MRGSVECTWGWGHCAPSPLLLWTLLLFAAPFGLLGEKTRQLLEFDSTNVSDTAAKPLGRPYPPYSLADFSWNNITDSLDPATLSATFQGHPMNDPTRTFANGSLAFRVQAFSRSSRPAQPPRLLHTADTCQLEVALIGASPRGNRSLFGLEVATLGQGPDCPSMQEQHSIDDEYAPAVFQLDQLLWGSLPSGFAQWRPVAYSQKPGGRESALPCQASPLHPALAYSLPQSPIVRAFFGSQNNFCAFNLTFGASTGPGYWDQHYLSWSMLLGVGFPPVDGLSPLVLGIMAVALGAPGLMLLGGGLVLLLHHKKYSEYQSIN

SEQ ID NO: 6082 - protein, 115 aa, Homo sapiens
MLALSSSFLVLSYLLTRWCGSVGFILANCFNMGIRITQSLCFIHRYYRRAPTGPWLACTYRQSCSGHLPSVVGLLLFRRYSSAVSRAGQPDWHTLLWGPSVWEQLSGQHSSQRPS

SEQ ID NO: 6083 - protein, 402 aa, Homo sapiens
MYSGNRSGGHGYWDGGGAAGAEGPAPAGTLSPAPLFSPGTYERLALLLGSIGLLGVGNNLLVLVLYYKFQRLRTPTHLLLVNISLSDLLVSLFGVTFTFVSCLRNGWVWDTVGCVWDGFSGSLFGIVSIATLTVLAYERYIRVVHARVINFSWAWRAITYIWLYSLAWAGAPLLGWNRYILDVHGLGCTVDWKSKDANDSSFVLFLFLGCLVVPLGVIAHCYGHILYSIRMLRCVEDLQTIQVIKILKYEKKLAKMCFLMIFTFLVCWMPYIVICFLVVNGHGHLVTPTISIVSYLFAKSNTVYNPVIYVFMIRKFRRSLLQLLCLRLLRCQRPAKDLPAAGSEMQIRPIVMSQKDGDRPKKKVTFNSSSIIFIITSDESLSVDDSDKTNGSKVDVIQVRPL

SEQ ID NO: 6084 - protein, 218 aa, Homo sapiens
  SITE (168): Xaa equals any amino acid
  SITE (174): Xaa equals any amino acid
  SITE (198): Xaa equals any amino acid
  SITE (213): Xaa equals any amino acid
MRALLALCLLLGWLRWGPAGAQQSGEYCHGWVDVQGNYHEGFQCPEDFDTLDATICCGSCALRYCCAAADARLEQGGCTNDRRELEHPGITAQPVYVPFLIVGSIFIAFIILGSVVAIYCCTCLRPKEPSQQPIRFSLRSYQTETLPMILTSTSPRAPSRQSSTATSXSFTGGXIRRFFSAIWFPGVTPVFRLPPSAXAPTGWEELSRLSVPXDTPRP

SEQ ID NO: 6085 - protein, 76 aa, Homo sapiens [sequence omitted]

SEQ ID NO: 6086 - protein, 89 aa, Homo sapiens
MPVPLLASAAWCHLCAGALPAWLWLPWRAAAAQWHVCASHCLPLHPAFSALGPHPDPGRAGPGAAPRDCAHPELHPLCLPRWSLQLLPR

SEQ ID NO: 6087 - protein, 104 aa, Homo sapiens
MLFCILLYTLGSARCHHLSFFLWGWSNPPEKTPLASWRGVKARLPGPGCQLLGAAGAEAGSCQAFSQQDALSTHLGFRIPLPHLQMGQMSPKPAAPFCFTLSTE

SEQ ID NO: 6088 - protein, 40 aa, Homo sapiens
METQICLTQIVALFFLRLVLGKLTCFLYGKLVLVEAFILA

SEQ ID NO: 6089 - protein, 87 aa, Homo sapiens
MMTFFGSHILLFLFCPLKAGHRHLVSSSFLTVAVSISKGPFFHSTAQKRKSRKQLPRPAFLVPLSSQNTQTRTKHHFSFLHLIVLQP

SEQ ID NO: 6090 - protein, 41 aa, Homo sapiens
MAVPLFLYIFTLLPLLPFLLSLCFSPLTVKRSSSSESKSSL

SEQ ID NO: 6091 - protein, 20 aa, Homo sapiens
MFIVALLILHWALGGTVMSK

SEQ ID NO: 6092 - protein, 35 aa, Homo sapiens
IYSSGYFQIYNMLLLTILILLCNRTPELIPGFYIR

SEQ ID NO: 6093 - protein, 106 aa, Homo sapiens
MVHIAIKTPLHPATPIPHRAFVPALAFLPFSFSSPLSSLKAVSCFQCDNTMMSFGRICQDRLILSPGCRMCMRQCCQAILFEALCCHNYHQVHTVGKRLTPDFRKC

SEQ ID NO: 6094 - protein, 40 aa, Homo sapiens
MVCFYALLLCFLSSVEIGPLSWLLCLSHIKCHFTALPFEA

SEQ ID NO: 6095 - protein, 43 aa, Homo sapiens
MHMPAAPVTVLKLLPFPCVCGLGWVPIGCVSIPSHLKGNLCCS

SEQ ID NO: 6096 - protein, 159 aa, Homo sapiens [sequence omitted]

SEQ ID NO: 6097 - protein, 59 aa, Homo sapiens
MLQQKTQFYSILWLCSIPWCVCTTFSLYSPPLMGTRVDFMSLNMCCNEKKHIFYKMIEV

SEQ ID NO: 6098 - protein, 165 aa, Homo sapiens
  SITE (56): Xaa equals any amino acid
MKIAVLFCFFLLIIFQTDFGKNEEIPRKQRRKIYHRRLRKSSTSHKHRSNRQLGIXQTTVFTPVARLPIVNFDYSMEEKFESFSSFPGVESSYNVLPGKKGHCLVKGITMYNKAVWSPEPCTTCLCSDGRVLCDETMCHPQRCPQTVIPEGECCPVCPLLVQSFS

SEQ ID NO: 6099 - protein, 333 aa, Homo sapiens
MSPWSWFLLQTLCLLPTGAASRRGAPGTANCELKPQQSELNSFLWTIKRDPPSYFFGTIHVPYTRVWDFIPDNSKEAFLQSSIVYFELDLTDPYTISALTSCQMLPQGENLQDVLPRDIYCRLKRHLEYVKLMMPLWMTPDQRGKGLYADYLFNAIAGNWERKRPVWVMLMVNSLTEVDIKSRGVPVLDLFLAQEAERLRKQTGAVEKVEEQCHPLNGLNFSQVIFALNQTLLQQESLRAGSLQIPYTTEDLIKHYNCGDLSSVILSHDSSQVPNFINATLPPQERITAQEIDSYLRRELIYKRNERIGKRVKALLEEFPDKGFFFAFGAASQ

SEQ ID NO: 6100 - protein, 226 aa, Homo sapiens
METVVIVAIGVLATIFLASFAALVLVCRQRYCRPRDLLQRYDSKPIVDLIGAMETQSEPSELELDDVVITNPHIEAILENEDWIEDASGLMSHCIAILKICHTLTEKLVAMTMGSGAKMKTSASVSDIIVVAKRISPRVDDVVKSMYPPLDPKLLDARTTALLLSVSHLVLVTRNACHLTGGLDWIDQSLSAAEEHLEVLREAALASEPDKGLPGPEGFLQEQSAI

SEQ ID NO: 6101 - protein, 117 aa, Homo sapiens [sequence omitted]

SEQ ID NO: 6102 - protein, 404 aa, Homo sapiens
MRLQDVYMLNVKGLARGVFQRVTGSAITDLYSPKRLFSLTGDDCFQVGKVAYDMGDYYHAIPWLEEAVSLFRGSYGEWKTEDEASLEDALDHLAFAYFRAGNVSCALSLSREFLLYSPDNKRMARNVLKYERLLAESPNHVVAEAVIQRPNIPHLQTRDTYEGLCQTLGSQPTLYQIPSLYCSYETNSNAYLLLQPIRKEVIHLEPYIALYHDFVSDSEAQKIRELAEPWLQRSVVASGEKQLQVEYRISKSAWLKDTVDLKLVTLNHRIAALTGLDVRPPYAEYLQVVNYGIGGHYEPHFDHATSPSSPLYRMKSGNRVATFMIYLSSVEAGGATAFIYANLSVPVVRNAALFWWNLHRSGEGDSDTLHAGCPVLVGDKWVANKWIHEYGQEFRRPCSSSPED

SEQ ID NO: 6103 - protein, 484 aa, Homo sapiens
MPRHLSGLLLLLWPLLLLLPPTPAAPGPLARPGLRRLGTRGPGGSPGRRPVSAVPTRAPYSGAGQPGGARGAGVCRSRPLDLVFIIDSSRSVRPLEFTKVKTFVSQIIDTLDIGAADTRVAVVNYASTVKIEFHLQTHSDKQSLKQAVARITPLSTGTMSGLAIQTAMDEAFTVEAGARGPTSNIPKVAIIVTDGRPQDQVNEVAARARASGIELYAVGVDRADMESLKMMASEPLDEHVFYVETYGVIEKLSSRFQETFCALDPCVLGTHRCQHVCVSDGEGKHHCECSQGYSLNADQKTCSAIDKCALNTHGCEHICVNDRTGSYHCECYEGYTLNQDRKTCSAQDQCAFGTHGCQHICVNDRDGSHHCECYEGYTLNADNKTCSVRSECAGGSHGCQHLCVDDGPAAYHCDCFPGYTLTEDRRTCAAIEEARRLVSTEDACGCEATLAFQERASSYLQRLNAKLDDILGKLQADAYGQIHR

SEQ ID NO: 6104 - protein, 410 aa, Homo sapiens
MQPPSLLLLVLGLLAAPAAALVRIPLHKFTSVRRTMSELGGPVEDLIARGPISKYAQGVPSVAGGPVPEVLRNYMDAQYYGEIGIGTPPQCFTVVFDTGSSNLWVPSIHCKLLDIACWIHHKYNSGKSSTYVKNGTSFDIHYGSGSLSGYLSQDTVSVPCKSGLSSLAGVKVERQTFGEATKQPGITFIAAKFDGILGMAYPRISVNNVLPVFDNLMQQKLVEKNIFSFYLNRDPGAQPGGELMLGGTDSKYYKGPLSYLNVTRKAYWQVHMEQVDVGSSLTLCKGGCEAIVDTGTSLIVGPVDEVRELQKAIGAVPLIQGEYMIPCEKVSTLPEVTLTLGGKPYKLSSEDYTLKVSQGGKSICLSGFMGMDIPPPGGPLWILGDVFIGRYYTVFDRDQNRVGLAEATRL

SEQ ID NO: 6105 - protein, 627 aa, Homo sapiens
MEARVVHALQKRQVSLLCVFLGVSWAGAEPLRYFVAEETERGTFLANLAIDLGLGVEELSARGCRIVSDETIGFLLLNPLTGDLLLNEKLDREELCGPTEPCVLPFQLLLEKPFQIFRAELWVRDINDHSPVFLDREITLNILESTTPGATFLLESAHDSDVGINNLRNYTISSNVYFHINVHDNGEGNVYSELVLDKVLDREEVPELRLTLTGLDGGSPPRSGTTLIRILVLDINDNVPEFVESLYKVQVPENSPVGSLVVTVSARDLDTGSNGEIVYAFFYATERTLKTFRINSTSGNLHLKAELNYEAIQTYTLTIQAKDGGGLSGKCTVVVHVTDINDNPPELLMSSLTSPIPENSPETVVAVFRIRDRDSGNNAKMVCSIQDHLPFVLKPSVENFYTLVTERALDREERTEYNITITVTDLGTPRLKTQHNLTVTVSDVNDNAPTFSQTTYTLRVRENNSPALHIGSVSATDRDSGANAQVTYSLLPPHDPQLPLGSLVSINADNGQLFALRSLDFEALQAFEFRVGAADRGSPALSSQALVRVLVADANDNAPFVLYPLQNGSAPCTELVPRAAEAGYLVAKVVAVDGDSGQNAWLSYQLLKATEPGLFGVWAHNGEVRTA

SEQ ID NO: 6106 - protein, 82 aa, Homo sapiens
MLLLQSLFFPMSWGSGGGGKGRDDLPREKPTTCPVFDRLFDIFAKIPLVESQASCARIGIAASHWRLDCSVDGMQADCLSLI

SEQ ID NO: 6107 - protein, 363 aa, Homo sapiens
MKTLLLLVGLLLTWENGRVLGDQMVSDTELQEMSTEGSKYINREIKNALKGVKQIKTLIEQTNEERKSLLTNLEEAKKKKEDALNDTKDSEMKLKASQGVCNDTMMALWEECKPCLKQTCMKFYARVCRSSTGLVGHQVEEFLNQSSPFYFWINGDRIDSLLENDRQQTHALDVMQDSFDRASSIMDELFQDRFFTREAQDPFHFSPFSSFQRRPFFFNIKHRFARNIMPFPGYQPLNFHDMFQPFFDMIHQAQQAMDVNLHRLPHFPMEFTEEDNQDGAVCKEIRHNSTGCLKMKDQCEKCREILSVDCSSNNPAQVQLRQELNNSLQIAEKFTKLVRRAAAVLPGEDVQHVLPAEAAGRAV

SEQ ID NO: 6108 - protein, 55 aa, Homo sapiens
MREKTGALPRCLGLLGVGLLWRWCGRRARAGVGKAWSATRSPSDSCFPGVARVGI

SEQ ID NO: 6109 - protein, 522 aa, Homo sapiens
MAAAMPLALLVLLLLGPGGWCLAEPPRDSLREELVITPLPSGDVAATFQFRTRWDSELQREGVSHYRLFPKALGQLISKYSLRELHLSFTQGFWRTRYWGPPFLQAPSDTDHYFLRYAVLPREVVCTENLTPWKKLLPCSSKAGLSVLLKADRLFHTSYHSQAVHIRPVCRNARCTSISWELRQTLSVVFDAFITGQGKKDWSLFRMFSRTLTEPCPLASESRVYVDITTYNQDNETLEVHPPPTTTYQDVILGTRKTYAIYDLLDTAMINNSRNLNIQLKWKRPPENEAPPVPFLHAQRYVSGYGLQKGELSTLLYNTHPYRAFPVLLLDTVPWYLRLYVHTLTITSKGKENKPSYIHYQPAQDRLQPHLLEMLIQLPANSVTKVSIQFERALLKWTEYTPDPNHGFYVSPSVLSALVPSMVAAKPVDWEESPLFNSLFPVSDGSNYFVRLYTEPLLVNLPTPDFSMPYNVICLTCTVVAVCYGSFYNLLTRTFHIEEPRTGGLAKRLANLIRRARGVPPL

SEQ ID NO: 6110 - protein, 246 aa, Homo sapiens
  SITE (222): Xaa equals any amino acid
  SITE (223): Xaa equals any amino acid
  SITE (236): Xaa equals any amino acid
  SITE (242): Xaa equals any amino acid
  SITE (244): Xaa equals any amino acid
MGAAVFFGCTFVAFGPAFALFLITVAGDPLRVIILVAGAFFWLVSLLLASVVWFILVHVTDRSDARLQYGLLIFGAAVSVLLQEVFRFAYYKLLKKADEGLASLSEDGRSPISIRQMAYVSGLSFGIISGVFSVINILADALGPGVVGIHGDSPYYFLTSAFLTAAIILLHTFWGVVFFDACERRRYWALGLVVGSHLLTSGLTFLNPWYEASLLPSMQSLXXWGSGPSSQLEGPXKYSAQXLXKD

SEQ ID NO: 6111 - protein, 453 aa, Homo sapiens
MRMASIMVWVMIIMVILVLGYGIFHCYMEYSRLRGEAGSDVSLVDLGFQTDFRVYLHLRQTWLAFMIILSILEVIIILLLIFLRKRILIAIALIKEASRAVGYVMCSLLYPLVTFFLLCLCIAYWASTAVFLSTSNEAVYKIFDDSPCPFTAKTCNPETFPSSNESRQCPNARCQFAFYGGESGYHRALLGLQIFNAFMFFWLANFVLALGQVTLAGAFASYYWALRKPDDLPAFPLFSAFGRALRYHTGSLAFGALILAIVQIIRVILEYLDQRLKAAENKFAKCLMTCLKCCFWCLEKFIKFLNRNAYIMIAIYGTNFCTSARNAFFLLMRNIIRVAVLDKVTDFLFLLGKLLIVGSVGILAFFFFTHRIRIVQDTAPPLNYYWVPILTVIVGSYLIAHGFFSVYGMCVDTLFLCFLEDLERNDGSAERPYFMSSTLKKLLNKTNKKAAES

SEQ ID NO: 6112 - protein, 48 aa, Homo sapiens
MYVFFFLFSLVLHLNCPQSAPHQPCVTPSTHKTEQKTPSLSWSPLGMG

SEQ ID NO: 6113 - protein, 128 aa, Homo sapiens
  SITE (106): Xaa equals any amino acid
MGAAGRQDFLFKAMLTISWLTLTCFPGATSTVAAGCPDQSPELQPWNPGHDQDHHVHIGQGKTLLLTSSATVYSIHISEGGKLVIKDHDEPIVLRTRHILIDNGGXLHAGECPLPFPGQFHHHFVWKG

SEQ ID NO: 6114 - protein, 199 aa, Homo sapiens
  SITE (118): Xaa equals any amino acid
  SITE (120): Xaa equals any amino acid
MTSCGQQSLNVLAVLFSLLFSAVLSAHFRVCEPYTDHKGRYHFGFHCPRLSDNKTFILCCHHNNTVFKYCCNETEFQAVMQANLTASSEGYMHNNYTALLGVWIYGFFVLMLLVLDLXYXSAMNYDICKVYLARWGIQGRWMKQDPRRWGNPARAPRPGQRAPQPQPPPGPLPQAPQAVHTLRGDAHSPPLMTFQSSSA

SEQ ID NO: 6115 - protein, 184 aa, Homo sapiens
MSRTAYTVGALLLLLGTLLPAAEGKKKGSQGAIPPPDKAQHNDSEQTQSPQQPGSRNRGRGQGRGTAMPGEEVLESSQEALHVTERKYLKRDWCKTQPLKQTIHEEGCNSRTIINRFCYGQCNSFYIPRHIRKEEGSFQSCSFCKPKKFTTMMVTLNCPELQPPTKKKRVTRVKQCRCISIDLD

SEQ ID NO: 6116 - protein, 48 aa, Homo sapiens
MRPVLRRTFLLTLFSVIALTKIKHDFFIMCSHMQCIPRVFLKHEFNNI

SEQ ID NO: 6117 - protein, 494 aa, Homo sapiens
MRPPGFRNFLLLASSLLFAGLSAVPQSFSPSLRSWPGAACRLSRAESERRCRAPGQPPGAALCHGRGRCDCGVCICHVTEPGMFFGPLCECHEWVCETYDGSTCAGHGKCDCGKCKCDQGWYGDACQYPTNCDLTKKKSNQMCKNSQDIICSNAGTCHCGRCKCDNSDGSGLVYGKFCECDDRECIDDETEEICGGHGKCYCGNCYCKAGWHGDKCEFQCDITPWESKRRCTSPDGKICSNRGTCVCGECTCHDVDPTGDWGDIHGDTCECDERDCRAVYDRYSDDFCSGHGQCNCGRCDCKAGWYGKKCEHPQSCTLSAEESIRKCQGSSDLPCSGRGKCECGKCTCYPPGDRRVYGKTCECDDRRCEDLDGVVCGGHGTCSCGRCVCERGWFGKLCQHPRKCNMTEEQSKNLCESADGILCSGKGSCHCGKCICSAEEWYISGEFCDCDDRDCDKHDGLICTGNGICSCGNCECWDGWNGNACEIWLGSEYP

SEQ ID NO: 6118 - protein, 164 aa, Homo sapiens
MTTWSCLVAMIVSGVITAVWAVRAAPIWRSQVKQKMRIGKQGNCRPPRCICSALGLLAPWMAVVLSQLSVRCVVSWVQGKPSSPRPRGSAASPAPGATPPTPRKPVSWLGYRENHRPKKPKSCTRLPGLPKLEPSSTLKGQDSWQMGHQQDKTLWSWASTGGSS

SEQ ID NO: 6119 - protein, 56 aa, Homo sapiens [sequence omitted]

SEQ ID NO: 6120 - protein, 40 aa, Homo sapiens
MVAMVFLKISVLPLMCRGQTKHKVLRDHAYPRVSQKRGHI

SEQ ID NO: 6121 - protein, 102 aa, Homo sapiens
MWSSIRLLSPVLSLILLLIALELVNIHAVCGKNAHEYQQYLKFVKSILQYTENLVAYTSYEKNKWNETINLTHTALLKMWTFSEKKQMLIHLAKKSTSKVLL

SEQ ID NO: 6122 - protein, 51 aa, Homo sapiens
MDGLIMCLIIFQIVNFWLPCIILLGILNPTYKNYVMVSTKCWMKRTYEHMS

SEQ ID NO: 6123 - protein, 624 aa, Homo sapiens
MEIPGSLCKKVKLSNNAQNWGMQRATNVTYQAHHVSRNKRGQVVGTRGGFRGCTVWLTGLSGAGKTTVSMALEEYLVCHGIPCYTLDGDNIRQGLNKNLGFSPEDREENVRRIAEVAKLFADAGLVCITSFISPYTQDRNNARQIHEGASLPFFEVFVDAPLHVCEQRDVKGLYKKARAGEIKGFTGIDSEYEKPEAPELVLKTDSCDVNDCVQQVVELLQERDIVPVDASYEVKELYVPENKLHLAKTDAETLPALKINKVDMQWVQVLAEGWATPLNGFMREREYLQCLHFDCLLDGGVINLSVPIVLTATHEDKERLDGCTAFALMYEGRRVAILRNPEFFEHRKEERCARQWGTTCKNHPYIKMVMEQGDWLIGGDLQVLDRVYWNDGLDQYRLTPTELKQKFKDMNADAVFAFQLRNPVHNGHALLMQDTHKQLLERGYRRPVLLLHPLGGWTKDDDVPLMWRMKQHAAVLEEGVLNPETTVVAIFPSPMMYAGPTEVQWHCRARMVAGANFYIVGRDPAGMPHPETGKDLYEPSHGAKVLTMAPGLITLEIVPFRVAAYNKKKKRMDYYDSEHHEDFEFISGTRMRKLAREGQKPPEGFMAPKAWTVLTEYYKSLEKA

SEQ ID NO: 6124 - protein, 967 aa, Homo sapiens
  SITE (40): Xaa equals any amino acid
  SITE (45): Xaa equals any amino acid
  SITE (169): Xaa equals any amino acid
  SITE (293): Xaa equals any amino acid
  SITE (297): Xaa equals any amino acid
  SITE (547): Xaa equals any amino acid
MQRAVPEGFGRRKLGSDMGNAERAPGSRSFGPVPTLLLLXAALLXVSDALGRPSEEDEELVVPELERAPGHGTTRLRLHAFDQQLDLELRPDSSFLAPGFTLQNVGRKSGSETPLPETDLAHCFYSGTVNGDPSSAAALSLCEGVRGAFYLLGEAYFIQPLPAASERLXTAAPGEKPPAPLQFHLLRRNRQGDVGGTCGVVDDEPRPTGKAETEDEDEGTEGEDEGPQWSPQDPALQGVGQPTGTGSIRKKRFVSSHRYVETMLVADQSMAEFHGSGLKHYLLTLFSVAARLXKHPXIRNSVSLVVVKILVIHDEQKGPEVTSNAALTLRNFCNWQKQHNPPSDRDAEHYDTAILFTRQDLCGSQTCDTLGMADVGTVCDPSRSCSVIEDDGLQAAFTTAHELGHVFNMPHDDAKQCASLNGVNQDSHMMASMLSNLDHSQPWSPCSAYMITSFLDNGHGECLMDKPQNPIQLPGDLPGTSYDANRQCQFTFGEDSKHCPDAASTCSTLWCTGTSGGVLVCQTKHFPWADGTSCGEGKWCINGKCVXKTDRKHFDTPFHGSWGMWGPWGDCSRTCGGGVQYTMRECDNPVPKNGGKYCEGKRVRYRSCNLEDCPDNNGKTFREEQCEAHNEFSKASFGSGPAVEWIPKYAGVSPKDRCKLICQAKGIGYFFVLQPKVVDGTPCSPDSTSVCVQGQCVKAGCDRIIDSKKKFDKCGVCGGNGSTCKKISGSVTSAKPGYHDIITIPTGATNIEVKQRNQRGSRNNGSFLAIKAADGTYILNGDYTLSTLEQDIMYKGVVLRYSGSSAALERIRSFSPLKEPLTIQVLTVGNALRPKIKYTYFVKKKKESFNAIPTFSAWVIEEWGECSKSCELGWQRRLVECRDINGQPASECAKEVKPASTRPCADHPCPQWQLGEWSSCSKTCGKGYKKRSLKCLSHDGGVLSHESCDPLKKPKHFIDFCTMAECS

SEQ ID NO: 6125 - protein, 174 aa, Homo sapiens
MYVRFFFRLHSISSHPSGIVSLCLLFETLLQTYLPQLFYHLREIGAQPLRISFKWMVRAFSGYLATDQLLLLWDRILGYNSLEILAVLAAAVFAFRAVNLMEVTSLAAAENLAAHSEQFCTAPLFPELYRVQIPVLLNSGRKKSAVYWTPISFNRTKKLRLQGRTYNDGSWNIT

SEQ ID NO: 6126 - protein, 314 aa, Homo sapiens
MWTALVLIWIFSLSLSESHAASNDPRNFVPNKMWKGLVKRNASVETVDNKTSEDVTMAAASPVTLTKGTSAAHLNSMEVTTEDTSRTDVSEPATSGGAADGVTSIAPTAVASSTTAASITTAASSMTVASSAPTTAASSTTVASIAPTTAASSMTAASSTPMTLALPAPTSTSTGRTPSTTATGHPSLSTALAQVPKSSALPRTATLATLATRAQTVATTANTSSPMSTRPSPSKHMPSDTAASPVPPMRPQAQGPISQVSVDQPVVNTTNKSTPMPSNTTPEPAPPHSGDHHQGTSQGANCQPSASTSHQPNP

SEQ ID NO: 6127 - protein, 62 aa, Homo sapiens
  SITE (10): Xaa equals any amino acid
  SITE (25): Xaa equals any amino acid
  SITE (38): Xaa equals any amino acid
MQPAWLWLWXWELGWELVFGAILLXLQDGLFDSVLYCXHLYSGLFFPWIVNSLMSGSSQLMS

SEQ ID NO: 6128 - protein, 600 aa, Homo sapiens
MPLTLLILSCLAELTMAEAEGNASCTVSLGGANMAETHKAMILQLNPSENCTWTIERPENKSIRIIFSYVQLDPDGSCESENIKVFDGTSSNGPLLGQVCSKNDYVPVFESSSSTLTFQIVTDSARIQRTVFVFYYFFSPNISIPNCGGYLDTLEGSFTSPNYPKPHPELAYCVWHIQVEKDYKIKLNFKEIFLEIDKQCKFDFLAIYDGPSTNSGLIGQVCGRVTPTFESSSNSLTVVLSTDYANSYRGFSASYTSIYAENINTTSLTCSSDRMRVIISKSYLEAFNSNGNNLQLKDPTCRPKLSNVVEFSVPLNGCGTIRKVEDQSITYTNIITFSASSTSEVITRQKQLQIIVKCEMGHNSTVEIIYITEDDVIQSQNALGKYNTSMALFESNSFEKTILESPYYVDLNQTLFVQVSLHTSDPNLVVFLDTCRASPTSDFASPTYDLIKSGCSRDETCKVYPLFGHYGRFQFNAFKFLRSMSSVYLQCKVLICDSSDHQSRCNQGCVSRSKRDISSYKWKTDSIIGPIRLKRDRSASGNSGFQHETHAEETPNQPFNSVHLFSFMVLALNVVTVATITVRHFVNQRADYKYQKLQNY

SEQ ID NO: 6129 - protein, 119 aa, Homo sapiens [sequence omitted]

SEQ ID NO: 6130 - protein, 131 aa, Homo sapiens [sequence omitted]

SEQ ID NO: 6131 - protein, 49 aa, Homo sapiens
MKHSFLSSDLIWCVLSLLCLGVWFRETWTTLFGRTGLPRNQQCPRRKGL

SEQ ID NO: 6132 - protein, 41 aa, Homo sapiens
MCVCLICSICQFLWCKYSHYSCFQANIVIPQKMELGRHNQD

SEQ ID NO: 6133 - protein, 79 aa, Homo sapiens [sequence omitted]

SEQ ID NO: 6134 - protein, 47 aa, Homo sapiens [sequence omitted]

SEQ ID NO: 6135 - protein, 62 aa, Homo sapiens
MLLRHPLPVCFCFSFCPFPVSALSLLPIGLVREGAASPTQQLRLQRESLSSITHRVNIKEGH

SEQ ID NO: 6136 - protein, 211 aa, Homo sapiens
MVFLKFFCMSFFCHLCQGYFDGPLYPEMSNGTLHHYFVPDGDYEENDDPEKCQLLFRVSDHRRCSQGEGSQVGSLLSLTLREEFTVLGHQVEDAGRVLEGISKSISYDLDGEESYGKYLRRESHQIGDAYSNSDKSLTELESKFKQGQEQDSRQESRLNEDFLGMLVHTRSLLKETLDISVGLRDKYELLALTIRSHGTRLGRLKNDYLKV

SEQ ID NO: 6137 - protein, 51 aa, Homo sapiens [sequence omitted]

SEQ ID NO: 6138 - protein, 53 aa, Homo sapiens
  SITE (49): Xaa equals any amino acid
MSHHAGLGGGILFSLKISFFIALAVVGGSRGVNDCQLGGCRVGSCPRVXVRVA

SEQ ID NO: 6139 - protein, 48 aa, Homo sapiens [sequence omitted]

SEQ ID NO: 6140 - protein, 80 aa, Homo sapiens
MFDRCRVTSCSCTCGAGAKWCTHVVALCLFRIHNASAVCLRAPVSESLSRLQRDQLQKFAQYLISELPQQVGEVGTPSCN

SEQ ID NO: 6141 - protein, 57 aa, Homo sapiens
MCWKPKCILLLSFVFQCVASSTFDPLGSERPWSQPQCPISFPLLITGCCWFSMSRVS

SEQ ID NO: 6142 - protein, 174 aa, Homo sapiens [sequence omitted]

SEQ ID NO: 6143 - protein, 59 aa, Homo sapiens
  SITE (37): Xaa equals any amino acid
MIGLTIIACFAVIVSAKRAVERHESLTSWNLAKKAKXREEAALAAQAKANDILSDKVFT

SEQ ID NO: 6144 - protein, 201 aa, Homo sapiens [sequence omitted]

SEQ ID NO: 6145 - protein, 44 aa, Homo sapiens [sequence omitted]

SEQ ID NO: 6146 - protein, 48 aa, Homo sapiens
MCFPACLCSPLTCLLSVWKPGLAHAVVHCMLEPVEFARVVQYEAGHVL

SEQ ID NO: 6147 - protein, 37 aa, Homo sapiens
MNSLFWMILLPVSQDQVVEGLQGGFSQIHMRILRKHL

SEQ ID NO: 6148 - protein, 420 aa, Homo sapiens
MAPWPPKGLVPAVLWGLSLFLNLPGPIWLQPSPPPQSSPPPQPHPCHTCRGLVDSFNKGLERTIRDNFGGGNTAWEEENLSKYKDSETRLVEVLEGVCSKSDFECHRLLELSEELVESWWFHKQQEAPDLFQWLCSDSLKLCCPAGTFGPSCLPCPGGTERPCGGYGQCEGEGTRGGSGHCDCQAGYGGEACGQCGLGYFEAERNASHLVCSACFGPCARCSGPEESNCLQCKKGWALHHLKCVDIDECGTEGANCGADQFCVNTEGSYECRDCAKACLGCMGAGPGRCKKCSPGYQQVGSKCLDVDECETEVCPGENKQCENTEGGYRCICAEGYKQMEGICVKEQIPESAGFFSEMTEDELVVLQQMFFGIIICALATLAAKGDLVFTAIFIGAVAAMTGYWLSERSDRVLEGFIKGR

SEQ ID NO: 6149 - protein, 387 aa, Homo sapiens
  SITE (228): Xaa equals any amino acid
  SITE (359): Xaa equals any amino acid
MGAFLDKPKTEKHNAHGAGNGLRYGLSSMQGWRVEMEDAHTAVVGIPHGLEDWSFFAVYDGHAGSRVANYCSTHLLEHITTNEDFRAAGKSGSALELSVENVKNGIRTGFLKIDEYMRNFSDLRNGMDRSGSTAVGVMISPKHIYFINCGDSRAVLYRNGQVCFSTQDHKPCNPREKERIQNAGGSVMIQRVNGSLAVSRALGDYDYKCVDGKGPTEQLVSPEPEVYXILRAEEDEFIILACDGIWDVMSNEELCEYVKSRLEVSDDLENVCNWVVDTCLHKGSRDNMSIVLVCFSNAPKVSDEAVKKDSELDKHLESRVEEIMEKSGEEGMPDLAHVMRILSAENIPNLPPGGGLAGXRNVIEAVYSRLNPHRESDGGAGDLEDPW

SEQ ID NO: 6150 - protein, 190 aa, Homo sapiens [sequence omitted]

SEQ ID NO: 6151 - protein, 49 aa, Homo sapiens
MGVGVLRILLSCLGEAAPKSAGTSLESAKECWSAATLLVLCVLCQLQHG

SEQ ID NO: 6152 - protein, 44 aa, Homo sapiens
MHLLLINFLPAVCIILLKNLQQALCFAQLFIMSINQGLGPNEMS

SEQ ID NO: 6153 - protein, 52 aa, Homo sapiens
MQRLGKAPGTWQAISKCWLLLLLSLPFSQSIIISLRAGTMSYLPLYFPQYFP

SEQ ID NO: 6154 - protein, 54 aa, Homo sapiens
MKTHLLMFLLSCMARCTGIVPKRPQPAFPLRGRRRKNSFLFLLSFSIEFLLCVW

SEQ ID NO: 6155 - protein, 47 aa, Homo sapiens
MINEWCFKLLSLWSFAYSNCKLIHKCKFVFLKKKKTGKEVSVKGSKL

SEQ ID NO: 6156 - protein, 159 aa, Homo sapiens
MLLLLIFWIAPAHGPTNIMVYISICSLLGSFTVPSTKGIGLAAQDILHNNPSSQRALCLCLVLLAVLGCSIIVQFRYINKALECFDSSVFGAIYYVVFTTLVLLASAILFREWSNVGLVDFLGMACGFTTVSVGIVLIQVFKEFNFNLGEMNKSNMKTD

SEQ ID NO: 6157 - protein, 102 aa, Homo sapiens
MTVRRLSLLCRDLWALWLLLKAGAVRGARAGPRLPGRCCGATCGDAGRGWTFWAQPCPQRLLGQKPGAGGCRGWVLGWVPPRPEEPCSLAGKVCTGLARWMV

SEQ ID NO: 6158 - protein, 53 aa, Homo sapiens
  SITE (11): Xaa equals any amino acid
MCKAVCKHRLXLFAVSSFSLGLGWVCVLVLMLWPVRLSLAPRPVQLQQRRSHC

SEQ ID NO: 6159 - protein, 575 aa, Homo sapiens
MRVLVVTIAPIYWALARESGEALNGHSLTGGRFRQESHVEFATGELLTMTQVARGLDPDGLLLLDVVVNGVVPESLADADLQVQDFEEHYVQTGPGQLFVGSTQRFFQGGLPSFLRCNHSIQYNAARGPQPQLVQHLRASAISSAFDPEAEALRFQLATALQAEENEVGCPEGFELDSQGAFCVDVDECAWDAHLCREGQRCVNLLGSYRCLPDCGPGFRVADGAGCEDVDECLEGLDDCHYNQLCENTPGGHRCSCPRGYRMQGPSLPCLDVNECLQLPKACAYQCHNLQGSYRCLCPPGQTLLRDGKACTSLERNGQNVTTVSHRGPLLPWLRPWASIPGTSYHAWVSLRPGPMALSSVGRAWCPPGFIRQNGVCTDLDECRVRNLCQHACRNTEGSYQCLCPAGYRLLPSGKNCQDINECEEESIECGPGQMCFNTRGSYQCVDTPCPATYRQGPSPGTCFRRCSQDCGTGGPSTLQYRLLPLPLGVRAHHDVARLTAFSEVGVPANRTELSMLEPDPRSPFALRPLRAGLGAVYTRRALTRAGLYRLTVRAAAPRHQSVFVLLIAVSPYPY

SEQ ID NO: 6160 - protein, 472 aa, Homo sapiens
MKFLIFAFFGGVHLLSLCSGKAICKNGISKRTFEEIKEEIASCGDVAKAIINLAVYGKAQNRSYERLALLVDTVGPRLSGSKNLEKAIQIMYQNLQQDGLEKVHLEPVRIPHWERGEESAVMLEPRIHKIAILGLGSSIGTPPEGITAEVLVVTSFDELQRRASEARGKIVVYNQPYINYSRTVQYRTQGAVEAAKVGALASLIRSVASFSIYSPHTGIQEYQDGVPKIPTACITVEDAEMMSRMASHGIKIVIQLKMGAKTYPDTDSFNTVAEITGSKYPEQVVLVSGHLDSWDVGQGAMDDGGGAFISWEALSLIKDLGLRPKRTLRLVLWTAEEQGGVGAFQYYQLHKVNISNYSLVMESDAGTFLPTGLQFTGSEKARAIMEEVMSLLQPLNITQVLSHGEGTDINFWIQAGVPGASLLDDLYKYFFFHHSHGDTMTVMDPKQMNVAAAVWAVVSYVVADMEEMLPRS

SEQ ID NO: 6161 - protein, 372 aa, Homo sapiens
  SITE (81): Xaa equals any amino acid
  SITE (162): Xaa equals any amino acid
  SITE (314): Xaa equals any amino acid
  SITE (315): Xaa equals any amino acid
MAWTKYQLFLAGLMLVTGSINTLSAKWADNFMAEGCGGSKEHSFQHPFLQAVGMFLGEFSCLAAFYLLRCRAAGQSDSSVXPQQPFNPLLFLPPALCDMTGTSLMYVALNMTSASSFQMLRGASDHIHWPVLGGLPGPEAGAEPVAGHPSHHRGAGGRGPGXPPEQARQSSTSFSEVITGDLLIIMAQIIVAIQMVLEEKFVYKHNVHPLRAVGTEGLFGFVILSLLLVPMYYIPAGSFSGNPRGTLEDALDAFCQVGQQPLIAVALLGNISSIAFFNFAGISVTKELSATTRMVLDSLRTVVIWALSLALGWXXFHALQILGFLILLIGTALYNGLHRPLLGRLSRGRPLAEESEQERLLGGTRTPINDAS

SEQ ID NO: 6162 - protein, 276 aa, Homo sapiens
  SITE (94): Xaa equals any amino acid
  SITE (103): Xaa equals any amino acid
MIHVNRNIMDFKLFLVFVAGVFLFFYARTLESKPYFLLLLGNCARCSNDIVFVLLLVKRFIRSIAPFGALMVGCWFASVYIVCQLMEDLKWLWXENRIYVSGXVLIVGFFSFVVCYKHGPLAHDRSRSLLMWMLRLLSLVLVYAGVAVPQFAYAAIILLMSSWSLHYPLRACSYMRWKMEQWFTSKELVVKYLTEDEYREQADAETNSALEELRRACRKPDFPSWLVVSRLHTPSKFADFVLGGSHLSPEEISLHEEQYGLGGAFLEEQLFNPSTA

SEQ ID NO: 6163 - protein, 83 aa, Homo sapiens
MKKVCWVWALAHLVLCERWLTAGCLLYVGVIQPCKGSPSSVCKARRCLHPKYRIKRYGYYKYSVRLIICHHHPHALKAELTDD

SEQ ID NO: 6164 - protein, 359 aa, Homo sapiens
MKLGCVLMAWALYLSLGVLWVAQMLLAASFETLQCEGPVCTEESSCHTEDDLTDAREAGFQVKAYTFSEPFHLIVSYDWLILQGPAKPVFEGDLLVLRCQAWQDWPLTQVTFYRDGSALGPPGPNREFSITVVQKADSGHYHCSGIFQSPGPGIPETASVVAITVQELFPAPILRAVPSAEPQAGGPMTLSCQTKLPLQRSAARLLFSFYKDGRIVQSRGLSSEFQIPTASEDHSGSYWCEAATEDNQVWKQSPQLEIRVQGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 6165 - protein, 192 aa, Homo sapiens
MEALLQSLVIVLLGFKSFLSEELGSEVLNLLTNKQYELLSKNLRKTRELFVHGLPGSGKTILALRIMEKIRNVFHCEPANILYICENQPLKKLVSFSKKNICQPVTRKTFMKNNFEHIQHIIIDDAQNFRTEDGDWYGKAKFITQTARDGPGVLWIFLDYFQTYHLSCSASPLPQTSIQEKRSTEWSAMQVQ

SEQ ID NO: 6166 - protein, 379 aa, Homo sapiens
  SITE (283): Xaa equals any amino acid
  SITE (303): Xaa equals any amino acid
  SITE (307): Xaa equals any amino acid
MGYIDDPDKYHQGFELLLSALGDPSERVVSATHQVFLPAYAAWTTELGNLQSHLILTLLNKIEKLLREGEHGLDEHKLHMYLSALQSLIPSLFALVLQNAPFSSKAKLHGEVPQIEVTRFPRPMSPLQDVSTIIGSREQLAVLLQLYDYQLEQEGTTGWESLLWVVNQLLPQLIEIVGKINVTSTACVHEFSRFFWRLCRTFGKIFTNTKVKPQFQEILRLSEENIDSSAGNGVLTKATVPIYATGVLTCYIQEEDRKLLVGFLEDVMTLLSLSHAPLDSLKXSFVELGANQAYHELLLTVLXYGVXHTSALVRCTAARMFELLVKGVNETLVAQRVVPALITLSSDPEISVRIATIPAFGTIMETVIQRELLERVKMQ

SEQ ID NO: 6167 - protein, 48 aa, Homo sapiens
MSTVTWLLKLFTQFMFPPTVSNSHTCARYYVFNFCLIISFNFNFHYHW

SEQ ID NO: 6168 - protein, 58 aa, Homo sapiens [sequence omitted]

SEQ ID NO: 6169 - protein, 41 aa, Homo sapiens
MKILILFIFIPGLLVEKNGPDHVCVCMCVRVCVCAHLGLFI

SEQ ID NO: 6170 - protein, 83 aa, Homo sapiens [sequence omitted]

SEQ ID NO: 6171 - protein, 49 aa, Homo sapiens
MVRSSSHFKFFLMLFTSTLQDVGHTSHPSAQPSSRLSDSPLICLINRQV

SEQ ID NO: 6172 - protein, 100 aa, Homo sapiens
  SITE (92): Xaa equals any amino acid
  SITE (96): Xaa equals any amino acid
MFVAVFYWVLTVFFLIIYITMTYTRIPQVPWTTVGLCFNGSAFVLYLSAAVVDASSVSPEKDSHNFNSWAASSFFAFLVTICYAGNTYFSFXAWRXRTIQ

SEQ ID NO: 6173 - protein, 40 aa, Homo sapiens
MLPVCVFKLLLYLYVLIRICTIIWCFKVYINAVILNKSSR

SEQ ID NO: 6174 - protein, 142 aa, Homo sapiens [sequence omitted]

SEQ ID NO: 6175 - protein, 57 aa, Homo sapiens
MVYRAFLIIILRFILIFLFKLNYSKLCPEIPFGLKFFSFVCIKVQIKKTSRKRRPYL

SEQ ID NO: 6176 - protein, 74 aa, Homo sapiens
MTNVYSLDGILVFGLLFVCTCAYFKKVPRLKTWLLSEKKGVWGVFYKAAVIGTRLHAAVAIACVVMAFYVLFIK

SEQ ID NO: 6177 - protein, 45 aa, Homo sapiens [sequence omitted]

SEQ ID NO: 6178 - protein, 63 aa, Homo sapiens
MCYFLEISLLMVFALNIKAAYGCCNINGTEVHRAKGPVSVPFPLSRPLSGTPLLDRLRPFQTL

SEQ ID NO: 6179 - protein, 262 aa, Homo sapiens
MLFSALLLEVIWILAADGGQHWTYEGPHGQDHWPASYPECGNNAQSPIDIQTDSVTFDPDLPALQPHGYDQPGTEPLDLHNNGHTVQLSLPSTLYLGGLPRKYVAAQLHLHWGQKGSPGGSEHQINSEATFAELHIVHYDSDSYDSLSEAAERPQGLAVLGILIELEKLQGTLFSTEEEPSKLLVQNYRALQPLNQRMVFASFIQAGSSYTTGEMLSLGVGILVGCLCLLLAVYFIARKIRKKRLENRKSVVFTSAQATTEA

SEQ ID NO: 6180 - protein, 399 aa, Homo sapiens
MGILLGLLLLGHLTVDTYGRPILEVPESVTGPWKGDVNLPCTYDPLQGYTQVLVKWLVQRGSDPVTIFLRDSSGDHIQQAKYQGRLHVSHKVPGDVSLQLSTLEMDDRSHYTCEVTWQTPDGNQVVRDKITELRVQKLSVSKPTVTTGSGYGFTVPQGMRISLQCQARGSPPISYIWYKQQTNNQEPIKVATLSTLLFKPAVIADSGSYFCTAKGQVGSEQHSDIVKFVVKDSSKLLKTKTEAPTTMTYPLKATSTVKQSWDWTTDMDGYLGETSAGPGKSLPVFAIILIISLCCMVVFTMAYIMLCRKTSQQEHVYEAARAHAREANDSGETMRVAIFASGCSSDEPTSQNLGNNYSDEPCIGQEYQIIAQINGNYARLLDTVPLDYEFLATEGKSVC

SEQ ID NO: 6181 - protein, 71 aa, Homo sapiens
MPAGVPMSTYLKMFAASLLAMCAGAEVVHRYYRPDLTIPEIPPKRGELKTELLGLKERKHKPQVSQQEELK

SEQ ID NO: 6182 - protein, 223 aa, Homo sapiens
MKFVPCLLLVTLSCLGTLGQAPRQKQGSTGEEFHFQTGGRDSCTMRPSSLGQGAGEVWLRVDCRNTDQTYWCEYRGQPSMCQAFAADPKSYWNQALQELRRLHHACQGAPVLRPSVCREAGPQAHMQQVTSSLKGSPEPNQQPEAGTPSLRPKATVKLTEATQLGKDSMEELGKAKPTTRPTAKPTQPGPRPGGNEEAKKKAWEHCWKPFQALCAFLISFFRG

SEQ ID NO: 6183 - protein, 152 aa, Homo sapiens [sequence omitted]

SEQ ID NO: 6184 - protein, 52 aa, Homo sapiens
MPSLNLVLRPLICLASITSFLIFFPLLTLILCSPNSPPFPLPAHPERHTHTQ

SEQ ID NO: 6185 - protein, 40 aa, Homo sapiens
MSVLSGFLFIVVVCCYCCFVARLQLTKYEFKNCVVIFRDL

SEQ ID NO: 6186 - protein, 135 aa, Homo sapiens
MGLWLGMLACVFLATAAFVAYTARLDWKLAAEEAKKHSGRQQQQRAESTATRPGPEKAVLSSVATGSSPGITLTTYSRSECHVDFFRTPEEAHALSAPTSRLSVKQLVIRRGAALGAASATLMVGLTVRILATRH

SEQ ID NO: 6187 - protein, 181 aa, Homo sapiens
MTVILIILIVVMARYCRSKNKNGYEAGKKDHEDFFTPQQHDKSKKPKKDKKNKKSKQPLYSSIVTVEASKPNGQRYDSVNEKLSDSPSMGRYRSVNGGPGSPDLARHYKSSSPLPTVQLHPQSPTAGKKHQAVQDLPPANTFVGAGDNISIGSDHCSEYSCQTNNKYSKQMRLHPYITVFG

SEQ ID NO: 6188 - protein, 61 aa, Homo sapiens [sequence omitted]

SEQ ID NO: 6189 - protein, 72 aa, Homo sapiens
MATILLKLPILSAMIKKPLRNYLKTSETTMEKIIIQKLVANLKFLPLGTLQLAMMIANLIKKLFFPLVKAAK

SEQ ID NO: 6190 - protein, 257 aa, Homo sapiens
MVSWMICRLVVLVFGMLCPAYASYKAVKTKNIREYVRWMMYWIVFALFMAAEIVTDIFISWFPFYYEIKMAFVLWLLSPYTKGASLLYRKFVHPSLSRHEKEIDAYIVQAKERSYETVLSFGKRGLNIAASAAVQAATKSQGALAGRLRSFSMQDLRSISDAPAPAYHDPLYLEDQVSHRRPPIGYRAGGLQDSDTEDECWSDTEAVPRAPARPREKPLIRSQSLRVVKRKPPVREGTSRSLKVRTRKKTVPSDVDS

SEQ ID NO: 6191 - protein, 58 aa, Homo sapiens
MRTFLTFVILKVILIFLSSCASFTRNLLTWPNDVSTEQFETRPFGSELLQTVINVSRT

SEQ ID NO: 6192 - protein, 59 aa, Homo sapiens
MIIANIFMNPLLCAGYLFCFAYTLIHLILLTTSEVCSITAPFFTAVLQSSACPSTHWPE

SEQ ID NO: 6193 - protein, 182 aa, Homo sapiens
MWRPSVLLLLLLLRHGAQGKPSPDAGPHGQGRVHQAAPLSDAPHDDAHGNFQYDHEAFLGREVAKEFDQLTPEESQARLGRIVDRMDRAGDGDGWVSLAELRAWIAHTQQRHIRDSVSAAWDTYDTDRDGRVGWEELRNATYGHYAPGEEFHDVEDAETYKKMLARDERRFRVADQDGDSMA

SEQ ID NO: 6194 - protein, 950 aa, Homo sapiens
MTWRMGPRFTMLLAMWLVCGSEPHPHATIRGSHGGRKVPLVSPDSSRPARFLRHTGRSRGIERSTLEEPNLQPLQRRRSVPVLRLARPTEPPARSDINGAAVRPEQRPAARGSPREMIRDEGSSARSRMLRFPSGSSSPNILASFAGKNRVWVISAPHASEGYYRLMMSLLKDDVYCELAERHIQQIVLFHQAGEEGGKVRRITSEGQILEQPLDPSLIPKLMSFLKLEKGKFGMVLLKKTLQVEERYPYPVRLEAMYEVIDQGPIRRIEKIRQKGFVQKCKASGVEGQVVAEGNDGGGGAGRPSLGSEKKKEDPRRAQVPPTRESRVKVLRKLAATAPALPQPPSTPRATTLPPAPATTVTRSTSRAVTVAARPMTTTAFPTTQRPWTPSPSHRPPTTTEVITARRPSVSENLYPPSRKDQHRERPQTTRRPSKATSLESFTNAPPTTISEPSTRAAGPGRFRDNRMDRREHGHRDPNVVPGPPKPAKEKPPKKKAQDKILSNEYEEKYDLSRPTASQLEDELQVGNVPLKKAKESKKHEKLEKPEKEKKKKMKNENADKLLKSEKQMKKSEKKSKQEKEKSKKKKGGKTEQDGYQKPTNKHFTQSPKKSVADLLGSFEGKRRLLLITAPKAENNMYVQQRDEYLESFCKMATRKISVITIFGPVNNSTMKIDHFQLDNEKPMRVVDDEDLVDQRLISELRKEYGMTYNDFFMVLTDVDLRVKQYYEVPITMKSVFDLIDTFQSRIKDMEKQKKEGIVCKEDKKQSLENFLSRFRWRRRLLVISAPNDEDWAYSQQLSALSGQACNFGLRHITILKLLGVGEEVGGVLELFPINGSSVVEREDVPAHLVKDIRNYFQVSPEYFSMLLVGKDGNVKSWYPSPMWSMVIVYDLIDSMQLRRQEMAIQQSLGMRCPEDEYAGYGYHSYHQGYQDGYQDDYRHHESYHHGYPY

SEQ ID NO: 6195 - protein, 260 aa, Homo sapiens
MLALLGLSQALNILLGLKGLAPAEISAVCEKGNFNVAHGLAWSYYIGYLRLILPELQARIRTYNQHYNNLLRGAVSQRLYILLPLDCGVPDNLSMADPNIRFLDKLPQQTGDRAGIKDRVYSNSIYELLENGQRAGTCVLEYATPLQTLFAMSQYSQAGFSGEDRLEQAKLFCRTLEDILADAPESQNNCRLIAYQEPADDSSFSLSQEVLRHLRQEEKEEVTVGSLKTSAVPSTSTMSQEPELLISGMEKPLPLRTDFS

SEQ ID NO: 6196 - protein, 247 aa, Homo sapiens
MHLARLVGSCSLLLLLGALSGWAASDDPIEKVIEGINRGLSNAEREVGKALDGINSGITHAGREVEKVFNGLSNMGSHTGKELDKGVQGLNHGMDKVAHEINHGIGQAGKEAEKLGHGVNNAAGQAGKEADKAVQGFHTGVHQAGKEAEKLGQGVNHAADQAGKEVEKLGQGAHHAAGQAGKELQNAHNGVNQASKEANQLLNGNHQSGSSSHQGGATTTPLASGASVNTPFINLPALWRSVANIMP

SEQ ID NO: 6197 - protein, 85 aa, Homo sapiens
MGCRGNKLFVLSYCTCLTWLLGTKSQKNPFQVCMSGGWAVSRLETGFQALHDGRASSPLSAACVLDRTVARRWKPPSVPLAHHTK

SEQ ID NO: 6198 - protein, 84 aa, Homo sapiens [sequence omitted]

SEQ ID NO: 6199 - protein, 42 aa, Homo sapiens
MFTLLLSSFFLQHCLQNNLYASEREQIFSNFLQLSSLKRRIC

SEQ ID NO: 6200 - protein, 71 aa, Homo sapiens
MVGTHLILFPFLLRTMVIFLCLKSSCGSFLPINKIQTPFILNLIYKTFKMCSLPNSLFSPLSFIFFIFFLT

SEQ ID NO: 6201 - protein, 35 aa, Homo sapiens
MPLPSSFPLPVFLSSCPFLMSVSIGFLILVFNVHP

SEQ ID NO: 6202 - protein, 55 aa, Homo sapiens
MVNIFGFVSCIVFRCSCSALLHESNHRPYLNKWSLLSTNKTLFRNNRGLDLVLVC

SEQ ID NO: 6203 - protein, 41 aa, Homo sapiens
MLVSMCMGLLFLQVGKQCIAFFYTESTRRPKHLKTMGSGYA

SEQ ID NO: 6204 - protein, 97 aa, Homo sapiens
MCKLCFYLYLCTWFPFGASGLFWDKWCLPRHLPVVSGQEQLSSSLPAALLFLGRRWRPPLRVSPGLSFRGGRAGEPQGWGDSWEMEVAPAPLDQYWL

SEQ ID NO: 6205 - protein, 78 aa, Homo sapiens
MVCFQSNKPSTSTWRQLSFVFVLFCLFCLGHAFLSLPFYILSIIAMCLEQWAFHNMNSLYHHEWEVRGNLIHVDFTLP

SEQ ID NO: 6206 - protein, 41 aa, Homo sapiens [sequence omitted]

SEQ ID NO: 6207 - protein, 47 aa, Homo sapiens
MLTVKILKCFLGWAVVAGGLGRSQARPSLLFNRLSPSVPQMRIQQPW

SEQ ID NO: 6208 - protein, 50 aa, Homo sapiens
MAPLWTLRPVLVWTTPTSMGEVSPWLTSTVMAKWTSSMATGMAPTASICR

SEQ ID NO: 6209 - protein, 58 aa, Homo sapiens
MRISRCNISLEIVSPSILLTFLDLIILLWALASCYRRFTSFPALNLPDVNSTLHYLQQ

SEQ ID NO: 6210 - protein, 606 aa, Homo sapiens
MTVVGNPRSWSCQWLPILILLLGTGHGPGVEGVTHYKAGDPVILYVNKVGPYHNPQETYHYYQLPVCCPEKIRHKSLSLGEVLDGDRMAESLYEIRFRENVEKRILCHMQLSSAQVEQLRQAIEELYYFEFVVDDLPIRGFVGYMEESGFLPHSHKIGLWTHLDFHLEFHGDRIIFANVSVRDVKPHSLDGLRPDEFLGLTHTYSVRWSETSVERRSDRRRGDDGGFFPRTLEIHWLSIINSMVLVFLLVGFVAVILMRVLRNDLARYNLDEETTSAGSGDDFDQGDNGWKIIHTDVFRFPPYRGLLCAVLGVGAQFLALGTGIIVMALLGMFNVHRHGAINSAAILLYALTCCISGYVSSHFYRQIGGERWVWNIILTTSLFSVPFFLTWSVVNSVHWANGSTQALPATTILLLLTVWLLVGFPLTVIGGIFGKNNASPFDAPCRTKNIAREIPPQPWYKSTVIHMTVGGFLPFSAISVELYYIFATVWGREQYTLYGILFFVFAILLSVGACISIALTYFQLSGEDYRWWWRSVLSVGSTGLFIFLYSVFYYARRSNMSGAVQTVEFFGYSLLTGYVFFLMLGTISFFSSLKFIRYIYVNLKMD

SEQ ID NO: 6211 - protein, 62 aa, Homo sapiens [sequence omitted]

SEQ ID NO: 6212 - protein, 295 aa, Homo sapiens
MGLPVSWAPPALWVLGCCALLLSLWALCTACRRPEDAVAPRKRARRQRARLQGSATAAEASLLRRTHLCSLSKSDTRLHELHRGPRSSRALRPASMDLLRPHWLEVSRDITGPQAAPSAFPHQELPRALPAAAATAGCAGLEATYSNVGLAALPGVSLAASPVVAEYARVQKRKGTHRSPQEPQQGKTEVTPAAQVDVLYSRVCKPKRRDPGPTTDPLDPKGQGAILALAGDLAYQTLPLRALDVDSGPLENVYESIRELGDPAGRSSTCGAGTPPASSCPSLGRGWRPLPASLP

SEQ ID NO: 6213 - protein, 83 aa, Homo sapiens
MCLLVEYSLMILTIIPSLLSFVLCLKGIKHGNYIFQTPLPEGYGWISAMSGLCIKFGRRKRRKTWLLQVGTLATIDTEFARSC

SEQ ID NO: 6214 - protein, 56 aa, Homo sapiens
  SITE (32): Xaa equals any amino acid
MLSFFICLLIFVHLLLLSFLISDWPPPTGSAXHKILRLMVVQRLSLLDQRKRWSEA

SEQ ID NO: 6215 - protein, 51 aa, Homo sapiens
MLTSWIASIPSRCGVLCICLCFGLVHCLDLSRKITIFSGAVYMVKNIQFWL

SEQ ID NO: 6216 - protein, 90 aa, Homo sapiens
MAIRLVFLALAGLVDGKPVWITLWMDAKRPNLAGTGSTWGSRRDSHCCHGPTAWSLPCLLCLFRAQQKDRERSLLGVPLPTLQGGNLSDG

SEQ ID NO: 6217 - protein, 267 aa, Homo sapiens
  SITE (22): Xaa equals any amino acid
  SITE (227): Xaa equals any amino acid
MLIAVGIHLLLLMFEVLVCDRXERGTHFWLLVFMPLFFVSPVSVAACVWGFRHDRSLELEILCSVNILQFIFIALKLDRIIHWPWLVVFVPLWILMSFLCLVVLYYIVWSLLFLRSLDVVAEQRRTHVTMAISWITIVVPLLTFEVLLVHRLDGHNTFSYVSIFVPLWLSLLTLMATTFRRKGGNHWWFGIRRDFCQFLLEIFPFLREYGNISYDLHHEDSEDAEEXSVPEAPKIAPIFGKKARVVITQSPGKYVPPPPKLNIDMPD

SEQ ID NO: 6218 - protein, 60 aa, Homo sapiens [sequence omitted]

SEQ ID NO: 6219 - protein, 57 aa, Homo sapiens
MCEGWLHPIFLYCCFWTTTPSCSAFGILDLHQQHPIPTPSSWFSGLCPWTELHHCLR

SEQ ID NO: 6220 - protein, 672 aa, Homo sapiens
MCSRVPLLLPLLLLLALGPGVQGCPSGCQCSQPQTVFCTARQGTTVPRDVPPDTVGLYVFENGITMLDAGSFAGLPGLQLLDLSQNQIASLPSGVFQPLANLSNLDLTANRLHEITNETFRGLRRLERLYLGKNRIRHIQPGAFDTLDRLLELKLQDNELRALPPLRLPRLLLLDLSHNSLLALEPGILDTANVEALRLAGLGLQQLDEGLFSRLRNLHDLDVSDNQLERVPPVIRGLRGLTRLRLAGNTRIAQLRPEDLAGLAALQELDVSNLSLQALPGDLSGLFPRLRLLAAARNPFNCVCPLSWFGPWVRESHVTLASPEETRCHFPPKNAGRLLLELDYADFGCPATTTTATVPTTRPVVREPTALSSSLAPTWLSPTAPATEAPSPPSTAPPTVGPVPQPQDCPPSTCLNGGTCHLGTRHHLACLCPEGFTGLYCESQMGQGTRPSPTPVTPRPPRSLTLGIEPVSPTSLRVGLQRYLQGSSVQLRSLRLTYRNLSGPDKRLVTLRLPASLAEYTVTQLRPNATYSVCVMPLGPGRVPEGEEACGEAHTPPAVHSNHAPVTQAREGNLPLLIAPALAAVLLAALAAVGAAYCVRRGRAMAAAAQDKGQVGPGAGPLELEGVKVPLEPGPKATEAVERPCPAGLSVKCHSWASKAWPQSPLHAKPYI

SEQ ID NO: 6221 - protein, 69 aa, Homo sapiens
  SITE (56): Xaa equals any amino acid
MYKAFLLALTTVFYLGILNSHFHGCVLCNTNVFKWYSHPVGQLSKRCLDASKLAYXKFTSIKYQCNYST

SEQ ID NO: 6222 - protein, 56 aa, Homo sapiens [sequence omitted]

SEQ ID NO: 6223 - protein, 434 aa, Homo sapiens
  SITE (381): Xaa equals any amino acid
MALTAPSLSLDARQLWDSPETAPAARTPQSPAPCVLLRAQRSLAPEPKEPLIPASPKAEPIWELPTRAPRLSIGDLDFSDLGEDEDQDMLNVESVEAGKDIPAPSPPLPLLSGVPPPPPLPPPPPIKGPFPPPPPLPLAAPLPHSVPDSSALPTKRKTVKLFWRELKLAGGHGVSASRFGPCATLWASLDPVSVDTARLEHLFESRAKEVLPSKKAGEGRRTMTTVLDPKRSNAINIGLTTLPPVHVIKAALLNFDEFAVSKDGIEKLLTMMPTEEERQKIEEAQLANPDIPLGPAENFLMTLASIGGLAARLQLWAFKLDYDSMEREIAEPLFDLKVGMEQLVQNATFRCILATLLAVGNFLNGSQSSGFELSYLEKVSXVKDTVRRQSLLHHLCSLVLQTRPESSDLYSEIPALTRCAKVSTCQNQPRPDKA

SEQ ID NO: 6224 - protein, 305 aa, Homo sapiens
MAAGLARLLLLLGLSAGGPAPAGAAKMKVVEEPNAFGVNNPFLPQASRLQAKRDPSPVSGPVHLFRLSGKCFSLVESTYKYEFCPFHNVTQHEQTFRWNAYSGILGIWHEWEIANNTFTGMWMRDGDACRSRSRQSKVELACGKSNRLAHVSEPSTCVYALTFETPLVCHPHALLVYPTLPEALQRQWDQVEQDLADELITPQGHEKLLRTLFEDAGYLKTPEENEPTQLEGGPDSLGFETLENCRKAHKELSKEIKRLKGLLTQHGIPYTRPTETSNLEHLGHETPRAKSPEQLRGDPGLRGSL

SEQ ID NO: 6225 - protein, 68 aa, Homo sapiens
MATVGLSWKKELVILLVGPGAAALQPTHTCCSLPSLSSLFPLRLNTKTSPKTTRTNLYLLSIAPLSHL

SEQ ID NO: 6226 - protein, 243 aa, Homo sapiens
MSSGTELLWPGAALLVLLGVAASLCVRCSRPGAKRSEKIYQQRSLREDQQSFTGSRTYSLVGQAWPGPLADMAPTRKDKLLQFYPSLEDPASSRYQNFSKGSRHGSEEAYIDPIAMEYYNWGRFSKPPEDDDANSYENVLICKQKTTETGAQQEGIGGLCRGDLSLSLALKTGPTSGLCPSASPEEDEESEDYQNSASIHQWRESRKVMGQLQREASPGPVGSPDEEDGEPDYVNGEVAATEA

SEQ ID NO: 6227 - protein, 364 aa, Homo sapiens
  SITE (20): Xaa equals any amino acid
MPGCPCPGCGMAGPRLLFLXALALELLGRAGGSQPALRSRGTATACRLDNKESESWGALLSGERLDTWICSLLGSLMVGLSGVFPLLVIPLEMGTMLRSEAGAWRLKQLLSFALGGLLGNVFLHLLPEAWAYTCSASPGGEGQSLQQQQQLGLWVIAGILTFLALEKMFLDSKEEGTSQAPNKDPTAAAAALNGGHCLAQPAAEPGLGAVVRSIKVSGYLNLLANTIDNFTHGLAVAASFLVSKKIGLLTTMAILLHEIPHEVGDFAILLRAGFDRWSAAKLQLSTALGGLLGAGFAICTQSPKGVEETAAWVLPFTSGGFLYIALVNVLPDLLEEEDPWRSLQQLLLLCAGIVVMVLFSLFVD

SEQ ID NO: 6228 - protein, 142 aa, Homo sapiens
MCAFPWLLLLLLLQEGSQRRLWRWCGSEEVVAVLQESISLPLEIPPDEEVENIIWSSHKSLATVVPGKEGHPATIMVTNPHYQGQVSFLDPSYSLHISNLSWEDSGLLPSSSQPENIPDLYHAAVQSMCLPMAVRAPDHCEL

SEQ ID NO: 6229 - protein, 282 aa, Homo sapiens
MLALTLAKADSPRTALLCSAWLLTASFSAQQHKGSLQVHQTLSVEMDQVLKALSFPKKKAALLSAAILCFLRTALRQSFSSALVALVPSGAQPLPATKDTVLAPLRMSQVRSLVIGLQNLLVQKDPLLSQACVGCLEALLDYLDARSPDIALHVASQPWNRFLLFTLLDAGENSFLRPEILRLMTLFMRYRSSSVLSHEEVGDVLQGVALADLSTLSNTTLQALHGFFQQLQSMGHLADHSMAQTLQASLEGLPPSTSSGQPPLQDMLCLGGVAVSLSHIRN

SEQ ID NO: 6230 - protein, 87 aa, Homo sapiens
  SITE (53): Xaa equals any amino acid
MTAFCSLLLQAQSLLPRTMAAPQDSLRPGEEDEGMQLLQTKDSMAKGARPGAXRGRARWGLAYTLLHNPTLQVFRKTALLGANGAQP

SEQ ID NO: 6231 - protein, 75 aa, Homo sapiens [sequence omitted]

SEQ ID NO: 6232 - protein, 122 aa, Homo sapiens
MPPLAPQLCRAVFLVPILLLLQVKPLNGSPGPKDGSQTEKTPSADQNQEQFEEHFVASSVGEMWQVVDMAQQEEDQSSKTAAVHKHSFHLSFCFSLASVMVFSGGPLRRTFPNIQLCFMLTH

SEQ ID NO: 6233 - protein, 122 aa, Homo sapiens; identical to SEQ ID NO: 6232

SEQ ID NO: 6234 - protein, 67 aa, Homo sapiens
MKLLLLTLTVLLLLSQLTPGGTQRCWNLYGKCRYRCSKKERVYVYCINNKMCCVKPKYQPKERWWPF

SEQ ID NO: 6235 - protein, 231 aa, Homo sapiens [sequence omitted]

SEQ ID NO: 6236 - protein, 178 aa, Homo sapiens
MLPLLIICLLPAIEGKNCLRCWPELSALIDYDLQILWVTPGPPTELSQSIHSLFLEDNNFLKPWYLDRDHLEEETAKFFTQVHQAIKTLRDDKTVLLEEIYTHKNLFTERLNKISDGLKEKGAPPLSMNAFPAPSPTCTPEPLGSVCLPSTSVSLPSHPPWQPAMSPVPGTGGPPCGL

SEQ ID NO: 6237 - protein, 126 aa, Homo sapiens
MCSSFPRMALCALWMWPSVKSSVPLPLREPFLWRSPGSQCLLCLQTIHVSCSEACPLLENISKNCTIPQRDLDNMAFPQALPLEKRCERFLQKSYRKLEKNPEKEEEHWARLQRYSLSLQRENFKK

SEQ ID NO: 6238 - protein, 233 aa, Homo sapiens
MALKNKFSCLWILGLCLVATTSSKIPSITDPHFIDNCIEAHNEWRGKVNPPAADMKYMIWDKGLAKMAKAWANQCKFEHNDCLDKSYKCYAAFEYVGENIWLGGIKSFTPRHAITAWYNETQFYDFDSLSCSRVCGHYTQLVWANSFYVGCAVAMCPNLGGASTAIFVCNYGPAGNFANMPPYVRGESCSLCSKEEKCVKNLCKNPFLKPTGRAPQQTAFNPFSLGFLLLRIF

SEQ ID NO: 6239 - protein, 298 aa, Homo sapiens
  SITE (42): Xaa equals any amino acid
  SITE (58): Xaa equals any amino acid
MARRSRHRLLLLLLRYLVVALGYHKAYGFSAPKDQQVVTAVXYQEAILACKTPKKTVXSRLEWKKLGRSVSFVYYQQTLQGDFKNRAEMIDFNIRIKNVTRSDAGKYRCEVSAPSEQGQNLEEDTVTLEVLVAPAVPSCEVPSSALSGTVVELRCQDKEGNPAPEYTWFKDGIRLLENPRLGSQSTNSSYTMNTKTGTLQFNTVSKLDTGEYSCEARNSVGYRRCPGKRMQVDDLNISGIIAAVVVVALVISVCGLGVCYAQRKGYFSKETSFQKSNSSSKATTMSENDFKHTKSFII

SEQ ID NO: 6240 - protein, 46 aa, Homo sapiens
MEPVALLQPTWWLLNVTLPLVAWSGPLICRPLLHGEGRQGAACLQG

SEQ ID NO: 6241 - protein, 65 aa, Homo sapiens
MIKILKEAIEETSFCSFWRISFQLSIHHIFLIFCAQLTTLLYSTFLFIPISWFLIVPGAVDKTIL

SEQ ID NO: 6242 - protein, 257 aa, Homo sapiens [sequence omitted]

SEQ ID NO: 6243 - protein, 163 aa, Homo sapiens
  SITE (106): Xaa equals any amino acid
  SITE (113): Xaa equals any amino acid
MSPRGTGCSAGLLMTVGWLLLAGLQSARGTNVTAAVQDAGLAHEGEGEEETENNDSETAENYAPPETEDVSNRNVVKEVEFGMCTVTCGIGVREVILTNGCPGGEXKCVVRVXECRGPTDCGWGKPISESLESVRLACIHTSPLIVSIYVELLRQTTIHYTCK

SEQ ID NO: 6244 - protein, 58 aa, Homo sapiens [sequence omitted]

SEQ ID NO: 6245 - protein, 47 aa, Homo sapiens
MYLFLLCCFISEHCAQHSFPHTCPNWKTRVLSFPLHPCPHLIHPNNT

SEQ ID NO: 6246 - protein, 208 aa, Homo sapiens
MWLFILLSLALISDAMVMDEKVKRSFVLDTASAICNYNAHYKNHPKYWCRGYFRDYCNIIAFSPNSTNHVALRDTGNQLIVTMSCLTKEDTGWYWCGIQRDFARDDMDFTELIVTDDKGTLANDFWSGKDLSGNKTRSCKAPKVVRKADRSRTSILIICILITGLGIISVISHLTKRRRSQRNRRVGNTLKPFSRVLTPKEMAPTEQM

SEQ ID NO: 6247 - protein, 84 aa, Homo sapiens
MKLLYLFLAILLAIEEPVISGKRHILRCMGNSGICRASCKKNEQPYLYCRNCQSCCLQSYMRISISGKEENTDWSYEKQWPRLP

SEQ ID NO: 6248 - protein, 44 aa, Homo sapiens
MGWLWLELLGLSIEETLVWAFLNKFLDSSAALLWRILGKSNLST

SEQ ID NO: 6249 - protein, 158 aa, Homo sapiens
MALEVLMLLAVLIWTGAENLHVKISCSLDWLMVSVIPVAESRNLYIFADELHLGMGCPANRIHTYVYEFIYLVRDCGIRTRVVSEETLLFQTELYFTPRNIDHDPQEIHLECSTSRKSVWLTPVSTENEIKLDPSPFIADFQTTAEELGLLSSSPNLL

SEQ ID NO: 6250 - protein, 89 aa, Homo sapiens
MVSASVFVGLVIFYIAFCLLWPLVVKGCTMIRWKINNLIASESYYTYASISGISSMPSLRHSRMGSMFSSRMTEDRAEPKEAVERQLMT

SEQ ID NO: 6251 - protein, 142 aa, Homo sapiens
MSGISGCPFFLWGLLALLGLALVISLIFNISHYVEKQRQDKMYSYSSDHTRVDEYYIEDTPIYGNLDDMISEPMDENCYEQMKARPEKSVNKMQEATPSAQATNETQMCYASLDHSVKGKRRSPGNRILISQTRMEMSNYMQ

SEQ ID NO: 6252 - protein, 94 aa, Homo sapiens
MLVIAGGILAALLLLIVVVLCLYFKIHNALKAAKEPEAVAVKNHNPDKVWWAKNSQAKTIATESCPALQCCEGYRMCASFDSLPPCCCDINEGL

SEQ ID NO: 6253 - protein, 39 aa, Homo sapiens
MAFGQEVTHLTKTSWLAPLRFIKGLLGPWGWILLILDLE

SEQ ID NO: 6254 - protein, 38 aa, Homo sapiens
MVSKHSLNLHFFYWKGGCACFTSEPRVFVVVELSLLDC

SEQ ID NO: 6255 - protein, 292 aa, Homo sapiens
MGIQTSPVLLASLGVGLVTLLGLAVGSYLVRRSRRPQVTLLDPNEKYLLRLLDKTTVSHHTLGLPVGKHIYLSTRIDGSLVIRPYTPVTSDEDQGYVDLVIKVYLKGVHPKFPEGGKMSQYLDSLKVGDVVEFRGPSGLLTYTGKGHFNIQPNKKSPPEPRVAKKLGMIAGGTGITPMLQLIRAILKVPEDPTQCFLLFANQTEKDIILREDLEELQARYPNRFKLWFTLDHPPKDWAYSKGFVTADMIREHLPAPGDDVLVLLCGPPPMVQLACHPNLDKLGYSQKMRFTY

SEQ ID NO: 6256 - protein, 90 aa, Homo sapiens
MALFSCLLLLKQSDGASPVLRALAASCLASPAGCCGTRKALNGNVGEKVGFTFMSFQGCDPSSPGCLCCSLLPSNSQLVFISFLVLSGLA

SEQ ID NO: 6257 - protein, 181 aa, Homo sapiens
MMLMPYGALIIGFVCGIISTLGFVYLTPFLESRLHIQDTCGINNLHGIPGIIGGIVGAVTAASASLEVYGKEGLVHSFDFQGFNGDWTARTQGKFQIYGLLVTLAMALMGGIIVGLILRLPFWGQPSDENCFEDAVYWEMPEGNSTVYIPEDPTFKPSGPSVPSVPMVSPLPMASSVPLVP

SEQ ID NO: 6258 - protein, 822 aa, Homo sapiens
MAAAVVVAEGDSDSRPGQELLVAWNTVSTGLVPPAALGLVSSRTSGAVPPKEEELRAAVEVLRGHGLHSVLEEWFVEVLQNDLQANISPEFWNAISQCENSADEPQCLLLLLDAFGLLESRLDPYLRSLELLEKWTRLGLLMGTGAQGLREEVHTMLRGVLFFSTPRTFQEMIQRLYGCFLRVYMQSKRKGEGGTDPELEGELDSRYARRRYYRLLQSPLCAGCSSDKQQCWCRQALEQFHQLSQVLHRLSLLERVSAEAVTTTLHQVTRERMEDRCRGEYERSFLREFHKWIERVVGWLGKVFLQDGPARPASPEAGNTLRRWRCHVQRFFYRIYASLRIEELFSIVRDFPDSRPAIEDLKYCLERTDQRQQLLVSLKAALETRLLHPGVNTCDIITLYISAIKALRVLDPSMVILEVACEPIRRYLRTREDTVRQIVAGLTGDSDGTGDLAVELSKTDPASLETGQDSEDDSGEPEDWVPDPVDADPGKSSSKRRSSDIISLLVSIYGSKDLFINEYRSLLADRLLHQFSFSPEREIRNVELLKLRFGEAPMHFCEVMLKDMADSRRINANIREEDEKRPAEEQPPFGVYAVILSSEFWPPFKDEKLEVPEDIRAALEAYCKKYEQLKAMRTLSWKHTLGLVTMDVELADRTLSVAVTPVQAVILLYFQDQASWTLEELSKAVKMPVALLRRRMSVWLQQGVLREEPPGTFSVIEEERPQDRDNMVLIDSDDESDSGMASQADQKEEELLLFWTYIQAMLTNLESLSLDRIYNMLRMFVVTGPALAEIDLQELQGYLQKKVRDQQLVYSAGVYRLPKNCS

SEQ ID NO: 6259 - protein, 45 aa, Homo sapiens
MAGVWNTIALWFLSVFGVISAPTTGTSPTSCRCVGPRPPGCGPAG

SEQ ID NO: 6260 - protein, 101 aa, Homo sapiens
  SITE (67): Xaa equals any amino acid
MELERCSVVLCILANLAVLRALFLPCIIFHCVSDSRSVNRETKVKFVHTSVHGVGHSFVQSAFKAFXLVPPEAVPEQKDPDPEFPTVKYPNPEEGKGVLVT

SEQ ID NO: 6261 - protein, 77 aa, Homo sapiens
  SITE (43): Xaa equals any amino acid
MAARSALALLLLLPVLLLPVQSRSEPETTAPTPTPIPGGNSSXSRPLPSIELHACGPYPKPGLLILLAPLALWPILL

SEQ ID NO: 6262 - protein, 188 aa, Homo sapiens
MILTMLLMLKLCTEVRVANELNARRRSFTAADSKDEEVKVAPRRSFLDFDPHHFWQWSSFSDYVQCVLAFTGVAGYITYLSIDSALFVETLGFLAVLTEAMLGVPQLYRNHRHQSTEGMSIKMVLMWTSGDAFKTAYFLLKGAPLQFSVCGLLQVLVDLAILGQAYAFARHPQKPAPHAVHPTGTKAL

SEQ ID NO: 6263 - protein, 86 aa, Homo sapiens [sequence omitted]

SEQ ID NO: 6264 - protein, 246 aa, Homo sapiens
MALLLCLVCLTAALAHGCLHCHSNFSKKFSFYRHHVNFKSWWVGDIPVSGALLTDWSDDTMKELHLAIPAKITREKLDQVATAVYQMMDQLYQGKMYFPGYFPNELRNIFREQVHLIQNAIIESRIDCQHRCGKQGSVQAEGRAGGSSGPWRLRGALAALVRVSGIFQYETISCNNCTDSHVACFGYNCESSAQWKSAVQGLLNYINNWHKQDTSMSLVSPALRCLEPPHLANLTLEDAAECLKQH

SEQ ID NO: 6265 - protein, 246 aa, Homo sapiens
MGPQHLRLVQLFCLLGAISTLPRAGALLCYEATASRFRAVAFHNWKWLLMRNMVCKLQEGCEETLVFIETGTARGVVGFKGCSSSSSYPAQISYLVSPPGVSIASYSRVCRSYLCNNLTNLEPFVKLKASTPKSITSASCSCPTCVGEHMKDCLPNFVTTNSCPLAASTCYSSTLKFQAGFLNTTFLLMGCAREHNQLLADFHHIGSIKVTEVLNILEKSQIVGAASSRQDPAWGVVLGLLFAFRD

SEQ ID NO: 6266 - protein, 84 aa, Homo sapiens
  SITE (65): Xaa equals any amino acid
MWSSSWDHRITTPRLANFFFFFFFFFFVEMGFRYVGQAGLKLLASSNLPALASQSAGITGVSHHXWLGGLIKTPILSLTPRVSG

SEQ ID NO: 6267 - protein, 40 aa, Homo sapiens
MLQEVKLDFLWLLNLPLILLFSILESSMKICTNAMFTRTG

SEQ ID NO: 6268 - protein, 110 aa, Homo sapiens
  SITE (93): Xaa equals any amino acid
MFLASWLLFCIVAPKDDAHLSFIQCKDIWKDNRKYSCFHFKSDQLLELASKACTSFQAQSRSFTAGAVPSEHPELPCGSQQLCCGCTARLGGXWIGASRCGSGSAFLASP

SEQ ID NO: 6269 - protein, 59 aa, Homo sapiens
  SITE (54): Xaa equals any amino acid
MWTARRCTETVAVSLRIFPLVLAMPLQGKCTSTCQRKPLLLVFIFVVNFLYIPXAAFLH

SEQ ID NO: 6270 - protein, 24 aa, Homo sapiens
MKYLLFLVFCLSYVKDLNIFDLLY

SEQ ID NO: 6271 - protein, 56 aa, Homo sapiens [sequence omitted]

SEQ ID NO: 6272 - protein, 53 aa, Homo sapiens
MQECLLHGCCCYLLRLGVLGTVQCISTWLILTANEQHRLKETSNSQSPAVSRA

SEQ ID NO: 6273 - protein, 231 aa, Homo sapiens
MWALQLSLPTCGLAALLTHMRPCSSPYPHAGLAALLTHMGPCRSPYPHGGLAAVLTHMRALQLSLPTWGLAALLTHMRPCSSPYPHAGLACCWLWSLSSHRSLQVQATHRLVVRTIKDRVMLKVLPQTRRRGPFLSSCRNDVMRNCVPRHAVLVTTCVFVSFPTHCKVGITGPITQVKQKPGNHSSPCPVIQLVAKAEFELMLPSVPKPVYLTLVLSCWCLCDVPCLSVSL

SEQ ID NO: 6274 - protein, 50 aa, Homo sapiens
  SITE (43): Xaa equals any amino acid
  SITE (50): Xaa equals any amino acid
MNFLVFLSLSSSLVSAAGPRFPSREERGVGGVVLIKSEDMTLXERSKGSX

SEQ ID NO: 6275 - protein, 41 aa, Homo sapiens
MCGLVILWPCIMTLFSSLSTGDVLLPCKILVGLRVFIGARV

SEQ ID NO: 6276 - protein, 32 aa, Homo sapiens
MPVPLWLVLWFCFLLYVASRRTFGLANYMPLP

SEQ ID NO: 6277 - protein, 362 aa, Homo sapiens
MRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRRGREMFEVTGLHDVDQGWMRAVRKHAKGLHIVPRLLFEDWTYDDFRNVLDSEDEIEELSKTVVQVAKNQHFDGFVVEVWNQLLSQKRVTDQLGMFTHKEFEQLAPVLDGFSLMTYDYSTAHQPGPNAPLSWVRACVQVLDPKSKWRSKILLGLNFYGMDYATSKDAREPVVGARYIQTLKDHRPRMVWDSQASEHFFEYKKSRSGRHVVFYPTLKSLQVRLELARELGVGVSIWELGQGLDYFYDLL

SEQ ID NO: 6278 - protein, 71 aa, Homo sapiens
MVQGPLTHLMLVLLISLIFLSRGSGRAWAFSHSCFKTSDLLPCRNRWEVIEFLHYSNLHSHISLSVTKTFL

SEQ ID NO: 6279 - protein, 37 aa, Homo sapiens
MCYIPGSTGGQCWPWCWCWLCREALEWLCGAVSAGPA

SEQ ID NO: 6280 - protein, 133 aa, Homo sapiens
MRVPLVLSWAFVLVGFSGVYLASESFWFPPSLCDLTSPPGLHLWKFIRDLVSMEELTDSAREMGYWMMVFSLKAMFPVSSGCFQERQETNKSLTLLRCSQRDTSPLMDGQTWARVRVTKPPTTATAAYNRHIR

SEQ ID NO: 6281 - protein, 42 aa, Homo sapiens
MFLFITFTILAIFIIEPRNLRVDLNLIKFQTSWPKTLVEEQN

SEQ ID NO: 6282 - protein, 318 aa, Homo sapiens
MALMLSLVLSLLKLGSGQWQVFGPDKPVQALVGEDAAFSCFLSPKTNAEAMEVRFFRGQFSSVVHLYRDGKDQPFMQMPQYQGRTKLVKDSIAEGRISLRLENITVLDAGLYGCRISSQSYYQKAIWELQVSALGSVPLISIAGYVDRDIQLLCQSSGWFPRPTAKWKGPQGQDLSTDSRTNRDMHGLFDVEISLTVQENAGSISCSMRHAHLSREVESRVQIGDWRRKHGQAGKRKYSSSHIYDSFPSLSFMDFYILRPVGPCRAKLVMGTLKLQILGEVHFVEKPHSLLQISGGSTTLKKGPNPWSFPSPCALFPT

SEQ ID NO: 6283 - protein, 101 aa, Homo sapiens
MSQLSRTSLSLLLTLLVLWGSSCCLPIWCLPNRHRLLKLSFLLFSPDIPYLSHTHPNNISCSVLSLRQHLNFTQPGALFTCLVQIQFGLILQPCISKWGLG

SEQ ID NO: 6284 - protein, 85 aa, Homo sapiens
  SITE (68): Xaa equals any amino acid
MGMPLVTVTAATFPTLSCPPRAWPEVEAPEAPALPVVPELPEVPMEMPLVLPPELELLSLEAVHRYQXGGTLMGWTRAEASANGS

SEQ ID NO: 6285 - protein, 51 aa, Homo sapiens [sequence omitted]

SEQ ID NO: 6286 - protein, 44 aa, Homo sapiens
MVLKQKQYLFTVGILFILFFSPVNAVKRFIPLRPGSSQAYMLLG

SEQ ID NO: 6287 - protein, 111 aa, Homo sapiens
MQFSLCLTAVFLLQLAAGILGFVFSDKARGKVSEIINNAIVHYRDDLDLQNLIDFGQKKVWVSQWSGGLWVKVNVIPRDASPSMPVGLFITCQVMASGKGFGKKSTRSRVL

SEQ ID NO: 6288 - protein, 102 aa, Homo sapiens [sequence omitted]

SEQ ID NO: 6289 - protein, 201 aa, Homo sapiens [sequence omitted]

SEQ ID NO: 6290 - protein, 102 aa, Homo sapiens
  SITE (91): Xaa equals any amino acid
  SITE (92): Xaa equals any amino acid
  SITE (93): Xaa equals any amino acid
MGRRSGLLGLRPGRSRWRWSGSVWVRSVLLLLGGLRASATSTPVSLGSSPPCRHHVPSDTEVINKVHLKANHVVKRDVDEHLRIKTVYDKXXXSCSLRKRIL

SEQ ID NO: 6291 - protein, 56 aa, Homo sapiens
MFLKVLVFLIFFSPFSSSLFSGEAVRGRGAGLGLGIGRGWTSCLSVLNGCDGARSH

SEQ ID NO: 6292 - protein, 78 aa, Homo sapiens
MSPHQPMQVSSSKTILWLVLSCLCPSSPHPVISGLPQWYIGVLAGIVPVAPIRPGDSGLDLQREGPQPILSQGLNRRT

SEQ ID NO: 6293 - protein, 42 aa, Homo sapiens
MMLGLRQKLTTSLTSAAALTCVLLLSMTGMTTSSSRSVLWKT

SEQ ID NO: 6294 - protein, 73 aa, Homo sapiens
MCWICVWLFFSPTKTSCFPWLIRPGPRSFTDSHGTPPWQCLEPSRFYVPWEASVVTFFAAGSAKMSCQSWLAP

SEQ ID NO: 6295 - protein, 159 aa, Homo sapiens
MSQAWVPGLAPTLLFSLLAGPQKIAAKCGLILACPKGFKCCGDSCCQENELFPGPVRIFVIIFLVILSVFCICGLAKCFCRNCREPEPDSPVDCRGPLELPSIIPPERVRVSLSAPPPPYSEVILKPSLGPTPTEPPPPYSFRPEEYTGDQRGIDNPAF

SEQ ID NO: 6296 - protein, 50 aa, Homo sapiens
MDGGPGAFSRAWVLQIPWLLLSGGNFALCEPRPCPSAGHPWQEAGLPSSP

SEQ ID NO: 6297 - protein, 68 aa, Homo sapiens
MKPTRSLWISFLMCCWIWFANILLRIFASVFFRDIGLKFSFFCCVSARLWYQDDAGLINELGRIPSFY

SEQ ID NO: 6298 - protein, 151 aa, Homo sapiens; identical to SEQ ID NO: 5959

SEQ ID NO: 6299 - protein, 506 aa, Homo sapiens
  SITE (65): Xaa equals any amino acid
  SITE (112): Xaa equals any amino acid
  SITE (423): Xaa equals any amino acid
  SITE (425): Xaa equals any amino acid
MGMRRHSLMLLPWWLGAAGRKECHREQLVAAVEVTEQETKVPKKTVIIEETITTVVKSPRGQRRXPSKSPSRSPSRCSASPLRPGLLAPDLLYLPGAGQPRRPEAEPGQKPXVPTLYVTEAEAHSPALPGLSGPQPKWVEVEETIEVRVKKMGPQGVSPTTEVPRSSSGHLFTLPGATPGGDPNSNNSNNKLLAQEAWAQGTAMVGVREPLVFRVDARGSVDWAASGMGSLEEEGTMEEAGEEEGEDGDAFVTEESQDTHSLGDRDPKILTHNGRMLTLADLEDYVPGEGETFHCGGPGPGAPDDPPCEVSVIQREIGEPTVGSLCCSAWGMHWVPEALSASLGLSPVGRHHRDPRSVALRAPPSSCGRPRLGLWAVLPGRSLSAPASGVLRTVARAASPQSFPPRPSTSGQWGRRSPFTSVXGXGPSYLTQLQPGGLGGACNVGMTGSKTSALGCFLSAWQEPQDCGRRMWPWAFVLFPHGPGPSLLAPATAARPDMALPLLQSW

SEQ ID NO: 6300 - protein, 45 aa, Homo sapiens
MWSIKLTCRLRGFWFWFWVLFFCGGGAGIWKNLALYVTEIFFART

SEQ ID NO: 6301 - protein, 615 aa, Homo sapiens [sequence omitted]

SEQ ID NO: 6302 - protein, 334 aa, Homo sapiens
MFQCGLLQQLCTILMATGVPADILTETINTVSEVIRGCQVNQDYFASVNAPSNPPRPAIVVLLMSMVNERQPFVLRCAVLYCFQCFLYKNQKGQGEIVSTLLPSTIDATGNSVSAGQLLCGGLFSTDSLSNWCAAVALAHALQENATQKEQLLRVQLATSIGNPPVSLLQQCTNILSQGSKIQTRVGLLMLLCTWLSNCPIAVTHFLHNSANVPFLTGQIAENLGEEEQLVQGLCALLLGISIYFNDNSLESYMKEKLKQLIEKRIGKENFIEKLGFISKHELYSRASQKPQPNFPSPEYMIFDHEFTKLVKELEGVITKAIYKSSEEDKKKKK

SEQ ID NO: 6303 - protein, 522 aa, Homo sapiens
MRLRVRLLKRTWPLEVPETEPTLGHLRSHLRQSLLCTWGYSSNTRFTITLNYKDPLTGDEETLASYGIVSGDLICLILQDDIPAPNIPSSTDSEHSSLQNNEQPSLATSSNQTSMQDEQPSDSFQGQAAQSGVWNDDSMLGPSQNFEAESIQDNAHMAEGTGFYPSEPMLCSESVEGQVPHSLETLYQSADCSDANDALIVLIHLLMLESGYIPQGTEAKALSMPEKWKLSGVYKLQYMHPLCEGSSATLTCVPLGNLIVVNATLKINNEIRSVKRLQLLPESFICKEKLGENVANIYKDLQKLSRLFKDQLVYPLLAFTRQALNLPDVFGLVVLPLELKLRIFRLLDVRSVLSLSAVCRDLFTASNDPLLWRFLYLRDFRDNTVRVQDTDWKELYRKRHIQRKESPKGRFVMLLPSSTHTIPFYPNPLHPRPFPSSRLPPGIIGGEYDQRPTLPYVGDPISSLIPGPGETPSQFPPLRPRFDPVGPLPGPNPILPGRGGPNDRFPFRPSRGRPTDGRLSFM

SEQ ID NO: 6304 - protein, 45 aa, Homo sapiens
MLVSLIICLLLDLLNQPSLLRDLILKQHTGNPHLSFPLKYSHWMG

SEQ ID NO: 6305 - protein, 168 aa, Homo sapiens
MVTFITATLWIAVFSYIMVWLVTIIGYTLGIPDVIMGITFLAAGQVSRLHGQPNCGETRPWGHGSLQHHRSNVFDILVGLGVPWGLQTMVVNYGSTVKINSRGLVYSVVLLLGSVALTVLGIHLNKWRLDRKLGVYVLVLYAIFLCFSIMIEFNVFTFVNLPMCREDD

SEQ ID NO: 6306 - protein, 48 aa, Homo sapiens
MMKYFFDVVVFLTFFLVFSLSIFLSDEEFPVSRTQNIGLCHFNPSFSE

SEQ ID NO: 6307 - protein, 168 aa, Homo sapiens
  SITE (83): Xaa equals any amino acid
MPLLRGLLWLQVLCAGPLHTEAVVLLVPSDDGRAFLLRSRLLHPEAHVPPAADRGASLQCVLHQAAPKSRPRSPAAGAALLHXPRRTGDEPCREFHGNGFPGPTQLTPGECGLPAPSSLLQHASAPVRTGSEGQVVGCPRARGETGEGLSLAFLSSLMFTSRNGLVGC

SEQ ID NO: 6308 - protein, 43 aa, Homo sapiens [sequence omitted]

SEQ ID NO: 6309 - protein, 212 aa, Homo sapiens [sequence omitted]

SEQ ID NO: 6310 - protein, 371 aa, Homo sapiens
  SITE (20): Xaa equals any amino acid
MLFPSFSRSLVPLPHALYLXQPLTHTTSLLAGIGPVLGLVCVPLLGSASDHWRGRYGRRRPFIWALSLGILLSLFLIPRAGWLAGLLCPDPRPLELALLILGVGLLDFCGQVCFTPLEALLSDLFRDPDHCRQAYSVYAFMISLGGCLGYLLPAIDWDTSALAPYLGTQEECLFGLLTLIFLTCVAATLLVAEEAALGPTEPAEGLSAPSLSPHCCPCRARLAFRNLGALLPRLHQLCCRMPRTLRRLFVAELCSWMALMTFTLFYTDFVGEGLYQGVPRAEPGTEARRHYDEGKALAASRGWCGSRPPETTLGAVSGLVPLHPGPDFSVRKVGMDPICIHGFSWVWNISACGFRKASGCSRSLIRVVAPV

SEQ ID NO: 6311 - protein, 187 aa, Homo sapiens
MVAATVAAAWLLLWAAACAQQEQDFYDFKAVNIRGKLVSLEKYRGSVSLVVNVASECGFTDQHYRALQQLQRDLGPHHFNVLAFPCNQFGQQEPDSNKEIESFARRTYSVSFPMFSKIAVTGTGAHPAFKYLAQTSGKEPTWNFWKYLVAPDGKVVGAWDPTVSVEEVRPQITALVRKLILLKREDL

SEQ ID NO: 6312 - protein, 105 aa, Homo sapiens
MSGLAAAAHVFRVCLFPLSWGSSKTTFIHGLSSYIATPVLNSIFSSWKSRRKDTWTCLLHRLSAFPISRRRRNFALFSHSCVCIRSSSDDVGPTMYSFSVPCRVK

SEQ ID NO: 6313 - protein, 67 aa, Homo sapiens
MGSFLHPQWHLLITFCAVLGKGLHSDPSRPFEHGGALGKVPRGRSTLLSKEVLLTLPPCLHVSVGRK

SEQ ID NO: 6314 - protein, 1887 aa, Homo sapiens
MAARGRGLLLLTLSVLLAAGPSAAAAKLNIPKVLLPFTRATRVNFTLEASEGCYRWLSTRPEVASIEPLGLDEQQCSQKAVVQARLTQPARLTSIIFAEDITTGQVLRCDAIVDLIHDIQIVSTTRELYLEDSPLELKIQALDSEGNTFSTLAGLVFEWTIVKDSEADRFSDSHNALRILTFLESTYIPPSYISEMEKAAKQGDTILVSGMKTGSSKLKARIQEAVYKNVRPAEVRLLILENILLNPAYDVYLMVGTSIHYKVQKIRQGKITELSMPSDQYELQLQNSIPGPEGDPTRPVAVLAQDTSMVTALQLGQSSLVLGHRSIRMQGASRLPNSTIYVVEPGYLGFTVHPGDRWVLETGRLYEITIEVFDKFSNKVYVSDNIRIETVLPAEFFEVLSSSQNGSYHRIRALKRGQTAIDAALTSVVDQDGGVHILQVPVWNQQEVEIHIPITLYPSILTFPWQPKTGAYQYTIRAHGGSGNFSWSSSSHLVATVTVKGVMTTGSDIGFSVIQAHDVQNPLHFGEMKVYVIEPHSMEFAPCQVEARVGQALELPLRISGLMPGGASEVVTLSDCSHFDLAVEVENQGVFQPLPGRLPPGSEHCSGVRVKAEAQGSTTLLVSYRHGHVHLSAKITIAAYLPLKAVDPSSVALVTLGSSKEMLFEGGPRPWILEPSKFFQNVTAEDTDSIGLALFAPHSSRNYQQHWILVTCQALGEQVIALSVGNKPSLTNPFPAVEPAVVKFVCAPPSRLTLVPVYTSPQLDMSCPLLQQNKQVVPVSSHRNPLLDLAAYDQEGRRFDNFSSLSIQWESTRPVLASIEPELPMQLVSQDDESGQKKLHGLQAILVHEASGTTAITATATGYQESHLSSARTKQPHDPLVPLSASIELILVEDVRVSPEEVTIYNHPGIQAELRIREGSGYFFLNTSTADVVKVAYQEARGVAMVHPLLPGSSTIMIHDLCLVFPAPAKAVVYVSDIQELYIRVVDKVEIGKTVKAYVRVLDLHKKPFLAKYFPFMDLKLRAASPIITLVALDEALDNYTITFLIRGVAIGQTSLTASVTNKAGQRINSAPQQIEVFPPFRLMPRKVTLLIGATMQVTSEGGPQPQSNILFSISNESVALVSAAGLVQGLAIGNGTVSGLVQAVDAETGKVVIISQDLVQVEVLLLRAVRIRAPIMRMRTGTQMPIYVTGITNHQNPFSFGNAVPGLTFHWSVTKRDVLDLRGRHHEASIRLPSQYNFAMNVLGRVKGRTGLRVVVKAVDPTSGQLYGLARELSDEIQVQVFEKLQLLNPEIEAEQILMSPNSYIKLQTNRDGAASLSYRVLDGPEKVPVVHVDEKGFLASGSMIGTSTIGVIAQEPFGANQTIIVAVKVSPVSYLRVSMSPVLHTQNKEALVAVPLGMTVTFTVHFHDNSGDVFHAHSSVLNFATNRDDFVQIGKGPTNNTCVVRTVSVGLTLLRVWDAEHPGLSDFMPLPVLQAISPELSGAMVVGDVLCLATVLTSLEGLSGTWSSSANSILHIDPKTGVAVARAVGSVTVYYEVAGHLRTYKEVVVSVPQRIMARHLHPIQTSFQEATASKVIVAVGDRSSNLRGECTPTQREVIQALHPETLISCQSQFKPAVFDFPSQDVFTVEPQFDTALGQYFCSITMHRLTDKQRKHLSMKKTALVVSASLSSSHFSTEQVGAEVPFSPGLFADQAEILLSNHYTSSEIRVFGAPEVLENLEVKSGSPAVLAFAKEKSFGWPSFITYTVGVLDPAAGSQGPLSTTLTFSSPVTNQAIAIPVTVAFVVDRRGPGPYGASLFQHFLDSYQVMFFTLFALLAGTAVMIIAYHTVCTPRDLAVPAALTPRASPGHSPHYFAASSPTSPNALPPARKASPPSGLWSPAYASH

SEQ ID NO: 6315 - protein, 302 aa, Homo sapiens
  SITE (262): Xaa equals any amino acid
  SITE (279): Xaa equals any amino acid
  SITE (294): Xaa equals any amino acid
  SITE (295): Xaa equals any amino acid
MLLLWKNFMYRRRQPVQLLVELLWPLFLFFILVAVRHSHPPLEHHECHFPNKPLPSAGTVPWLQGLICNVNNTCFPQLTPGEEPGRLSNFNDSLVSRLLADARTVLGGASAHRTLAGLGKLIATLRAARSTAQPQPTKQSPLEPPMLDVAELLTSLLRTESLGLALGQAQEPLHSLLEAAEDLAQELLALRSLVELRALLQRPRGTSGPLELLSEALCSVRGPSSTVGPSLNWYEASDLMELVGQEPESACRQQLSPLLGAXWSLDSTRCPLVWNAEAXSSEVLLTDHFTEVMXXERLQSYL

SEQ ID NO: 6316 - protein, 52 aa, Homo sapiens
MKCFFLFVVILIIMKSNLSDIIIATYTYCIPDYFFHTFIFNLSVYLNSKFIS

SEQ ID NO: 6317 - protein, 110 aa, Homo sapiens
MLLWWQCLCCHAVLEPAATAMPEDAAPSSLPVPPNMTSSRFHYFWTLLQIKLTQFYSKPRSLSATPEKNIGLQEPERRERFTGESCRWELKSQVMSLPHQKLTRMYTMPL

SEQ ID NO: 6318 - protein, 40 aa, Homo sapiens
MRRQTFMSILVFQCSPISFGLCINKERTVVSSVITDNLCL

SEQ ID NO: 6319 - protein, 211 aa, Homo sapiens [sequence omitted]

SEQ ID NO: 6320 - protein, 90 aa, Homo sapiens
MYLLCWLYIMGVLGASCNWHVGVPFPGTHWPRSQNHLLWVYNHLNELPVPAGRSSEQLYLGYTEKLCIWISCYLAIRITEIQGSRVILMA

SEQ ID NO: 6321 - protein, 414 aa, Homo sapiens
MNPTLGLAIFLAVLLTVKGLLKPSFSPRNYKALSEVQGWKQRMAAKELARQNMDLGFKLLKKLAFYNPGRNIFLSPLSISTAFSMLCLGAQDSTLDEIKQGFNFRKMPEKDLHEGFHYIIHELTQKTQDLKLSIGNTLFIDQRLQPQRKFLEDAKNFYSAETILTNFQNLEMAQKQINDFISQKTHGKINNLIENIDPGTVMLLANYIFFRARWKHEFDPNVTKEEDFFLEKNSSVKVPMMFRSGIYQVGYDDKLSCTILEIPYQKNITAIFILPDEGKLKHLEKGLQVDTFSRWKTLLSRRVVDVSVPRLHMTGTFDLKKTLSYIGVSKIFEEHGDLTKIAPHRSLKVGEAVHKAELKMDERGTEGAAGTGAQTLPMETPLVVKIDKPYLLLIYSEKIPSVLFLGKIVNPIGK

SEQ ID NO: 6322 - protein, 346 aa, Homo sapiens [sequence omitted]

SEQ ID NO: 6323 - protein, 188 aa, Homo sapiens
MDVNIAPLRAWDDFFPGSDRFARPDFRDISKWNNRVVSNLLYYQTNYLVVAAMMISIVGFLSPFNMILGGIVVVLVFTGFVWAAHNKDVLRRMKKRYPTTFVMVVMLASYFLISMFGGVMVFVFGITFPLLLMFIHASLRLRNLKNKLENKMEGIGLKRTPMGIVLDALEQQEEGINRLTDYISKVKE

SEQ ID NO: 6324 - protein, 45 aa, Homo sapiens
MSMKCYLVVLICIPLMATDAECLFLCLRAMRISLEKGLSRSFAYF

SEQ ID NO: 6325 - protein, 165 aa, Homo sapiens
  SITE (127): Xaa equals any amino acid
MCLSLLAALACSAGDTWASEVGPVLSKSSPRLITTWEKVPVGTNGGVTVVGLVSSLLGGTFVGIAYFLTQLIFVNDLDISAPQWPIIAFGGLAGLLGSIVDSYLGATMQYTGLDESTGMVVNSPTNXARHIAGKPILDNNAVNLFSSVLIALLLPTAAWGFWPRG

SEQ ID NO: 6326 - protein, 155 aa, Homo sapiens [sequence omitted]

SEQ ID NO: 6327 - protein, 62 aa, Homo sapiens
MTWTKCPLPLGPAFFTQCCLIGLLVPLLGWGNQNTQWYPTSKMPDLKDSKTTDLCQHVKHMV

SEQ ID NO: 6328 - protein, 46 aa, Homo sapiens
MIHRARSLAALSSLMLYTKLVQPVACISHVAQDGFEYGPTQIHKLS

SEQ ID NO: 6329 - protein, 182 aa, Homo sapiens
MKGWGWLALLLGALLGTAWARRSQDLHCGACRALVDELEWEIAQVDPKKTIQMGSFRINPDGSQSVVEVPYARSEAHLTELLEEICDRMKEYGEQIDPSTHRKNYVRVVGRNGESSELDLQGIRIDSDISGTLKFACESIVEEYEDELIEFFSREADNVKDKLCSKRTDLCDHALHISHDEL

SEQ ID NO: 6330 - protein, 300 aa, Homo sapiens
MKFLLDILLLLPLLIVCSLESFVKLFIPKRRKSVTGEIVLITGAGHGIGRLTAYEFAKLKSKLVLWDINKHGLEETAAKCKGLGAKVHTFVVDCSNREDIYSSAKKVKAEIGDVSILVNNAGVVYTSDLFATQDPQIEKTFEVNVLAHFWTTKAFLPAMTKNNHGHIVTVASAAGHVSVPFLLAYCSSKFAAVGFHKTLTDELAALQITGVKTTCLCPNFVNTGFIKNPSTSLGPTLEPEEVVNRLMHGILTEQKMIFIPSSIAFLTTLERILPERFLAVLKRKISVKFDAVIGYKMKAQ

SEQ ID NO: 6331 - protein, 191 aa, Homo sapiens
MAAPRGRAAPWTTALLLLLASQVLSPGSCADEEEVPEEWVLLHVVQGQIGAGNYSYLRLNHEGKIVLRMRSLKGDADLYVSASSLHPSFDDYELQSATCGPDAVSIPAHFRRPVGIGVYGHPSHLESEFEMKVYYDGTVEQHPFGEAAYPADGADAGQKHAGAPEDASQEEESVLWTILISILKLELEILF

SEQ ID NO: 6332 - protein, 88 aa, Homo sapiens
MTSIWHRPVCPLSWLVPSAAFSNWGPGCRAVCSPRWATPAKIPTPKCDRVAHEEGSALRVPSRVHSSSQLLRVAPASPTSSLSPVMSR

SEQ ID NO: 6333 - protein, 385 aa, Homo sapiens
MSFIMKLHRHFQRTVILLATFCMVSIIISAYYLYSGYKQENELSETASEVDCGDLQHLPYQLMEVKAMKLFDASRTDPTVLVFVESQYSSLGQDIIMILESSRFQYHIEIAPGKGDLPVLIDKMKGKYILIIYENILKYINMDSWNRSLLDKYCVEYGVGVIGFHKTSEKSVQSFQLKGFPFSIYGNLAVKDCCINPHSPLIRVTKSSKLEKGSLPGTDWTVFQINHSAYQPVIFAKVKTPENLSPSISKGAFYATIIHDLGLHDGIQRVLFGNNLNFWLHKLIFIDAISFLSGKRLTLSLDRYILVDIDDIFVGKEGTRMNTNDVKVRLYFLKFQSSVHLPAGIQLSQFVLQLGYPGHGIYWESLGNLGLSLTLNQLRRLCISI

SEQ ID NO: 6334 - protein, 146 aa, Homo sapiens
MLMPVHFLLLLLLLLGGPRTGLPHKFYKAKPIFSCLNTALSEAEKGQWEDASLLSKRSFHYLRSRDASSGEEEEGKEKKTFPISGARGGARGTRYRYVSQAQPRGKPRQDTAKSPHRTKFTLSLDVPTNIMNLLFNIAKAKNLRAQ

SEQ ID NO: 6335 - protein, 199 aa, Homo sapiens
MRRLLLALPFALLPLAVAHAHEDHDHEHGSLGAHEHGVGRLNAVLDGQALELELDSPAMNLVGFEHVATSAADKAKVAAVRKQLENPSALFNLPKAAGCVVSSQELNSPLFGDKPEAEHDDDDHASDGKGAAAHKHDHDHSEIHAHYQFTCATPTALGNLDLSQVFKTFPATQKIQVQLIGPSGQQGVDATATAATLKF

SEQ ID NO: 6336 - protein, 84 aa, Homo sapiens
  SITE (65): Xaa equals any amino acid
MWVFFLPFFSILFKICWCISLSQTKEKQSSNLMFYFFCICTYERRRKKEMRRGEKKRSFCLIGLXQHMIAVQAWFHEQHQIQIS

SEQ ID NO: 6337 - protein, 57 aa, Homo sapiens
MAVSVIFCQKLKTGSVKLWIQMLLWLQFSVACLRLRKGGKWSPWGLMLKEVIWKDCR

SEQ ID NO: 6338 - protein, 60 aa, Homo sapiens
MVSRSTSLTLIVFLFHRLSKAPGKMVENSPSPLPERAIYGFVLFLSSQFGFKNLKGSRVC

SEQ ID NO: 6339 - protein, 224 aa, Homo sapiens
MGIFPGIILIFLRVKFATAAVIVSGHQKSTTVSHEMSGLNWKPFVYGGLASIVAEFGTFPVDLTKTRLQVQGQSIDARFKEIKYRGMFHALFRICKEEGVLALYSGIAPALLRQASYGTIKIGIYQSLKRLFVERLEDETLLINMICGVVSGVISSTIANPTDVLKIRMQAQGSLFQGSMIGSFIDIYQQEGTRGLWRVSTLFLLLSYTLSSYNLQRIFFYIKT

SEQ ID NO: 6340 - protein, 215 aa, Homo sapiens
  SITE (83): Xaa equals any amino acid
  SITE (141): Xaa equals any amino acid
MYGKSSTRAVLLLLGIQLTALWPIAAVEIYTSRVLEAVNGTDARLKCTFSSFAPVGDALTVTWNFRPLDGGPEQFVFYYHIDXFQPMSGRFKDRVSWDGNPERYDASILLWKLQFDDNGTYTCQVKNPPDVDGVIGDIRLXVVHTVRFSEIHFLALAIGSACALMIIIVIVVVLFQHYRKKRWAERAHKVVEIKSKEEERLNQEKKVSVYLEDTD

SEQ ID NO: 6341 - protein, 413 aa, Homo sapiens
MRRGCAVLGALGLLAGAGVGSWLLVLYLCPAASQPISGTLQDEEITLSCSEASAEEALLPALPKTVSFRINSEDFLLEAQVRDQPRWLLVCHEGWSPALGLQICWSLGHLRLTHHKGVNLTDIKLNSSQEFAQLSPRLGGFLEEAWQPRNNCTSGQVVSLRCSECGARPLASRIVGGQSVAPGRWPWQASVALGFRHTCGGSVLAPRWVVTAAHCMHSFRLARLSSWRVHAGLVSHSAVRPHQGALVERIIPHPLYSAQNHDYDVALLRLQTALNFSDTVGAVCLPAKEQHFPKGSRCWVSGWGHTHPSHTYSSDMLQDTVVPLFSTQLCNSSCVYSGALTPRMLCAGYLDGRADACQGDSGGPLVCPDGDTWRLVGVVSWGRGCAEPNHPGVYAKVAEFLDWIHDTAQDSLL

SEQ ID NO: 6342 - protein, 52 aa, Homo sapiens [sequence omitted]

SEQ ID NO: 6343 - protein, 365 aa, Homo sapiens
MFVGLMAFLLSFYLIFTNEGRALKTATSLAEGLSLVVSPDSIHSVAPENEGRLVHIIGALRTSKLLSDPNYGVHLPAVKLRRHVEMYQWVETEESREYTEDGQVKKETRYSYNTEWRSEIINSKNFDREIGHKNPSAMAVESFMATAPFVQIGRFFLSSGLIDKVDNFKSLSLSKLEDPHVDIIRRGDFFYHSENPKYPEVGDLRVSFSYAGLSGDDPDLGPAHVVTVIARQRGDQLVPFSTKSGDTLLLLHHGDFSAEEVFHRELRSNSMKTWGLRAAGWMAMFMGLNLMTRILYTLVDWFPVFRDLVNIGLKAFAFCVATSLTLLTVAAGWLFYRPLWALLIAGLALVPILVARTRVPAKKLE

SEQ ID NO: 6344 - protein, 50 aa, Homo sapiens
MYSLVLTFLVSFCALSKTFLDHWFQMFIYYILFKDSEIGFCHPLLYVLFH

SEQ ID NO: 6345 - protein, 250 aa, Homo sapiens
  SITE (114): Xaa equals any amino acid
MFLATLSFLLPFAHPFGTVSCEYMLGSPLSSLAQVNLSPFSHPKVHMDPNYCHPSTSLHLCSLAWSFTRLLHPPLSPGISQVVKDHVTKPTAMAQGRVAHLIEWKGWSKPSDSXAALESAFSSYSDLSEGEQEARFAAGVAEQFAIAEAKLRAWSSVDGEDSTDDSYDEDFAGGMDTGEGHPGLGLWWTHLIDLGILSEPHPEHSQPLQGEGEGQTQSRQAWTLQGQEGCPHSWVGNEQTEMDSFLSHRC

SEQ ID NO: 6346 - protein, 60 aa, Homo sapiens
MAAVMLVLTVVLGLYNSYNSCAEQADGPLGRSTCSAAPGTPGGAQDSSMSSLQSSRKPHT

SEQ ID NO: 6347 - protein, 47 aa, Homo sapiens
MSLLLPPLALLLLLAALVAPATAATAYRPDWNRLSGLTRARVETCGG

SEQ ID NO: 6348 - protein, 44 aa, Homo sapiens
MPCHGLLAQGLSLAPLPPWALCCVGVSRALQDIQQHPRPPAPCQ

SEQ ID NO: 6349 - protein, 52 aa, Homo sapiens
MSKARFPFLAFPPLVLCLEHSQASLGTRLPVVTPSSLPSSCKGIGCGFLELG

SEQ ID NO: 6350 - protein, 131 aa, Homo sapiens
MLWTLTFFLLQRSLTSPWLFGLLFLGSSNTAVCCFLGQLIMGPKGERGFPGPPGRCLCGPTMNVNNPSYGESVYGPSSPRVPVVRLSGRSLGWLSVRTSHLILMGLCKILSVKLTFFHDSEYTLIIGNWKI

SEQ ID NO: 6351 - protein, 194 aa, Homo sapiens
MKLASGFLVLWLSLGGGLAQSDTSPDTEESYSDWGLRHLRGSFESVNSYFDSFLELLGGKNGVCQYRCRYGKAPMPRPGYKPQEPNGCGSYFLGLKVPESMDLGIPAMTKCCNQLDVCYDTCGANKYRCDAKFRWCLHSICSDLKRSLGFVSKVEACDSLVDTVFNTVWTLGCRPFMNSQRAACICAEEEKEEL

SEQ ID NO: 6352 - protein, 162 aa, Homo sapiens
  SITE (66): Xaa equals any amino acid
MLIYWLQSSFILSAFVLINSPVTTGIQKSCCKFFPVSINLCFASLHRMKVVTLVALQWLNIALRSXLEEVQQAADGMTIKGSKVQVSFCAPGAPGRSTLAALIAAQRVMHSNQKGLLPEPNPVQIMKSLNNPAMLQVLLQAPSYVDELLNQPFLEHLTACHI

SEQ ID NO: 6353 - protein, 79 aa, Homo sapiens
MTLMCLCLSVTVLHPLRSKERLSGTFCGYSSSWCSPASESSSPGSLLTCAASGSHPDCPLSQRLLGVQLAALGRPQGLF

SEQ ID NO: 6354 - protein, 42 aa, Homo sapiens
  SITE (9): Xaa equals any amino acid
  SITE (15): Xaa equals any amino acid
  SITE (18): Xaa equals any amino acid
  SITE (22): Xaa equals any amino acid
  SITE (28): Xaa equals any amino acid
  SITE (29): Xaa equals any amino acid
  SITE (30): Xaa equals any amino acid
  SITE (32): Xaa equals any amino acid
  SITE (40): Xaa equals any amino acid
MLFLVFSLXLLKPLXFFXFGGXRIVNIXXXQXQHHAEGKXGS

SEQ ID NO: 6355 - protein, 55 aa, Homo sapiens
MSHCTWPVCLFCLVPPPMGDLKEVCLPHRCPGRTACCSYSEPHLQTEEDRRTLIC

SEQ ID NO: 6356 - protein, 77 aa, Homo sapiens
  SITE (69): Xaa equals any amino acid
MTGQIPRLSKVNLFTLLSLWMELFPAEAQRQKSQKNEEGKHGPLGDNEERTRVSTDKRQDYWEQLRCLXERFTITAG

SEQ ID NO: 6357 - protein, 115 aa, Homo sapiens
MAGTVLGVGAGVFILALLWVAVLLLCVLLSRASGAARFSVIFLFFGAVIITSVLLLFPRAGEFPAPEVEVKIVDDFFIGRYVLLAFLSAIFLGGLFLVLIHYVLEPIYAKPLHSY

SEQ ID NO: 6358 - protein, 51 aa, Homo sapiens
MWWWLMLATTALKPIATSSSCTEALPGLWRDRHWGDWTRGSGWEVGQTWQH

SEQ ID NO: 6359 - protein, 56 aa, Homo sapiens
MTFLLQWFPLGRARVVGDLCGFSTQIHPGVSRAGMADLESPPFPRTCSVPRAANKG

SEQ ID NO: 6360 - protein, 275 aa, Homo sapiens
MGNFRGHALPGTFFFIIGLWWCTKSILKYICKKQKRTCYLGSKTLFYRLEILEGITIVGMALTGMAGEQFIPGGPHLMLYDYKQGHWNQLLGWHHFTMYFFFGLLGVADILCFTISSLPVSLTKLMLSNALFVEAFIFYNHTHGREMLDIFVHQLLVLVVFLTGLVAFLEFLVRNNVLLELLRSSLILLQGSWFFQIGFVLYPPSGGPAWDLMDHENILFLTICFCWHYAVTIVIVGMNYAFITWLVKSRLKRLCSSEVGLLKNAEREQESEEEM

SEQ ID NO: 6361 - protein, 76 aa, Homo sapiens [sequence omitted]

SEQ ID NO: 6362 - protein, 69 aa, Homo sapiens
MLLSKEHTSLGWLVIFLTLASQLISYGSRTGNSRCPPCLYRTLHTVSTSHVLSSLFVSTFSGDELVWTT

SEQ ID NO: 6363 - protein, 130 aa, Homo sapiens
METLGALLVLEFLLLSPVEAQQATEHRLKPWLVGLAAVVGFLFIVYLVLLANRLWCSKARAEDEEETTFRMESNLYQDQSEDKREKKEAKEKEEKRKKEKKTAKEGESNLGLDLEEKEPGDHERAKSTVM

SEQ ID NO: 6364 - protein, 458 aa, Homo sapiens [sequence omitted]

SEQ ID NO: 6365 - protein, 21 aa, Homo sapiens
DLHIKLLEHYCLTSCKKVLQL

SEQ ID NO: 6366 - protein, 58 aa, Homo sapiens
MWPCCLDSLLFGFWLWAQGITLLSEDSIRIVCSSCEPEVLHVPTPVYRPCPSHSPLTF

SEQ ID NO: 6367 - protein, 222 aa, Homo sapiens [sequence omitted]

SEQ ID NO: 6368 - protein, 60 aa, Homo sapiens
MSHCARPTFLTLLLASCFWAAAIPNRNVILSVSFRPLHMQFTLSILVFILRILILLRSFL

SEQ ID NO: 6369 - protein, 97 aa, Homo sapiens
MILLLSLFQGVRGSLGSPGNRENKEKKVFISLVGSRGLGCSISSGPIQKPGIFISHVKPGSLSAEVGLEIGDQIVEVNGVDFSNLDHKELQLAGSCS

SEQ ID NO: 6370 - protein, 406 aa, Homo sapiens
MHPAVFLSLPDLRCSLLLLVTWVFTPVTTEITSLDTENIDEILNNADVALVNFYADWCRFSQMLHPIFEEASDVIKEEFPNENQVVFARVDCDQHSDIAQRYRISKYPTLKLFRNGMMMKREYRGQRSVKALADYIRQQKSDPIQEIRDLAEITTLDRSKRNIIGYFEQKDSDNYRVFERVANILHDDCAFLSAFGDVSKPERYSGDNIIYKPPGHSAPDMVYLGAMTNFDVTYNWIQDKCVPLVREITFENGEELTEEGLPFLILFHMKEDTESLEIFQNEVARQLISEKGTINFLHADCDKFRHPLLHIQKTPADCPVIAIDSFRHMYVFGDFKDVLIPGKLKQFVFDLHSGKLHREFHHGPDPTDTAPGEQAQDVASSPPESSFQKLAPSEYRYTLLRDRDEL

SEQ ID NO: 6371 - protein, 84 aa, Homo sapiens
MVWCQCLCPLCACWEEAQALWWPPLCTWPGEARGSGASLRLRPPLQNKLSPGVCLSLFLSPERNAGVPEASLQTKHPCTSYGSG

SEQ ID NO: 6372 - protein, 30 aa, Homo sapiens
MFAFVILVFITSMWAQTISLHVSSSEEVSC

SEQ ID NO: 6373 - protein, 43 aa, Homo sapiens
MLSFQKAILFLAMGCLPCIPQGLSCAFHPASFHKALSGCRTLI

SEQ ID NO: 6374 - protein, 44 aa, Homo sapiens
MTKRRKPRYRFIFALYALRLVFLFRAVTNTDASRLRAKRGECPY

SEQ ID NO: 6375 - protein, 70 aa, Homo sapiens
  SITE (67): Xaa equals any amino acid
MVSFVGICLLLGSFFSPSLQGTIWHHPAKPDGSGHGLPSFAVIMGKQVVPTVYWRMPYPRRGGPGTXFAL

SEQ ID NO: 6376 - protein, 74 aa, Homo sapiens [sequence omitted]

SEQ ID NO: 6377 - protein, 180 aa, Homo sapiens
MYSCLLLPDLLYLTLSPLVVAMLLTPHFNVANPQNLLAGLWLENEHSFTLMAPERARTHHCQPEERKVLFCLFPIVPNSQAQVQPPQMPPFCCAAAKEKTQEEQLQEPLGSQCPDTCPNSLCPSHTQLTKANTLSLFFFFSFFLSRVSLLSPRLECNGRILAHCNLHLPGSSNSPVSASR

SEQ ID NO: 6378 - protein, 73 aa, Homo sapiens
  SITE (29): Xaa equals any amino acid
MLVLFKFLPLTSSGRFSSVTLYHRVHHQXVFSQEAKSFSPASTLNLYICSSQFQSLQKLYCGVIPVLRYASIE

SEQ ID NO: 6379 - protein, 129 aa, Homo sapiens
MAPSGPLLLVLLVPLAAARAGPYFRPGRGCRLPLRGDQLSGLGRRTYPRPHEYLSPSDLPKSWDWRNVNGVNYASATRNQHIPQYCGSCWAHGSTSAMAGPDQHQEKGGVALHPAVRAARPRLRQRGLL

SEQ ID NO: 6380 - protein, 40 aa, Homo sapiens
MHIHLDTSSLKTLHLGTLFFLFYLALTQNEENICDGKVTL

SEQ ID NO: 6381 - protein, 59 aa, Homo sapiens
  SITE (15): Xaa equals any amino acid
MNCDVLWCVLLLVCXSLFSAVGHGLWIWRYQEKKSLFYVPKSDGSSLSPVTAAVNSFLT

SEQ ID NO: 6382 - protein, 78 aa, Homo sapiens
  SITE (7): Xaa equals any amino acid
  SITE (42): Xaa equals any amino acid
  SITE (43): Xaa equals any amino acid
MFGAHRXWQGSVLLFLSFAWGNGGSVTFSDVPRVMPLAGGPXXQVSSTPRPPPHQVTSSPGLESAHIVCPERKKKKKK

SEQ ID NO: 6383 - protein, 125 aa, Homo sapiens
MRWILILVIALWFIELLDVWSTCSQPICAKWTRTEAEGSKKSLSSEGHHMDLPDVVITSLPGSGAEILKQLFFNSSDFLYIRVPTAYIDIPETELEIDSFVDACEWKCQISAVGIFVYSEAGCSL

SEQ ID NO: 6384 - protein, 58 aa, Homo sapiens
MPFAWNDLTSLLFYLAGCFSSCRLGQGTPGSLPWTSNEEGIIQGPTPMFWNLTPFSGT

SEQ ID NO: 6385 - protein, 122 aa, Homo sapiens
MYRAIDSFPRWRSYFYFITLIFFLAWLVKNVFIAVIIETFAEIRVQFQQMWGSRSSTTSTATTQMFHEDAAGGWQLVAVDVNKPQGRAPACLQVQYNDIFKNRPAKVFEFYFIQENPQLFKL

SEQ ID NO: 6386 - protein, 9 aa, Homo sapiens
MSLQSRGSN

SEQ ID NO: 6387 - protein, 62 aa, Homo sapiens [sequence omitted]

SEQ ID NO: 6388 - protein, 45 aa, Homo sapiens
MRPVCSLGWAGWPGLVCGLRALLGPSLFPVTFGATEAVHSLDVCS

SEQ ID NO: 6389 - protein, 289 aa, Homo sapiens
MFVLLYVTSFAICASGQPRGNQLKGENYSPRYICSIPGLPGPPGPPGANGSPGPHGRIGLPGRDGRDGRKGEKGEKGTAGLRGKTGPLGLAGEKGDQGETGKKGPIGPEGEKGEVGPIGPPGPKGDRGEQGDPGLPGVCRCGSIVLKSAFSVGITTSYPEERLPIIFNKVLFNEGEHYNPATGKFICAFPGIYYFSYDITLANKHLAIGLVHNGQYRIKTFDANTGNHDVASGSTVIYLQPEDEVWLEIFFTDQNGLFSDPGWADSLFSGFLLYVDTDYLDSISEDDEL

SEQ ID NO: 6390 - protein, 312 aa, Homo sapiens [sequence omitted]

SEQ ID NO: 6391 - protein, 142 aa, Homo sapiens
MPRCRWLSLILLTIPLALVARKDPKKNETGVLRKLKPVNASNANVKQCLWFAMQEYNKESEDKYVFLVVKTLQAQLQVTNLLEYLIDVEIARSDCRKPLSTNEICAIQENSKLKRKLSCSFLVGALPWNGEFTVMEKKCEDA

SEQ ID NO: 6392 - protein, 190 aa, Homo sapiens [sequence omitted]

SEQ ID NO: 6393 - protein, 61 aa, Homo sapiens
MNASLISWVLVLHRICLGLSDIPKENCIITISGMQLSHHGQSLGKWAEKLHVFYSLFSFLL

SEQ ID NO: 6394 - protein, 230 aa, Homo sapiens
MASLGLQLVGYILGLLGLLGTLVAMLLPSWKTSSYVGASIVTAVGFSKGLWMECATHSTGITQCDIYSTLLGLPADIQAAQAMMVTSSAISSLACIISVVGMRCTVFCQESRAKDRVAVAGGVFFILGGLLGFIPVAWNLHGILRDFYSPLVPDSMKFEIGEALYLGIISSLFSLIAGIILCFSCSSQRNRSNYYDAYQAQPLATRSSPRPGQPPKVKSEFNSYSLTGYV

SEQ ID NO: 6395 - protein, 52 aa, Homo sapiens
MGPCRASRCLSLLVLFPPGVAGRPAPGRLHPVPTGPLPRMYSAGARGRHGAH

SEQ ID NO: 6396 - protein, 75 aa, Homo sapiens
MGPLWGAPLRAWAAGSVGCPCCLSCASPSSISSAGDPLASCSTCGSTWEIPLTWMTMDHLLVRYYLSQARWCTTG

SEQ ID NO: 6397 - protein, 742 aa, Homo sapiens
MAVRELCFPRQRQVLFLFLFWGVSLAGSGFGRYSVTEETEKGSFVVNLAKDLGLAEGELAARGTRVVSDDNKQYLLLDSHTGNLLTNEKLDREKLCGPKEPCMLYFQILMDDPFQIYRAELRVRDINDHAPVFQDKETVLKISENTAEGTAFRLERAQDPDGGLNGIQNYTISPNSFFHINISGGDEGMIYPELVLDKALDREEQGELSLTLTALDGGSPSRSGTSTVRIVVLDVNDNAPQFAQALYETQAPENSPIGFLIVKVWAEDVDSGVNAEVSYSFFDASENIRTTFQINPFSGEIFLRELLDYELVNSYKINIQAMDGGGLSARCRVLVEVLDTNDNPPELIVSSFSNSVAENSPETPLAVFKINDRDSGENGKMVCYIQENLPFLLKPSVENFYILITEGALDREIRAEYNITITVTDLGTPRLKTEHNITVLVSDVNNNAPAFTQTSYTLFVRENNSPALHIGSVSATDRDSGTNAQVTYSLLPPQDPHLPLASLVSINADNGHLFALRSLDYEALQAFEFRVGATDRGSPALNSEALGARAGAGRQRQLALRAVPAAERLRALHRAGAPGGRAGLPGDQGGGGGRRLGPERLAVVPAAQGHGARAVRCVGAQWGGAHRQAAERARRSQAQAGGACQGQWRASSLGHRHAARAPGGRLLPALPASPGGGPGPGPGRLAHRLPGGGVGLGVFALPPLGAPVRGGAAVQEEQGGLGGSLLGARGSFSRASGGREGR

SEQ ID NO: 6398 - protein, 150 aa, Homo sapiens
MGYLFFLLFMICWMIYGCISYWGLHCETTYTKDGFWTYITQIATCSPWMFWMFLNSVFHFMWVAVLLMCQMYQISCLGITTNERMNARRYKHFKVTTTSIESPFNHGCVRNIIDFFEFRCCGLFRPVIVDWTRQYTIEYDQISGSGYQLV

SEQ ID NO: 6399 - protein, 41 aa, Homo sapiens
MSGAWGSGFAGALWSMGLCASSVWGNSWDIDFCPRDSHGEW

SEQ ID NO: 6400 - protein, 178 aa, Homo sapiens
MQNDFGQVWRWVKEDSSYANVQDGFNGDTPLICACRRGHVRIVSFLLRRNANVNLKNQKERTCLHYAVKKKFTFIDYLLIILLMPVLLIGYFLMVSKTKQNEALVRMLLDAGVEVNATDCYGCTALHYACEMKNQSLIPLLLEARADPTIKNKHGESSLDIARRLKFSQIELMLRKAL

SEQ ID NO: 6401 - protein, 183 aa, Homo sapiens [sequence omitted]

SEQ ID NO: 6402 - protein, 435 aa, Homo sapiens
  SITE (249): Xaa equals any amino acid
  SITE (253): Xaa equals any amino acid
  SITE (317): Xaa equals any amino acid
  SITE (322): Xaa equals any amino acid
  SITE (356): Xaa equals any amino acid
MPLFLLSLPTPPSASGHERRQRPEAKTSGSEKKYLRAMQANRSQLHSPPGTGSSEDASTPQCVHTRLTGEGSCPHSGDVHIQINSIPKECAENASSRNIRSGVHSCAHGCVHSRLRGHSHSEARLTDDTAAESGDHGSSSFSEFRYLFKWLQKSLPYILILSVKLVMQHITGISLGIGLLTTFMYANKSIVNQVFLRERSSKIQCAWLLVFLAGSSVLLYYTFHSQSLYYSLIFLNPTLDHLSFWEVFXIVGXTDFILKFFFMGLKCLILLVPSFIMPFKSKGYWYMLLEELCQYYRTFVPIPVWFRYLISYGEFGXVTRWXLGILLALLYLILKLLEFFGHLRTFRQVLRIFFTXPSYGVAASKRQCSDVDDICSICQAEFQKPILLICQHIFCEECMTLWFNREKTCPLCRTVISDHINKWKDGATSSHLQIY

SEQ ID NO: 6403 - protein, 261 aa, Homo sapiens [sequence omitted]

SEQ ID NO: 6404 - protein, 60 aa, Homo sapiens
MRGCVPAFLLHVLSLRRACCTQAAQVFTAQLPGRQVARRRGGWHEQQGGPMLCSSHHSRT

SEQ ID NO: 6405 - protein, 182 aa, Homo sapiens; identical to SEQ ID NO: 6329

SEQ ID NO: 6406 - protein, 39 aa, Homo sapiens
MPCVFCYLLLLVQFTYTFTLSNPNSSSRPDSDFNFLKAI

SEQ ID NO: 6407 - protein, 78 aa, Homo sapiens [sequence omitted]

SEQ ID NO: 6408 - protein, 84 aa, Homo sapiens
MEVWHGLVIAVVSLFLQACFLTAINYLLSRHMGNWLSILFPPSHSQRPFSSLQQDRPFGVPKRHSKTTRGPTGQIPSHRSPSPQ

SEQ ID NO: 6409 - protein, 55 aa, Homo sapiens [sequence omitted]

SEQ ID NO: 6410 - protein, 38 aa, Homo sapiens
MTMVLCIFILGHHAREDPPSNGHITSEGAFLVNVGAPQ

SEQ ID NO: 6411 - protein, 153 aa, Homo sapiens
  SITE (68): Xaa equals any amino acid
  SITE (72): Xaa equals any amino acid
  SITE (83): Xaa equals any amino acid
  SITE (103): Xaa equals any amino acid
  SITE (110): Xaa equals any amino acid
  SITE (121): Xaa equals any amino acid
  SITE (123): Xaa equals any amino acid
  SITE (126): Xaa equals any amino acid
  SITE (134): Xaa equals any amino acid
MTKARLFRLWLVLGSVFMILLIIVYWDSAGAAHFYLHTSFSRPHTGPPLPTPGPDRDRELTADSDVDXFLDXFLSAGVKQSDXPRKETEQPPAPGSMEESVRXYDWSPRXARRTQTRAGSXRXGGXCCGASAPXPAWPSPPRSAHSTTSPTRS

SEQ ID NO: 6412 - protein, 637 aa, Homo sapiens
MIAELVSSALGLALYLNTLSADFCYDDSRAIKTNQDLLPETPWTHIFYNDFWGTLLTHSGSHKSYRPLCTLSFRLNHAIGGLNPWSYHLVNVLLHAAVTGLFTSFSKILLGDGYWTFMAGLMFASHPIHTEAVAGIVGRADVGASLFFLLSLLCYIKHCSTRGYSARTWGWFLGSGLCAGCSMLWKEQGVTVLAVSAVYDVFVFHRLKIKQILPTIYKRKNLSLFLSISLLIFWGSSLLGARLYWMGNKPPSFSNSDNPAADSDSLLTRTLTFFYLPTKNLWLLLCPDTLSFDWSMDAVPLLKTVCDWRNLHTVAFYTGLLLLAYYGLKSPSVDRECNGKTVTNGKQNANGHSCLSDVEYQNSETKSSFASKVENGIKNDVSQRTQLPSTENIVVLSLSLLIIPFVPATNLFFYVGFVIAERVLYIPSMGFCLLITVGARALYVKVQKRFLKSLIFYATATLIVFYGLKTAIRNGDWQNEEMLYRSGIKVNPAKAWGNLGNVLKSQSKISEAESAYRNALYYRSNMADMLYNLGLLLQENSRFAEALHYYKLAIGSRPTLASAYLNTGIILMNQGRTEEARRTFLKCSEIPDENLKDPHAHKSSVTSCLYNLGKLYHEQGHYEVWPMPLCPFPSPLF

SEQ ID NO: 6413 - protein, 84 aa, Homo sapiens
  SITE (5): Xaa equals any amino acid
  SITE (48): Xaa equals any amino acid
MGFSXVGCGRGDDALFLIFDLFFQLDFFPGLFLGPAAFVIPRPGPRPXTSSAGAPPAVGSGCDRAEVLSGTLGSQPGDSEPRGR

SEQ ID NO: 6414 - protein, 227 aa, Homo sapiens
MVLTATVLNVYASIFLITALSVARYWVVAMAAGPGTHLSLFWARIATLAVWAAAALVTVPTAVFGVEGEVCGVRLCLLRFPSRSWLGAYQLQRVVLAFMVPLGVITTSYLLLLAFLQRRQRRRQDSRVVARSVRILVASFFLCWFPNHVVTLWGVLVQFALVPWISTFYTLQPYVFPVTTCLAHSNSCLNPIAYVLSRIPAHWRPLLVDPSSVPSLMHSLSIHSAPK

SEQ ID NO: 6415 - protein, 79 aa, Homo sapiens
MGLCEASCSSLDNALPVHSVLVVSVSSSVFTGLGSCYSPCLFPECLRVTEMKKPLGSRKCGLALIWFGFVSPPKSHLEL

SEQ ID NO: 6416 - protein, 125 aa, Homo sapiens
MRPGKKVLVMGIVDLNPESFAISLTCGDSEDPPADVAIELKAVFTDRQLLRNSCISGERGEEQSAIPYFPFIPDQPFRVEILCEHPRFRVFVDGHQLFDFYHRIQTLSAIDTIKINGDLQITKLG

SEQ ID NO: 6417 - protein, 151 aa, Homo sapiens
MLHWVLSFFFLLSCPRTEGLPGLYCPGCSQCPGRGMWPGDPGPGIQGPGLDLRTGMEATGAQQPTLSSPHCLLSLPTLPARAVQLRWDLSISRAGGRVAVLGLCLEPGGSLLLPPSALPETDPCAACPPCPFVPMSGGGGRPTVPEAGHQP

SEQ ID NO: 6418 - protein, 299 aa, Homo sapiens
MGTKAQVERKLLCLFILAILLCSLALGSVTVHSSEPEVRIPENNPVKLSCAYSGFSSPRVEWKFDQGDTTRLVCYNNKITASYEDRVTFLPTGITFKSVTREDTGTYTCMVSEEGGNSYGEVKVKLIVLVPPSKPTVNIPSSATIGNRAVLTCSEQDGSPPSEYTWFKDGIVMPTNPKSTRAFSNSSYVLNPTTGELVFDPLSASDTGEYSCEARNGYGTPMTSNAVRMEAVERNVGVIVAAVLVTLILLGILVFGIWFAYSRGHFDRTKKGTSSKKVIYSQPSARSEGEFKQTSSFLV

SEQ ID NO: 6419 - protein, 225 aa, Homo sapiens
  SITE (66): Xaa equals any amino acid
  SITE (101): Xaa equals any amino acid
MIHVRHCTPIPALLVCCGATAVIMLVGDTYTLINYVSFINYLCYGVTILGLLLLRWRRPALHRPIXVNLLIPVAYLVFWAFLLVFSFISEPMVCGVGVIIXLTGVPIFFLGVFWRSKPKCVHRLTESMTHWGQELCFVVYPQDAPEEEENAPAHPPCCLPQTSPRSHNEIFVETEAVVSVYMLFIEEVFWQKSFVLFFSGKKRKKIRLSEACFKEALKCGLGFLS

SEQ ID NO: 6420 - protein, 60 aa, Homo sapiens
MSHHARPYKAFRIVSCYFYLFIIVVVIILLLYPISQGWHVANIVFLKNISDHILVLLKTF

SEQ ID NO: 6421 - protein, 79 aa, Homo sapiens
MAAFFALAALVQVVYTIPAVLTLLVGLNPEVTGNVIWKSISAIHILFCTVWAVGLASYLLHRTQQNILHEEEGRSCLVW

SEQ ID NO: 6422 - protein, 41 aa, Homo sapiens
MAIWKLISIYFMFATWLYSISPKLKNNLPGLQDPKETCLME

SEQ ID NO: 6423 - protein, 348 aa, Homo sapiens
MKEDCLPSSHVPISDSKSIQKSELLGLLKTYNCYHEGKSFQLRHREEEGTLIIEGLLNIAWGLRRPIRLQMQDDREQVHLPSTSWMPRRPSCPLGCWSLLLGLSSLSLPAAISALQLSVFRKEPSPQNGNITAQGPSIQPVHKAESSTDSSGPLEEAEEAPQLMRTKSDASCMSQRRPKCRAPGEAQRIRRHRFSINGHFYNHKTSVFTPAYGSVTNVRVNSTMTTLQVLTLLLNKFRVEDGPSEFALYIVHESGERTKLKDCEYPLISRILHGPCEKIARIFLMEADLGVEVPHEVAQYIKFEMPVLDSFVEKLKEEEEREIIKLTMKFQALRLTMLQRLEQLVEAK

SEQ ID NO: 6424 - protein, 43 aa, Homo sapiens
MAARGRSGVGPPGFLRALALLQLSCGFYWACSRGWMVRGTPHP

SEQ ID NO: 6425 - protein, 40 aa, Homo sapiens [sequence omitted]

SEQ ID NO: 6426 - protein, 47 aa, Homo sapiens
MTLYLSLLNMIPLNLASCSSHLELLKKLIMSYRVFTFPIPDTCHLHI

SEQ ID NO: 6427 - protein, 43 aa, Homo sapiens [sequence omitted]

SEQ ID NO: 6428 - protein, 75 aa, Homo sapiens
MLAAELICCPSLHIFFFAAFSLWQCTVLTMPFKNVPYCISILRRDRTKKYIAQIIFYFIDNDKEYFLNPIKIDFN

SEQ ID NO: 6429 - protein, 58 aa, Homo sapiens [sequence omitted]

SEQ ID NO: 6430 - protein, 59 aa, Homo sapiens [sequence omitted]

SEQ ID NO: 6431 - protein, 47 aa, Homo sapiens
MRLSRAAHNLQTILYSVFCLCLHVAMMDRSPSSILALWRSGSCSVEI

SEQ ID NO: 6432 - protein, 57 aa, Homo sapiens
MTLPWEWVPDKRIWLLSLTLVHALLPLCLLPWDVGARSPFISGEPINLGFPNLQNCK

SEQ ID NO: 6433 - protein, 401 aa, Homo sapiens
MVALRGASALLVLFLAAFLPPPQCTQDPAMVHYIYQRFRVLEQGLEKCTQATRAYIQEFQEFSKNISVMLGRCQTYTSEYKSAVGNLALRVERAQREIDYIQYLREADECIESEDKTLAEMLLQEAEEEKKIRTLLNASCDNMLMGIKSLKIVKKMMDTHGSWMKDAVYNSPKVYLLIGSRNNTVWEFANIRAFMEDNTKPAPRKQILTLSWQGTGQVIYKGFLFFHNQATSNEIIKYNLQKRTVEDRMLLPGGVGRALVYQHSPSTYIDLAVDEHGLWAIHSGPGTHSHLVLTKIEPGTLGVEHSWDTPCRSQDAEASFLLCGVLYVVYSTGGQGPHRITCIYDPLGTISEEDLPNLFFPKRPRSHSMIHYNPRDKQLYAWNEGNQIIYKLQTKRKLTLK

SEQ ID NO: 6434 - protein, 33 aa, Homo sapiens
MKSVIFIQSVILFFLPMSGDHQGISGLDELPQA

SEQ ID NO: 6435 - protein, 58 aa, Homo sapiens
MSSFLRVIFIPNIKVIFLPPGTTSLIHTMDQGVIAAFKFYYLRREDFCPVPYCSGGRH

SEQ ID NO: 6436 - protein, 45 aa, Homo sapiens [sequence omitted]

SEQ ID NO: 6437 - protein, 43 aa, Homo sapiens
MKLPWNIVNILKASALYALKWLLLILYYVIFTLKKEKIALLYT

SEQ ID NO: 6438 - protein, 94 aa, Homo sapiens
MHFISFLYPIALATTSSTVLNRSGECGHPCLVPVLRENAFSLSPFGMMFAVGLSYMAFFTLRYVPSVPILLRVFIIQECWILSNAFSASGEMII

SEQ ID NO: 6439 - protein, 123 aa, Homo sapiens [sequence omitted]

SEQ ID NO: 6440 - protein, 75 aa, Homo sapiens
  SITE (66): Xaa equals any amino acid
  SITE (73): Xaa equals any amino acid
MKPTLSKFLGTDAELPKLYPPSLQAPRGETQLLGPGLERPTREGRVEQMLFNQKSVSWGSQLPQSXNTFLKNXDP

SEQ ID NO: 6441 - protein, 82 aa, Homo sapiens
MRPGRGAGTPGRPGRGRGLAATCSLSSPSHLLPTLLHTFSFSLPPPSPAAPRQPSPPALLLPGPQKPRPGDPTYTGALTDWS

SEQ ID NO: 6442 - protein, 354 aa, Homo sapiens
  SITE (98): Xaa equals any amino acid
  SITE (100): Xaa equals any amino acid
  SITE (109): Xaa equals any amino acid
  SITE (123): Xaa equals any amino acid
  SITE (129): Xaa equals any amino acid
  SITE (131): Xaa equals any amino acid
  SITE (159): Xaa equals any amino acid
  SITE (169): Xaa equals any amino acid
  SITE (171): Xaa equals any amino acid
  SITE (172): Xaa equals any amino acid
  SITE (175): Xaa equals any amino acid
  SITE (183): Xaa equals any amino acid
  SITE (188): Xaa equals any amino acid
  SITE (189): Xaa equals any amino acid
  SITE (225): Xaa equals any amino acid
  SITE (229): Xaa equals any amino acid
  SITE (231): Xaa equals any amino acid
MEDGVLKEGFLVKRGHIVHNWKARWFILRQNTLVYYKLEGGRRVTPPKGRILLDGCTITCPCLEYENRPLLIKLKTQTSTEYFLEACSREEAGCLGLXRXPGLFMQGSXGKVQQLHSLRNSFXLPPHIXLXRIVDKMHDSNTGIRSSPNMEQRSTYKKXFLGSSLVDWXIXXSFXGSRLEAVXLASMXXEENFLRSVAVRCMGGIRSGDLAEQFLDDSTALYTFXESYXKXISPKEEISLSTVELSGTVVKQGYLAKQGHKRKNWKVRRFVLRKDPAFLHYYDPSKEENRPVGGFSLRGSLVSALEDNGVPTGVKGNVQGNLFKVITKDDTHYYIQASSKAERAEWIEAIKKLT

SEQ ID NO: 6443 - protein, 66 aa, Homo sapiens
  SITE (63): Xaa equals any amino acid
MTWKGWSRTRIWKPSLPQLFTMYLLAQIRAASRASEDSCSYSSDTMWPQSGNSSTFAFFRPRXKMR

SEQ ID NO: 6444 - protein, 130 aa, Homo sapiens [sequence omitted]

SEQ ID NO: 6445 - protein, 98 aa, Homo sapiens
  SITE (45): Xaa equals any amino acid
MLRLEARATTPGLQTHSCLGFYIKYEHKNTFPKYSLWLCLTLGTXPSTSSILRYVRGVYRGLEYIRFFSNSSSSRRRLTTSLGFKVSGLKFPPEITIR

SEQ ID NO: 6446 - protein, 54 aa, Homo sapiens [sequence omitted]

SEQ ID NO: 6447 - protein, 14 aa, Homo sapiens
TLTSFLELPLAPEP

SEQ ID NO: 6448 - protein, 43 aa, Homo sapiens [sequence omitted]

SEQ ID NO: 6449 - protein, 40 aa, Homo sapiens
MNSCLFLCILILESAMVVLMKVHFIVAFELTAKAINQKQK

SEQ ID NO: 6450 - protein, 33 aa, Homo sapiens
MKVNLNINLLIIKSLSASAGAMNSEWEIASGEW

SEQ ID NO: 6451 - protein, 37 aa, Homo sapiens [sequence omitted]

SEQ ID NO: 6452 - protein, 89 aa, Homo sapiens [sequence omitted]

SEQ ID NO: 6453 - protein, 31 aa, Homo sapiens
MQPCVISWEQCSFVSPRGPHVYICFHDQRRF

SEQ ID NO: 6454 - protein, 93 aa, Homo sapiens
MPRATLWGHLSPAWVLVPWTPRACGQAAPGRGHVASDHKSGLPWPKHCSCLHPRASQPCLFSLNSNRTVFTAIQRVALGWTFWVQANLVPRCT

SEQ ID NO: 6455 - protein, 76 aa, Homo sapiens [sequence omitted]

SEQ ID NO: 6456 - protein, 248 aa, Homo sapiens
MAMLPLVLHWFFIEWYSGKKSSSALFQHITALFECSMAAIITLLVSDPVGVLYIRSCRVLMLSDWYTMLYNPSPDYVTTVHCTHEAVYPLYTIVFIYYAFCLVLMMLLRPLLVKKIACGLGKSDRFKSIYAALYFFPILTVLQAVGGGLLYYAFPYIILVLSLVTLAVYMSASEIENCYDLLVRKKRLIVLFSHWLLHAYGIISISRVDKLEQDLPPLALVPTPALFYLFTAKFTEPSRILSEGANGH

SEQ ID NO: 6457 - protein, 60 aa, Homo sapiens [sequence omitted]

SEQ ID NO: 6458 - protein, 283 aa, Homo sapiens
MAELAKELPQVSFVKLEAEGVPEVSEKYEISSVPTFLFFKNSQKIDRLDGAHAPELTKKVQRHASSGSFLPSANEHLKEDLNLRLKKLTHAAPCMLFMKGTPQEPRCGFSKQMVEILHKHNIQFSSFDIFSDEEVRQGLKAYSSWPTYPQLYVSGELIGGLDIIKELEASEELDTICPKAPKLEERLKVLTNKASVMLFMKGNKQEAKCGFSKQILEILNSTGVEYETFDILEDEEVRQGLKAYSNWPTYPQLYVKGELVGGLDIVKELKENGELLPILRGEN

SEQ ID NO: 6459 - protein, 155 aa, Homo sapiens
  SITE (108): Xaa equals any amino acid
  SITE (113): Xaa equals any amino acid
MMARQTGVFYLTLVLILVTSGLFFAFDCPYLAVKITPAIPAVAGILFFFVMGTLLRTSFSDPGVLPRATPDEAADLERQIGNTESLPMASGHFPPGPSYSGEGRPRAXQEELXAGKEGGQKSAFLSSLGGQDELKKRCDIRLEGQVSWRQDCRPT

SEQ ID NO: 6460 - protein, 85 aa, Homo sapiens [sequence omitted]

SEQ ID NO: 6461 - protein, 31 aa, Homo sapiens
MKKQSKRCLWKPPGSLRRLWWMRALLILKYI

SEQ ID NO: 6462 - protein, 48 aa, Homo sapiens
  SITE (6): Xaa equals any amino acid
  SITE (38): Xaa equals any amino acid
MQAPFXHFSFRMFSNLYCFSDFQPNISPCPLCHCILPXHHHVFLLLAV

SEQ ID NO: 6463 - protein, 48 aa, Homo sapiens
MLCFLPIPLLSILSPQTQASRLLDETVRRKHFLTYPFGISSIITQALL

SEQ ID NO: 6464 - protein, 126 aa, Homo sapiens [sequence omitted]

SEQ ID NO: 6465 - protein, 89 aa, Homo sapiens
MCVCYFLVFLQIWARLSHLLVWIYPGAGLQPGKGHPAQSLFPHEHCHLMPQHSLTLKILEEKLGGKGESGSNFTFLHCKILATSALNFS

SEQ ID NO: 6466 - protein, 62 aa, Homo sapiens
MFLVFFLSFFSHSISALTLVCSQGGKADMNLLSWDFRPHWLEGIRFLLGWGQALMAGLFPWL

SEQ ID NO: 6467 - protein, 174 aa, Homo sapiens
VVFGASLFLLLSLTVFSIVSVTAYIALALLSVTISFRIYKGVIQAIQKSDEGHPFRAYLESEVAISEELVQKYSNSALGHVNCTIKELRRLFLVDDLVDSLKFAVLMWVFTYVGALFNGLTLLILALISLFSVPVIYERHQAQIDHYLGLANKNVKDAMAKIQAKIPGLKRKAE

SEQ ID NO: 6468 - protein, 198 aa, Homo sapiens
  SITE (29): Xaa equals any amino acid
MKKSLENLNRLQVMLLHLTAAFLQRAQHXFDYKDESGFPKPPSYNVATTLPSYDEAERTKAEATIPLVPGRDEDFVGRDDFDDADQLRIGNDGIFMLTFFMAFLFNWIGFFLSFCLTTSAAGRYGAISGFGLSLIKWILIVRFSTYFPGYFDGQYWLWWVFLVLGFLLFLRGFINYAKVRKMPETFSNLPRTRVLFIY

SEQ ID NO: 6469 - protein, 760 aa, Homo sapiens
  SITE (267): Xaa equals any amino acid
  SITE (315): Xaa equals any amino acid
  SITE (438): Xaa equals any amino acid
MIPNQHNAGAGSHQPAVFRMAVLDTDLDHILPSSVLPPFWAKLVVGSVAIVCFARSYDGDFVFDDSEAIVNNKDLQAETPLGDLWHHDFWGSRLSSNTSHKSYRPLTVLTFRINYYLSGGFHPVGFHVVNILLHSGISVLMVDVFSVLFGGLQYTSKGRRLHLAPRASLLAALLFAVHPVHTECVAGVVGRADLLCALFFLLSFLGYCKAFRESNKEGAHSSTFWVLLSIFLGAVAMLCKEQGITVLGLNAVFDILVIGKFNVLEIXQKVLHKDKSLENLGMLRNGGLLFRMTLLTSGGAGMLYVRWRIMGTGPXAFTEVDNPASFADSMLVRAVNYNYYYSLNAWLLLCPWWLCFDWSMGCIPLIKSISDWRVIALAALWFCLIGLICQALCSEDGHKRRILTLGLGFLVIPFLPASNLFFRVGFVVAERVLYLPSXGYCVLLTFGFGALSKHTKKKKLIAAVVLGILFINTLRCVLRSGEWRSEEQLFRSALSVCPLNAKVHYNIGKNLADKGNQTAAIRYYREAVRLNPKYVHAMNNLGNILKERNELQEAEELLSLAVQIQPDFAAAWMNLGIVQNSLKRFEAAEQSYRTAIKHRRKYPDCYYNLGRLYADLNRHVDALNAWRNATVLKPEHSLAWNNMIILLDNTGNLAQAEAVGREALELIPNDHSLMFSLANVLGKSQKYKESEALFLKAIKANPNAASYHGNLAVLYHRWGHLDLAKKHYEISLQLDPTASGTKENYGLLRRKLELMQKKAV

SEQ ID NO: 6470 - protein, 44 aa, Homo sapiens
MKKHTKCQWLKMTILFLTVMKIGYGTSASCYRPEVLGLLMPHPL

SEQ ID NO: 6471 - protein, 57 aa, Homo sapiens
MVSLLSSYLLLLELLSKRSLFLQWYLFFGLQCCSSFLCRKNESQCFTRLKERSAGSV

SEQ ID NO: 6472 - protein, 72 aa, Homo sapiens
MLRPALPWLYLGLCSLLVGEAEAPSPVDPLERSRPYAVLRGQNLVLMGTIFSILLVTVILMAFCVYKPIRRR

SEQ ID NO: 6473 - protein, 311 aa, Homo sapiens
  SITE (256): Xaa equals any amino acid
MGVMAMLMLPLLLLGISGLLFIYQEVSRLWSKSAVQNKVVVITDAISGLGKECARVFHTGGARLVLCGKNWERLENLYDALISVADPSKTFTPKLVLLDLSDISCVPDVAKEVLDCYGCVDILINNASVKVKGPAHKISLELDKKIMDANYFGPITLTKALLPNMISRRTGQIVLVNNIQGKFGIPFRTTYAASKHAALGFFDCLRAEVEEYDVVISTVSPTFIRSYHVYPEQGNWEASIWKFFFRKLTYGVHPVXVAEEVMRTVRRKKQEVFMANPIPKAAVYVRTFFPEFFFAVVACGVKEKLNVPEEG

SEQ ID NO: 6474 - protein, 464 aa, Homo sapiens
MVRLAAELLLLLGLLLLTLHITVLRGSGAADGPDAAAGNASQAQLQNNLNVGSDTTSETSFSLSKEAPREHLDHQAAHQPFPRPRFRQETGHPSLQRDFPRSFLLDLPNFPDLSKADINGQNPNIQVTIEVVDGPDSEADKDQHPENKPSWSVPSPDWRAWWQRSLSLARANSGDQDYKYDSTSDDSNFLNPPRGWDHTAPGHRTFETKDQPEYDSTDGEGDWSLWSVCSVTCGNGNQKRTRSCGYACTATESRTCDRPNCPGIEDTFRTAATEVSLLAGSEEFNATKLFEVDTDSCERWMSCKSEFLKKYMHKVMNDLPSCPCSYPTEVAYSTADIFDRIKRKDFRWKDASGPKEKLEIYKPTARYCIRSMLSLESTTLAAQHCCYGDNMQLITRGKGAGTPNLISTEFSAELHYKVDVLPWIICKGDWSRYNEARPPNNGQKCTESPSDEDYIKQFQEAREY

SEQ ID NO: 6475 - protein, 123 aa, Homo sapiens
  SITE (114): Xaa equals any amino acid
MRGSWHRSPLPAVVLPSVLQTALSPLALCQAWRRAVPHGVPSQRLRNQEASLVPKGVPRAWYPGPLQNGLWTHLEKGELLGLKPTPGGLLLLRSFWDPHPSRPFLCTLLPPPLXIFPPLRCSA

SEQ ID NO: 6476 - protein, 63 aa, Homo sapiens
MFILLIVFVFSKSKQVLSICLKIFKVEINSISFCKNKKYKDLPYAFASEKTGRTYSNVNNDYL

SEQ ID NO: 6477 - protein, 37 aa, Homo sapiens
MWQHCFVILFVQVMHTVLIKGSNKYWGLFFFFPQGIL

SEQ ID NO: 6478 - protein, 63 aa, Homo sapiens [sequence omitted]

SEQ ID NO: 6479 - protein, 85 aa, Homo sapiens
MQNQSSTNHPGASIALSRPSLNKDFRDHAEQQHIAAQQKAALQHAHAHSSGYFITQDSAFGNLFFLFYLALTQNEENICDGKVTL

SEQ ID NO: 6480 - protein, 36 aa, Homo sapiens
MFFGAPTAGAVQVWLLLLSPAASPVEELSVLVPCGQ

SEQ ID NO: 6481 - protein, 71 aa, Homo sapiens
  SITE (31): Xaa equals any amino acid
  SITE (44): Xaa equals any amino acid
  SITE (48): Xaa equals any amino acid
  SITE (49): Xaa equals any amino acid
  SITE (64): Xaa equals any amino acid
  SITE (70): Xaa equals any amino acid
MPSPKYCMHTNDVQSVEYNGDTLFQKLSSSXLSFKSIHIYPNEXKTCXXIFISKVYMISKTWKXPRFTSXG

SEQ ID NO: 6482 - protein, 43 aa, Homo sapiens
MYSLFLTCIFPFTLCHKKILMVIHDFTGPVHVFPEKTVLEWNY

SEQ ID NO: 6483 - protein, 670 aa, Homo sapiens
MIASCLCYLLLPATRLFRALSDAFFTCRKNVLLANSSSPQVEGDFAMAPRGPEQEECEGLLQQWREEGLSQVLSTASEGPLIDKGLAQSSLALLMDNPGEENAASEDRWSSRQLSDLRAAENLDEPFPEMLGEEPLLEVEGVEGSMWAAIPMQSEPQYADCAALPVGALATEQWEEDPAVLAWSIAPEPVPQEEASIWPFEGLGQLQPPAVEIPYHEILWREWEDFSTQPDAQGLKAGDGPQFQFTLMSYNILAQDLMQQSSELYLHCHPDILNWNYRFVNLMQEFQHWDPDILCLQEVQEDHYWEQLEPSLRMMGFTCFYKRRTGCKTDGCAVCYKPTRFRLLCASPVEYFRPGLELLNRDNVGLVLLLQPLVPEGLGQVSVAPLCVANTHILYNPRRGDVKLAQMAILLAEVDKVARLSDGSHCPIILCGDLNSVPDSPLYNFIRDGELQYHGMPAWKVSGQEDFSHQLYQRKLQAPLWPSSLGITDCCQYVTSCHPKRSERRKYGRDFLLRFRFCSIACQRPVGLVLMEGVTDTKPERPAGWAESVLEEDASELEPAFSRTVGTIQHCLHLTSVYTHFLPQRGRPEVTTMPLGLGMTVDYIFFSAESCENGNRTDHRLYRDGTLKLLGRLSLLSEEILWAANGLPNPFCSSDHLCLLASFGMEVTAP

SEQ ID NO: 6484 - protein, 609 aa, Homo sapiens
MEGKPMRRCTNIRPGETGMDVTSRCTLGDPNKLPEGVPQPARMPYISDKHPRQTLEVINLLRKHRELCDVVLVVGAKKIYAHRVILSACSPYFRAMFTGELAESRQTEVVIRDIDERAMELLIDFAYTSQITVEEGNVQTLLPAACLLQLAEIQEACCEFLKRQLDPSNCLGIRAFADTHSCRELLRIADKFTQHNFQEVMESEEFMLLPANQLIDIISSDELNVRSEEQVFNAVMAWVKYSIQERRPQLPQVLQHVRLPLLSPKFLVGTVGSDPLIKSDEECRDLVDEAKNYLLLPQERPLMQGPRTRPRKPIRCGEVLFAVGGWCSGDAISSVERYDPQTNEWRMVASMSKRRCGVGVSVLDDLLYAVGGHDGSSYLNSVERYDPKTNQWSSDVAPTSTCRTSVGVAVLGGFLYAVGGQDGVSCLNIVERYDPKENKWTRVASMSTRRLGVAVAVLGGFLYAVGGSDGTSPLNTVERYNPQENRWHTIAPMGTRRKHLGCAVYQDMIYAVGGRDDTTELSSAERYNPRTNQWSPVVAMTSRRSGVGLAVVNGQLMAVGGFDGTTYLKTIEVFDPDANTWRLYGGMNYRRLGGGVGVIKMTHCESHIW

SEQ ID NO: 6485 - protein, 48 aa, Homo sapiens
MHMGLTTCKCHWKMAYLRFLILWSFPLSSAVSGAKRVTDLLNGKHWKP

SEQ ID NO: 6486 - protein, 44 aa, Homo sapiens
MKGWPVFLLVQAVTFLSVAQSGAMACAASGVVYSVDVPACSSRS

SEQ ID NO: 6487 - protein, 47 aa, Homo sapiens
MKMNKLFWIRILKLLLQALSQCKLLIKGQVAVPKDLIMDSEIAKVTN

SEQ ID NO: 6488 - protein, 192 aa, Homo sapiens
MSQQKCIVIFALVCCFAILVALIFSAVDIMGEDEDGLSEKNCQNKCRIALVENIPEGLNYSENAPFHLSLFQGWMNLLNMAKKSVDIVSSHWDLNHTHPSACQGQRLFEKLLQLTSQNIEIKLVSDVTADSKVLEALKLKGAEVTYMNMTAYNKGRLQSSFWIVDKQHVYIGSAGLDWQSLGQVHILLYSCK

SEQ ID NO: 6489 - protein, 94 aa, Homo sapiens
MIGYRLCLHLLSLLGFQPLPMGLCRVREQKFKQFSGLSHFSFRISPVTFPSYVHADSQPTRDKWVPWDLSSFTCMCAEASKSARNVWTALQTPL

SEQ ID NO: 6490 - protein, 146 aa, Homo sapiens
VPFTFQHDCEASPATWNYLRRMTAGFMGMAVAIILFGWIIGVLGCCWDRGLMQYVAGLLFLMGGTFCIISLCTCVAGINFELSRYPRYLYGLPDDISHGYGWSMFCAWGGLGLTLISGFFCTLAPSVQPVPRTNYPKSRPENGTVC

SEQ ID NO: 6491 - protein, 39 aa, Homo sapiens
MHNQRQVFLFHLFSNYLLSINSVPGTLLAATYCLNMTYG

SEQ ID NO: 6492 - protein, 37 aa, Homo sapiens
MHRYITFFKCFRSVILDLLFILSPFKSGMLYSILKHL

SEQ ID NO: 6493 - protein, 27 aa, Homo sapiens
MLNVFFSLILFFSPNRALPAISSCITF

SEQ ID NO: 6494 - protein, 66 aa, Homo sapiens
  SITE (14): Xaa equals any amino acid
  SITE (62): Xaa equals any amino acid
MFGFIFLLLIFCIXLCSRTLSTFIPKLVGFLYWKFSINLSLLLTLIKKKKKKKKTPRGGPGXQSPP

SEQ ID NO: 6495 - protein, 641 aa, Homo sapiens
  SITE (93): Xaa equals any amino acid
  SITE (469): Xaa equals any amino acid
  SITE (486): Xaa equals any amino acid
MRPVSVWQWSPWGLLLCLLCSSCLGSPSPSTGPEKKAGSQGLRFRLAGFPRKPYEGRVEIQRAGEWGTICDDDFTLQAAHILCRELGFTEATXWTHSAKYGPGTGRIWLDNLSCSGTEQSVTECASRGWGNSDCTHDEDAGVICKDQRLPGFSDSNVIEVEHHLQVEEVRIRPAVGWGRRPLPVTEGLVEVRLPDGWSQVCDKGWSAHNSHVVCGMLGFPSEKRVNAAFYRLLAQRQQHSFGLHGVACVGTEAHLSLCSLEFYRANDTARCPGGGPAVVSCVPGPVYAASSGQKKQQQSKPQGEARVRLKGGAHPGEGRVEVLKASTWGTVCDRKWDLHAASVVCRELGFGSAREALSGARMGQGMGAIHLSEVRCSGQELSLWKCPHKNITAEDCSHSQDAGVRCNLPYTGAETRIRLSGGRSQHEGRVEVQIGGPGPLRWGLICGDDWGTLEAMVACRQLGLGYANXGLQETWYWDSGNITEVXMSGVRCTGTELSLDQCAHHGTHITCKRTGTRFTAGVICSETASDLLLHSALVQETAYIEDRPLHMLYCAAEENCLASSARSANWPYGHRRLLRFSSQIHNLGRADFRPKAGRHSWVWHECHGHYHSMDIFTHYDILTPNGTKVAEGPQTSSVSKT

SEQ ID NO: 6496 - protein, 192 aa, Homo sapiens
  SITE (48): Xaa equals any amino acid
  SITE (49): Xaa equals any amino acid
  SITE (78): Xaa equals any amino acid
MWLLCVALAVLAWGFLWVWDSSERMKSREQGGRLGAESRTLLVIAHPXXEAMFFAPTVLGLARLRHWVYLLCFSAVFXRELSEYTEVLPLNPSQPRDRSGRLTWWVGGRRQLAYYASRIEEQRNSCSWLYSVPAFPLGTPPVLVILWNFFLFVEGARILTLLYSTRNNLCCIVPAQSLKLTSNDSKRPSCCL

SEQ ID NO: 6497 - protein, 82 aa, Homo sapiens; identical to SEQ ID NO: 5888

SEQ ID NO: 6498 - protein, 99 aa, Homo sapiens [sequence omitted]

SEQ ID NO: 6499 - protein, 48 aa, Homo sapiens
MSWPLCTLLFSWDCILAVKTSRLKFDSQGYILGTFKVSFQRDFINRLD

SEQ ID NO: 6500 - protein, 88 aa, Homo sapiens
MMFCFVLFLRWSLALLPGWLAVARSRLTAISCFLGLSDSPALASRVAGTTGAHHHARLVFCILVETVSPCWPGWSRSPDFVICLPQTP

SEQ ID NO: 6501 - protein, 74 aa, Homo sapiens
MSVVPVMIPFLLLLFFFSLSSTHHPHLLYFSIFIFSGSLLVRILSCRKESSHQVLLSRKCFIKGHRQHRQLTKV

SEQ ID NO: 6502 - protein, 32 aa, Homo sapiens
MHMWILSLHFIFTPRLVLCEVRPNKIVEDTII

SEQ ID NO: 6503 - protein, 262 aa, Homo sapiens
MAAASAGATRLLLLLLMAVAAPSRARGSGCRAGTGARGAGAEGREGEACGTVGLLLEHSFEIDDSANFRKRGSLLWNQQDGTLSLSQRQLSEEERGRLRDVAALNGLYRVRIPRRPGALDGLEAGGYVSSFVPACSLVESHLSDQLTLHVDVAGNVVGVSVVTHPGGCRGHEVEDVDLELFNTSVQLQPPTTAPGPETAAFIERLEMEQAQKAKNPQEQKSFFAKYWMYIIPVVLFLMMSGAPDTGGQGGGGGGGGGGGSGR

SEQ ID NO: 6504 - protein, 228 aa, Homo sapiens
MALPRCTWPNYVWRAVMACLVHRGLGAPLTLCMLGCLLQAGHVLSQKLDDVDPLVATNFGKIRGIKKELNNEILGPVIQFLGVPYAAPPTGERRFQPPEPPSPWSDIRNATQFAPVCPQNIIDGRLPEVMLPVWFTNNLDVVSSYVQDQSEDCLYLNIYVPTEDDIRDSGGPKPVMVYIHGGSYMEGTGNLYDGSVLASYGNVIVITVNYRLGVLGKKSLSFVFTMNP

SEQ ID NO: 6505 - protein, 69 aa, Homo sapiens [sequence omitted]

SEQ ID NO: 6506 - protein, 52 aa, Homo sapiens
MDSCLFLRDFCWKMRMLTILPLGTLFPLLTLLLLPLEVPSVSCGVPFAVWDL

SEQ ID NO: 6507 - protein, 121 aa, Homo sapiens
MASCLALRMALLLVSGVLAPAVLTDDVPQEPVPTLWNEPAELPSGEGPVESTSPGREPVDTGPPAPTVAPGPEDSTAQERLDQGGGSLGPGAIAAIVIAALLATCVVLALVVVALRKFSAS

SEQ ID NO: 6508 - protein, 529 aa, Homo sapiens
MVAQDPQGCLQLCLSEVANGLRNPVSMVHAGDGTHRFFVAEQVGVVWVYLPDGSRLEQPFLDLKNIVLTTPWIGDERGFLGLAFHPKFRHNRKFYIYYSCLDKKKVEKIRISEMKVSRADPNKADLKSERVILEIEEPASNHNGGQLLFGLDGYMYIFTGDGGQAGDPFGLFGNAQNKSSLLGKVLRIDVNRAGSHGKRYRVPSDNPFVSEPGAHPAIYAYGIRNMWRCAVDRGDPITRQGRGRIFCGDVGQNRFEEVDLILKGGNYGWRAKEGFACYDKKLCHNASLDDVLPIYAYGHAVGKSVTGGYVYRGCESPNLNGLYIFGDFMSGRLMALQEDRKNKKWKKQDLCLGSTTSCAFPGLISTHSKFIISFAEDEAGELYFLATSYPSAYAPRGSIYKFVDPSRRAPPGKCKYKPVPVRTKSKRIPFRPLAKTVLDLLKEQSEKAARKSSSATLASGPAQGLSEKGSSKKLASPTSSKNTLRGPGTKKKARVGPHVRQGKRRKSLKSHSGRMRPSAEQKRAGRSLP

SEQ ID NO: 6509 - protein, 95 aa, Homo sapiens
MAPPPACRSPMSPPPPLLLLLLLSLALLGARARAEPAGSAVPAQSRPCVDCHAFEFMQRALQDLRKTACSLDARTETLLLQAERRALCACWPAGH

SEQ ID NO: 6510 - protein, 81 aa, Homo sapiens
MVHYSWCALFCHFAQGTCLQNSFQSGLVKGCQGSTGGNQGSFQAAKMSPVCYSGHTGWLSRPWAKSISQSADDRSPPSRRT

SEQ ID NO: 6511 - protein, 337 aa, Homo sapiens [sequence omitted]

SEQ ID NO: 6512 - protein, 23 aa, Homo sapiens
MRKKFLLAQVFLSLSVMPSMPVT

SEQ ID NO: 6513 - protein, 184 aa, Homo sapiens; identical to SEQ ID NO: 5892

SEQ ID NO: 6514 - protein, 372 aa, Homo sapiens
MAYHSFLVEPISCHAWNKDRTQIAICPNNHEVHIYEKSGAKWTKVHELKEHNGQVTGIDWAPESNRIVTCGTDRNAYVWTLKGRTWKPTLVILRINRAARCVRWAPNENKFAVGSGSRVISICYFEQENDWWVCKHIKKPIRSTVLSLDWHPNNVLLAAGSCDFKCRIFSAYIKEVEERPAPTPWGSKMPFGELMFESSSSCGWVHGVCFSASGSRVAWVSHDSTVCLADADKKMAVATLASETLPLLALTFITDNSLVAAGHDCFPVLFTYDAAAGMLSFGGRLDVPKQSSQRGLTARERFQNLDKKASSEGGTAAGAGLDSLHKNSVSQISVLSGGKAKCSQFCTTGMDGGMSIWDVKSLESALKDLKIK

SEQ ID NO: 6515 - protein, 312 aa, Homo sapiens
MESLYDLWEFYLPYLYSCISLMGCLLLLLCTPVGLSRMFTVMGHLLVKPTILEDLDEQIYIITLEEEALQRRLNGLSSSVEYNIMELEQELENVKTLKTKLERRKKASAWERNLVYPAVMVLLLIETSISVLLVACNILCLLVDETAMPKGTRGPGIGNASLSTFGFVGAALEIILIFYLMVSSVVGFYSLRFFGNFTPKKDDTTMTKIIGNCVSILVLSSALPVMSRTLGITRFDLLGDFGRFNWLGNFYIVLSYNLLFAIVTTLCLVRKFTSAVREELFKALGLHKLHLPNTSRDSETAKPSVNGHQKAL

SEQ ID NO: 6516 - protein, 262 aa, Homo sapiens
MQKLELNHSELIQQSQVLWRMIAELKERSQRPVRWMLQDIQEVLNRSKSWSLQQPEPISLELKTDCRVLGLREILKTYAADVRLDPDTAYSRLIVSEDRKRVHYGDTNQKLPDNPERFYRYNIVLGSQCISSGRHYWEVEVGDRSEWGLGVCKQNVDRKEVVYLSPHYGFWVIRLRKGNEYRAGTDEYPILSLPVPPRRVGIFVDYEAHDISFYNVTDCGSHIFTFPRYPFPGRLLPYFSPCYSIGTNNTAPLAICSLDGED

SEQ ID NO: 6517 - protein, 27 aa, Homo sapiens
MRRMASALLLDQLTKALLSGHQNWKAF

SEQ ID NO: 6518 - protein, 323 aa, Homo sapiens
MSPAAAAEPDGDQQDRHVSKLIFCFFVFGAVLLCVGVLLSIFGFQACQYKPLPDCPMVLKVAGPACAVVGLGAVILARSRAQLQLRAGLQRGQQMDPDRAFICGESRQFAQCLIFGFLFLTSGMLISVLGIWVPGCGSNWAQEPLNETDTGDSEPRMCGFLSLQIMGPLIVLVGLCFFVVAHVKKRNTLNAGQDASEREEGQIQIMEPVQVTVGDSVIIFPPPPPPYFPESSASAVAESPGTNSLLPNENPPSYYSIFNYGTPTSEGAASERDCESIYTISGTNSSSEASHTPHLPSELPPRYEEKENAAATFLPLSSEPSPP

SEQ ID NO: 6519 - protein, 61 aa, Homo sapiens
  SITE (37): Xaa equals any amino acid
  SITE (39): Xaa equals any amino acid
MGRLGLCLLRSLWVPQRRATTLGWTLALRVLPTARAXRXLPVAADTARRACGAHTRIRVLG

SEQ ID NO: 6520 - protein, 115 aa, Homo sapiens
MLGLLGSTALVGWITGAAVAVLLLLLLLATCLFHGRQDCDVERNRTAAGGNRVRRAQPWPFRRRGHLGIFHHHRHPGHVSHVPNVGLHHHHHPRHTPHHLHHHHHPHRHHPRHAR

SEQ ID NO: 6521 - protein, 50 aa, Homo sapiens
MGLKRKQGFVFLFLLLKSTVASWLLSGVGRIWGLVHFVKVNHVCLNNRGV

SEQ ID NO: 6522 - protein, 99 aa, Homo sapiens
MYFLLTCRFSLHLLPCPLFLCFLPPCSLFVEETSYLCFVSHGMNFAECIFTCSLMCCLVLHISCKLTVESTSLITFTFFLGWWGWRYTQLFPFHDVSSR

SEQ ID NO: 6523 - protein, 119 aa, Homo sapiens
MAASAGAGAVIAAPDSRRWLWSVLAAALGLLTAGVSALEVYTPKEIFVANGTQGKLTCKFKSTSTTGGLTSVSWSFQPEGADTTVSGPVIYAQLDHSGGHHSDKINKSESVVYADIRKN

SEQ ID NO: 6524 - protein, 244 aa, Homo sapiens [sequence omitted]

SEQ ID NO: 6525 - protein, 45 aa, Homo sapiens
MVKHFTLWMVCLSLVFRKLLSLLPKKKEGQVNFFNQKKITHFIKP

SEQ ID NO: 6526 - protein, 43 aa, Homo sapiens
MYAAALSTAPSLFFLHLCLLKTLILFSLSSIPLPPLLYSYDLH

SEQ ID NO: 6527 - protein, 310 aa, Homo sapiens
MALRRPPRLRLCARLPDFFLLLLFRGCLIGAVNLKSSNRTPVVQEFESVELSCIITDSQTSDPRIEWKKIQDEQTTYVFFDNKIQGDLAGRAEILGKTSLKIWNVTRRDSALYRCEVVARNDRKEIDEIVIELTVQVKPVTPVCRVPKAVPVGKMATLHCQESEGHPRPHYSWYRNDVPLPTDSRANPRFRNSSFHLNSETGTLVFTAVHKDDSGQYYCIASNDAGSARCEEQEMEVYDLNIGGIIGGVLVVLAVLALITLGICCAYRRGYFINNKQDGESYKNPGKPDGVNYIRTDEEGDFRHKSSFVI

SEQ ID NO: 6528 - protein, 310 aa, Homo sapiens; identical to SEQ ID NO: 6527

SEQ ID NO: 6529 - protein, 49 aa, Homo sapiens
MSPRPLIARCEALGCGARRLPWWALAMALCACGRCVAANSIGETLPSEV

SEQ ID NO: 6530 - protein, 262 aa, Homo sapiens
  SITE (231): Xaa equals any amino acid
MSPPPLLQPLLLLLPLLNVEPSGATLIRIPLHRVQPGRRILNLLRGWREPAELPKLGAPSPGDKPIFVPLSNYRDVQYFGEIGLGTPPQNFTVAFDTGSSNLWVPSRRCHFFSVPCWLHHRFDPKASSSFQANGTKFAIQYGTGRVDGILSEDKLTIGGIKGASVIFGEALWEPSLVFAFAHFDGILGLGFPILSVEGVRPPMDVLVEQGLLDKPVFSFYLNRDPEEPDGXELVLGGSDPAHYIPPSPFVPVRSPPMADPQG

SEQ ID NO: 6531 - protein, 69 aa, Homo sapiens
MLMGSILYVLFCVWLLQCIFEIYPHCCVYPKCVLFHCQIMFCYMNILQNICLFIYWWIFAFVPVWGYYE

SEQ ID NO: 6532 - protein, 50 aa, Homo sapiens
MNAYRVKPAVFDLLLAVGIAAYLGMAYVAVQHFSLLYKTVQRLLVKAKTQ

SEQ ID NO: 6533 - protein, 145 aa, Homo sapiens [sequence omitted]

SEQ ID NO: 6534 - protein, 179 aa, Homo sapiens
  SITE (8): Xaa equals any amino acid
  SITE (27): Xaa equals any amino acid
  SITE (84): Xaa equals any amino acid
  SITE (85): Xaa equals any amino acid
  SITE (86): Xaa equals any amino acid
  SITE (99): Xaa equals any amino acid
MTSAGPVXLFLLVSISTSVILMQHLLXASYCDLLHKAAAHLGCWQKVDPALCSNVLQHPWTEECMWPQGVLVKHSKNVYKAVGXXXVAIPSDVSHFRFXFFFSKPLRILNILLLLEGAVIVYQLYSLMSSEKWHQTISLALILFSNYYAFFKLLRDRLVLGKAYSYSASPQRDLDHRFS

SEQ ID NO: 6535 - protein, 287 aa, Homo sapiens
  SITE (263): Xaa equals any amino acid
MALLPIFFGALRSVRCARGKNASDMPETITSRDAARFPIIASCTLLGLYLFFKIFSQEYINLLLSMYFFVLGILALSHTISPFMNKFFPASFPNRQYQLLFTQGSGENKEEIINYEFDTKDLVCLGLSSIVGVWYLLRKHWIANNLFGLAFSLNGVELLHLNNVSTGCILLGGLFIYDVFWVFGTNVMVTVAKSFEAPIKLVFPQDLLEKGLEANNFAMLGLGDVVIPGIFIALLLRFDISLKKNTHTYFYTSFAAYIFGLGXYHLHHAHLQACSVMRSQILRIQRQ

SEQ ID NO: 6536 - protein, 68 aa, Homo sapiens
MRAVGERLLLKLQRLPQAEPVEIVAFSVIILFTATVLLLLLIACSCCCTHCCCPERRGRKVQVQPTPP

SEQ ID NO: 6537 - protein, 74 aa, Homo sapiens
MAVVPTWCSTVLLTLCPQLAWWQVWRMCRYTTGKMPSSPSISPPSSRVPGSLMGKSSRVTSRRARWNLGPCGTV

SEQ ID NO: 6538 - protein, 43 aa, Homo sapiens
MLSFVSRCHWSSIAEESEFLFLILVCYFSSSCSSCIIHQWYYV

SEQ ID NO: 6539 - protein, 33 aa, Homo sapiens
MNFVLFFIGINVGCRGENSLKYFTVTVLCSPRD

SEQ ID NO: 6540 - protein, 27 aa, Homo sapiens
MCLFVSLLILSLGIGKHSMNIYTLTFF

SEQ ID NO: 6541 - protein, 332 aa, Homo sapiens
MRLLAFLSLLALVLQETGTASLPRKERKRREEQMPREGDSFEVLPLRNDVLNPDNYGEVIDLSNYEELTDYGDQLPEVKVTSLAPATSISPAKSTTAPGTPSSNPTMTRPTTAGLLLSSQPNHGLPTCLVCVCLGSSVYCDDIDLEDIPPLPRRTAYLYARFNRISRIRAEDFKGLTKLKRIDLSNNLISSIDNDAFRLLHALQDLILPENQLEALPVLPSGIEFLDVRLNRLQSSGIQPAAFRAMEKLQFLYLSDNLLDSIPGPLPPSLRSVHLQNNLIETMQRDVFCDPEEHKHTRRQLEDIRLDGNPINLSLFPSAYFCLPRLPIGRFT

SEQ ID NO: 6542 - protein, 61 aa, Homo sapiens
MQLRGLSLNPRLLLTLGSFNQVGQPLLQRGVGWLSSLSHAACEDRGGGVGSGKSPENRRGI

SEQ ID NO: 6543 - protein, 57 aa, Homo sapiens
MSTKILQFLFSSCCWVPPMLFLFKNTKCRTSLLYCFYFILLTCSLSEYDSLLSSKVF

SEQ ID NO: 6544 - protein, 82 aa, Homo sapiens
MNLGWYQMHPLKMIWLTIFLTWLMRQASPTGHDLEVKVFCCYCGLKYLVMGEECRVVALAQTQENPFSPLFYFCYSDHLSPF

SEQ ID NO: 6545 - protein, 353 aa, Homo sapiens
MPWPLLLLLAVSGAQTTRPCFPGCQCEVETFGLFDSFSLTRVDCSGLGPHIMPVPIPLDTAHLDLSSNRLEMVNESVLAGPGYTTLAGLDLSHNLLTSISPTAFSRLRYLESLDLSHNGLTALPAESFTSSPLSDVNLSHNQLREVSVSAFTTHSQGRALHVDLSHNLIHRLVPHPTRAGLPAPTIQSLNLAWNRLHAVPNLRDLPLRYLSLDGNPLAVIGPGAFAGLGGLTHLSLASLQRLPELAPSGFRELPGLQVLDLSGNPKLNWAGAEVFSGLSSLQELDLSGTNLVPLPEALLLHLPALQSVSVGQDVRCRRLVREGTYPRRPGSSPKVALHCVDTRESAARGPTIL

SEQ ID NO: 6546 - protein, 434 aa, Homo sapiens
MGMGRGAGRSALGFWPTLAFLLCSFPAATSPCKILKCNSEFWSATSGSHAPASDDTPEFCAALRSYALCTRRTARTCRGDLAYHSAVHGIEDLMSQHNCSKDGPTSQPRLRTLPPAGDSQERSDSPEICHYEKSFHKHSATPNYTHCGLFGDPHLRTFTDRFQTCKVQGAWPLIDNNYLNVQVTNTPVLPGSAATATSKLTIIFKNFQECVDQKVYQAEMDELPAAFVDGSKNGGDKHGANSLKITEKVSGQHVEIQAKYIGTTIVVRQVGRYLTFAVRMPEEVVNAVEDWDSQGLYLCLRGCPLNQQIDFQAFHTNAEGTGARRLAAASPAPTAPETFPYETAVAKCKEKLPVEDLYYQACVFDLLTTGDVNFTLAAYYALEDVKMLHSNKDKLHLYERTRDLPGRAAAGLPLAPRPLLGALVPLLALLPVFC

SEQ ID NO: 6547 - protein, 73 aa, Homo sapiens
MELLKCSWQLFFSFLTHCSASTIVWLFVQHRLSQSHNKPFFGILQRCHSWHLNRESFVPNQSFSIYESCSIRK

SEQ ID NO: 6548 - protein, 40 aa, Homo sapiens
MPTTVGAQIFIFIFLLCTLFFLPFYGCLKSREKGRLVNDE

SEQ ID NO: 6549 - protein, 216 aa, Homo sapiens
MKERKGFNLQGPLILWSFCLAIFSILGAVRMWGIMGTVLLTGGLKQTVCFINFIDNSTVKFWSWVFLLSKVIELGDTAFIILRKRPLIFIHWYHHSTVLVYTSFGYKNKVPAGGWFVTMNFGVHAIMYTYYTLKAANVKPPKMLPMLITSLQILQMFVGAIVSILTYIWRQDQGCHTTMEHLFWSFILYMTYFILFAHFFCQTYIRPKVKAKTKSQ

SEQ ID NO: 6550 - protein, 81 aa, Homo sapiens
MFHFGLWDLHFFLIVMAHRDDCSFKGGCGLLERFQCPHTSFSSASQKRLADGMECLCEIERTQTRIRKICLPTLHGHLLAV

SEQ ID NO: 6551 - protein, 247 aa, Homo sapiens [sequence omitted]

SEQ ID NO: 6552 - protein, 96 aa, Homo sapiens
MIRRLVFAAFPRLFPVPLPSMLTHWASLAVIPTMTATSVGKAPPGPLPDASPSLRLPARRRPDPVGACRGVRRNGRPNGPASVSSTGVPAQSVVQR

SEQ ID NO: 6553 - protein, 125 aa, Homo sapiens
MYFIFTSFWAYKIYYVYGFMMLVLVILCIVTVCVTIVCTYFLLNAEDYRWQWTSFLSAASTAIYVYMYSFYYYFFKTKMYGLFQTSFYFGYMAVFSTALGIMCGAIGYMGTSAFVRKIYTNVKID

SEQ ID NO: 6554 - protein, 50 aa, Homo sapiens
MLLTLFAHTALDTYLLSEAFFPHSILPALLLIKISSACSQTQSESQKNPA

SEQ ID NO: 6555 - protein, 37 aa, Homo sapiens
MLYSHLYRWEYTIPFLLLLIMASSPSLFCLPRSLKSV

SEQ ID NO: 6556 - protein, 42 aa, Homo sapiens
MTVASIRHILVEIWLPIALAMGTRGLTQIVAVIQSRSQWALS

SEQ ID NO: 6557 - protein, 170 aa, Homo sapiens
MTVLINIILSLVKTGPGQHLNHSELAILLNLLQSKTSVNMADFVQVLNIKVNSETQQQLNKINLPAGILATGEKQTDPSTPQQESSKPLGGIQPSSQTIQPKVETDAAQAAVQSAFAVLLTQLIKAQQSKQKDVLLEERENGSGHEASLQLRPLQNLALRCRVSVQIPDH

SEQ ID NO: 6558 - protein, 105 aa, Homo sapiens
MSFLGFILNLGARLIVQPQAALASRGLRGQGLPCETQVCKRTLRPGAVGWLVHKGRRALSISRKSALVSLGVMYVGPGKRPGVVRKHSLLVKMQARGKEVSPTMC

SEQ ID NO: 6559 - protein, 286 aa, Homo sapiens
  SITE (221): Xaa equals any amino acid
MPLFKLYMVMSACFLAAGIFWVSILCRNTYSVFKIHWLMAALAFTKSISLLFHSINYYFINSQGPPHRRPCRHVLHRTPAEGRPPLHHHRPDWLRLGFIKYVLSDKEKKVFGIVIPMQVLANVAYIIIESREEGATNYVLWKEILFLVDLICCGAILFPVVWSIRHLQDASGTDGKVAVNLAKLKLFRHYYVMVICYVYFTRIIAILLQVAVPFQWQWLYXLLVEGSTLAFFVLTGYKFQPTGNNPYLQLPQEDEEDVQMEQVMTDSGFREGLSKVNKTASGRELL

SEQ ID NO: 6560 - protein, 48 aa, Homo sapiens
MTDITCFLFSYLSTLLSPIYLDVLLFSLLLFLFHIAGMHILTFINHDI

SEQ ID NO: 6561 - protein, 31 aa, Homo sapiens
MLQTLILIFLLLLPCYLELLCFSLISSSAKT

SEQ ID NO: 6562 - protein, 61 aa, Homo sapiens
MRLCTTWMAVKFLWWGMTWIPSGKACSWTQPLCSSGGWSSPTHLPTSLLLGWRASLCMKRS

SEQ ID NO: 6563 - protein, 70 aa, Homo sapiens [sequence omitted]

SEQ ID NO: 6564 - protein, 51 aa, Homo sapiens
MKLVTMFDKLSRNRVIQPMGMSPRGHLTSLQDAMCETMEQQLSSDPDSDPD

SEQ ID NO: 6565 - protein, 98 aa, Homo sapiens
  SITE (43): Xaa equals any amino acid
MRFAVVFLMQFPTSLQMPFDIWQHFMPLPLSVFILVFSPFSHXLGSLLQSRFSDFRFFSLCPFPLCPVTRSTFWHRPISQFPLSQVQQHLKDIYKRDT

SEQ ID NO: 6566 - protein, 64 aa, Homo sapiens
MLYSDLKLVRCHNGPVHVISVYTTPPDPSNPYNTPPLFASCMVISYVTFTPVSADCFFNVLVCF

SEQ ID NO: 6567 - protein, 220 aa, Homo sapiens [sequence omitted]

SEQ ID NO: 6568 - protein, 45 aa, Homo sapiens
MRTLALLVLLFCSCTHSSMGWGRQAWGVALGEVRSPPAQDTVAKT

SEQ ID NO: 6569 - protein, 77 aa, Homo sapiens
MTIFTPFLVLLLLVNSPRFSTITLMRSGFHNPSVCLSFTLKPQCYLVLMYQKNRRQDGSKVFFKTARLKFYLNITAK

SEQ ID NO: 6570 - protein, 97 aa, Homo sapiens
MLWKLKLSRCWLDLTLLIFSQISHMDQIIFFFVVYPILNNIFSLNYCRDFFCGGYFLFCSKIIRCKAILCLTVALSKQLCSGVAFDVLEFDYMQSCI

SEQ ID NO: 6571 - protein, 88 aa, Homo sapiens
  SITE (73): Xaa equals any amino acid
MNLVGFCLFICLLLMLLLLLLFSKFSIVEKYAAPEEMIGHSPAWCWTLSSLAQPSPDLSVYLTLVFYILQRQXQNNPNLTQIPGIHLI

SEQ ID NO: 6572 - protein, 192 aa, Homo sapiens [sequence omitted]

SEQ ID NO: 6573 - protein, 183 aa, Homo sapiens
MALARPGTPDPQALASVLLLLLWAPALSLLAGTVPSEPPSACASDPCAPGTECQATESGGYTCGPMEPRGCATQPCHHGALCVPQGPDPNGFRCYCVPGFQGPRCELDIDECASRPCHHGATCRNLADRYECHCPLGYAAPHLNPLSYVWGIPHLMRQRLPPDGDSKANDSKKLGPQKIYSGK

SEQ ID NO: 6574 - protein, 108 aa, Homo sapiens
MHQDWLCNLGWPLLSLWAAESAPHVAMASATAQLWSRPCGRTHMVSLALGHQETGLWLCSAFGCVVDSPWASVCPSVKGQLTVCGILPRVPVCVYVCACVRVSMCVHI

SEQ ID NO: 6575 - protein, 49 aa, Homo sapiens
MILLPGLSHYNALGLFFAAVLLFLNLGQVPMLAVRRDSVHSTCNFREWK

SEQ ID NO: 6576 - protein, 47 aa, Homo sapiens
  SITE (11): Xaa equals any amino acid
MTPWLLILVSXGFLKSISDPQFQELSINIASCHPGTVMPYSGTSHLK

SEQ ID NO: 6577 - protein, 77 aa, Homo sapiens
MYTFICTWLWRDKLIHIGLQISLTGRRAQKNNIFLHFFGSILKNKKGTPKGSLVTPLLGFLITNIIFTCKVNGPLIS

SEQ ID NO: 6578 - protein, 31 aa, Homo sapiens
MVLSACPNYVLPLPFLLITLKCDGTTTEAVC

SEQ ID NO: 6579 - protein, 30 aa, Homo sapiens
MEGLMLPLLSVIYSEGTVWEEIIVSGRQYY

SEQ ID NO: 6580 - protein, 57 aa, Homo sapiens
MCGVTYAWYMPLLLLKFYSLLLAQVLLNPFLMCTGWRKNYSQHFERKVFRNNINWHY

SEQ ID NO: 6581 - protein, 72 aa, Homo sapiens
MVYYLNRALRATFSILFSVVCLLFLGSIVNCFLNDVFKPLTLNFSTALSAWRKESSAWNSLGLLPPTDEYPT

SEQ ID NO: 6582 - protein, 61 aa, Homo sapiens
MIVYWMIWALRSPLTTAQNIHSSTALTEFAKCIKEVTWRVRSYETICRKWGKKGHMAQLKL

SEQ ID NO: 6583 - protein, 181 aa, Homo sapiens
MVLPFMIVFLLISSLLNFAYIAKILNDYKMKNDTVWDLNMYKSEYFIKQILLNLGVIFFFTLSLITCIFLIISLWRHNRQMQSNVTGLRDSNTEAHVKAMKVLISFIILFILYFIGMAIEISCFTVRENKLLLMFGMTTTAIYPWGHSFILILGNSKLKQASLRVLQQLKCCEKRKNLRVT

SEQ ID NO: 6584 - protein, 71 aa, Homo sapiens [sequence omitted]

SEQ ID NO: 6585 - protein, 93 aa, Homo sapiens [sequence omitted]

SEQ ID NO: 6586 - protein, 80 aa, Homo sapiens
MALGSMYLVLTLIVAKVLRGAEPCCGPLKNRVLRPCPLPVHCPLPIPSPAEGIPWVAYLPIRWFISCCPGHCIQIPMCTS

SEQ ID NO: 6587 - protein, 115 aa, Homo sapiens [sequence omitted]

SEQ ID NO: 6588 - protein, 302 aa, Homo sapiens
MLVTNRPGVLKEPKLMGAISFFIFFFTLLVLARQNEYYCRLDFLWKKKLRQEREETETMENLTRLLLENVLPAHVAPQFIGQNRRNEDLYHQSYECVCVLFASVPDFKEFYSESNINHEGLECLRLLNEIIADFDELLSKPKFSGVEKIKTIGSTYMAATGLNATSGQDAQQDAERSCSHLGTMVEFAVALGSKLDVINKHSFNNFRLRVGLNHGPVVAGVIGAQKPQYDIWGNTVNVASRMESTGVLGKIQVTEETAWALQSLGYTCYSRGVIKVKGKGQLCTYFLNTDLTRTGPPSATLG

SEQ ID NO: 6589 - protein, 241 aa, Homo sapiens [sequence omitted]

SEQ ID NO: 6590 - protein, 36 aa, Homo sapiens
MTGTPAWAHLLLLLLLGSAPQTRLWPPSQCPVTSPE

SEQ ID NO: 6591 - protein, 43 aa, Homo sapiens
MGTVLLLLLLVVAHCCCCSSPGPRRESPRKERPKGVDNLALEP

SEQ ID NO: 6592 - protein, 122 aa, Homo sapiens
  SITE (63): Xaa equals any amino acid
  SITE (99): Xaa equals any amino acid
  SITE (122): Xaa equals any amino acid
MMTMTSDRWFSMAWASCSLSRPPLTPSCSCQQPATVALLLQTISVCSAQQADPLSPPRACRPXRQFPVLQSAGPPHSPHVYAFVLFPVSSRWQGGDFCXICCCFPQCLGRCLEHTRCSINPX

SEQ ID NO: 6593 - protein, 147 aa, Homo sapiens [sequence omitted]

SEQ ID NO: 6594 - protein, 6 aa, Homo sapiens
PWPPLV

SEQ ID NO: 6595 - protein, 73 aa, Homo sapiens
MGVKLEIFRMIIYLTFPVAMFWVSNQAEWFEDDVIQRKRELWPPEKLQEIEEFKERLRKRREEKLLRDAQQNS

SEQ ID NO: 6596 - protein, 51 aa, Homo sapiens
MKCTAVFAPSAWPNTLSLLVSLHTVMCINWHLVSASHMHIGRIVILEGDGM

SEQ ID NO: 6597 - protein, 87 aa, Homo sapiens
MDPRRVTACCHVWTVGLFCIWAVGLSCSLSLSHVIVWLSGAGCTLICEDNPFLLLFSQYLQPHHPEIMKPFILGHKSSNGGLSPPSA

SEQ ID NO: 6598 - protein, 51 aa, Homo sapiens
MRAVHPALGLCLLPAPSCGKVLVAGALEGVPAGVAEAEANIAQVPPIARQT

SEQ ID NO: 6599 - protein, 446 aa, Homo sapiens
MTSKEIILGLCLLSLVLSMILMVIIRYISRVLVWILTILVILGSLGGTGVLWWPYAKQRRSPKETVTPEQLQIAEDNLRALLIYAISATVFTVILFLIMLVMRKRVALTIALFHVAGKVFIHLPLLVFQPFWTFFALVLFWVYWIMTLLFLGTTGSPVQNEQGFVEFKISGPLQYMWWYHVVGLIWISEFILACQQMTVAGAVVTYYFTRDKRNLPFTPILASVNRLIRYHLGTVAKGSFIITLVKIPRMILMYIHSQLKGKENACARCVLKSCICCLWCLEKCLNYLNQNAYTATAINSTNFCTSAKDAFVILVENALRVATINTVGDFMLFLGKVLIVCSTGLAGIMLLNYQQDYTVWVLPLIIVCLFAFLDAHCFLSIYEMVVDVLFLCFAIDTKYNDGSPGREFYMDKVLMEFVENSRKAMKEAGKGGVADSRELKPMLKKR

SEQ ID NO: 6600 - protein, 95 aa, Homo sapiens
MKGSRALLLVALTLFCICRMATGEDNDEFFMDFLQTLLVGTPEELYEGTLGKYNVNEDAKAAMTELKSCIDGLQPMHKAELVKLLVQVLGSQDGA

SEQ ID NO: 6601 - protein, 303 aa, Homo sapiens
MEATGTWALLLALALLLLLTLALSGTRARGHLPPGPTPLPLLGNLLQLRPGALYSGLMRLSKKYGPVFTIYLGPWRPVVVLVGQEAVREALGGQAEEFSGRGTVAMLEGTFDGHGVFFSNGERWRQLRKFTMLALRDLGMGKREGEELIQAEARCLVETFQGTEGRPFDPSLLLAQATSNVVWSLLFGLRFSYEDKEFQAVVRAAGGTLLGVSSQGGQVSGWDPSPTTFPEGSCQGPMRTSCPSPHRPTRCSPGSCGPCQAPTSSSSTTSAAPWLPSQSGRCSSTRGTWMLRAPHVTLSMPSC

SEQ ID NO: 6602 - protein, 595 aa, Homo sapiens
MGCLWGLALPLFFFCWEVGVSGSSAGPSTRRADTAMTTDDTEVPAMTLAPGHAALETQTLSAETSSRASTPAGPIPEAETRGAKRISPARETRSFTKTSPNFMVLIATSVETSAASGSPEGARMTTVQTITGSDPREAIFDTLCTDDSSEEAKTLTMDILTLAHTSTEAKGLSSESSASSDGPHPVITPSRASESSASSDGPHPVITPSRASESSASSDGPHPVITPSRASESSASSDGPHPVITPSRASESSASSDGPHPVITPSRASESSASSDGPHPVITPSWSPGSDVTLLAEALVSVTNIEVINCSITEIETTTSSIPGASDTDLIPTEGVKASSTSDPPALPDSTEAKPHITEVTASAETLSTAGTTESAAPDATVGTPLPTNSATEREVTAPGATTLSGALVTVSRNPLEETSALSVETPSYVKVSGAAPVSIEAGSAVGKTTSFAGSSASSYSPSEAALKNFTPSETPTMDIATKGPFPTSRDPLPSVPPTTTNSSRGTNSTLAKITTSAKTTMKPPTATPTTARTRPTTDVSAGENGGFLLLRLSVASPEDLTDPRVAERLMQQLHRELHAHAPHFQVSLLRVRRG

SEQ ID NO: 6603 - protein, 240 aa, Homo sapiens
  SITE (192): Xaa equals any amino acid
  SITE (222): Xaa equals any amino acid
  SITE (235): Xaa equals any amino acid
MALSSLIVILLVVFALVLHGQNKKYKNCSTGKGISTMEESVTLDNGGFAALELSSRHLNVKSTFSKKNGTRSPPRPSPGGLHYSDEDICNKYNGAVLTESVSLKEKSADASESEATDSDYEDALPKHSFVNHYMSDPTYYNSWKRRAQGPRTCAAQVRGGGGLRGGRAAAPGHHHAERGRRLHPRWPRRANXAHRLLLLRVSKAPRLPQGGTEATFRSLFLXRQSTPITELKFLXKKKKI

SEQ ID NO: 6604 - protein, 273 aa, Homo sapiens
  SITE (217): Xaa equals any amino acid
MRLPGVPLARPALLLLLPLLAPLLGTGAPAELRVRVRLPDGQVTEESLQADSDADSISLELRKPDGTLVSFTADFKKDVKVFRALILGELEKGQSQFQALCFVTQLQHNEIIPSEAMAKLRQKNPRAVRQAEEVRGLEHLHMDVAVNFSQGALLSPHLHNVCAEAVDAIYTRQEDVRFWLEQGVDSSVFEALPKASEQAELPRCRQVGDRGKPCVCXYGLSLAWYPCMLKYCHSRDRPTPYKCGIRSCQKSYSFDFYVPQRQLCLWDEDPYPG

SEQ ID NO: 6605 - protein, 95 aa, Homo sapiens
MAEPIACLCLICCIIISATTQMPFEGSCFCLVPCNFQPYFRHFRPNDLRHMVFTHGLWALEKLSPLKENQNVACICIFCLRFHLILKWILDSPKV

SEQ ID NO: 6606 - protein, 63 aa, Homo sapiens [sequence omitted]

SEQ ID NO: 6607 - protein, 45 aa, Homo sapiens
MPAHFLFILIFFVEMVSCCVTQASLEFLVSSDFPALVSRNAGLQA

SEQ ID NO: 6608 - protein, 51 aa, Homo sapiens
MACLIRFPAIGSLPYSTWPFFFFIFLFFSCLTFIPFSPLSSFCEPYPRKEP

SEQ ID NO: 6609 - protein, 41 aa, Homo sapiens
MFSLPQYLIYFVLSILVVSTLFSLPLFLVPLRGEKKDDNGV

SEQ ID NO: 6610 - protein, 84 aa, Homo sapiens
MNPLCPPLLLLDLQTQCPQRCSYILYSCFSGMVLMPPKAPACESTFVFISWSPLSSLVPPRPSFHHLPRHSELDQYLCGRLGVT

SEQ ID NO: 6611 - protein, 40 aa, Homo sapiens
MFIFRDGLTMFSRLVSNSCPQVILPSWPPESLGGSGRRIS

SEQ ID NO: 6612 - protein, 23 aa, Homo sapiens
MWPLLLRLLFLHLFLAKNKLIFK

SEQ ID NO: 6613 - protein, 47 aa, Homo sapiens
MSWGYFLGASVLLQNFFSSYLLTPSGKIIEEVTVVKASVNSISKNFM

SEQ ID NO: 6614 - protein, 59 aa, Homo sapiens
MGLSVLLPLCLLGPGRFTSGQKPLDTPGLGAAVLSVRKAGLKMRSHLTPSVCTVPSPGS

SEQ ID NO: 6615 - protein, 92 aa, Homo sapiens
PNLLFQTLLLHPFSTIISTSHTVLLDIHKEQHAFLCLGHDIFSSMHLLFNSLFCLISKCLLIACNMPCPVLGSESIKINKQDPDMQGDHNLV

SEQ ID NO: 6616 - protein, 53 aa, Homo sapiens
MWHLSFHCLLLLLPLCEVTHSLFAFYHNWKLFEASLETEAAMLPVQPAEPRAN

SEQ ID NO: 6617 - protein, 177 aa, Homo sapiens
  SITE (155): Xaa equals any amino acid
MLFLFLYCLLVVLPFKLTPKHSAEVLLSIHKSKKYLCKVKAACKIQAWYRCWRAHKEYLAILKAVKIIQGCFYTKLERTRFLNVRASAIIIQRKWRAILPAKIAHEHFLMIKRHRAACLIQAHYRGYKGRQVFLRQKSAALIIQKYIRAREAGKXERIKYIEFKNLQLSYKHWCVVG

SEQ ID NO: 6618 - protein, 113 aa, Homo sapiens
  SITE (57): Xaa equals any amino acid
  SITE (73): Xaa equals any amino acid
MNSAFSTCLLLLQDLGVPLTLTGLPPALGLAPPVLEPRAPGLELPLWGGSQAPPLPXLSSVPCSAPPLYLSVXRPLTERRCRVSRGPRWSQGQGWDLQGTRGAHGLRHLCPGS

SEQ ID NO: 6619 - protein, 51 aa, Homo sapiens
MLSPLSQSLLVALNVLFLLPNFLALSKNLTYDCYFRFFPTFFLPPKEMWYL

SEQ ID NO: 6620 - protein, 45 aa, Homo sapiens
MSCGCCFIHIYNLLLSLCYGLGVERVKFFTFSILKKETMLLNYLF

SEQ ID NO: 6621 - protein, 42 aa, Homo sapiens [sequence omitted]

SEQ ID NO: 6622 - protein, 68 aa, Homo sapiens
MYLGSRIVKALFFLLFCIFHIWYNEHVLRTVLDLRKYANTVQIVLASPMPSSSIANVSTLVWCVCCNG

SEQ ID NO: 6623 - protein, 26 aa, Homo sapiens
MLRWHLWSWFCWFCLSEAGVLLDLPT

SEQ ID NO: 6624 - protein, 80 aa, Homo sapiens [sequence omitted]

SEQ ID NO: 6625 - protein, 43 aa, Homo sapiens
MSSVKCPYMWCFWAFPLFQLSVFIPVSKSHSINYYNFIVSLNI

SEQ ID NO: 6626 - protein, 69 aa, Homo sapiens
MAAARNLRTALIFGGFISMVGAAFYPIYFRPLMRLEEYQKEQAVNRAGIVQEDVQPPGLKVWSDPFGRK

SEQ ID NO: 6627 - protein, 46 aa, Homo sapiens
  SITE (11): Xaa equals any amino acid
MVCALGVYVCXSAPTAAVPKPAKGTICLKMLSGANCACQGQVTRQH

SEQ ID NO: 6628 - protein, 82 aa, Homo sapiens [sequence omitted]

SEQ ID NO: 6629 - protein, 52 aa, Homo sapiens
MILFMCFLVYCLSSVEWKSHRYFVFFSPCPFLYPQLLEHSLEHSKCSVLFME

SEQ ID NO: 6630 - protein, 24 aa, Homo sapiens
MWHLWRRLLSCFPVAMLQDYKYSV

SEQ ID NO: 6631 - protein, 40 aa, Homo sapiens
MWPSLGRCCLFFCLLTNLTSCHTSQITLCSRETCVWSRTT

SEQ ID NO: 6632 - protein, 78 aa, Homo sapiens
MKEAGKGGVADSRELKPMVGGDEEVAALQEFHFHFLSLSVFTDCTSSGEAFVICITQTCCSFCLCAYPSLGWQNSCHN

SEQ ID NO: 6633 - protein, 83 aa, Homo sapiens [sequence omitted]

SEQ ID NO: 6634 - protein, 44 aa, Homo sapiens
MASSSLVSDSSVPSVAHWIGSLGKHVSCNFEDRNEKNEQTTKHQ

SEQ ID NO: 6635 - protein, 216 aa, Homo sapiens
MWSIGAGALGAAALALLLANTDVFLSKPQKAALEYLEDIDLKTLEKEPRTFKAKELWEKNGAVIMAVRRPGCFLCREEAADLSSLKSMLDQLGVPLYAVVKEHIRTEVKDFQPYFKGEIFLDEKKKFYGPQRRKMMFMGFIRLGVWYNFFRAWNGGFSGNLEGEGFILGGVFVVGSGKQGILLEHREKEFGDKVNLLSVLEAAKMIKPQTLASEKK

SEQ ID NO: 6636 - protein, 74 aa, Homo sapiens [sequence omitted]

SEQ ID NO: 6637 - protein, 68 aa, Homo sapiens
MVASQAWWLSNLWHLWEVGSAQGLPLDPPALAPYLPWALRWPCFSGFASLAGALVLAHSLPTAWPGSS

SEQ ID NO: 6638 - protein, 25 aa, Homo sapiens
MFLVLLCILKSLIIGHVMITLNLTF

SEQ ID NO: 6639 - protein, 48 aa, Homo sapiens
MWLQTLPLFATGCKAVPWNCFGWCLTQEVFAVLGDLVNSADQVNRLFF

SEQ ID NO: 6640 - protein, 74 aa, Homo sapiens [sequence omitted]

SEQ ID NO: 6641 - protein, 34 aa, Homo sapiens
MAVGEAVFVPLQHPPLLHGSPIPKLLPGPLAVKC

SEQ ID NO: 6642 - protein, 36 aa, Homo sapiens
MEVLFDSLLFSSFIFPSQSLLSRTSAFSHKPNGLSE

SEQ ID NO: 6643 - protein, 22 aa, Homo sapiens
MLLVNLVFVCFFLFERRVHLKC

SEQ ID NO: 6644 - protein, 30 aa, Homo sapiens
  SITE (20): Xaa equals any amino acid
  SITE (23): Xaa equals any amino acid
MGEQPHFSLCVLLAAVREDXDPXVFPCCFL

SEQ ID NO: 6645 - protein, 126 aa, Homo sapiens
MGTSALWPFLPLLFLLGFLFSSCGFPEASFGPWVVVRAELWGCVVGAACVLGLYWQVGQSSLNTLARSQKPGLRVQPGKPGKLLPVTFQMLPPPCGGCCSPLGLCPSSGGSRMWRRTWVGARALHP

SEQ ID NO: 6646 - protein, 34 aa, Homo sapiens
MFYWGGLSFYFLLSSGVGFYCFLFGFGMEIWIAA

SEQ ID NO: 6647 - protein, 32 aa, Homo sapiens
MTIWQLFAVLIVLFAKSREISTEGEPCVLSKN

SEQ ID NO: 6648 - protein, 58 aa, Homo sapiens
MLFFYLNYLMIALLLLFKKIQKSNKGKDGNLMIEGVACVTVGGKEYIDFALVDIFMLV

SEQ ID NO: 6649 - protein, 58 aa, Homo sapiens
MQVFSALLYSLMHFYLPSFTLEMYLNTLLSHDLLSFFHCSGLVFFVYFKSVTGLFSGV

SEQ ID NO: 6650 - protein, 41 aa, Homo sapiens
MGKVGWLMVGGVAPGIRGGWGWTLGIMVGGAIAHCCCCLIR

SEQ ID NO: 6651 - protein, 62 aa, Homo sapiens
MPENLVLILALLLSVCGLKQVIFLSASIYSKMCTLIATKKVVAKTRNDAYWYLISLKHIVGF

SEQ ID NO: 6652 - protein, 457 aa, Homo sapiens
  SITE (84): Xaa equals any amino acid
  SITE (169): Xaa equals any amino acid
MVTCTCLPDYEGDGWSCRARNPCTDGHRGGCSEHANCLSTGLNTRRCECHAGYVGDGLQCLEESEPPVDRCLGQPPPCHSDAMXTDLHFQEKRAGVFHLQATSGPYGLNFSEAEAACEAQGAVLASFPQLSAAQQLGFHLCLMGWLANGSTAHPVVFPVADCGNGRVGXVSLGARKNLSERWDAYCFRVQDVACRCRNGFVGDGISTCNGKLLDVLAATANFSTFYGMLLGYANATQRGLDFLDFLDDELTYKTLFVPVNEGFVDNMTLSGPDLELHASNATLLSANASQGKLLPAHSGLSLIISDAGPDNSSWAPVAPGTVVVSRIIVWDIMAFNGIIHALASPLLAPPQPQAVLAPEAPPVAAGVGAVLAAGALLGLVAGALYLRARGKPMGFGFSAFQAEDDADDDFSPWQEGTNPTLVSVPNPVFGSDTFCEPFDDSLLEEDFPDTQRILTVK

SEQ ID NO: 6653 - protein, 64 aa, Homo sapiens [sequence omitted]

SEQ ID NO: 6654 - protein, 175 aa, Homo sapiens
  SITE (142): Xaa equals any amino acid
  SITE (149): Xaa equals any amino acid
  SITE (155): Xaa equals any amino acid
  SITE (158): Xaa equals any amino acid
  SITE (160): Xaa equals any amino acid
  SITE (163): Xaa equals any amino acid
MYWIVFALYTVIETVADQTVAWFPLYYELKIAFVIWLLSPYTKGASLIYRKFLHPLLSSKEREIDDYIVQAKERGYETMVNFGRQGLNLAATAAVTAAVKSQGAITERLRSFSMHDLTTIQGDEPVGQRPYQPLPEAKKKSXQPPVNQXVMEFHXKTXMXKQXKKQRGHIQIMRC

SEQ ID NO: 6655 - protein, 39 aa, Homo sapiens [sequence omitted]

SEQ ID NO: 6656 - protein, 63 aa, Homo sapiens
MLLLFIYFYSHPAPVPAGATSKPRYRVITCGPASVFSTSFSHSPPARCLGRLEQMFHFGLASG

SEQ ID NO: 6657 - protein, 32 aa, Homo sapiens
MSICPLLVMLILITWVRCPVSPVYRYCFSFCN

SEQ ID NO: 6658 - protein, 113 aa, Homo sapiens
MLSHVFPICTRPCLSMYFPCVPSMYLVYFLPLNHGILLTEPYVPYPAHCYALFPNSCLVGPSTPSPCHRISISAQIPPISIAFMYYPQSTLTIIFSQDCSLLFCVFLRGIKEK

SEQ ID NO: 6659 - protein, 43 aa, Homo sapiens
MPYMFRPAFLNCGTFAIFGQLNSVVGAVLCIAGCLAASLASTY

SEQ ID NO: 6660 - protein, 276 aa, Homo sapiens
MHNPDGSASPTADPGSDGSASPTADPGSELQTLGQAARRPPPPRAGHDAPRRTRPSARKPLSCFSRRPMPTREPPKTRGSRGHLHTHPPGPGPPLQGLAPRGLKTSAPRPPCQPQPGPHKAKTKKIVFEDELLSQALLGAKKPIGAIPKGHKPRPHPVPDYELKYPPVSSERERSRYVAVFQDQYGEFLELQHEVGCAQAKLRQLEALLSSLPPPQSQKEAQVAARVWREFEMKRMDPGFLDKQARCHYLKGKLRHLKTQIQKFDDQGDSEGSVYF

SEQ ID NO: 6661 - protein, 51 aa, Homo sapiens
MYILCSGLLQGQLHYFLGWAFLWLKLGCPWLSQGSQPKRHSGENLWPIREE

SEQ ID NO: 6662 - protein, 30 aa, Homo sapiens
MPFPISILQLCLQISNLSFCLQKIYKIPFV

SEQ ID NO: 6663 - protein, 54 aa, Homo sapiens
MRFQSYLWPSRILVGTYCIAAEVLFPSALASCGPVWQGGAPTKSWQPGAKTIIP

SEQ ID NO: 6664 - protein, 99 aa, Homo sapiens
MGPFFPYSLLSFFPCSFSSPSFIFLLLILKTGCSLFPCCPISPLCPYFSQSLSPLKSRAGRCYWCFFTLGPSSIFVFSVYPLPDTSFSPSLGPKAENQC

SEQ ID NO: 6665 - protein, 89 aa, Homo sapiens
MLVLVSGIIFSLADRSSSSTIRMDALAFLQGLLGTEPAEAFHPHLPILLPPVMACVADPFYKIAARGPGGAAGAGAGPVAAAQASDAGS

SEQ ID NO: 6666 - protein, 69 aa, Homo sapiens
MEPRSFLLPELGGRVSHIPLGLTLVFACFLMVRETAGGFSFRAGDLEEISRKRTNVLGSLRGTELIGYI

SEQ ID NO: 6667 - protein, 68 aa, Homo sapiens [sequence omitted]

SEQ ID NO: 6668 - protein, 49 aa, Homo sapiens
MVNLTVPPLLLLYVLGHGKPKECLRCSSGLSKSYTDLGRRSADSKHSLK

SEQ ID NO: 6669 - protein, 75 aa, Homo sapiens
MASYKTLKMLFSCLLTCSVSNEQYAVIFNFFPLYICFLSDCFKCFSLSLVLSNLIIIYLGVIFFIFFVLDIHRSS

SEQ ID NO: 6670 - protein, 86 aa, Homo sapiens [sequence omitted]

SEQ ID NO: 6671 - protein, 43 aa, Homo sapiens
MFHRFFILSALSRIRALTTFLDDLGMTHQTLLLLLGPSIYSFC

SEQ ID NO: 6672 - protein, 43 aa, Homo sapiens
MIVLKWIFLACVHECMCKPLKCFLEKILEVLIMVKLKMGVLPA

SEQ ID NO: 6673 - protein, 53 aa, Homo sapiens
MRLILFAMSPKLLFLFLFLYISVKSFDLVLSFRSVLFMSDLIHCFYHQLHFKL

SEQ ID NO: 6674 - protein, 118 aa, Homo sapiens [sequence omitted]

SEQ ID NO: 6675 - protein, 76 aa, Homo sapiens
  SITE (71): Xaa equals any amino acid
MLVLLSLLASGGLPLLLVGDVLASKSSTVLFLPGDSSPGCSMITPLPPSRMCLKAGSSGEQTVVPLSLLLXSKSSK

SEQ ID NO: 6676 - protein, 378 aa, Homo sapiens
AREKPYLVEEAVSYNELDYVSVGLDQQTVKLVCTNRRKQFLLDTADVALAEFFLASLKSAMIKGCREPPYPSILTDATMEKLALAKFVAQESKCEASAVTVRFYGLVHWEDPTDESLGPTPCHCSPPEGTITKEGMLHYKAGTSYLGKEHWKTCFVVLSNGILYQYPDRTDVIPLLSVNMGGEQCGGCRRANTTDRPHAFQVILSDRPCLELSAESEAEMAEWMQHLCQAVSKGVIPQGVAPSPCIPCCLVLTDDRLFTCHEDCQTSFFRSLGTAKLGDISAVSTEPGKEYCVLEFSQDSQQLLPPWVIYLSCTSELDRLLSALNSGWKTIYQVDLPHTAIQEASNKKKFEDALSLIHSAWQRSDSLCRGRASRDPWC

SEQ ID NO: 6677 - protein, 77 aa, Homo sapiens
MAGLGLLSLVQFSVTGGHWTGIADSLVATLGCRLSGSVPPPLLPAPSGHSRALHQTLTWCLHLLSLSPSSNPWKSLV

SEQ ID NO: 6678 - protein, 50 aa, Homo sapiens [sequence omitted]

SEQ ID NO: 6679 - protein, 29 aa, Homo sapiens
MHLVGGTLLVLAPRGAVLPLSSQSMPFLQ

SEQ ID NO: 6680 - protein, 102 aa, Homo sapiens
MLLHWLLQNELQSAVASCLVSISLGKEDFLQTGCKVKSHVGVIHRREKGGAIYLPNSLVLPTSHWIRLSYRNRHRGFILWTLMSTWEARCHGPCVMFDFNQK

SEQ ID NO: 6681 - protein, 65 aa, Homo sapiens
SILLVSLDLLPTSILLVSLWICSPPPSSWVNPGSFVGYLERKRQKLICQMTRTNRLFGMKRKTSG

SEQ ID NO: 6682 - protein, 47 aa, Homo sapiens
MSLQAIDLLWSLCTQTSLLTLICICSHSQALSSSPQLHLRSSSIRFS

SEQ ID NO: 6683 - protein, 103 aa, Homo sapiens
  SITE (50): Xaa equals any amino acid
  SITE (62): Xaa equals any amino acid
  SITE (64): Xaa equals any amino acid
  SITE (74): Xaa equals any amino acid
  SITE (80): Xaa equals any amino acid
  SITE (84): Xaa equals any amino acid
  SITE (87): Xaa equals any amino acid
  SITE (94): Xaa equals any amino acid
  SITE (97): Xaa equals any amino acid
  SITE (98): Xaa equals any amino acid
  SITE (100): Xaa equals any amino acid
MKTVSLLLTLWFSQTFSFNLFFAPPHSLLQSSIFFSVSSITTVHPILVFXFAFFGAWLPRLXSXLLRRSGQGDXLSPGFXGCSXLRXAPLCSLXSGXXVXPVS

SEQ ID NO: 6684 - protein, 69 aa, Homo sapiens
MFLIVFCFLQSLSAMPIVLIFYRSSLKILNRGIGSGQSEWLEFWLSKKNFILHKHVVRSFCAYAAWIGC

SEQ ID NO: 6685 - protein, 392 aa, Homo sapiens
MDALVEDDICILNHEKAHKRDTVTPVSIYSGDESVASHFALVTAYEDIKKRLKDSEKENSLLKKRIRFLEEKLIARFEEETSSVGREQVNKAYHAYREVCIDRDNLKSKLDKMNKDNSESLKVLNEQLQSKEVELLQLRTEVETQQVMRNLNPPSSNWEVEKLSCDLKIHGLEQELELMRKECSDLKIELQKAKQTDPYQEDNLKSRDLQKLSISSDNMQHAYWELKREMSNLHLVTQVQAELLRKLKTSTAIKKACAPVGCSEDLGRDSTKLHLMNFTATYTRHPPLLPNGKALCHTTSSPLPGDVKVLSEKAILQSWTDNERSIPNDGTCFQEHSSYGRNSLEDNSWVFPSPPKSSETAFGETKTKTLPLPNLPPLHYLDQHNQNCLYKN

SEQ ID NO: 6686 - protein, 42 aa, Homo sapiens
MISAQSSISWALIFIMAPALHLVLRFPSKFKPERKGEARSPK

SEQ ID NO: 6687 - protein, 101 aa, Homo sapiens [sequence omitted]

SEQ ID NO: 6688 - protein, 68 aa, Homo sapiens
MPLQRRVKVKTTSSRCLPGTTWDLLSSPCSAASGHWALLPSTSPRGPARPSPKGTSAWPAPPPAGPSS

SEQ ID NO: 6689 - protein, 129 aa, Homo sapiens
MFLLNFRYIMRFFFWPMLQAKLMSFHFLKPIIFMNSLILCLKQSCSCEVEISLLPLSQQTHRTDLGFSHSGSQNEPFLNLDKRAAEAHCAVMVLCLLGRDLKARRSREGPALCSSQVVICILKLARKRF

SEQ ID NO: 6690 - protein, 40 aa, Homo sapiens
MRLVPSHLLAILINIKDQMMCFCIALMMRLSSCIASSGPW

SEQ ID NO: 6691 - protein, 42 aa, Homo sapiens
MSFIALHPLLPEAALGVPGQSPHRPLWQTQCCVAPPQPRAEF

SEQ ID NO: 6692 - protein, 42 aa, Homo sapiens
MGSSETSLLGLQLVTFLLLHMVLLLCVTVSKFPFCKDTAILD

SEQ ID NO: 6693 - protein, 55 aa, Homo sapiens
MGTVGLWPSWLWLPASWPLTSCGVTRRRLRGPGLRRTSQTGRHTSPCPTATWAES

SEQ ID NO: 6694 - protein, 94 aa, Homo sapiens
  SITE (77): Xaa equals any amino acid
MQDIVYKLVPGLQEGECLTVLLIPEVPAWPLQPLLSWKFGSRMGGPFPFGRITVFSSLLSAQLHLLGWSLLSSKMRXHLFTPYVYSFSKYGSHV

SEQ ID NO: 6695 - protein, 187 aa, Homo sapiens [sequence omitted]

SEQ ID NO: 6696 - protein, 122 aa, Homo sapiens
MRHHTWLIFLILIFVEMGGQVSLCCPGCSRTPGHKPSSHLSLPMRRNYRWLRCEPPCLAFLHYLEIRWEEAFFWVGLRRHTEVPQVIGAGPLPFSPPWVVVDRSLGWDGEERSCCVSCLLFK

SEQ ID NO: 6697 - protein, 29 aa, Homo sapiens
MPGIFILFMTLASTFDQRLLNDSQPKDHS

SEQ ID NO: 6698 - protein, 87 aa, Homo sapiens
MENTFFVFLVSALLLAVIYLNIQVVRGQRKVICLLKEQISNEGEDKIFLINKLHSIYERKEREERSRVGTTEEAAAPPALLTDEQDA

SEQ ID NO: 6699 - protein, 57 aa, Homo sapiens
MGHLHWGVSGNFFFPRLSLFLLFAWLQITQANEPRLPGKYSIKAIKITICITFRTSA

SEQ ID NO: 6700 - protein, 49 aa, Homo sapiens [sequence omitted]

SEQ ID NO: 6701 - protein, 26 aa, Homo sapiens
MHHHTQLMFIYLFIYLFILGVFFFFF

SEQ ID NO: 6702 - protein, 81 aa, Homo sapiens
MRTNQSLCSFLLWSVPFHQAACPQAKDHPLEPSMHPEGTQLQSCSTMLGPRQLSSEKQPLLPPRSHLKSSPMLRACKGLTS

SEQ ID NO: 6703 - protein, 237 aa, Homo sapiens
MANFKGHALPGSFFLIIGLCWSVKYPLKYFSHTRKNSPLHYYQRLEIVEAAIRTLFSVTVSGIVDMLTYLVSHVPLGVDRLVMAVAVFMEGFLFYYHVHNRPPLDQHIHSLLLYALFGGCVSISLEVIFRDHIVLELFRTSLIILQGTWFWQIGFVLFPPFGTPEWDQKDDANLMFITMCFCWHYLAALSIVAVNYSLVYCLLTRMKRHGRGEIIGIQKLNSDDTYQTALLSGSDEE

SEQ ID NO: 6704 - protein, 56 aa, Homo sapiens
MFKRMCFFFQVFLPLACTELLWKGAPCRHIFQTGPDLLVTQRCVHSLLLGYLISIF

SEQ ID NO: 6705 - protein, 27 aa, Homo sapiens
MVLFLFFVFVFCLYWELALLVTSLFSF

SEQ ID NO: 6706 - protein, 56 aa, Homo sapiens
  SITE (52): Xaa equals any amino acid
MNGCHRRKRLHLCKTIYLLWFVFSFLLSNEVVSSHWHILRAVQIICTLFHRXISAF

SEQ ID NO: 6707 - protein, 70 aa, Homo sapiens
  SITE (60): Xaa equals any amino acid
MEFTQIVLSFRTKEMPVIFLIVNLAKHRLKEWLSSLPSTLSLLLICAKCHCLLLIPKTVXSSLCLLPNSK

SEQ ID NO: 6708 - protein, 45 aa, Homo sapiens
MCCFFLKTLNLWLGYFCQFICLPCQVTLCLIDVLCVFHSVHAELS

SEQ ID NO: 6709 - protein, 85 aa, Homo sapiens
MQVFFLSEIGMLWVVVKMAHSAMLVSHTQDPTPSRWPCSLAQSILLTCSPQHRFSLERKIQLPPRRWWAEGREGCWVRERVGERT

SEQ ID NO: 6710 - protein, 40 aa, Homo sapiens
MGMLLAFWLPGASWQEAGPRASTQRMRTQTQMSTRKPKPA

SEQ ID NO: 6711 - protein, 24 aa, Homo sapiens
MKLSLLILTLMQRYFRTITNSLCK

SEQ ID NO: 6712 - protein, 196 aa, Homo sapiens
MSRRSMLLAWALPSLLRLGAAQETEDPACCSPIVPRNEWKALASECAQHLSLPLRYVVVSHTAGSSCNTPASCQQQARNVQHYHMKTLGWCDVGYNFLIGEDGLVYEGRGWNFTGAHSGHLWNPMSIGISFMGNYMDRVPTPQAIRAAQGLLACGVAQGALRSNYVLKGHRDVQRTLSPGNQLYHLIQNWPHYRSP

SEQ ID NO: 6713 - protein, 261 aa, Homo sapiens
MAAACRSVKGLVAVITGGASGLGLATAERLVGQGASAVLLDLPNSGGEAQAKKLGNNCVFAPADVTSEKDVQTALALAKGKFGRVDVAVNCAGIAVASKTYNLKKGQTHTLEDFQRVLDVNLMGTFNVIRLVAGEMGQNEPDQGGQRGVIINTASVAAFEGQVGQAAYSASKGGIVGMTLPIARDLAPIGIRVMTIAPGLFGTPLLTSLPEKVCNFLASQVPFPSRLGDPAEYAHLVQAIIENPFLNGEVIRLDGAIRMQP

SEQ ID NO: 6714 - protein, 103 aa, Homo sapiens [sequence omitted]

SEQ ID NO: 6715 - protein, 54 aa, Homo sapiens [sequence omitted]

SEQ ID NO: 6716 - protein, 229 aa, Homo sapiens
MDLLQFLAFLFVLLLSGMGATGTLRTSLDPSLEIYKKMFEVKRREQLLALKNLAQLNDIHQQYKILDVMLKGLFKVLEDSRTVLTAADVLPDGPCPQDEKLKDAFSHVVENTAFFGDVVLRFPRIVHYYFDHNSNWNLLIRWGISFCNQTGVFNQGPHSPILSLMAQELGISEKDSNFQNPFKIDRTEFIPSTDPFQKALREEEKRRKKEEKRKEIRKGPRISRSQSEL

SEQ ID NO: 6717 - protein, 55 aa, Homo sapiens
MIKHALIRPFIVFSLLLRLCSENLFCPNTQFIVLSCFQSVVKSLLSILNLSYCIF

SEQ ID NO: 6718 - protein, 86 aa, Homo sapiens [sequence omitted]

SEQ ID NO: 6719 - protein, 55 aa, Homo sapiens
MRPWWSLLLEACATCAQTGPTRSTSCTQEVSHSSSTAYPAPMRRRCCLPSPRSCT

SEQ ID NO: 6720 - protein, 137 aa, Homo sapiens
MQACVLLLGLVLSAQLQSPENMRMGGGRVLLRAHPVPAGGGQCQSSAKGPWVGTGPEREERDSPEGRWASYWAQSWEGVAASTGWAWTPLAPTPSGCGCSPKPGEQDRPGVSGRLPGASQSSQGPPPASASLRAVPK

SEQ ID NO: 6721 - protein, 199 aa, Homo sapiens [sequence omitted]

SEQ ID NO: 6722 - protein, 171 aa, Homo sapiens [sequence omitted]

SEQ ID NO: 6723 - protein, 89 aa, Homo sapiens
MEKPLFLSPFPELVFCCFCFILFWGDSFLLFNLESPVPLGCRQFLPGPSRNPHSPSPLLRYLQEAANLVHSDKPPTQISLLPLCPKSHH

SEQ ID NO: 6724 - protein, 56 aa, Homo sapiens [sequence omitted]

SEQ ID NO: 6725 - protein, 45 aa, Homo sapiens
  SITE (11): Xaa equals any amino acid
MHRQLLGFCFXFCFFFKRHCDCILLYLIGFVFLLTMVKIHLSEHS

SEQ ID NO: 6726 - protein, 21 aa, Homo sapiens
MGWVSSPHVKRRECVLKKPFF

SEQ ID NO: 6727 - protein, 45 aa, Homo sapiens
MGGTESYISSSPLLRTLLLSYLVFLYYLYLLFYVARSPFGKAEYK

SEQ ID NO: 6728 - protein, 398 aa, Homo sapiens
MGAPAASLLLLLLLFACCWAPGGANLSQDDSQPWTSDETVVAGGTVVLKCQVKDHEDSSLQWSNPAQQTLYFGEKRALRDNRIQLVTSTPHELSISISNVALADEGEYTCSIFTMPVRTAKSLVTVLGIPQKPIITGYKSSLREKDTATLNCQSSGSKPAARLTWRKGDQELHGEPTRIQEDPNGKTFTVSSSVTFQVTREDDGASIVCSVNHESLKGADRSTSQRIEVLYTPTAMIRPDPPHPREGQKLLLHCEGRGNPVPQQYLWEKEGSVPPLKMTQESALIFPFLNKSDSGTYGCTATSNMGSYKAYYTLNVNDPSPVPSSSSTYHAIIGGIVAFIVFLLLIMLIFLGHYLIRHKGTYLTHEAKGSDDAPDADTAIINAEGGQSGGDDKKEYFI

SEQ ID NO: 6729 - protein, 446 aa, Homo sapiens
MFSLSWQLSLVTFMGFPIIMMVSNIYGKYYKRLSKEVQNALARASNTAEETISAMKTVRSFANEEEEAEVYLRKLQQVYKLNRKEAAAYMYYVWGSGLTLLVVQVSILYYGGHLVISGQMTSGNLIAFIIYEFVLGDCMESVGSVYSGLMQGVGAAEKVFEFIDRQPTMVHDGSLAPDHLEGRVDFENVTFTYRTRPHTQVLQNVSFSLSPGKVTALVGPSGSGKSSCVNILENFYPLEGGRVLLDGKPISAYDHKYLHRVISLVSQEPVLFARSITDNISYGLPTVPFEMVVEAAQKANAHGFIMELQDGYSTETGEKGAQLSGGQKQRVAMARALVRNPPVLILDEATSALDAESEYLIQQAIHGNLQKHTVLIIAHRLSTVEHAHLIVVLDKGRVVQQGTHQQLLAQGGLYAKLVQRQMLGLQPAADFTAGHNEPVANGSHKA

SEQ ID NO: 6730 - protein, 201 aa, Homo sapiens
MVTLAELLVLLAALLATVSGYFVSIDAHAEECFFERVTSGTKMGLIFEVAEGGFLDIDVEITGPDNKGIYKGDRESSGKYTFAAHMDGTYKFCFSNRMSTMTPKIVMFTIDIGEAPKGQDMETEAHQNKLEEMINELAVAMTAVKHEQEYMEVRERIHRAINDNTNSRVVLWSFFEALVLVAMTLGQIYYLKRFFEVRRVV

SEQ ID NO: 6731 - protein, 136 aa, Homo sapiens
MASLGLLLLLLLTALPPLWSSSLPGLDTAESKATIADLILSALERATVFLEQRLPEINLDGMVGVRVLEEQLKSVREKWAQEPLLQPLSLRVGMLGEKLEAAIQRSLHYLKLSDPKYLRGRTAASPAASQTSAGAS

SEQ ID NO: 6732 - protein, 285 aa, Homo sapiens
MVVAGVVVLILALVLAWLSTYVADSGSNQLLGAIVSAGDTSVLHLGHVDHLVAGQGNPEPTELPHPSEGNDEKAEEAGEGRGDSTGEAGAGGGVEPSLEHLLDIQGLPKRQAGAGSSSPEAPLRSEDSTCLPPSPGLITVRLKFLNDTEELAVARPEDTVGALKSKYFPGQESQMKLIYQGRLLQDPARTLRSLNITDNCVIHCHRSPPGSAVPGPSASLAPSATEPPSLGVNVGSLMVPVFVVLLGVVWYFRINYRQFFTAPATVSLVGVTVFFSFLVFGMYGR

SEQ ID NO: 6733 - protein, 119 aa, Homo sapiens
MGQGACQKYVCWFLNVVCPCPPGSGRVHVSPHTCAREGASWRGDSRARGLHLWLPLASLGGPGLPGSQALSCGTWHLADQLAGRKIGGHRAGGQCPLPVSIRSTCHCMQPVGTFLAVRN

SEQ ID NO: 6734 - protein, 27 aa, Homo sapiens
MAIFCFSLCSLGSILGKGMSTFGSISV

SEQ ID NO: 6735 - protein, 55 aa, Homo sapiens
MSIVMSPLLLPICYLNLLLFFVNLAKNLSILFVSSKKYTFVFIDFLYCFSILYFI

SEQ ID NO: 6736 - protein, 99 aa, Homo sapiens
  SITE (75): Xaa equals any amino acid
MGRVSIQQLGVLVALPVPLLLLGCGSALHPGAPRSIPHTMPSTREVGQTRPGPCQPSVPRFSHWLHRMVAFSLPXSQSCSEGAWRSTLSHQGQLETKAI

SEQ ID NO: 6737 - protein, 64 aa, Homo sapiens
MAVTLSLLLGGRVCAAVTRCGFATRGVAGPGPIGREPDPDSDWEPEERELQEVERYRLLPGPSA

SEQ ID NO: 6738 - protein, 61 aa, Homo sapiens
  SITE (58): Xaa equals any amino acid
MEHAAGLPVTRHPLALLLALCPGPFPALLLPLLPWGYPLAPPGLCKLPQGAPLPCSSXLTS

SEQ ID NO: 6739 - protein, 54 aa, Homo sapiens
MAWCLLSVFFLRALCAHSSTAYKCVLCSPRSPWLVEANFWLDFYGKSYFMSPKH

SEQ ID NO: 6740 - protein, 44 aa, Homo sapiens
MGLFPKLLSLIFQIVYFLPSALEMTVASPSCHFCDALESLFFSN

SEQ ID NO: 6741 - protein, 57 aa, Homo sapiens
MKFYAVLLSICLLLSCWCACHVRDCNLICLFSTVKAITRELLQLPSYVKRFFFNSLR

SEQ ID NO: 6742 - protein, 57 aa, Homo sapiens
MNCVEWWKSVFLFVVLLFVTSVSCLGVVGVAVEGSLQSCSFYSLCNKRLEHVKGIFK

SEQ ID NO: 6743 - protein, 25 aa, Homo sapiens
MLHWGVLCSLFLMLFNEGASASLQQ

SEQ ID NO: 6744 - protein, 35 aa, Homo sapiens
MFGAFFFCLLFKSFLNGGPFHLHLSFPLKSLKPFL

SEQ ID NO: 6745 - protein, 98 aa, Homo sapiens
MVYIYHIFFIHSLLDGQLGWFHIFAIVSCAAPDIIFNSFAFSTYISKSCSFYLQNVSCIHSSLSIFNLFQCPIISCMEECNNWLTGLFLHFKIKRCDR

SEQ ID NO: 6746 - protein, 115 aa, Homo sapiens
MAVAVLLCGCIVATVSFFWEESLTQHVAGLLFLMTGIFCTISLCTYAASISYDLNRLPKLIYSLPADVEHGYSWSIFCAWCSLGFIVAAGGLCIAYPFISRTKIAQLKSGRDSTV

SEQ ID NO: 6747 - protein, 68 aa, Homo sapiens
  SITE (50): Xaa equals any amino acid
MPHFLDWFVPVYLVISVLILVGFGACIYYFEPGLQEAHKWRMQRPLVDRXLRKTLMVRDNLAFGGPEV

SEQ ID NO: 6748 - protein, 243 aa, Homo sapiens
  SITE (15): Xaa equals any amino acid
  SITE (190): Xaa equals any amino acid
MDQYCILGRIGEGAXGIVFKAKHVETGEIVALKKVALRRLEDGFPNQALREIKALQEMEDNQYVVQLKAVFPHGGGFVLAFEFMLSDLAEVVRHAQRPLAQAQVKSYLQMLLKGVAFCHANNIVHRDLKPANLLISASGQLKIADFGLARVFSPDGSRLYTHQVATRSSLSCRTTTRSPLRSRCPCPWRXCCLTSLPRHWICWVNSFSTLLTSASQLPRLSSISTSSQLPCLPIHLSCRFLSV

SEQ ID NO: 6749 - protein, 38 aa, Homo sapiens [sequence omitted]

SEQ ID NO: 6750 - protein, 65 aa, Homo sapiens
MEAKFGLLCFLVSTPWAELLSLLLHLTQVPFPGSQGLGLNNCRAACHDLSHLLLSHSAINQTKEF

SEQ ID NO: 6751 - protein, 65 aa, Homo sapiens
  SITE (44): Xaa equals any amino acid
MLCTILTVVIIIAAQTTRTTGIPKNAPGPAPLCAPRSPRLFLQXYRGPNGRPAHPFLGPSDLDTS

SEQ ID NO: 6752 - protein, 57 aa, Homo sapiens
  SITE (10): Xaa equals any amino acid
  SITE (28): Xaa equals any amino acid
MLLVYDLYLXPKLWALATPQKNGKGARXGDGTPAQAFWDFWSHLISADPQTWERAAP

SEQ ID NO: 6753 - protein, 213 aa, Homo sapiens
MNRMELLKLLLTCFSEAMYLPPAPESGSTNPWVQFFCSTENRHALPLFTSLLNTVCAYDPVGYGIPYNHLLFSDYREPLVEEAAQVLIVTLDHDSASSASPTVDGTTTGTAMDDADPPGPENLFVNYLSRIHREEDFQFILKGIARLLSNPLLQTYLPNSTKKDPVPPGAASSLLEALRLQQEIPLLRAEEQRRPRHPCPHPLLPQRCPGRSV

SEQ ID NO: 6754 - protein, 41 aa, Homo sapiens
  SITE (41): Xaa equals any amino acid
MDINFCLRGRHGVLFCFVLFCFCHLLTVLSTHRAFYYLSAX

SEQ ID NO: 6755 - protein, 32 aa, Homo sapiens
  SITE (19): Xaa equals any amino acid
  SITE (20): Xaa equals any amino acid
MKRYNSLQRTQLVLLALRXXTVSASSSCSLSS

SEQ ID NO: 6756 - protein, 64 aa, Homo sapiens
MCCASHPCQREGWLCVIFTVFLKVTVCVFTFVQITGSKAANSAYYMLKLPSLCFLHIWNYTFKD

SEQ ID NO: 6757 - protein, 119 aa, Homo sapiens
MAILLACFTAVLAFICLQFWCVRCHEPRWSYRAGHMEEANGLVRWPEEAPDLGQREEDLQGLPLVEMPRKNSRDGAELDPEANQDAPDAGALQRGGVVTHPLYCLIVGNESGEESARIM

SEQ ID NO: 6758 - protein, 152 aa, Homo sapiens
MLPSAWGPLQVASFFLLSFSFCFLSSSPHLGRQETHLVVLEDDEGAPCPAEDELALQDNGFLSKNEVLRSKVSRLTERLRKRYPTNNFGNCTGCSATFSVLKKRRSCSNCGNSFCSRCCSFKVPKSSMGATAPEAQRETVFVCASCNQTLSK

SEQ ID NO: 6759 - protein, 21 aa, Homo sapiens
MKNSFFTVSWALTCSFSWATV

SEQ ID NO: 6760 - protein, 44 aa, Homo sapiens
MMGILFIHLFIYLFTEDWFLPVQFNSFSEVSIMIRKIDCSYYSK

SEQ ID NO: 6761 - protein, 53 aa, Homo sapiens [sequence omitted]

SEQ ID NO: 6762 - protein, 318 aa, Homo sapiens
MHKCYTFLIFMVLLLPSLGLSSLDLFFRWLFDKKFLAEAAIRFECVFLPDNGAFFVNYVIASAFIGNAMDLLRIPGLLMYMIRLCLARSAAERRNVKRHQAYEFRFGAAYAWMMCVFTVVMTYSITCPIIVPFGLMYMLLKHLVDRYNLYYAYLPAKLDKKIHSGAVNQVVAAPILCLFWLLFFSTMRTGFLAPTSMFTFVVLVITIVICLCHVCFGHFKYLSAHNYKIEHTETDTVDPRSNGRPPTAAAVPKSAKYIAQVLQDSEVDGDGDGAPGSSGDEPPSSSSQDEELLMPPDALTDTDFQSCEDSLIENEIHQ

SEQ ID NO: 6763 - protein, 97 aa, Homo sapiens
MALLALASAVPSALLALAVFRVPAWACLLCFTTYSERLRICQMFVGMRSPSLKSVRRPSRPPSRASLTPKSVRRPSTLHQCPGEGAEGGQERPRGSG

SEQ ID NO: 6764 - protein, 447 aa, Homo sapiens
  SITE (8): Xaa equals any amino acid
  SITE (28): Xaa equals any amino acid
  SITE (309): Xaa equals any amino acid
  SITE (333): Xaa equals any amino acid
MELSQMSXLMGLSVLLGLLALMATAAVXRGWLRAGEERSGRPACQKANGFPPDKSSGSKKQKQYQRIRKEKPQQHNFTHRLLAAALKSHSGNISCMDFSSNGKYLATCADDRTIRIWSTKDFLQREHRSMRANVELDHATLVRFSPDCRAFIVWLANGDTLRVFKMTKREDGGYTFTATPEDFPKKHKAPVIDIGIANTGKFIMTASSDTTVLIWSLKGQVLSTINTNQMNNTHAAVSPCGRFVASCGFTPDVKVWEVCFGKKGEFQEVVRAFELKGHSAAVHSFAFSNDSRRMASVSKDGTWKLWDTXVEYKKKQDPYLLKTGRFEEAAGAXPCRLALSPNAQVLALASGSSIHLYNTRRGEKEECFERVHGECIANLSFDITGRFLASCGDRAVRLFHNTPGHRAMVEEMQGHLKRASNESTRQRLQQQLTQAQETLKSLGALKK

SEQ ID NO: 6765 - protein, 40 aa, Homo sapiens
MLKRVILLVEMFIHFLIYAKSFYHKSWEQLSFTHYLLQIS

SEQ ID NO: 6766 - protein, 473 aa, Homo sapiens
MKRASAGGSRLLAWVLWLQAWQVAAPCPGACVCYNEPKVTTSCPQQGLQAVPVGIPAASQRIFLHGNRISHVPAASFRACRNLTILWLHSNVLARIDAAAFTGLALLEQLDLSDNAQLRSVDPATFHGLGRLHTLHLDRCGLQELGPGLFRGLAALQYLYLQDNALQALPDDTFRDLGNLTHLFLHGNRISSVPERAFRGLHSLDRLLLHQNRVAHVHPHAFRDLGRLMTLYLFANNLSALPTEALAPLRALQYLRLNDNPWVCDCRARPLWAWLQKFRGSSSEVPCSLPQRLAGRDLKRLAANDLQGCAVATGPYHPIWTGRATDEEPLGLPKCCQPDAADKASVLEPGRPASAGNALKGRVPPGDSPPGNGSGPRHINDSPFGTLPGSAEPPAHCSAARGLRATRFPTSGPRRRPGCSRKNRTRSHCRLGQAGSGGGGTGDSEGSGALPSLTCSLTPLGLALVLWTVLGPC

SEQ ID NO: 6767 - protein, 587 aa, Homo sapiens
MWRLGCLIWEVFNGPLPRAAALRNPGKIPKTLVPHYCELVGANPKVRPNPARFLQNCRAPGGFMSNRFVETNLFLEEIQIKEPAEKQKFFQELSKSLDAFPEDFCRHKVLPQLLTAFEFGNAGAVVLTPLFKVGKFLSAEEYQQKIIPVVVKMFSSTDRAMRIRLLQQMEQFIQYLDEPTVNTQIFPHVVHGFLDTNPAIREQTVKSMLLLAPKLNEANLNVELMKHFARLQAKDEQGPIRCNTTVCLGKIGSYLSASTRHRVLTSAFSRATRDPFAPSRVAGVLGFAATHNLYSMNDCAQKILPVLCGLTVDPEKSVRDQAFKAIRSFLSKLESVSEDPTQLEEVEKDVHAASSPGMGGAAASWAGWAVTGVSSLTSKLIRSHPTTAPTETNIPQRPTPEGHWETQEEDKDTAEDSSTADRWDDEDWGSLEQEAESVLAQQDDWSTGGQVSRASQVSNSDHKSSKSPESDWSSWEAEGSWEQGWQEPSSQEPPPDGTRLASEYNWGGPESSDKGDPFATLSARPSTQPRPDSWGEDNWEGLETDSRQVKAELARKKREERRREMEAKRAERKVAKGPMKLGARKLD

SEQ ID NO: 6768 - protein, 27 aa, Homo sapiens
  SITE (15): Xaa equals any amino acid
MGSSRGVLFCFVLIXLVVGIAGREIKF

SEQ ID NO: 6769 - protein, 216 aa, Homo sapiens
MRLSALLALASKVTLPPHYRYGMSPPGSVADKRKNPPWIRRRPVVVEPISDEDWYLFCGDTVEILEGKDAGKQGKVVQVIRQRNWVVVGGLNTHYRYIGKTMDYRGTMIPSEAPLLHRQVKLVDPMDRKPTEIEWRFTEAGERVRVSTRSGRIIPKPEFPRADGIVPETWIDGPKDTSVEDALERTYVPCLKTLQEEVMEAMGIKETRKYKKVYWY

SEQ ID NO: 6770 - protein, 49 aa, Homo sapiens
MSLRQKSSFRLMVMSLTILKLSKTTVLCLRCLHSLKLTWRDGARCINAE

SEQ ID NO: 6771 - protein, 124 aa, Homo sapiens
MLLILVTPVPTRLRARPRLDLLVLTPRACPASRVRGRLSCRRTLPRMGPASCSALATNAAPGPPHPAGPAFSSISHMATTPQSLEPPAGNSVPQSLMSILDPASSWVPKSASPPRVACPCPPAL

SEQ ID NO: 6772 - protein, 52 aa, Homo sapiens
MWLNFSDVHTYLSSIALLCFCLSGVLCCICNNSVFHIQQYILIIITFPLVVI

SEQ ID NO: 6773 - protein, 51 aa, Homo sapiens
MLTLTHFVSYDYFIVKRLVGWLVGWLVCFVLVSPFIHSLSTNYNFLCFMCG

SEQ ID NO: 6774 - protein, 203 aa, Homo sapiens
MPTSSYRSVWPLTLLALKSTACALAFTRMPGFQTPSEFLENPSQSSRLTAPFRKHVRPKKQHEIRRLGELVKKLSDFTGCTQVVDVGSGQGHLSRFMALGLGLMVKSIEGDQRLVERAQRLDQELLQALEKEEKRNPQICAAGATASGARSPAATESGCPSGPPGPGEPCGGLLQPGSTACPTGGDAYSTGPAAVPSGTGFPC

SEQ ID NO: 6775 - protein, 78 aa, Homo sapiens
MPAVSGPGPLFCLLLLLLDPHSPETGCPPLRRFEYKLSFKGPRLALPGAGIPFWSHHGGEGQGWGPLCPGSLKVLEGL

SEQ ID NO: 6776 - protein, 40 aa, Homo sapiens
MPLQPWDTFMILGLYFLVSGMTSDSAGQGKLNSVQDGHHW

SEQ ID NO: 6777 - protein, 256 aa, Homo sapiens
  SITE (75): Xaa equals any amino acid
  SITE (187): Xaa equals any amino acid
  SITE (229): Xaa equals any amino acid
  SITE (232): Xaa equals any amino acid
  SITE (235): Xaa equals any amino acid
  SITE (236): Xaa equals any amino acid
  SITE (237): Xaa equals any amino acid
MLGAKPHWLPGPLHSPGLPLVLVLLALGAGWAQEGSEPVLLEGECLVVCEPGRAAAGGPGGAALGEAPPGRVAFXAVRSHHHEPAGETGNGTSGAIYFDQVLVNEGGGFDRASGSFVAPVRGVYSFRFHVVKVYNRQTVQVSLMLNTWPVISAFANDPDVTREAATSSVLLPLDPGDRVSLRLRRGXSTGWLEILKFLWLPHLPSLKDPSLSSTRIQPLTTFFCPLLPXKQXKQXXXSLWLLSHLFAWEPVPNTQV

SEQ ID NO: 6778 - protein, 136 aa, Homo sapiens [sequence omitted]

SEQ ID NO: 6779 - protein, 322 aa, Homo sapiens
MALPPGPAALRHTLLLLPALLSSGWGELEPQIDGQTWAERALRENERHAFTCRVAGGPGTPRLAWYLDGQLQEASTSRLLSVGGEAFSGGTSTFTVTAHRAQHELNCSLQDPRSGRSANASVILNVQFKPEIAQVGAKYQEAQGPGLLVVLFALVRANPPANVTWIDQDGPVTVNTSDFLVLDAQNYPWLTNHTVQLQLRSLAHNLSVVATNDVGVTSASLPAPGPSRHPSLISSDSNNLKLNNVRLPRENMSLPSNLQLNDLTPDSRAVKPADRQMAQNNSRPELLDPEPGGLLTSQGFIRLPVLGYIYRVSSVSSDEIWL

SEQ ID NO: 6780 - protein, 40 aa, Homo sapiens
MSHASRKTKHFPPLLQNPFLMLTLLTMAVSAQPLPFSRPR

SEQ ID NO: 6781 - protein, 21 aa, Homo sapiens
FIPDKRRPTLMLGILPSLPVP

SEQ ID NO: 6782 - protein, 314 aa, Homo sapiens
MVAPVWYLVAAALLVGFILFLTRSRGRAASAGQEPLHNEELAGAGRVAQPGPLEPEEPRAGGRPRRRRDLGSRLQAQRRAQRVAWAEADENEEEAVILAQEEEGVEKPAETHLSGKIGAKKLRKLEEKQARKAQREAEEAEREERKRLESQREAEWKKEEERLRLEEEQKEEEERKAREEQAQREHEEYLKLKEAFVVEEEGVGETMTEEQSQSFLTEFINYIKQSKVVLLEDLASQVGLRTQDTINRIQDLLAEGTITGVIDDRGKFIYITPEELAAVANFIRQRGRVSIAELAQASNSLIAWGRESPAQAPA

SEQ ID NO: 6783 - protein, 463 aa, Homo sapiens
ARGTNLARSKSVSSGDLRPMGIALGGHRGTGELGAALSRLALRPEPPTLRRSTSLRRLGGFPGPPTLFSIRTEPPASHGSFHMISARSSEPFYSDDKMAHHTLLLGSGHVGLRNLGNTCFLNAVLQCLSSTRPLRDFCLRRDFRQEVPGGGRAQELTEAFADVIGALWHPDSCEAVNPTRFRAVFQKYVPSFSGYSQLDAQEFLKLLMERLHLEINRRDRRAPPILANGPVPSPPRRGGALLEEPELSDDDRANLMWKRYLEREDSKIVDLFVGQLKSCLKCQACGYRSTTFEVFCDLSLPIPKKGFAGGKVSLRDCFNLFTKEEELESENAPVCDRCRQKTRSTKKLTVQRFPRILVLHLNRFSASRGSIKKSSVGVDFPLQRLSLGDFASDKAGSPVYQLYALCNHSGSVHYGHYTALCRCQTGWHVYNDSRVSPVSENQVASSEGYVLFYQLMQEPPRCL

SEQ ID NO: 6784 - protein, 51 aa, Homo sapiens
  SITE (20): Xaa equals any amino acid
  SITE (28): Xaa equals any amino acid
MHYLLKECDIDTDAYFFFFXLLVLFLPXKYSPPFYSIVLFRWNDSYKISHY

SEQ ID NO: 6785 - protein, 50 aa, Homo sapiens
MLILVTMMKMVLGLFFLMNLLSGKKSVRHHSKNYVKKMQTFQFPRVYKLM

SEQ ID NO: 6786 - protein, 44 aa, Homo sapiens [sequence omitted]

SEQ ID NO: 6787 - protein, 52 aa, Homo sapiens
MHNLLLSCVIFNFPLVFIVARTPYLPSLLSICNLEAPVYLRIDPGWPHLCMA

SEQ ID NO: 6788 - protein, 90 aa, Homo sapiens
MNWSFLCMCLACFPLDLVLGVRYAIEDCVFLFHLSPVRGALILCPKLPPWPWRCFCGLVGFPCAHACPLSDSGFASPCQSVPRLLTALAR

SEQ ID NO: 6789 - protein, 45 aa, Homo sapiens
MAWVTSYGPLEDESNPSHWFFFANSFAFIFLITINSIFHVLRAPG

SEQ ID NO: 6790 - protein, 85 aa, Homo sapiens
  SITE (81): Xaa equals any amino acid
MNQRYRHKIKNYKTIHYAYDSCNNKKVQGTIISYNRGITSHREQQYHIAGIYTRILGNLVWIYTRIPGDPVWLVRGFPEKXISES

SEQ ID NO: 6791 - protein, 57 aa, Homo sapiens
MTMVMEQVYLMSFLLLLLRTMMKAHWTYTLGWTVLFLTALPNPVYHQEIVWTYMKRS

SEQ ID NO: 6792 - protein, 45 aa, Homo sapiens
MSNLMVAMIAVITIAVSIPSTRADTEISYTYWAYLSILAGNNAWI

SEQ ID NO: 6793 - protein, 42 aa, Homo sapiens
  SITE (16): Xaa equals any amino acid
MKNMHVYLNYNNFLLXLLRLMLNICSFTQPLVAEEERPLTPL

SEQ ID NO: 6794 - protein, 65 aa, Homo sapiens [sequence omitted]

SEQ ID NO: 6795 - protein, 55 aa, Homo sapiens
MKPVSRRTLDWIYSVLLLAIVLISWGCIIYASMVSARRQLRKKYPDKIFGTNENL

SEQ ID NO: 6796 - protein, 33 aa, Homo sapiens
MPMVFLLLFNLMSWLIRNARVILRSLNLKRDQV

SEQ ID NO: 6797 - protein, 140 aa, Homo sapiens
MFAGLFFLFFVRFGIGRQLLIKFPWFFSFGYFSKQGPTQKQIDAASFTLTFFGQGYSQGTGTDKNKPNIKICTQVKGPEAGYVATPIAMVQAAMTLLSDASHLPKAGGVFTPGAAFSKTKLIDRLNKHGIEFSVISSSEV

SEQ ID NO: 6798 - protein, 23 aa, Homo sapiens
MKIVVLLPLFLLATFPRKLQTCL

SEQ ID NO: 6799 - protein, 312 aa, Homo sapiens
MAAGVDCGDGVGARQHVFLVSEYLKDASKKMKNGLMFVKLVNPCSGEGAIYLFNMCLQQLFEVKVFKEKHHSWFINQSVQSGGLLHFATPVDPLFLLLHYLIKADKEGKFQPLDQVVVDNVFPNCILLLKLPGLEKLLHHVTEEKGNPEIDNKKYYKYSKEKTLKWLEKKVNQTVAALKTNNVNVSSRVQSTAFFSGDQASTDKEEDYIRYAHGLISDYIPKELSDDLSKYLKLPEPSASLPNPPSKKIKLSDEPVEAKEDYTKFNTKDLKTEKKNSKMTAAQKALAKVDKSGMKSIDTFFGVKNKKKIGKV

SEQ ID NO: 6800 - protein, 54 aa, Homo sapiens
MVLQNTNTLLIVSAFLLSMLFFKFSIAIFLVTNLSFERSNLLLGPSSDLFLNFK

SEQ ID NO: 6801 - protein, 65 aa, Homo sapiens
  SITE (29): Xaa equals any amino acid
  SITE (35): Xaa equals any amino acid
  SITE (63): Xaa equals any amino acid
  SITE (64): Xaa equals any amino acid
MWACWGMLGCIPLFVPWVPVLGKHFSGCXYLCGRXPCWIAFICVRTPCGPTTAPTATLKWSPXXT

SEQ ID NO: 6802 - protein, 195 aa, Homo sapiens
MAPRALPGSAVLAAAVFVGGAVSSPLVAPDNGSSRTLHSRTETTPSPSNDTGNGHPEYIAYALVPVFFIMGLFGVLICHLLKKKGYRCTTEAEQDIEEEKVEKIELNDSVNENSDTVGQIVHYIMKNEANADVLKAMVADNSLYDPESPVTPSTPGSPPVSPGPLSPGGTPGKHVCGHHLAYGGRCCREGCVSSV

SEQ ID NO: 6803 - protein, 106 aa, Homo sapiens
MCVGWWWWLVVLGLGMGGTLGCDGFLSQRWCFTAGKYLELGGGLSRHQADFIFSQTKATFTSKGKTQNTKIETSMPPHLFRQQEPPGQRVFLTLRVTLTSHLVSCG

SEQ ID NO: 6804 - protein, 46 aa, Homo sapiens
MMLLLASAFLIGTVLGSNRSCMSQCCGHHKSQKAQKTSSFITAPVK

SEQ ID NO: 6805 - protein, 24 aa, Homo sapiens
MIMEEIFLNLIKNIYKSPYSQCNT

SEQ ID NO: 6806 - protein, 257 aa, Homo sapiens
  SITE (100): Xaa equals any amino acid
MAALTSHLQNQSNNSNWNLRTRSKCKKDVFMPPSSSSELQESRGLSNFTSTHLLLKEDEGVDDVNFRKVRKPKGKVTILKGIPIKKTKKGCRKSCSGFVXSDSKRESVCNKADAESEPVAQKSQLDRTVCISDAGACGETLSVTSEENSLVKKKERSLSSGSNFCSEQKTSGIINKFCSAKDSEHNEKYEDTFLESEEIGTKVEVVERKEHLHTDILKRGSEMDNNCSPTRKDFTEDTIPRNTDRKKENKPVFFQQI

SEQ ID NO: 6807 - protein, 90 aa, Homo sapiens
MLVLFCFISLIKVQCTLCHSSVGNRIPLKSWPCKIQLSFNIHAFVPLRKYFLSFFVLQNYNVIQGVYRLVIKGSFLCVTFFLYSYSIFKQ

SEQ ID NO: 6808 - protein, 46 aa, Homo sapiens
MNVTVTLPKYHLALIWLLFHFGWALLSVCSKTVLMNLSNVHNAVIG

SEQ ID NO: 6809 - protein, 58 aa, Homo sapiens
MDKNVTRSRTIKLVQASWTPPFQLPAFCLMPVCQWLELGLLFRTSVAILILPWGHNCP

SEQ ID NO: 6810 - protein, 671 aa, Homo sapiens
MPHAFKPGDLVFAKMKGYPHWPARIDDIADGAVKPPPNKYPIFFFGTHETAFLGPKDLFPYDKCKDKYGKPNKRKGFNEGLWEIQNNPHASYSAPPPVSSSDSEAPEANPADGSDADEDDEDRGVMAVTAVTATAASDRMESDSDSDKSSDNSGLKRKTPALKMSVSKRARKASSDLDQASVSPSEEENSESSSESEKTSDQDFTPEKKAAVRAPRRGPLGGRKKKKAPSASDSDSKADSDGAKPEPVAMARSASSSSSSSSSSDSDVSVKKPPRGRKPAEKPLPKPRGRKPKPERPPSSSSSDSDSDEVDRISEWKRRDEARRRELEARRRREQEEELRRLREQEKEEKERRRERADRGEAERGSGGSSGDELREDDEPVKKRGRKGRGRGPPSSSDSEPEAELEREAKKSAKKPQSSSTEPARKPGQKEKRVRPEEKQQAKPVKVERTRKRSEGFSMDRKVEKKKEPSVEEKLQKLHSEIKFALKVDSPDVKRCLNALEELGTLQVTSQILQKNTDVVATLKKIRRYKANKDVMEKAAEVYTRLKSRVLGPKIEAVQKVNKAGMEKEKAEEKLAGEELAGEEAPQEKAEDKPSTDLSAPVNGEATSQKGESAEDKEHEEGRDSEEGPRCGSSEDLHDSVREGPDLDRPGSDRQERERARGDSEALDEES

SEQ ID NO: 6811 - protein, 64 aa, Homo sapiens
MWETYIWLVLTFAQKACCMKLTATMLKQIHIKKCRSIQWLLRVNSFMESSMSLSSKIRPHQRRN

SEQ ID NO: 6812 - protein, 743 aa, Homo sapiens
MNVSWISLRRRSFRAFGRVWTCSGLLQMTSIKGKLSLVWQRLDGHFCRTLEESVYSIAISLAQRYSVSRWEVFMTHLEFLFTDSGLSTLEIENRAQDLHLFETLKTDPEAFHQHMVKYIYPTIGGFDHERLQYYFTLLENCGCADLGNCAIKPETHIRLLKKFKVVASGLNYKKLTDENMSPLEALEPVLSSQNILSISKLVPKIPEKDGQMLSPSSLYTIWLQKLFWTGDPHLIKQVPGSSPEWLHAYDVCMKYFDRLHPGDLITVVDAVTFSPKAVTKLSVEARKEMTRKAIKTVKHFIEKPRKRNSEDEAQEAKDSKVTYADTLNHLEKSLAHLETLSHSFILSLKNSEQETLQKYSHLYDLSRSEKEKLHDEAVAICLDGQPLAMIQQLLEVAVGPLDISPKDIVQSAIMKIISALSGGSADLGGPRDPLKVLEGVVAAVHASVDKGEELVSPEDLLEWLRPFCADDAWPVRPRIHVLQILGQSFHLTEEDSKLLVFFRTEAILKASWPQRQVDIADIENEENRYCLFMELLESSHHEAEFQHLVLLLQAWPPMKSEYVITNNPWVRLATVMLTRCTMENKEGLGNEVLKMCRSLYNTKQMLPAEGVKELCLLLLNQSLLLPSLKLLLESRDEHLHEMALEQITAVTTVNDSNCDQELLSLLLDAKLLVKCVSTPFYPRIVDHLLASLQQGRWDAEELGRHLREAGHEAEAGSLLLAVRGTHQAFRTFSTALRAAQHWV

SEQ ID NO: 6813 - protein, 264 aa, Homo sapiens
  SITE (71): Xaa equals any amino acid
  SITE (80): Xaa equals any amino acid
  SITE (86): Xaa equals any amino acid
  SITE (93): Xaa equals any amino acid
  SITE (95): Xaa equals any amino acid
  SITE (133): Xaa equals any amino acid
  SITE (157): Xaa equals any amino acid
  SITE (183): Xaa equals any amino acid
  SITE (204): Xaa equals any amino acid
MATPLPPPSPRHLRLLRLLLSGLVLGAALRGAAAGHPECCRLSREPGLCPEEAGKCPPGAHACGPAFSPSXRNSKGLFCXDAPGFXRGPGPTXTXNEIDSWPKGACPERNLDINSALTQGRTAVPGACHLGIXGTGAGAGAGLPFHSRNPHAHAPHXPWVTPVSSDPVHMSPLEPRGGQGDGXALVLILAFCVAGAAALSVASXCWCRLQREIRLTQKAEYATAKALATPAATPDLAWGPAPGTERGDVPLPAPTATDVVPGAA

SEQ ID NO: 6814 - protein, 50 aa, Homo sapiens [sequence omitted]

SEQ ID NO: 6815 - protein, 631 aa, Homo sapiens [sequence omitted]

SEQ ID NO: 6816 - protein, 172 aa, Homo sapiens
MGLPRGSFFWLLLLLTAACSGLLFALYFSAVQRYPGPAAGARDTTSFEAFFQSKASNSWTGKGQACRHLLHLAIQRHPHFRGLFNLSIPVLLWGDLFTPALWDRLSQHKAPYGWRGLSHQVIAFQPEPSERFRECQAVCPAQGHPSKVYPVCRGGQRRHSEWVPPGSQHRCP

SEQ ID NO: 6817 - protein, 334 aa, Homo sapiens
MRGPSWSRPRPLLLLLLLLSPWPVWAQVSATASPSGSLGAPDCPEVCTCVPGGLASCSALSLPAVPPGLSLRLRALLLDHNRVRALPPGAFAGAGALQRLDLRENGLHSVHVRAFWGLGALQLLDLSANQLEALAPGTFAPLRALRNLSLAGNRLARLEPAALGALPLLRSLSLQDNELAALAPGLLGRLPALDALHLRGNPWGCGCALRPLCAWLRRHPLPASEAETVLCVWPGRLTLSPLTAFSDAAFSHCAQPLALRDLAVVYTLGPASFLVSLASCLALGSGLTACRARRRRLRTAALRPPRPPDPNPDPDPHGCASPADPGSPAAAAQA

SEQ ID NO: 6818 - protein, 40 aa, Homo sapiens
MFWFWFLLSLSFQQVEQQQVFQCICCTRTKYKSVWHQKSK

SEQ ID NO: 6819 - protein, 124 aa, Homo sapiens
MLSSPILASGPAWLACSFSHVQWWVCLIAQVQFSAATVSPGRAGTGAAPSVPAVWAAEARGPSVPSTLQGSPVLQRDLANPPPKKKKKKKKKKKKKKKKKKKKKKKKKKKKKKKKKKKKKKKKK

SEQ ID NO: 6820 - protein, 88 aa, Homo sapiens [sequence omitted]

SEQ ID NO: 6821 - protein, 41 aa, Homo sapiens [sequence omitted]

SEQ ID NO: 6822 - protein, 44 aa, Homo sapiens
MKKEMVLLTTTYFSLHVKVFFCLFVCFSILSSSRRGSLANNSSW

SEQ ID NO: 6823 - protein, 51 aa, Homo sapiens
MANAMAYLSIFLCGASSSPCDCALLVPVSLFRGRKVANFKNQNSDVTSGNA

SEQ ID NO: 6824 - protein, 71 aa, Homo sapiens [sequence omitted]

SEQ ID NO: 6825 - protein, 227 aa, Homo sapiens
  SITE (125): Xaa equals any amino acid
MGWTMRLVTAALLLGLMMVVTGDEDENSPCAHEALLDEDTLFCQGLEVFYPELGNIGCKVVPDCNNYRQKITSWMEPIVKFPGAVDGATYILVMVDPDAPSRAEPRQRFWRHWLVTDIKGADLKXGKIQGQELSAYQAPSPPAHSGFHRYQFFVYLQEGKVISLLPKENKTRGSWKMDRFLNRFHLGEPEASTQFMTQNYQDSPTLQAPRERASEPKHKNQAEIAAC

SEQ ID NO: 6826 - protein, 31 aa, Homo sapiens
MSRLLLLFGRLCSLWCLSWLYSTDTRPLLRG

SEQ ID NO: 6827 - protein, 32 aa, Homo sapiens
MPVTLSSLGFWVLLSLLFPWRTDQGCGPATCY

SEQ ID NO: 6828 - protein, 61 aa, Homo sapiens
MRLPIAPHLQYFMWSVLLFLVILVDMKWHLSVAFHYISLMTNGILSPFQCLLAIHVSLFFV

SEQ ID NO: 6829 - protein, 42 aa, Homo sapiens
  SITE (10): Xaa equals any amino acid
MVLGLLLLLXFFSFSSSPSPSSSLLLLSSFFFQSLALSPRLE

SEQ ID NO: 6830 - protein, 46 aa, Homo sapiens
MYIFHFVFLIGYAMCGIQVTNVTLASGPSNLHVYLLQSYLTRGPNH

SEQ ID NO: 6831 - protein, 327 aa, Homo sapiens
MAELPGPFLCGALLGFLCLSGLAVEVKVPTEPLSTPLGKTAELTCTYSTSVGDSFALEWSFVQPGKPISESHPILYFTNGHLYPTGSKSKRVSLLQNPPTVGVATLKLTDVHPSDTGTYLCQVNNPPDFYTNGLGLINLTVLVPPSNPLCSQSGQTSVGGSTALRCSSSEGAPKPVYNWVRLGTFPTPSPGSMVQDEVSGQLILTNLSLTSSGTYRCVATNQMGSASCELTLSVTEPPQGRVAGALIGVLLGVLLLSVAAFCLVRFQKERGKKPKETYGGSDLREDAIAPGISEHTCMRADSSKGFLERPSSASTVTTTKSKLPMVV

SEQ ID NO: 6832 - protein, 61 aa, Homo sapiens
MKSALHRDICILMLTAALFTIAKTEKQHKCPSIDEQINNLQYICTMEYHSALQKEMLLYLQ

SEQ ID NO: 6833 - protein, 179 aa, Homo sapiens
MLYYLWMLHSVTLFLNLLACLAWFSGNSSKGVDFGLSILWFLIFTPCAFLCWYRPIYKAFRSDNSFSFFVFFFVFFCQIGIYIIQLVGIPGLGDSGWIAALSTLDNHSLAISVIMMVVAGFFTLCAVLSVFLLQRVHSLYRRTGASFQQAQEEFSQGIFSSRTFHRAASSAAQGAFQGN

SEQ ID NO: 6834 - protein, 77 aa, Homo sapiens
MDAFAGSPFSLMVPKCVLILFCLVYSLQCIQPYSSLLNSASLPYHHGLKLANLLLIVFYPHIHSIPFSSSHPSKLHI

SEQ ID NO: 6835 - protein, 237 aa, Homo sapiens
MKGILVAGITAVLVAAVESLSCVQCNSWEKSCVNSIASECPSHANTSCISSSASSSLETPVRLYQNMFCSAENCSEETHITAFTVHVSAEEHFHFVSQCCQGKECSNTSDALDPPLKNVSSNAECPACYESNGTSCHGKPWKCYEEEQCVFLVAELKNDIESKSLVLKGCSNVSNATCQFLSGENKTLGGVIFRKFECANVNSLTPTSAPTTSHNVGSKASLYLLALASLLLRGLLP

SEQ ID NO: 6836 - protein, 91 aa, Homo sapiens
  SITE (84): Xaa equals any amino acid
MARVLQLEPQTSACLLSLLCPALQEPGPASGTESAHFLRAHSRCGPGLPPPHVSSPQPTPPGPEAKVRGCMGARWWLGRAPGVXGVFRDTT

SEQ ID NO: 6837 - protein, 82 aa, Homo sapiens
MAIPPFIMNTLEKKAFLKRFPWMSAPIQVGLVGFCLVFATPLCCALFPQKSSMSVTSLEAELQAKIQESHPELRRVYFNKGL

SEQ ID NO: 6838 - protein, 41 aa, Homo sapiens
MGLLLLLLLGCWTHIFFTNGMIYWYLEGHPILNEILFILHF

SEQ ID NO: 6839 - protein, 19 aa, Homo sapiens
  SITE (2): Xaa equals any amino acid
MXGPWGEEALIRLPTPSGL

SEQ ID NO: 6840 - protein, 336 aa, Homo sapiens
MDTMNVVMPLAVTHSLLNLREFTVVEKPYACNDCGKAFSHDFFLSEHQRTHIGEKPYECKECNKAFRQSAHLAQHQRIHTGEKPFACNECGKAFSRYAFLVEHQRIHTGEKPYECKECNKAFRQSAHLNQHQRIHTGEKPYECNQCGKAFSRRIALTLHQRIHTGEKPFKCSECGKTFGYRSHLNQHQRIHTGEKPYECIKCGKFFRTDSQLNRHHRIHTGERPFECSKCGKAFSDALVLIHHKRSHAGEKPYECNKCGKAFSCGSYLNQHQRIHTGEKPYECSECGKAFHQILSLRLHQRIHAGEKPYKCNECGNNFSCVSALRRHQRIHNRETL

SEQ ID NO: 6841 - protein, 111 aa, Homo sapiens
MGPSSCLLLILIPLLQLINLGSTQCSLDSVMDKKIKDVLNSLEYSPSPISKKLSCASVKSQGRPSSCPAGMAVTGCACGYGCGSWDVQLETTCHCQCSVVDWTTARCCHLT

SEQ ID NO: 6842 - protein, 165 aa, Homo sapiens
  SITE (145): Xaa equals any amino acid
  SITE (147): Xaa equals any amino acid
  SITE (148): Xaa equals any amino acid
  SITE (152): Xaa equals any amino acid
MAVYLLWQELGPAVLAGVAVLVFVIPINALAATKIKKLKVSLATLCVYFLLDEGNILTATKVFTSMSLFNILRIPLFELPTVISAVVQTKISLGRLEDFLNTEELLPQSIETNYTGDHAIGFTDASFSWDKTGMPVLKEALWLMXLXXPGFXIAFCKKTFSLAPS

SEQ ID NO: 6843 - protein, 20 aa, Homo sapiens
EWLVFTFLLVFGSPLGKGPL

SEQ ID NO: 6844 - protein, 130 aa, Homo sapiens
  SITE (31): Xaa equals any amino acid
MRYNEKELQALSRQPAEMAAELGMRGPKKGXDEAEPVGALLLERCRVVREEPGTFSISFIEDPERKYHFECSSEEQCQEWMEALRRASYEFMRRSLIFYRNEIRKVTGKDPLEQFGISEEARFQLSGLQA

SEQ ID NO: 6845 - protein, 424 aa, Homo sapiens
  SITE (144): Xaa equals any amino acid
  SITE (263): Xaa equals any amino acid
MEKQCCSHPVICSLSTMYTFLLGAIFIALSSSRILLVKYSANEENKYDYLPTTVNVCSELVKLVFCVLVSFCVIKKDHQSRNLKYASWKEFSDFMKWSIPAFLYFLDNLIVFYVLSYLQPAMAVIFSNFSIITTALLFRIVLKXRLNWIQWASLLTLFLSIVALTAGTKTLQHNLAGRGFHHDAFFSPSNSCLLFRNECPRKDNCTAKEWTFPEAKWNTTARVFSHIRLGMGHVLIIVQCFISSMANIYNEKILKEGNQLTEXIFIQNSKLYFFGILFNGLTLGLQRSNRDQIKNCGFFYGHSAFSVALIFVTAFQGLSVAFILKFLDNMFHVLMAQVTTVIITTVSVLVFDFRPSLEFFLEAPSVLLSIFIYNASKPQVPEYAPRQERIRDLSGNLWERSSGDGEELERLTKPKSDESDEDTF

SEQ ID NO: 6846 - protein, 98 aa, Homo sapiens
MKLMVLVFTIGLTLLLGVQAMPANRLSCYRKILKDHNCHNLPEGVADLTQIDVNVQDHFWDGKGCEMICYCNFSELLCCPKDVFFGPKISFVIPCNNQ

SEQ ID NO: 6847 - protein, 98 aa, Homo sapiens
MFICFLTLLTPGFSLSLRRKHYLITFRWFTYSVKNMCKYFVQSPVSNKQPYVVTNHLFCHSVLGHRSVGMVSDLDAPTFHVRPRTVPWSVDSWSALTG

SEQ ID NO: 6848 - protein, 293 aa, Homo sapiens
MVIFTLSVSMLLRYSHHQIFVFIAPLLTVILALVGMEAIMSEFFNDTTTAFYIILIVWLADQYDAICCHTSTSKRHWLRFFYLYHFAFYAYHYRFNGQYSSLALVTSWLFIQHSMIYFFHHYELPAILQQVRIQEMLLQAPPLGPGTPTALPDDMNNNSGAPATAPDSAGQPPALGPVSPGASGSPGPVAAAPSSLVAAAASVAAAAGGDLGWMAETAAIITDASFLSGLSASLLERRPASPLGPAGGLPHAPQDSVPPSDSAASDTTPLGAAVGGPSPASMAPTEAPSEVGS

SEQ ID NO: 6849 - protein, 217 aa, Homo sapiens [sequence omitted]

SEQ ID NO: 6850 - protein, 543 aa, Homo sapiens [sequence omitted]

SEQ ID NO: 6851 - protein, 44 aa, Homo sapiens
MAPACQILRWALALGLGLMFEVTHAFRSQGRGSLVVAVGRERKM

SEQ ID NO: 6852 - protein, 388 aa, Homo sapiens
MMTITFLPYTFSLMVTFPDVPLGIFLFCVCVIAIGVVQALIVGYAFHFPHLLSPQIQRSAHRALYRRHVLGIVLQGPALCFAAAIFSLFFVPLSYLLMVTVILLPYVSKVTGWCRDRLLGHREPSAHPVEVFSFDLHEPLSKERVEAFSDGVYAIVATLLILDICEDNVPDPKDVKERFSGSLVAALSATGPRFLAYFGSFATVGLLWFAHHSLFLHVRKATRAMGLLNTLSLAFVGGLPLAYQQTSAFARQPRDELERVRVSCTIIFLASIFQLAMWTTALLHQAETLQPSVWFGGREHVLMFAKLALYPCASLLAFASTCLLSRFSVGIFHLMQIAVPCAFLLLRLLVGLALATLRVLRGLARPEHPPPAPTGQDDPQSQLLPAPC

SEQ ID NO: 6853 - protein, 149 aa, Homo sapiens
MLHMYSQKDPLILCVRLAVLLAVTLTVPVVLFPIRRALQQLLFPGKAFSWPRHVAIALILLVLVNVLVICVPTIRDIFGVIGSTSAPSLIFILPSIFYLRIVPSEVEPFLSWPKIQALCFGVLGVLFMAVSLGFMFANWATGQSRMSGH

SEQ ID NO: 6854 - protein, 63 aa, Homo sapiens
MSAASFWPRPVASISVFILLGSSVTTSKTRSGVISSAGKPIWVQSPHLALLEVLLQKGIVPEK

SEQ ID NO: 6855 - protein, 52 aa, Homo sapiens
MCFRFFLFCSRILLKLFFLLFPASAFPLSTRSSLSVNEHVVVSPRSTVSISR

SEQ ID NO: 6856 - protein, 32 aa, Homo sapiens
MWGQGSQKSHFSDLVFGVRELCAQPSDPGSPH

SEQ ID NO: 6857 - protein, 43 aa, Homo sapiens
MGGKGINYTMPHICLLLLNALVVSCLLLEAILLQHLVLCNELP

SEQ ID NO: 6858 - protein, 63 aa, Homo sapiens
MGQTEAMQEEMRTRTCTTTPQPMETIRQNKTRRHMTRKQAWTLQKCQCHERQKLGMLFWIKGD

SEQ ID NO: 6859 - protein, 48 aa, Homo sapiens
MVSPWLPLLVSLFHLLNCLRGVGTSGQSLGLPSSSFPPTPEHKATARD

SEQ ID NO: 6860 - protein, 142 aa, Homo sapiens
MTLIEVLVSVLILAVGLLGAAVIQLNALKYTDSSRMTSQASFIAYDMLDRIRANSGADYSWGQGERAPSSTSVASVRDLDLHDFEANIVGFAGESAKGSVAVNQREVTISISWDDSRGAKAQGTRETFTLTSRVAVDPRVLP

SEQ ID NO: 6861 - protein, 46 aa, Homo sapiens
  SITE (34): Xaa equals any amino acid
  SITE (37): Xaa equals any amino acid
MFMLCNLLLPLLEFIFGSTYLSTDLYLHTCMRVXPGXTFIHFNQMF

SEQ ID NO: 6862 - protein, 69 aa, Homo sapiens [sequence omitted]

SEQ ID NO: 6863 - protein, 84 aa, Homo sapiens
  SITE (48): Xaa equals any amino acid
MPILVFSICLQCTLFRSEAIIFQEERNHQVTLLKAVKTKFQSGTGLRXPVLEYAKSIQIISKYTCGTVLPVFKMRRYYVGQKCQ

SEQ ID NO: 6864 - protein, 70 aa, Homo sapiens
MWFEILPGLSVMGVCLLIPGLATAYIHRFTNGGKEKRVAHFGYHWSLMERDRRISGVDRYYVSKGLENID

SEQ ID NO: 6865 - protein, 29 aa, Homo sapiens
MPALSMALTMLGCYAIAILLFVTLVRKPA

SEQ ID NO: 6866 - protein, 198 aa, Homo sapiens
MAALTAEHFAALQSLLKASSKDVVRQLCQESFSSSALGLKKLLDVTCSSLSVTQEEAEELLQALHRLTRLVAFRDLSSAEAILALFPENFHQNLKNLLTKIILEHVSTWRTEAQANQISLPRLVDLDWRVDIKTSSDSISRMAVPTCLLQMKIQEDPSLCGDKPSISAVTVELSKETLDTMLDGLGRIRDQLSAVASK

SEQ ID NO: 6867 - protein, 58 aa, Homo sapiens
  SITE (47): Xaa equals any amino acid
MRLILIIGRLALDSIAQNSQNVSQSSQGSYHHGSSPPRPVRPLPGPXRRRDPSLDCCS

SEQ ID NO: 6868 - protein, 39 aa, Homo sapiens
MCLLPGGVLLIWSCASGTPASHTKDWGRCKFSAATKRSS

SEQ ID NO: 6869 - protein, 86 aa, Homo sapiens
MGANFTVFLQYLVFPIFGFLLIISHPSQPLFSSPPLCLQHPILPSLPFNLPILFFPLKSHMILQSSFVFPKKKKNFFFFKESFLDS

SEQ ID NO: 6870 - protein, 51 aa, Homo sapiens
MAVPSGCWPSWPRPSSWWSTRISPRSATPLTASTWSLVTCSSQVSACGTSI

SEQ ID NO: 6871 - protein, 32 aa, Homo sapiens
MLLPLFTLLILLLRVFPKEIIQNRKKLKAEKC

SEQ ID NO: 6872 - protein, 103 aa, Homo sapiens [sequence omitted]

SEQ ID NO: 6873 - protein, 63 aa, Homo sapiens
MCAWHCVHLALCVVGMLFLLSVTSSQFCKQRQNHALPLKPIGFKCHLFDDAFPITPFDTSHGT

SEQ ID NO: 6874 - protein, 37 aa, Homo sapiens
MLARKAERGSMGTARDSHILLVCSVVHPASAQPVYTV

SEQ ID NO: 6875 - protein, 58 aa, Homo sapiens
MIGKSLVMFCFLSWGAGVHGCALYYNASNRIGIFYIFCFTYLRLHECVMLSNLRVNEL

SEQ ID NO: 6876 - protein, 203 aa, Homo sapiens
MAEGDNRSTNLLAAETASLEEQLQGWGEVMLMADKVLRWERAWFPPAIMGVVSLVFLIIYYLDPSVLSGVSCFVMFLCLADYLVPILAPRIFGSNKWTTEQQQRFHEICSNLVKTRRRAVGWWKRLFTLKEEKPKMYFMTMIVSLAAVAWVGQQVHNLLLTYLIVTSLLLLPGLNQHGIILKYIGMAKREINKLLKQKEKKNE

SEQ ID NO: 6877 - protein, 49 aa, Homo sapiens
MHLLLLSCLLAGKASCHVVRSPVDNPLWQGGNAYGQQPVRTGPCQQPHK

SEQ ID NO: 6878 - protein, 67 aa, Homo sapiens
MCILHSHCLLFLNLNQVVCFHGNFSLSCFCQTQISYINIFSGKNGCDSKLEHLLFYFRKSLLNIFLV

SEQ ID NO: 6879 - protein, 148 aa, Homo sapiens
MQFILTGITLSGYLFTFSACAVLSASITVWGLMECLIHRHGSHTTEHLTRTLTSQQSSRGHLSLSHSTTQSNQPERTLALLTGGTADLSVWRQHSPKMGAIFQDAVFALDSQAYLWGIVSNRENIWVLEQWPPPKGFHSCQETPQESH

SEQ ID NO: 6880 - protein, 58 aa, Homo sapiens
MATASINNLISSLLLHLSLLSSKAGKFLIWKEHKTACGCYANSTCLLPNGLSNHKGKS

SEQ ID NO: 6881 - protein, 74 aa, Homo sapiens
MGKLIRLSVMVMSVRRLFSIYWVLSTVPDAVGSRGGMEEECSRGLCCVAGQHKQAKGKRQAWNKGGEYQCVTYC

SEQ ID NO: 6882 - protein, 67 aa, Homo sapiens
MKQHQKLWRLGFLLCFNLVFCVLGRRHPWPWAVRPLMCVYADRELLGWLLRWVVLLVFSVLKLIFRL

SEQ ID NO: 6883 - protein, 101 aa, Homo sapiens
MAFWFTGLPLLSLILLCIGRVFLGVGESFASTGSTLWGIGLVGPLHTARVISWNGVATYGAMAAGAPLGVYLNQHWGLAGVAALIVLAVAVSLWLASANPT

SEQ ID NO: 6884 - protein, 27 aa, Homo sapiens
MRARTLPPSLLCLWCLAPYLNICWMNG

SEQ ID NO: 6885 - protein, 184 aa, Homo sapiens
MPSLRFLALALLLAILPALPNAHAAPGIGGLIGGGSQASAKEEPQSNAQPSADERKQRLLSQAEETRQRLTDLKAELAGAPKEISEAQRTLSKLVSEDNSDLPERLSKLSVPVLEQRLAARVDELALWQQALSAANSMLISAQTRPERAQADISKNQLRIDEINGLLKSGRENNKPLTDERRAL

SEQ ID NO: 6886 - protein, 86 aa, Homo sapiens
  SITE (2): Xaa equals any amino acid
MXLQPNPHARAKPCCYLLFLSCLIPSMFSLSVDPVSPVLRIVPGSDHFSLPLLLPPPLAWIIAAASQLALLCPSLFSPSVCSQQRS

SEQ ID NO: 6887 - protein, 109 aa, Homo sapiens
MLLGVGLVVLALIAGWVLQQANRSAQQLTATGQSLMQSQRLAKSVSQALVGSPQAFPDVVESSGVLARNVRALNGGDNELDVQALGEPFRPNWMPSRRWWSVPSATRAW

SEQ ID NO: 6888 - protein, 36 aa, Homo sapiens
  SITE (7): Xaa equals any amino acid
  SITE (9): Xaa equals any amino acid
MKPLQHXGXRIFFLGLSAPFNPGLCQAAPLLRGFWG

SEQ ID NO: 6889 - protein, 82 aa, Homo sapiens
MVLRTDSVPALFTYLSTFWLAFISGLADILTLCTKMADTIIFHHILQKILLLKNTLRNMFYGQISLGNSELLFLLCRITMHC

SEQ ID NO: 6890 - protein, 80 aa, Homo sapiens
MCPAAALAWPTSAISLIVSLAPSWAAARDNWAASPYTTQARPALRAALTTISGPMPAASPMVMPTGREGFTVLGMGLRCG

SEQ ID NO: 6891 - protein, 51 aa, Homo sapiens
MLRPPRWALMAASSHPPPLWSWVLGLAAHPTGMSPGTGPHHGWVSASSSSS

SEQ ID NO: 6892 - protein, 329 aa, Homo sapiens
MDRHGYKAGILLGLCLYAAGALLFMPAAAAASFPFFLFALFVIACGLGCLETAANPYATVLGEPQGAERRLNLAQSFNGLGQFFGPLIGGAMFFSAGSTPASDMSSLQTTYVVIAVLVLLVALLIARTPLPDLRAQEQALQPTAGKGLWQHREFVGGVITQFFYVAAQVGVGAFFINYVTEHWAQMGNQQAAYLLSIAMLAFMFGRFFSTWLMGRVSAQKLLLIYALINIALCGLVVIGLEGISVIALIAVFFFMSIMFPTLFAMGVKNLGPHTKRGSSFMIMAIVGGALMPYLMGKVADNSTVALAYLLPMGCFVIVAVYARSRLRHP

SEQ ID NO: 6893 - protein, 47 aa, Homo sapiens
MSQLCFSLLLSSTCHGGVASLLTSDLSSQSHRFSICTNVNHSKYSSL

SEQ ID NO: 6894 - protein, 60 aa, Homo sapiens [sequence omitted]

SEQ ID NO: 6895 - protein, 23 aa, Homo sapiens
ICLWGRPNLTTQGTLKGISGRRS

SEQ ID NO: 6896 - protein, 33 aa, Homo sapiens
MFCISLSFFNLPEYSPCSLLSVQELVPQFFYVV

SEQ ID NO: 6897 - protein, 53 aa, Homo sapiens
MDIQGKALYIRFLLTLCQMVVSVMGKRRQGRRGLGGAAAVGREICRRWGCCVT

SEQ ID NO: 6898 - protein, 65 aa, Homo sapiens
  SITE (55): Xaa equals any amino acid
MKVAVRGKQRECRDRILGKKTKAWTQRRRSKCGSGYKVRVSVQEVNKVSRTRKSXRSRKPAFGDR

SEQ ID NO: 6899 - protein, 127 aa, Homo sapiens
MRHMRQVAPARRAQLEHSGLHASLCLLSLLSLLPTLEANMSGFHQAPLTLLPSCTQGDGEARGHHTQPSFWRTEMKCPVEALLEHLATRAVVGRNGDHGAQQEHRTASEGQQQPLAESSPWWQPPHG

SEQ ID NO: 6900 - protein, 26 aa, Homo sapiens
MLLFFFWTLFRESVDHNNSDTFFSGP

SEQ ID NO: 6901 - protein, 56 aa, Homo sapiens
MLTGVISGSTGAMALSLASLSAHCFAFRCLAAPFYFFAGLGKHGRRILISFLFSAW

SEQ ID NO: 6902 - protein, 29 aa, Homo sapiens
MLVIIIMTALVSHVPSVHSVPHAVPFTSS

SEQ ID NO: 6903 - protein, 63 aa, Homo sapiens
  SITE (6): Xaa equals any amino acid
MATLEXNQREVDREIRSLLLWFLLCEIVSGWLCPEGPWFSQGCQIYKNLSSSSSYNLSFLLSL

SEQ ID NO: 6904 - protein, 94 aa, Homo sapiens [sequence omitted]

SEQ ID NO: 6905 - protein, 54 aa, Homo sapiens
MAVRLIKPAVFAVLAGFSVLWLSPASLAASFDCDRAKRLTRKPSVPRAPSMIRT

SEQ ID NO: 6906 - protein, 42 aa, Homo sapiens [sequence omitted]

SEQ ID NO: 6907 - protein, 84 aa, Homo sapiens [sequence omitted]

SEQ ID NO: 6908 - protein, 159 aa, Homo sapiens
MDAMILLNVLALTRLAKAAATNFVAQGRGTIINIGSIVALAPKVLNGVYGGTKAFVQAFSESLQHELSDKGVVVQVVLPGATATEFWDIAGLPVNNLPEAMVMTTENLVDAALAGLAQGEAVTIPSLPDSADWDTYERARLALGPNLSHREPAARYGLK

SEQ ID NO: 6909 - protein, 274 aa, Homo sapiens
MFYIIGGVATLLLILVIIVFKEKPKYPPSRAQSLSYALTSPDASYLGSIARLFKNLNFVLLVITYGLNAGAFYALSTLLNRMVIWHYPGEEVNAGRIGLTIVIAGMLGAVISGIWLDRSKTYKETTLVVYIMTLVGMVVYTFTLNLGHLWVVFITAGTMGFFMTGYLPLGFEFAVELTYPESEGISSGLLNISAQVFGIIFTISQGQIIDNYGTKPGNIFLCVFLTLGAALTAFIKADLRRQKANKETLENKLQEEEEESNTSKVPTAVSEDHL

SEQ ID NO: 6910 - protein, 211 aa, Homo sapiens
  SITE (99): Xaa equals any amino acid
MANAGLQLLGFILAFLGWIGAIVSTALPQWRIYSYAGDNIVTAQAMYEGLWMSCVSQSTGQIQCKVFDSLLNLSSTLQATRALMVVGILLGVIAIFVAXVGMKCMKCLEDDEVQKMRMAVIGGAIFLLAGLAILVATAWYGNRIVQEFYDPMTPVNARYEFGQALFTGWAAASLCLLGGALLCCSCPRKTTSYPTPRPYPKPAPSSGKDYV

SEQ ID NO: 6911 - protein, 129 aa, Homo sapiens
MANAGLQLLGFILAFLGWIGAIVSTALPQWRIYSYAGDNIVTAQAMYEGLWMSCVSQSTGQIQCKVFDSLLNLSSTLQATRALMVVGILLGVIAIFVATVGMKCMKCLEDDEVQKMRMAILVATAWYGQ

SEQ ID NO: 6912 - protein, 210 aa, Homo sapiens [sequence omitted]

SEQ ID NO: 6913 - protein, 117 aa, Homo sapiens
MLGHCCYFWQVWPASEALAAGPTPSTGSSSPSWKQHIGTSLQKTRGSLPTTTLTSGAGQSTSTGKNPAAGRSLEGALPAGVWPCFAQSPCTGGQQTPSSTGLRSCLVRSPATWWRTP

SEQ ID NO: 6914 - protein, 313 aa, Homo sapiens
MNQLSFLLFLIATTRGWSTDEANTYFKEWTCSSSPSLPRSCKEIKDECPSAFDGLYFLRTENGVIYQTFCDMTSGGGGWTLVASVHENDMRGKCTVGDRWSSQQGSKADYPEGDGNWANYNTFGSAEAATSDDYKNPGYYDIQAKDLGIWHVPNKSPMQHWRNSSLLRYRTDTGFLQTLGHNLFGIYQKYPVKYGEGKCWTDNGPVIPVVYDFGDAQKTASYYSPYGQREFTAGFVQFRVFNNERAANALCAGMRVTGCNTEHHCIGGGGYFPEASPQQCGDFSGFDWSGYGTHVGYSSSREITEAAVLLFYR

SEQ ID NO: 6915 - protein, 80 aa, Homo sapiens [sequence omitted]

SEQ ID NO: 6916 - protein, 90 aa, Homo sapiens [sequence omitted]

SEQ ID NO: 6917 - protein, 706 aa, Homo sapiens [sequence omitted]

SEQ ID NO: 6918 - protein, 130 aa, Homo sapiens [sequence omitted]

SEQ ID NO: 6919 - protein, 31 aa, Homo sapiens
MVSLNLSLPNNIISLVFFFLLQPVQKGVSGG

SEQ ID NO: 6920 - protein, 74 aa, Homo sapiens [sequence omitted]

SEQ ID NO: 6921 - protein, 94 aa, Homo sapiens
MLPTLTAPTLALLLLPKISCLLTSTHPRTQGSRAHFPRAWRLDPGEFLHPLQDPHSSPLWSLDHRWRWPELTCWLWGHSSCWPRMRRGTREYKG

SEQ ID NO: 6922 - protein, 49 aa, Homo sapiens [sequence omitted]

SEQ ID NO: 6923 - protein, 148 aa, Homo sapiens
MHMLNGALLALLFPVVNTRLLPFELEIYYIQHVMLYVVPIYLLWKGGAYTPEPLSSFRWALLSTGLMFFYHFSVLQILGLVTEVNLNNMLCPAISDPFYGPWYRIWASGHQTLMTMTHGKLVILFSYMAGPLCKYLLDLLRLPAKKID

SEQ ID NO: 6924 - protein, 290 aa, Homo sapiens
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 6925 - protein, 53 aa, Homo sapiens
MVYCVVSPRRATLFCVLLLGTRCEIISVRSSFGEYDKINSILKGLLKIPFNEF

SEQ ID NO: 6926 - protein, 552 aa, Homo sapiens [sequence omitted]

SEQ ID NO: 6927 - protein, 57 aa, Homo sapiens
MKVLLSLSLVGLFIGFSDAVLNETCRFWINTSSKGNLQILKNQIQIIDRLRKMPASA

SEQ ID NO: 6928 - protein, 56 aa, Homo sapiens
MKESRKMLWVFKMLFFKIVLWVNLLSAALSCIQKQMLGIAPQKCVPKLCFQLYIMR

SEQ ID NO: 6929 - protein, 77 aa, Homo sapiens [sequence omitted]

SEQ ID NO: 6930 - protein, 121 aa, Homo sapiens
MVFFTCLWFLNEHILVCNCSNVSLCYSLPLKEKITFFYNLTHYFFNRCFKHLFVFVEQIFLNIVYTRNLIVYFSELNYAICSSVNEALTVQSNPLKVLPWEIRRVSNSQCLSLISVPYNNT

SEQ ID NO: 6931 - protein, 348 aa, Homo sapiens
MLCPWRTANLGLLLILTIFLVAEAEGAAQPNNSLMLQTSKENHALASSSLCMDEKQITQNYSKVLAEVNTSWPVKMATNAVLCCPPIALRNLIIITWEIILRGQPSCTKAYKKETNETKETNCTDERITWVSRPDQNSDLQIRTVAITHDGYYRCIMVTPDGNFHRGYHLQVLVTPEVTLFQNRNRTAVCKAVAGKPAAHISWIPEGDCATKQEYWSNGTVTVKSTCHWEVHNVSTVNCHVSHLTGNKSLYIELLPVPGAKKSAKLYIPYIILTIIILTIVGFIWLLKVNGCRKYKLNKTESTPVVEEDEMQPYASYTEKNNPLYDTTNKVKASEALQSEVDTDLHTL

SEQ ID NO: 6932 - protein, 953 aa, Homo sapiens
MEEQGHSEMEIIPSESHPHIQLLKSNRELLVTHIRNTQCLVDNLLKNDYFSAEDAEIVCACPTQPDKVRKILDLVQSKGEEVSEFFLYLLQQLADAYVDLRPWLLEIGFSPSLLTQSKVVVNTDPVSRYTQQLRHHLGRDSKFVLCYAQKEELLLEEIYMDTIMELVGFSNESLGSLNSLACLLDHTTGILNEQGETIFILGDAGVGKSMLLQRLQSLWATGRLDAGVKFFFHFRCRMFSCFKESDRLCLQDLLFKHYCYPERDPEEVFAFLLRFPHVALFTFDGLDELHSDLDLSRVPDSSCPWEPAHPLVLLANLLSGKLLKGASKLLTARTGIEVPRQFLRKKVLLRGFSPSHLRAYARRMFPERALQDRLLSQLEANPNLCSLCSVPLFCWIIFRCFQHFRAAFEGSPQLPDCTMTLTDVFLLVTEVHLNRMQPSSLVQRNTRSPVETLHAGRDTLCSLGQVAHRGMEKSLFVFTQEEVQASGLQERDMQLGFLRALPELGPGGDQQSYEFFHLTLQAFFTAFFLVLDDRVGTQELLRFFQEWMPPAGAATTSCYPPFLPFQCLQGSGPAREDLFKNKDHFQFTNLFLCGLLSKAKQKLLRHLVPAAALRRKRKALWAHLFSSLRGYLKSLPRVQVESFNQVQAMPTFIWMLRCIYETQSQKVGQLAARGICANYLKLTYCNACSADCSALSFVLHHFPKRLALDLDNNNLNDYGVRELQPCFSRLTVLRLSVNQITDGGVKVLSEELTKYKIVTYLGLYNNQITDVGARYVTKILDECKGLTHLKLGKNKITSEGGKYLALAVKNSKSISEVGMWGNQVGDEGAKAFAEALRNHPSLTTLSLASNGISTEGGKSLARALQQNTSLEILWLTQNELNDEVAESLAEMLKVNQTLKHLWLIQNQITAKGTAQLADALQSNTGITEICLNGNLIKPEEAKVYEDEKRIICF

SEQ ID NO: 6933 - protein, 747 aa, Homo sapiens
MGRGPWDAGPSRRLLPLLLLLGLARGAAGAPGPDGLDVCATCHEHATCQQREGKKICICNYGFVGNGRTQCVDKNECQFGATLVCGNHTSCHNTPGGFYCICLEGYRATNNNKTFIPNDGTFCTDIDECEVSGLCRHGGRCVNTHGSFECYCMDGYLPRNGPEPFHPTTDATSCTEIDCGTPPEVPDGYIIGNYTSSLGSQVRYACREGFFSVPEDTVSSCTGLGTWESPKLHCQEINCGNPPEMRHAILVGNHSSRLGGVARYVCQEGFESPGGKITSVCTEKGTWRESTLTCTEILTKINDVSLFNDTCVRWQINSRRINPKISYVISIKGQRLDPMESVREETVNLTTDSRTPEVCLALYPGTNYTVNISTAPPRRSMPAVIGFQTAEVDLLEDDGSFNISIFNETCLKLNRRSRKVGSEHMYQFTVLGQRWYLANFSHATSFNFTTREQVPVVCLDLYPTTDYTVNVTLLRSPKRHSVQITIATPPAVKQTISNISGFNETCLRWRSIKTADMEEMYLFHIWGQRWYQKEFAQEMTFNISSSSRDPEVCLDLRPGTNYNVSLRALSSELPVVISLTTQITEPPLPEVEFFTVHRGPLPRLRLRKAKEKNGPISSYQVLVLPLALQSTFSCDSEGASSFFSNASDADGYVAAELLAKDVPDDAMEIPIGDRLYYGEYYNAPLKRGSDYCIILRITSEWNKVRRHSCAVWAQVKDSSLMLLQMAGVGLGSLAVVIILTFLSFSAV

SEQ ID NO: 6934 - protein, 697 aa, Homo sapiens
MLLPLLLSSLLGGSQAMDGRFWIRVQESVMVPEGLCISVPCSFSYPRQDWTGSTPAYGYWFKAVTETTKGAPVATNHQSREVEMSTRGRFQLTGDPAKGNCSLVIRDAQMQDESQYFFRVERGSYVRYNFMNDGFFLKVTALTQKPDVYIPETLEPGQPVTVICVFNWAFEECPPPSFSWTGAALSSQGTKPTTSHFSVLSFTPRPQDHNTDLTCHVDFSRKGVSVQRTVRLRVAYAPRDLVISISRDNTPALEPQPQGNVPYLEAQKGQFLRLLCAADSQPPATLSWVLQNRVLSSSHPWGPRPLGLELPGVKAGDSGRYTCRAENRLGSQQRALDLSVQYPPENLRVMVSQANRTVLENLGNGTSLPVLEGQSLCLVCVTHSSPPARLSWTQRGQVLSPSQPSDPGVLELPRVQVEHEGEFTCHARHPLGSQHVSLSLSVHYSPKLLGPSCSWEAEGLHCSCSSQASPAPSLRWWLGEELLEGNSSQDSFEVTPSSAGPWANSSLSLHGGLSSGLRLRCEAWNVHGAQSGSILQLPDKKGLISTAFSNGAFLGIGITALLFLCLALIIMKILPKRRTQTETPRPRFSRHSTILDYINVVPTAGPLAQKRNQKATPNSPRTPLPPGAPSPESKKNQKKQYQLPSFPEPKSSTQAPESQESQEELHYATLNFPGVRPRPEARMPKGTQADYAEVKFQ

SEQ ID NO: 6935 - protein, 66 aa, Homo sapiens
MVGLLLIALLTWGYIRYSGQYRELGGAIDFGAAYVLEQASSHIGNSTQATVRDAVVGRPSMDKKAQ

SEQ ID NO: 6936 - protein, 53 aa, Homo sapiens
MMISGLKLLVLFLKFAPENYCLSTETLQMPNRHLRLSKATCYLMKCLLPSYFE

SEQ ID NO: 6937 - protein, 445 aa, Homo sapiens
MAAPTPARPVLTHLLVALFGMGSWAAVNGIWVELPVVVKELPEGWSLPSYVSVLVALGNLGLLVVTLWRRLAPGKDEQVPIRVVQVLGMVGTALLASLWHHVAPVAGQLHSVAFLALAFVLALACCAPNVTFLPFLSHLPPRFLRSFFLGQGLSALLPCVLALVQGVGRLECPPAPINGTPGPPLDFLERFPASTFFWALTALLVASAAAFQGLLLLLPPPPSVPTGELGSGLQVGAPGAEEEVEESSPLQEPPSQAAGTTPGPDPKAYQLLSARSACLLGLLAATNALTNGVLPAVQSFSCLPYGRLAYHLAVVLGSAANPLACFLAMGVLCRSLAGLGGLSLLGVFCGGYLMALAVLSPCPPLVGTSAGVVLVVLSWVLCLGVFSYVKVAASSLLHGGGRPALLAAGVAIQVGSLLGAVAMFPPTSIYHVFHSRKDCADPCDS

SEQ ID NO: 6938 - protein, 66 aa, Homo sapiens
MRSLISSHPCQHLLLLLLLLFLILAILVDVKWYLVLFICISLMTSDVEHLFMCLLAIRISSWRNVY

SEQ ID NO: 6939 - protein, 152 aa, Homo sapiens
MGVHVGAALGALWFCLTGALEVQVPEDPVVALVGTDATLCCSFSPEPGFSLAQLNLIWQLTDTKQLVHSFAEGQDQGSAYANRTALFLDLLAQGNASLRLQSVRVADEGQLHLLREHPGFRQRCRQPAGGRSLLEAQHDPGAQQGPAARGTW

SEQ ID NO: 6940 - protein, 831 aa, Homo sapiens
MKVHMHTKFCLICLLTFIFHHCNHCHEEHDHGPEALHRQHRGMTELEPSKFSKQAAENEKKYYIEKLFERYGENGRLSFFGLEKLLTNLGLGERKVVEINHEDLGHDHVSHLDILAVQEGKHFHSHNHQHSHNHLNSENQTVTSVSTKRNHKCDPEKETVEVSVKSDDKHMHDHNHRLRHHHRLHHHLDHNNTHHFHNDSITPSERGEPSNEPSTETNKTQEQSDVKLPKGKRKKKGRKSNENSEVITPGFPPNHDQGEQYEHNRVHKPDRVHNPGHSHVHLPERNGHDPGRGHQDLDPDNEGELRHTRKREAPHVKNNAIISLRKDLNEDDHHHECLNVTQLLKYYGHGANSPISTDLFTYLCPALLYQIDSRLCIEHFDKLLVEDINKDKNLVPEDEANIGASAWICGIISITVISLLSLLGVILVPIINQGCFKFLLTFLVALAVGTMSGDALLHLLPHSQGGHDHSHQHAHGHGHSHGHESNKFLEEYDAVLKGLVALGGIYLLFIIEHCIRMFKHYKQQRGKQKWFMKQNTEESTIGRKLSDHKLNNTPDSDWLQLKPLAGTDDSVVSEDRLNETELTDLEGQQESPPKNYLCIEEEKIIDHSHSDGLHTIHEHDLHAAAHNHHGENKTVLRKHNHQWHHKHSHHSHGPCHSGSDLKETGIANIAWMVIMGDGIHNFSDGLAIGAAFSAGLTGGISTSIAVFCHELPHELGDFAVLLKAGMTVKQAIVYNLLSAMMAYIGMLIGTAVGQYANNITLWIFAVTAGMFLYVALVDMLPEMLHGDGDNEEHGFCPVGQFILQNLGLLFGFAIMLVIALYEDKIVFDIQF

SEQ ID NO: 6941 - protein, 40 aa, Homo sapiens
MGALMRGIQFLFLCYFSSSCLPSEVQNTYPEVNLPFNWGP

SEQ ID NO: 6942 - protein, 419 aa, Homo sapiens
MSCAGRAGPARLAALALLTCSLWPARADNASQEYYTALINVTVQEPGRGAPLTFRIDRGRYGLDSPKAEVRGQVLAPLPLHGVADHLGCDPQTRFFVPPNIKQWIALLQRGNCTFKEKISRAAFHNAVAVVIYNNKSKEEPVTMTHPGTGDIIAVMITELRGKDILSYLEKNISVQMTIAVGTRMPPKNFSRGSLVFVSISFIVLMIISSAWLIFYFIQKIRYTNARDRNQRRLGDAAKKAISKLTTRTVKKGDKETDPDFDHCAVCIESYKQNDVVRILPCKHVFHKSCVDPWLSEHCTCPMCKLNILKALGIVPNLPCTDNVAFDMERLTRTQAVNRRSALGDLAGDNSLGLEPLRTSGISPLPQDGELTPRTGEINIAVTKEWFIIASFGLLSALTLCYMIIRATASLNANEVEWF

SEQ ID NO: 6943 - protein, 92 aa, Homo sapiens
  SITE (29): Xaa equals any amino acid
MEIRTRVVWLCLCLCLCLCLCLSLFSLPXSLSPLPSPLSLSVSLSLSFHGLPLMPSRSWTVLLPSQLTATSLPDSPASACRVPAIAGARHHA

SEQ ID NO: 6944 - protein, 480 aa, Homo sapiens
MLFRNRFLLLLALAALLAFVSLSLQFFHLIPVSTPKNGMSSKSRKRIMPDPVTEPPVTDPVYEALLYCNIPSVAERSMEGHAPHHFKLVSVHVFIRHGDRYPLYVIPKTKRPEIDCTLVANRKPYHPKLEAFISHMSKGSGASFESPLNSLPLYPNHPLCEMGELTQTGVVQHLQNGQLLRDIYLKKHKLLPNDWSADQLYLETTGKSRTLQSGLALLYGFLPDFDWKKIYFRHQPSALFCSGSCYCPVRNQYLEKEQRRQYLLRLKNSQLEKTYGEMAKIVDVPTKQLRAANPIDSMLCHFCHNVSFPCTRNGCVDMEHFKVIKTHQIEDERERREKKLYFGYSLLGAHPILNQTIGRMQRATEGRKEELFALYSAHDVTLSPVLSALGLSEARFPRFAARLIFELWQDREKPSEHSVRILYNGVDVTFHTSFCQDHHKRSPKPMCPLENLVRFVKRDMFVALGGSGTNYYDACHREGF

SEQ ID NO: 6945 - protein, 47 aa, Homo sapiens
MLQDLLSALWFCHPCCLCCGLCWLGVDAGCSQGGSGCPQGKISNNGI

SEQ ID NO: 6946 - protein, 40 aa, Homo sapiens
MLCDLILLFNIKMAIYHLIILQFFCSVCSEPDTALSISPL

SEQ ID NO: 6947 - protein, 53 aa, Homo sapiens
MFISLFIFGLVRLWPCCVVIYFVYSICKHQCSQEAHSSIFNCKFVSQSQFSIM

SEQ ID NO: 6948 - protein, 122 aa, Homo sapiens
MRVRIGLTLLLCAVLLSLASASSDEEGSQDESLDSKTTLTSDESVKDHTTAGRVVAGQIFLDSEESELESSIQEEEDSLKSQEGESVTEDISFLESPNPENKDYEEPKKVRKPGSLDIFLAF

SEQ ID NO: 6949 - protein, 305 aa, Homo sapiens
  SITE (11): Xaa equals any amino acid
MALCALTRALXSLNLAPPTVAAPAPSLFPAAQMMNNGLLQQPSALMLLPCRPVLTSVALNANFVSWKSRTKYTITPVKMRKSGGRDHTGRIRVHGIGGGHKQRYRMIDFLRFRPEETKSGPFEEKVIQVRYDPCRSADIALVAGGSRKRWIIATENMQAGDTILNSNHIGRMAVAAREGDAHPLGALPVGTLINNVESEPGRGAQYIRAAGTCGVLLRKVNGTAIIQLPSKRQMQVLETCVATVGRVSNVDHNKRVIGKAGRNRWLGKRPNSGRWHRKGGWAGRKIRPLPPMKSYVKLPSASAQS

SEQ ID NO: 6950 - protein, 156 aa, Homo sapiens
MAGQFRSYVWDPLLILSQIVLMQTVYYGSLGLWLALVDGLVRSSPSLDQMFDAEILGFSTPPGRLSMMSFILNALTCALGLLYFIRRGKQCLDFTVTVHFFHLLGCWFYSSRFPSALTWWLVQAVCIALMAVIGEYLCMRTELKEIPLNSAPKSNV

SEQ ID NO: 6951 - protein, 43 aa, Homo sapiens
MAFFFALFVIFFVIVVQMESHSGLGKKSKILSGGQGEEVYFLD

SEQ ID NO: 6952 - protein, 401 aa, Homo sapiens
MRLRLRLLALLLLLLAPPARAPKPSAQDVSLGVDWLTRYGYLPPPHPAQAQLQSPEKLRDAIKVMQRFAGLPETGRMDPGTVATMRKPRCSLPDVLGVAGLVRRRRRYALSGSVWKKRTLTWRVRSFPQSSQLSQETVRVLMSYALMAWGMESGLTFHEVDSPQGQEPDILIDFARAFHQDSYPFDGLGGTLAHAFFPGEHPISGDTHFDDEETWTFGSKDGEGTDLFAVAVHEFGHALGLGHSSAPNSIMRPFYQGPVGDPDKYRLSQDDRDGLQQLYGKAPQTPYDKPTRKPLAPPPQPPASPTHSPSFPIPDRCEGNFDAIANIRGETFFFKGPWFWRLQPSGQLVSPRPARLHRFWEGLPAQVRVVQAAYARHRDGRILLFSGPQFWVFQDRQLEGG

SEQ ID NO: 6953 - protein, 61 aa, Homo sapiens
MHSKQTLLWKELLLAIPCIIASPRSLWPRWASGKVKDWVNTARVGRTSLRLPVRKVEEAWV

SEQ ID NO: 6954 - protein, 937 aa, Homo sapiens
MQNSGKTKFKRTSIDRLMNTLVLWIFGFLICLGIILAIGNSIWESQTGDQFRTFLFWNEGEKSSVFSGFLTFWSYIIILNTVVPISLYVSVEVIRLGHSYFINWDRKMYYSRKAIPAVARTTTLNEELGQIEYIFSDKTGTLTQNIMTFKRCSINGRIYGEVHDDLDQKTEITQEKEPVDFSVKSQADREFQFFDHNLMESIKMGDPKVHEFLRLLALCHTVMSEENSAGELIYQVQSPDEGALVTAARNFGFIFKSRTPETITIEELGTLVTYQLLAFLDFNNTRKRMSVIVRNPEGQIKLYSKGADTILFEKLHPSNEVLLSLTSDHLSEFAGEGLRTLAIAYRDLDDKYFKEWHKMLEDANVATEERDERIAGLYEEIERDLMLLGATAVEDKLQEGVIETVTSLSLANIKIWVLTGDKQETAINIGYACNMLTDDMNDVFVIAGNNAVEVREELRKAKQNLFGQNRNFSNGHVVCEKKQQLELDSIVEETITGDYALIINGHSLAHALESDVKNDLLELACMCKTVICCRVTPLQKAQVVELVKKYRNAVTLAIGDGANDVSMIKSAHIGVGISGQEGLQAVLASDYSFAQFRYLQRLLLVHGRWSYFRMCKFLCYFFYKNFAFTLVHFWFGFFCGFSAQTVYDQWFITLFNIVYTSLPVLAMGIFDQDVSDQNSVDCPQLYKPGQLNLLFNKRKFFICVMHGIYTSLVLFFIPYGAFYNVAGEDGQHIADYQSFAVTMATSLVIVVSVQIALDTSYWTFINHVFIWGSIAIYFSILFTMHSNGIFGIFPNQFPFVGNARHSLTQKCIWLVILLTTVASVMPVVAFRFLKVDLYPTLSDQIRRWQKAQKKARPPSSRRPRTRRSSSRRSGYAFAHQEGYGELITSGKNMRAKNPPPTSGLEKTHYNSTSWIENLCKKTTDTVSSFSQDKTVKL

SEQ ID NO: 6955 - protein, 453 aa, Homo sapiens
MKLLVILLFSGLITGFRSDSSSSLPPKLLLVSFDGFRADYLKNYEFPHLQNFIKEGVLVEHVKNVFITKTFPNHYSIVTGLYEESHGIVANSMYDAVTKKHFSDSNDKDPFWWNEAVPIWVTNQLQENRSSAAAMWPGTDVPIHDTISSYFMNYNSSVSFEERLNNITMWLNNSNPPVTFATLYWEEPDASGHKYGPEDKENMSRVLKKIDDLIGDLVQRLKMLGLWENLNVIITSDHGMTQCSQDRLINLDSCIDHSYYTLIDLSPVAAILPKINRTEVYNKLKNCSPHMNVYLKEDIPNRFYYQHNDRIQPIILVADEGWTIVLNESSQKLGDHGYDNSLPSMHPFLAAHGPAFHKGYKHSTINIVDIYPMMCHILGLKPHPNNGTFGHTKCLLVDQWCINLPEAIAIVIGSLLVLTMLTCLIIIMQNRLSVPRPFSRLQLQEDDDDPLIG

SEQ ID NO: 6956 - protein, 125 aa, Homo sapiens
MVARVFYYLCVIALQYVAPLVMLLHTTLLLKTLGNHSWGIYPESISTLPVDNSLLSNSVYSELPSAEGKMKVTVTQITVALSSLKNIFTPLLFRGLLSFLTWWIAACLFSTSLFGLFYHQYLTVA

SEQ ID NO: 6957 - protein, 66 aa, Homo sapiens
  SITE (36): Xaa equals any amino acid
MQHLLLHSLCLSCSTMARNVPASPSPSAVIVSFLRXPQPCFLYSLQNCESIKPLFFINSPVSSSSL

SEQ ID NO: 6958 - protein, 424 aa, Homo sapiens
  SITE (268): Xaa equals any amino acid
  SITE (316): Xaa equals any amino acid
  SITE (318): Xaa equals any amino acid
MLFCLGIFLSFYLLTVLLACWENWRQKKKTLLVAIDRACPESGHPRVLADSFPGSSPYEGYNYGSFENVSGSTDGLVDSAGTGDLSYGYQGRSFEPVGTRPRVDSMSSVEEDDYDTLTDIDSDKNVIRTKQYLYVADLARKDKRVLRKKYQIYFWNIATIAVFYALPVVQLVITYQTVVNVTGNQDICYYNFLCAHPLGNLSLPCVAPSSAFNNILSNLGYILLGLLFLLIILQREINHNRALLRNDLCALECGIPKHFGLFYAMGTXLMMEGLLSACYHVCPNYTNFQFDTSFMYMIAGLCMLKLYQKRHPDINXSXYSAYACLAIVIFFSVLGVVFGKGNTAFWIVFSIIHIIATLLLSTQLYYMGRWKLDSGIFRRILHVLYTDCIRQCSGAALRGPHGAAGHGQRHQLVAGCLWAYHAPQ

SEQ ID NO: 6959 - protein, 307 aa, Homo sapiens
  SITE (165): Xaa equals any amino acid
  SITE (247): Xaa equals any amino acid
MGTQEGWCLLLCLALSGAAETKPHPAEGQWRAVDVVLDCFLAKDGAHRGALASSEDRARASLVLKQVPVLDDGSLEDFTDFQGGTLAQDDPPIIFEASVDLVQIPQAEALLHADCSGKEVTCEISRYFLQMTETTVKTAAWFMANMQVSGGGPSISLVMKTPRVXKNEALWHPTLNLPLSPQGTVRTAVEFQVMTQTQSLSFLLGSSASLDCGFSMAPGLDLISVEWRLQHKGRGQLVYSWTAGRGXLCGRALPWSLHNWAWPGMPPSPCPASLYRTRGPTFARSPPLCTELSRSSSSTSKLPLKYD

SEQ ID NO: 6960 - protein, 267 aa, Homo sapiens
MAPWALLSPGVLVRTGHTVLTWGITLVLFLHDTELRQWEEQGELLLPLTFLLLVLGSLLLYLAVSLMDPGYVNVQPQPQEELKEEQTAMVPPAIPLRRCRYCLVLQPLRARHCRECRRCVRRYDHHCPWMENCVGERNHPLFVVYLALQLVVLLWGLYLAWSGLRFFQPWGLWLRSSGLLFATFLLLSLFSLVASLLLVSHLYLVASNTTTWEFISSHRIAYLRQRPSNPFDRGLTRNLAHFFCGWPSGSWETLWAEEEEEGSSPAV

SEQ ID NO: 6961 - protein, 168 aa, Homo sapiens
MPLLRGLLWLQVLCAGPLHTEAVVLLVPSDDGRAFLLRSRLLHPEAHVPPAADRGASLQCVLHQAAPKSRPRSPAAGAALLHRPRRTGDEPCREFHGNGFPGPTQLTPGECGLPAPSSLLQHASAPVRTGSEGQVVGCPRARGETGEGLSLAFLSSLMFTSRNGLVGC

SEQ ID NO: 6962 - protein, 170 aa, Homo sapiens
MAAAGSVKAALQVAEVLEAIVSCCVGPEGRQVLCTKPTGEVLLSRNGGRLLEALHLEHPIARMIVDCVSSHLKKTGDGAKTFIIFLCHLLRGLHAITDREKDPLMCENIQTHGRHWKNCSRWKFISQALLTFQTQILDGIMDQYLSRHFLSIFSSAKERTLCRSSLESVS

SEQ ID NO: 6963 - protein, 41 aa, Homo sapiens
MAQCCLWLGSWVLDMASCSPFSTGIWKTSMELQPSLGSVQS

SEQ ID NO: 6964 - protein, 288 aa, Homo sapiens
  SITE (87): Xaa equals any amino acid
  SITE (99): Xaa equals any amino acid
  SITE (230): Xaa equals any amino acid
  SITE (263): Xaa equals any amino acid
  SITE (264): Xaa equals any amino acid
  SITE (270): Xaa equals any amino acid
  SITE (275): Xaa equals any amino acid
MARISFSYLCPASWYFTVPTVSPFLRQRVAFLGLFFISCLLLLMLIIDFRHWSASLPRDRQYERYLARVGELEATDTEDPNLNYGLXVDCGSSGSRIFXYFWPRHNGNPHDLLDIKQMRDRNSQPVVKKIKPGISAMADTPEHASDYLRPLLSFAAAHVPVKKHKETPLYILCTAGMRLLPERKQLAILADLVKDLPLEFDFLFSQSQAEVISGKQEGVYAWIGINFVLXRFDHEDESDAEATQELAAGRRRTVGILDMGGAXXQIAYEXPTFPXKKTPPLFPLLGGI

SEQ ID NO: 6965 - protein, 180 aa, Homo sapiens [sequence omitted]

SEQ ID NO: 6966 - protein, 101 aa, Homo sapiens
  SITE (23): Xaa equals any amino acid
  SITE (29): Xaa equals any amino acid
MLLFGLCWGPYVATLLLSVLAYXQRPPLXPGTLLSLLSLGSASAAAVPVAMGLGDQRYTAPWRAAAQRCLQGLWGRASRDSPGPSIAYHPSSQSSVDLDLN

SEQ ID NO: 6967 - protein, 86 aa, Homo sapiens
MSLCRILGYSFSSRLSSLILPLAVFHYCLSCPLHFKLSFKYLPFPSFPFSSLPCPALPCPALPSPPLPCPPLPSPPLPLPSLSFFR

SEQ ID NO: 6968 - protein, 82 aa, Homo sapiens [sequence omitted]

SEQ ID NO: 6969 - protein, 227 aa, Homo sapiens
MVGKIKRLKKSAFVVLILLITAKLLVLPLLCREMVELLDKGDSVVNHTSLSNYAFLYGVFPVAPGVAIFATQFNMEVEIITSGMVISTFVSAPIMYVSAWLLTFPTMDPKPLAYAIQNVSFDISIVSLISLIWSLAILLLSKKYKQLPHMLTTNLLIAQSIVCAGMMIWNFVKEKNFVGQILVFVLLYSSLYSTYLWTGLLAISLFLLKKRERVQIPVGIIIISGWG

SEQ ID NO: 6970 - protein, 405 aa, Homo sapiens
MQWRALVLGLVLLRLGLHGVLWLVFGLGPSMGFYQRFPLSFGFQRLRSPDGPASPTSGPVGRPGGVSGPSWLQPPGTGAAQSPRKAPRRPGPGMCGPANWGYVLGGRGRGPDEYEKRYSGAFPPQLRAQMRDLARGMFVFGYDNYMAHAFPQDELNPIHCRGRGPDRGDPSNLNINDVLGNYSLTLVDALDTLAIMGNSSEFQKAVKLVINTVSFDKDSTVQVFEATIRVLGSLLSAHRIITDSKQPFGDMTIKDYDNELLYMAHDLAVRLLPAFENTKTGIPYPRVNLKTGVPPDTNNETCTAGAGSLLVEFGILSRLLGDSTFEWVARRAVKALWNLRSNDTGLLGVAPFLAIGTAHCLVPFSFHLLWALPPFYSSTQLTTQQELCQLYLISLCDPLQRGCMV

SEQ ID NO: 6971 - protein, 261 aa, Homo sapiens
MMCVVLTTLPCLTFSIAVTEVQKSINGSADVLPDMLPDLPVSLVLLSLIMVDIIEKLRIYPLRGSQKSSENGHIHSTSLQHIKTVTEQVRQSPENAASPQATNSTQVSQPSGAMTRSQESVFMGPQEPSCDSGILRMMSRRDVRAELFLWSFLLWSDTIEMVRVAGHPNVYKSSWLYPVYIFSFISLLRITFTPQNPLLNSLSVLLQDLPFVFVRLGLIIALGTITPVLGLCKNILVTLSYIYFNYLTRIRIFSAFEMSPF

SEQ ID NO: 6972 - protein, 294 aa, Homo sapiens
  SITE (188): Xaa equals any amino acid
  SITE (211): Xaa equals any amino acid
MPRGDSEQVRYCARFSYLWLKFSLIIYSTVFWLIGALVLSVGIYAEVERQKYKTLESAFLAPAIILILLGVVMFMVSFIGVLASLRDNLYLLQAFMYILGICLIMELIGGVVALTFRNQTIDFLNDNIRRGIENYYDDLDFKNIMDFVQKKFKCCGGEDYRDWSKNQYHDCSAPGPLACGVPYTCCIXNTTEVVNTMCGYKTIDKERFSVXDVIYVRGCTNAVIIWFMDNYTIMAGILLGILLPQFLGVLLTLLYITRVEDIIMEHSVTDGLLGPGAKPSVEAAGTGCCLCYPN

SEQ ID NO: 6973 - protein, 55 aa, Homo sapiens
MCVGLFLSSVFFHICVHPFANATLSCLLEIGKLCESFNFVLFQIVLAILVPLTFI

SEQ ID NO: 6974 - protein, 48 aa, Homo sapiens
MKPPPLFFFLKIVLAIWGPLWFHMNFRFVFSISMKNAIGILIGIALNL

SEQ ID NO: 6975 - protein, 455 aa, Homo sapiens
MAALLLLPLLLLLPLLLLKLHLWPQLRWLPADLAFAVRALCCKRALRARALAAAAADPEGPEGPCILAWRLAELAQQRARNFLLRSRALATQRRSARVTGLTRLPTCARLGLGTRRRRQRRGERWRRRAGSAGSRRCSGRKRRGVCRRGRCRQRWRSRAPLSPGATVALLLPAGPEFLWLWIGLAKAGLRTAFVPTALRRGPLLHCLRSCGARALVLAPEFLESLEPDLPALRAMGLHLWAAGPGTHPAGISDLLAEVSAEVDGPVPGYLSSPQSITDTCLYIFTSGTTGLPKAARISHLKILQCQGFYQLCGVHQEDVIYLALPLYHMSGSLLGIVGCMGIGATVVLKSKFSAGQFWEDCQQHRVTVFQYIGELCRYLVNQPPSKAERGHKVRLAVGSGLRPDTWERFVRRFGPLQVLETYGLTEGNVPPSTTQDSGALWGVLPGFTSISSPSP

SEQ ID NO: 6976 - protein, 458 aa, Homo sapiens
MMLIPMASVMAVTEPKWVSVWSRFLWVTLLSMVLGSLLALLLPLGAVEEQCLAVLKGLYLLRSKPDRAQHAATKCTSPSTELSITSRGATLLVAKTKASPAGKLEARAALNQALEMKRQGKREKAQKLFMHALKMDPDFVDALTEFGIFSEEDKDIIQADYLYTRALTISPYHEKALVNRDRTLPLVEEIDQRYFSIIDSKVKKVMSIPKGNSALRRVMEETYYHHIYHTVAIEGNTLTLSEIRHILETRYAVPGKSLEEQNEVIGMHAAMKYINTTLVSRIGSVTISDVLEIHRRVLGYVDPVEAGRFRTTQVLVGHHIPPHPQDVEKQMQEFVQWLNSEEAMNLHPVEFAALAHYKLVYIHPFIDGNGRTSRLLMNLILMQAGYPPITIRKEQRSDYYHVLEAANEGDVRPFIRFIAKCTETTLDTLLFATTEYSVALPEAQPNHSGFKETLPVKP

SEQ ID NO: 6977 - protein, 120 aa, Homo sapiens
MILWLDWALFLLVFPGQFFCWFCLGSLMRLQVAAGSASVWGSAGMTWPLSACGPLSSMMVSGFQASKPQCTSIYPAFACIALAHVSLAKTDHVAKLRVSVGRVYTSAWILKGMIHWGPLL

SEQ ID NO: 6978 - protein, 118 aa, Homo sapiens
MAGPRGLLPLCLLAFCLAGFSFVRGQVLFKGCDVKTTFVTHVPCTSCAAIKKQTCPSGWLRELPDQITQDCRCGPPLSLPVSRSILWGGRDSGSLTGPQNEEKHSLIHAPVAPPGWWR

SEQ ID NO: 6979 - protein, 90 aa, Homo sapiens [sequence omitted]

SEQ ID NO: 6980 - protein, 485 aa, Homo sapiens [sequence omitted]

SEQ ID NO: 6981 - protein, 43 aa, Homo sapiens
MRWIWLTLTFGITSQLASGKLSKYWAIVFEDRSLESYVSKFKC

SEQ ID NO: 6982 - protein, 360 aa, Homo sapiens
MGAPLLSPGWGAGAAGRRWWMLLAPLLPALLLVRPAGALVEGLYCGTRDCYEVLGVSRSAGKAEIARAYRQLARRYHPDRYRPQPGDEGPGRTPQSAEEAFLLVATAYETLKDEETRKDYDYMLDHPEEYYSHYYHYYSRRLAPKVDVRVVILVSVCAISVFQFFSWWNSYNKAISYLATVPKYRIQATEIAKQQGLLKKAKEKGKNKKSKEEIRDEEENIIKNIIKSKIDIKGGYQKPQICDLLLFQIILAPFHLCSYIVWYCRWIYNFNIKGKEYGEEERLYIIRKSMKMSKSQFDSLEDHQKETFLKRELWIKENYEVYKQEQEEELKKKLANDPRWKRYRRWMKNEGPGRLTFVDD

SEQ ID NO: 6983 - protein, 143 aa, Homo sapiens [sequence omitted]

SEQ ID NO: 6984 - protein, 352 aa, Homo sapiens [sequence omitted]

SEQ ID NO: 6985 - protein, 120 aa, Homo sapiens [sequence omitted]

SEQ ID NO: 6986 - protein, 96 aa, Homo sapiens
MARSLLIILGADFTFPTSFNCFQKMNLAKKSRGSFTHLLTHSWCLSLFLKEADQGLRENNFDFSHVCPSKPPLWTDSPSVPGRNWDNPRTFLVPSR

SEQ ID NO: 6987 - protein, 146 aa, Homo sapiens
MAALLLLPLLLLLPLLLLKLHLWPQLRWLPAATAARGALEKASGQRREPEMQRPEAARSLPEGTVPPEVEEPPPLCHLEQLWRCSSPLAQSFCGSGSGWPRPACALPLCPPPCAGAPCCTASAAAARARWCWRQSFWSPWSRTCPP

SEQ ID NO: 6988 - protein, 196 aa, Homo sapiens
  SITE (12): Xaa equals any amino acid
  SITE (22): Xaa equals any amino acid
  SITE (55): Xaa equals any amino acid
  SITE (147): Xaa equals any amino acid
  SITE (156): Xaa equals any amino acid
  SITE (184): Xaa equals any amino acid
MGKWKESLQNAXHLPPILLLRXIHLFCAVLAGGKENGQMAVSDGSVKGLLSVVRXWSRGPAPDPCLVPLALEALVGAVHVLHASRAPPRGPELRALLESYFHVLNADWPAGLSSGPEEALVTLRVSMLDAIPMMLHVKTGQCLQPPXSATIALNTXLGSFKNKQGSWTKTQTHCSPCSQSADLXHEVTPLGPRRWL

SEQ ID NO: 6989 - protein, 64 aa, Homo sapiens
  SITE (16): Xaa equals any amino acid
MAGRRLNLRWALSVLXVLLMAETVSGTRGSSTGAHISPQFPASGVNQTPVVDVTWACMCSMWSL

SEQ ID NO: 6990 - protein, 347 aa, Homo sapiens [sequence omitted]

SEQ ID NO: 6991 - protein, 77 aa, Homo sapiens [sequence omitted]

SEQ ID NO: 6992 - protein, 112 aa, Homo sapiens
MESHLSTWPCHPSCCLFLILLFPSHPTSMTKSKARLPHLENCSQNDTSKPLGQARPPSSPTRTTDLTTGPTSSPAPLGILHTAVRVTHLHTLTLMGEEKAVFVARAQVGTLA

SEQ ID NO: 6993 - protein, 138 aa, Homo sapiens
VFCKGQAALALAACGVLLGSGGPAAAWEADPRGQVWPCPDRARTEVGGSPCAVPSSPEEAGLKPPGVAEASPCQRPKPRLGFYRCSFPSTWSPSTPSSPNSQPPFFFFLHASKVQGPQMYRSLMYHPAREPADYQAKK

SEQ ID NO: 6994 - protein, 54 aa, Homo sapiens
MQQICSCLGAFALLFFWPGHFTSTFSIFYDFLPIFGSLFKCHPSKRPSKLPYLK

SEQ ID NO: 6995 - protein, 406 aa, Homo sapiens
MSGAPTAGAALMLCAATAVLLSAQGGPVQSKSPRFASWDEMNVLAHGLLQLGQGLREHAERTRSQLSALERRLSACGSACQGTEGSTDLPLAPESRVDPEVLHSLQTQLKAQNSRIQQLFHKVAQQQRHLEKQHLRIQHLQSQFGLLDHKHLDHEVAKPARRKRLPEMAQPVDPAHNVSRLHRLPRDCQELFQVGERQSGLFEIQPQGSPPFLVNCKMTSDGGWTVIQRRHDGSVDFNRPWEAYKAGFGDPHGEFWLGLEKVHSITGDRNSRLAVQLRDWDGNAELLQFSVHLGGEDTAYSLQLTAPVAGQLGATTVPPSGLSVPFSTWDQDHDLRRDKNCAKSLSGGWWFGTCSHSNLNGQYFRSIPQQRQKLKKGIFWKTWRGRYYPLQATTMLIQPMAAEAAS

SEQ ID NO: 6996 - protein, 47 aa, Homo sapiens
MYFFTFYFSISSFMFFLLVIVKATNGPRYVVGCRRQVILYICIVPDD

SEQ ID NO: 6997 - protein, 79 aa, Homo sapiens
  SITE (53): Xaa equals any amino acid
MVQHIQPAALSLLAQWSTLVQELEAALQLAFYPDAVEEWLEENVHPSLQRLQXLLQDLSEVSAPPLPPTSPGRDVAQDP

SEQ ID NO: 6998 - protein, 304 aa, Homo sapiens
  SITE (98): Xaa equals any amino acid
  SITE (166): Xaa equals any amino acid
  SITE (231): Xaa equals any amino acid
MSSSEMWTVLWHRFSMVLRLPEEASAQEGELSLSSPPSPEPDWTLISPQGIFLSHGSILMSILKHLLCPSFLNQLRQAPHGSEFLPVVVLSVCQLLCXPFALDMDADLLIDVLADLRDSEVAAHLLQVCCYHLPLMQVELPISLLTRLALMDPTSLNQFVNTVSAXPRTIVSFLSVALLSDQPLLTSDLLSLLAHTARVLSPSHLSFIQELLAGSDESYRPLRSSWATQRXLCGHTLIGSWDTCSNTAWPCVGHCRASLDCSAFCCLGLETRILLCGAVPALLWAMQPTRLVLWDLPWQLQCPV

SEQ ID NO: 6999 - protein, 32 aa, Homo sapiens [sequence omitted]

SEQ ID NO: 7000 - protein, 486 aa, Homo sapiens
MQPSGLEGPGTFGRWPLLSLLLLLLLLQPVTCAYTTPGPPRALTTLGAPRAHTMPGTYAPSTTLSSPSTQGLQEQARALMRDFPLVDGHNDLPLVLRQVYQKGLQDVNLRNFSYGQTSLDRLRDGLVGAQFWSAYVPCQTQDRDALRLTLEQIDLIRRMCASYSELELVTSAKALNDTQKLACLIGVEGGHSLDNSLSILRTFYMLGVRYLTLTHTCNTPWAESSAKGVHSFYNNISGLTDFGEKVVAEMNRLGMMVDLSHVSDAVARRALEVSQAPVIFSHSAARGVCNSARNVPDDILQLLKKNGGVVMVSLSMGVIQCNPSANVSTVADHFDHIKAVIGSKFIGIGGDYDGAGKFPQGLEDVSTYPVLIEELLSRGWSEEELQGVLRGNLLRVFRQVEKVQEENKWQSPLEDKFPDEQLSSSCHSDLSRLRQRQSLTSGQELTEIPIHWTAKLPAKWSVSESSPHMAPVLAVVATFPVLILWL

SEQ ID NO: 7001 - protein, 48 aa, Homo sapiens
MLSKSSKMVSVKRADPGSLGFTFLLSSLPKCTVGVSRGRPTCTSCSDG

SEQ ID NO: 7002 - protein, 34 aa, Homo sapiens
MLWPCCPSPLPIWASPSPRLTWWCLLSCFGTQGC

SEQ ID NO: 7003 - protein, 41 aa, Homo sapiens
MRHCCWLWSSCMLWEPSTTLGSSPRLVERWQSCRWTPCCPK

SEQ ID NO: 7004 - protein, 50 aa, Homo sapiens
MAPEGPSPSCALGPQPLPQPPRTYLAPALSTSPVFSPASAPSVSYLPGTG

SEQ ID NO: 7005 - protein, 87 aa, Homo sapiens
MLLRVFHFFLHILHKKQTGVSLLYLLLTLFLLQQQVIPQPSLPLLHLVSFQICHYPFPQWMLQYRQAKMVLGTRCQMSLMHFQNSQN

SEQ ID NO: 7006 - protein, 16 aa, Homo sapiens
MQKCMLSALVFHIQWS

SEQ ID NO: 7007 - protein, 23 aa, Homo sapiens
MHPQSAFCALAAANASLGRSSCQ

SEQ ID NO: 7008 - protein, 182 aa, Homo sapiens
MLLLCHALAIAVVQIVIFSESWAFAKNINFYNVRPPLDPTPFPNSFKCFTCENAGDNYNCNRWAEDKWCPQNTQYCLTVHHFTSHGRSTSITKKCASRSECHFVGCHHSRDSEHTECRSCCEGMICNVELPTNHTNAVFAVMHAQRTSGSSAPTLYLTSACLGLCASIAVMPPFLGEAETSL

SEQ ID NO: 7009 - protein, 103 aa, Homo sapiens
  SITE (60): Xaa equals any amino acid
MEFCLIFLLLILEFCQIFDCLRKCYYRLTCLSCLLLNLLIFFSEKVVSENPNIVVIGLAXVIMLSIMFIKWLLILLIFLLSFKNLGKEQEEREDLLNSLLTTS

SEQ ID NO: 7010 - protein, 151 aa, Homo sapiens [sequence omitted]

SEQ ID NO: 7011 - protein, 53 aa, Homo sapiens
MTLSVLFAFPIWLKYLNLNIFFLALKIFWVILSFCTSCTSWYSGARVIFFQII

SEQ ID NO: 7012 - protein, 388 aa, Homo sapiens; identical to SEQ ID NO: 6852

SEQ ID NO: 7013 - protein, 42 aa, Homo sapiens
MIYFLCLAYCKFFILIHSSNIIATKKCLYLDQRQDFLCVCFA

SEQ ID NO: 7014 - protein, 200 aa, Homo sapiens
  SITE (10): Xaa equals any amino acid
  SITE (11): Xaa equals any amino acid
  SITE (27): Xaa equals any amino acid
  SITE (50): Xaa equals any amino acid
  SITE (60): Xaa equals any amino acid
  SITE (84): Xaa equals any amino acid
  SITE (178): Xaa equals any amino acid
  SITE (180): Xaa equals any amino acid
  SITE (190): Xaa equals any amino acid
MLQRMLIDVXXFLFLFAVWMVAFGVAXQGILRQNEQRWRWIFRSVIYEPXLAMFGQVPSXVDGTTYDFAHCTFTGNESKPLCVXLDEHNLPRFPEWITIPLVCIYMLSTNILLVNLLVAMFGYTVGTVQENNDQVWKFQRYFLVQEYCSRLNIPFPFIVFAYFYMVVKKCFKCCCKEXNXESSVCCSKMXTMRLWHGRVS

SEQ ID NO: 7015 - protein, 53 aa, Homo sapiens
MLMRYKSYFFISILLLCCFFFLILQVYKLSFKILSQDFKNCRVLVWRSLPSFS

SEQ ID NO: 7016 - protein, 712 aa, Homo sapiens
MGQGLKAWPRYRVVGSADAGQYNLEITDAELSDDASYECQATEAALRSRRAKLTVLIPPEDTRIDGGPVILLQAGTPHNLTCRAFNAKPAATIIWFRDGTQQEGAVASTELLKDGKRETTVSQLLINPTDLDIGRVFTCRSMNEAIPSGKETSIELDVHHPPTVTLSIEPQTVQEGERVVFTCQATANPEILGYRWAKGGFLIEDAHESRYETNVDYSFFTEPVSCEVHNKVGSTNVSTLVNVHFAPRIVVDPKPTTTDIGSDVTLTCVWVGNPPLTLTWTKKDSNMGPRPPGSPPEAALSAQVLSNSNQLLLKSVTQADAGTYTCRAIVPRIGVAEREVPLYVNGPPIISSEAVQYAVRGDGGKVECFIGSTPPPDRIAWAWKENFLEVGTLERYTVERTNSGSGVLSTLTINNVMEADFQTHYNCTAWNSFGPGTAIIQLEEREVLPVGIIAGATIGASILLIFFFIALVFFLYRRRKGSRKDVTLRKLDIKVETVNREPLTMHSDREDDTASVSTATRVMKAIYSSFKDDVDLKQDLRCDTIDTREEYEMKDPTNGYYNVRAHEDRPSSRAVLYADYRAPGPARFDGRPSSRLSHSSGYAQLNTYSRGPASDYGPEPTPPGPAAPAGTDTTSQLSYENYEKFNSHPFPGAAGYPTYRLGYPQAPPSGLERTPYEAYDPIGKYATATRFSYTSQHSDYGQRFQQRMQTHV

SEQ ID NO: 7017 - protein, 105 aa, Homo sapiens
MDDFLFSVSILSGILCSILAVLKFMLGKVLTSRALITDGFNSLVGGVMGFSILLSAEVFKHDSAVWYLDGSIGVLIGLTIFAYGVKLLIDMVPRVRQTRHYEMFE

SEQ ID NO: 7018 - protein, 286 aa, Homo sapiens
MLMLMLLMMFAVHCTWVTSNAYSSPSVVLASYNHDGTRNILDDFREAYFWLRQNTDEHARVMSWWDYGYQIAGMANRTTLVDNNTWNNSHIALVGKAMSSNETAAYKIMRTLDVDYVLVIFGGVIGYSGDDINKFLWMVRIAEGEHPKDIRESDYFTPQGEFRVDKAGSPTLLNCLMYKMSYYRFGEMQLDFRTPPGFDRTRNAEIGNKDIKFKHLEEAFTSEHWLVRIYKVKAPDNRETLDHKPRVTNIFPKQKYLSKKTTKRKRGYIKNKLVFKKGKKISKKTV

SEQ ID NO: 7019 - protein, 89 aa, Homo sapiens [sequence omitted]

SEQ ID NO: 7020 - protein, 38 aa, Homo sapiens
MLRGASGMCRGHLHLIVFFPVLLLSHPLYKKWVLTWSL

SEQ ID NO: 7021 - protein, 40 aa, Homo sapiens
MLSLTVSLKSVSIAAQSLFLDLHFPIQMTLVHKEIAKLET

SEQ ID NO: 7022 - protein, 43 aa, Homo sapiens
MCMFSTCGLSNYLIITTFLLLSISSLVPPTPSKLFDSSSHWKY

SEQ ID NO: 7023 - protein, 140 aa, Homo sapiens
MCAMYLMIKAFLPKMLAQKSGNIINMSSVASSVKGVVNRCVYSTTKAAVIGLTKSVAADFIQQGIRCNCVCPGTVDTPSLQERIQARGNPEEARNDFLKRQKTGRFATAEEIAMLCVYLASDESAYVTGNPVIIDGGWSL

SEQ ID NO: 7024 - protein, 16 aa, Homo sapiens
EAPWGLLKLLLLLAVF

SEQ ID NO: 7025 - protein, 31 aa, Homo sapiens
MFEALWATDYLCCLFLFVSFFRPLQKCKNHS

SEQ ID NO: 7026 - protein, 16 aa, Homo sapiens
MQQKQKKANEKKEEPK

SEQ ID NO: 7027 - protein, 32 aa, Homo sapiens
MSMDLANLYLLFIVHRFLIFFIPVSFKLPSFE

SEQ ID NO: 7028 - protein, 94 aa, Homo sapiens
  SITE (82): Xaa equals any amino acid
  SITE (83): Xaa equals any amino acid
MLNQGYIRKIILIIILGSFSSPKKAILMGFQNQKKALNEEQTTGVPMSISGKLRPSRSLDFVQPPRFQSQQPSAVVDRRGFXXKAARGQEFSES

SEQ ID NO: 7029 - protein, 48 aa, Homo sapiens [sequence omitted]

SEQ ID NO: 7030 - protein, 30 aa, Homo sapiens
MQLSKFLLFLFVYTRENPTSACVWGEKSTV

SEQ ID NO: 7031 - protein, 22 aa, Homo sapiens
MYLVFCLSCVSNQGPHSPVGTW

SEQ ID NO: 7032 - protein, 222 aa, Homo sapiens
  SITE (120): Xaa equals any amino acid
MLWLLFFLVTAIHAELCQPGAENAFKVRLSIRTALGDKAYAWDTNEEYLFKAMVAFSMRKVPNREATEISHVLLCNVTQRVSFWFVVTDPSKNHTLPAVEVQSAIRMNKNRINNAFFLNXQTLEFLKIPSTLAPPMDPSVPIWIIIFGVIFCIIIVAIALLILSGIWQRRRKNKEPSEVDDAEDKCENMITIENGIPSDPLDMKGGHINDAFMTEDERLTPL

SEQ ID NO: 7033 - protein, 113 aa, Homo sapiens
MIFSMPQQGSSWFLSAFLSWPLALAPALTPTPAPARAPGAPRAAGAPGRVAAGRGTCAGALAPGQEAWSAVWEPGLFIWVEHPLGCQGHGLDRFPLPTALPLQGGHAACCPQL

SEQ ID NO: 7034 - protein, 56 aa, Homo sapiens
MNWCLCIISLTTLLSIPVHIVGEEKDMLKCTFCLLNTLKKCVVWKRLYHNGGANNL

SEQ ID NO: 7035 - protein, 230 aa, Homo sapiens
MSCSEGFKNLFYRTYMLFKNASGKRRFLLCLLLFTVITYFFVVIGIAPIFILYELDSPLCWNEVFIGYGSALGSASFLTSFLGIWLFSYCMEDIHMAFIGIFTTMTGMAMTAFASTTLMMFLARVPFLFTIVPFSVLRSMLSKVVRSTEQGTLFACIAFLETLGGVTAVSTFNGIYSATVAWYPGFTFLLSAGLLLLPAISLCVVKCTSWNEGSYELLIQEESSEDASDR

SEQ ID NO: 7036 - protein, 40 aa, Homo sapiens
MFVFSLLHFGVLLLQCDPCWAFLYNQQLNLLPNACLPFIF

SEQ ID NO: 7037 - protein, 45 aa, Homo sapiens
MLLCSVRNILWHTAFLGSAVLCFVLVLVLHLECLIIDAYFNSISF

SEQ ID NO: 7038 - protein, 148 aa, Homo sapiens
MSPGYTFKTALAVLYLVHMIQNMFPYNMGLSLLANPAPSSSSNLLSEASALHLLLADGNLQGKAEGFLGKPGKPVFPMCQICLASKKGCMGFLASFQEALGFLLLPRFPQSSQMLKFLKVDVTGSLTTNKLAVTVFETQYLWQLTSNQ

SEQ ID NO: 7039 - protein, 111 aa, Homo sapiens
  SITE (9): Xaa equals any amino acid
MQSPKFLSXTPYLFQTPFHLISLPCHFFIFKMPIVYVLFKFFERLKQPLSKIPFCLLAFKFSIRAFFLPLWHAALWLSFVFFAGFLHDVVVVSCLTLCGVVSCSFSSPRCL

SEQ ID NO: 7040 - protein, 39 aa, Homo sapiens
MIHSGCTSQCLEGFFLIFLLDFNPVLALDLIGIMRKASH

SEQ ID NO: 7041 - protein, 40 aa, Homo sapiens [sequence omitted]

SEQ ID NO: 7042 - protein, 87 aa, Homo sapiens
MTGQIPRLSKVNLFTLLSLWMELFPAEAQRQKSQKNEEGKHGPLGDNEERTRVSTDKRQKTMFCLFENDCKCKALRVMIRSMSRSVP

SEQ ID NO: 7043 - protein, 94 aa, Homo sapiens [sequence omitted]

SEQ ID NO: 7044 - protein, 74 aa, Homo sapiens
MFTSFGLASPRILFCFCFFDLGFIFFCVLYYIVKGILAETLVFGARGEQECWAVYFRWRTHLQTFGLFSFNCSV

SEQ ID NO: 7045 - protein, 11 aa, Homo sapiens
MALLISSLIWS

SEQ ID NO: 7046 - protein, 38 aa, Homo sapiens [sequence omitted]

SEQ ID NO: 7047 - protein, 104 aa, Homo sapiens
MYWGIFFSILNFLAFFSLVLISVLLWTGMVVFRSLDPGAELVGFESHLYHCCVTSGNLPNFPGPQFSYIENGNNKSICFIGLLREFANSIYANLLDQCLAHNSQ

SEQ ID NO: 7048 - protein, 95 aa, Homo sapiens
MYRDSHSVLALNWKVVATLKYFLLYVIILYNLERDNGHSNYENYELGDKSLNLLLFYNSMYKLVFPYIFTFSSFLISSYTSILYKMFYIQRTVKS

SEQ ID NO: 7049 - protein, 44 aa, Homo sapiens
MPHPIWCYRNSARKVHLFACLFILYILPILYSCTKDLIENLKSS

SEQ ID NO: 7050 - protein, 468 aa, Homo sapiens
MPALHTLNLDHNLIDALPPGAFAQLGQLSRLDLTSNRLATLAPDPLFSRGRDAEASPAPLVLSFSGNPLHCNCELLWLRRLARPDDLETCASPPGLAGRYFWAVPEGEFSCEPPLIARHTQRLWVLEGQRATLRCRALGDPAPTMHWVGPDDRLVGNSSRARAFPNGTLEIGATGAGDAGGYTCIATNPAGEATARVELRVLALPHGGNSSAEGGRPGPSDIAASARTAAEGEGTLESEPAVQVTEVTATSGLVSWGPGRPADPVWMFQIQYNSSEDETLIYRIVPASSHHFLLKHLVPGADYDLCLLALSPAAGPSDLTATRLLGCAHFSTLPASPLCHALQAHVLGGTLTVAVGGVLVAALLVFTVALLVRGRGAGNGRLPLKLSHVQSQTNGGPSPTPKAHPPRSPPPRPQRSCSLDLGDAGCYGYARRLGGAWARRSHSVHGGLLGAGCRGVGGSAERLEESVV

SEQ ID NO: 7051 - protein, 69 aa, Homo sapiens
MPTSILLTWHLLTWHLLGCHKTDKSFHVRLDTCQGGVSKLGHRQHPRPGHWVEETVLGRSRREGPGLFP

SEQ ID NO: 7052 - protein, 337 aa, Homo sapiens
MIWRSRAGAELFSLMALWEWIALSLHCWVLAVAAVSDQHATSPFDWLLSDKGPFHRSQEYTDFVDRSRQGFSTRYKIYREFGRWKVNNLAVERRNFLGSPLPLAPEFFRNIRLLGRRPTLQQITENLIKKYGTHFLLSATLGGEESLTIFVDKRKLSKRAEGSDSTTNSSSVTLETLHQLAASYFIDRDSTLRRLHHIQIASTAIKVTETRTGPLGCSNYDNLDSVSSVLVQSPENKIQLQGLQVLLPDYLQERFVQAALSYIACNSEGEFICKENDCWCHCGPKFPECNCPSMDIQAMEENLLRITETWKAYNSDFEESVFYTCGKMRCICSLSDL

SEQ ID NO: 7053 - protein, 43 aa, Homo sapiens [sequence omitted]

SEQ ID NO: 7054 - protein, 94 aa, Homo sapiens
  SITE (2): Xaa equals any amino acid
MXAISAHCNLYLPGSSDSPASASGVAVITGVCHHAQVIFVFLVETAFHHVVQAGLKLLTSGHPPTLGSHSAGITGVSHCTWPPFNFIFTYFYLF

SEQ ID NO: 7055 - protein, 44 aa, Homo sapiens
MVFLVFYVLRALKCNSSYHSCTNVLTQIASQIDKTLNNFSLKKC

SEQ ID NO: 7056 - protein, 41 aa, Homo sapiens
MNPCLSIIFLLTPVLLSHPLQSLHFLLKVDLDFSLSCSICT

SEQ ID NO: 7057 - protein, 69 aa, Homo sapiens
MTVYLLKTHPCFFVAYQMQVALIILLPGLRNSKTVTMPLSPALLPTLLFFPSPTPFFHPFLSVLCCFKY

SEQ ID NO: 7058 - protein, 9 aa, Homo sapiens
MLVCSFLFL

SEQ ID NO: 7059 - protein, 109 aa, Homo sapiens
MVLTGVRLMKWRDEKTFGTDCVEAVILLVTLLWEKKEAFHVGFSEELQYFPERSTEKLKVFEWEEEKQTTATSEDNTKHLVHSVYTRGAVNFLVEKELSLEKYLKKPLK

SEQ ID NO: 7060 - protein, 47 aa, Homo sapiens
MFMCRLLLWATGAYGFLGDDVEYTSVLPHQKGKEAWVFICQLPFIIG

SEQ ID NO: 7061 - protein, 56 aa, Homo sapiens
  SITE (56): Xaa equals any amino acid
MLQTLLCLWQYTSAQVLKMLCIHRQKWDNFWAVVMINLLIRIQRLPFSLPIALRVX

SEQ ID NO: 7062 - protein, 255 aa, Homo sapiens
MKVLATSFVLGSLGLAFYLPLVVTTPKTLAIPEKLQEAVGKVIINATTCTVTCGLGYKEETVCEVGPDGVRRKCQTQRLECLTNWICGMLHFTILIGKEFELSCLSSDILEFGQEAFRFTWRLARGVISTDDEVFKPFQANSHFVKFKYAQEYDSGTYRCDVQLVKNLRLVKRLYFGLRVLPPNLVNLNFHQSLTEDQKLIDEGLEVNLDSYSKPHHPKWKKKVASALGIGIAIGVVGGVLVRIVLCALRGGLQQ

SEQ ID NO: 7063 - protein, 70 aa, Homo sapiens
MISGVLIFNLIASSWVLCFPLCDLSCQKTLRIFFASFFHAVCVHVSCTSWQPLVLFIKWWVVGCSPAVSL

SEQ ID NO: 7064 - protein, 58 aa, Homo sapiens
MWQVRRGGCVLAVCSQARGTGGRLGWVGTSSLRVRMAESTSLMSQGRSPIPRMTPARP

SEQ ID NO: 7065 - protein, 65 aa, Homo sapiens
MVLSVALLHALSHLMPCKTCLASTSPSAMIVSFLRPPQPAMWNCESIKPFLFIHYPVSGSIFIAV

SEQ ID NO: 7066 - protein, 14 aa, Homo sapiens
MIYQIYGIICSLFP

SEQ ID NO: 7067 - protein, 378 aa, Homo sapiens
MSKEPLILWLMIEFWWLYLTPVTSETVVTEVLGHRVTLPCLYSSWSHNSNSMCWGKDQCPYSGCKEALIRTDGMRVTSRKSAKYRLQGTIPRGDVSLTILNPSESDSGVYCCRIEVPGWFNDVKINVRLNLQRASTTTHRTATTTTRRTTTTSPTTTRQMTTTPAALPTTVVTTPDLTTGTPLQMTTIAVFTTANTCLSLTPSTLPEEATGLLTPEPSKEGPILTAESETVLPSDSWSSAESTSADTVLLTSKESKVWDLPSTSHVSMWKTSDSVSSPQPGASDTAVPEQNKTTKTGQMDGIPMSMKNEMPISQLLMIIAPSLGFVLFALFVAFLLRGKLMETYCSQKHTRLDYIGDSKNVLNDVQHGREDEDGLFTL

SEQ ID NO: 7068 - protein, 98 aa, Homo sapiens
  SITE (17): Xaa equals any amino acid
  SITE (24): Xaa equals any amino acid
MLAFPVLLEVSWSVLFXFSFFSPXPSAPQPPTPSRSVLHARCSNVRSEMAGTREKLLVSFVSGSGMALSSLASLFVLFELCRSLFSQAELPTRSILDQ

SEQ ID NO: 7069 - protein, 67 aa, Homo sapiens
MSRNLRTALIFGGFISLIGAAFYPIYFRPLMRLEEYKKEQAINRAGIVQEDVQPPGLKVWSDPFGRK

SEQ ID NO: 7070 - protein, 74 aa, Homo sapiens [sequence omitted]

SEQ ID NO: 7071 - protein, 43 aa, Homo sapiens
  SITE (25): Xaa equals any amino acid
  SITE (29): Xaa equals any amino acid
MAFLQSASYVMVILCACVIIIGILXYAFXFETLSPKKRRDIEI

SEQ ID NO: 7072 - protein, 54 aa, Homo sapiens
MSNVVFSLKAVMWVLFYCLFVCCCILFSLLFALQNALGKGWFLSLLVCVFFFFF

SEQ ID NO: 7073 - protein, 274 aa, Homo sapiens
MSSNGIPECYAEEDEFSGLETDTAVPTEEAYVIYDEDYEFETSRPPTTTEPSTTATTPRVIPEEGAISSFPEEEFDLAGRKRFVAPYVTYLNKDPSAPCSLTDALDHFQVDSLDEIIPNDLKKSDLPPQHAPRNITVVAVEGCHSFVIVDWDKATPGDVVTGYLVYSASYEDFIRNKWSTQASSVTHLPIENLKPNTRYYFKVQAQNPHGYGPISPSVSFVTESDNPLLVVRPPGGEPIWIPFAFKHDPSYTDCHGRQYVKRTLVSKVRGSWSL

SEQ ID NO: 7074 - protein, 23 aa, Homo sapiens
  SITE (19): Xaa equals any amino acid
MAANTFVLIMGIPTSANAXRDLF

SEQ ID NO: 7075 - protein, 74 aa, Homo sapiens
MMYVQSAIMSLQHLLVLHRVIIISMHFAFGNGCTFKILVQCAIRKYTSKMISRIIQMYLTTMDLFHPMKLQRKL

SEQ ID NO: 7076 - protein, 555 aa, Homo sapiens
MAAAAWLQVLPVILLLLGAHPSPLSFFSAGPATVAAADRSKWHIPIPSGKNYFSFGKILFRNTTIFLKFDGEPCDLSLNITWYLKSADCYNEIYNFKAEEVELYLEKLKEKRGLSGKYQTSSKLFQNCSELFKTQTFSGDFMHRLPLLGEKQEAKENGTNLTFIGDKTAMHEPLQTWQDAPYIFIVHIGISSSKESSKENSLSNLFTMTVEVKGPYEYLTLEDYPLMIFFMVMCIVYVLFGVLWLAWSACYWRDLLRIQFWIGAVIFLGMLEKAVFYAEFQNIRYKGESVQGALILAELLSAVKRSLARTLVIIVSLGYGIVKPRLGVTLHKVVVAGALYLLFSGMEGVLRVTGAQTDLASLAFIPLAFLDTALCWWIFISLTQTMKLLKLRRNIVKLSLYRHFTNTLILAVAASIVFIIWTTMKFRIVTCQSDWRELWVDDAIWRLLFSMILFVIMVLWRPSANNQRFAFSPLSEEEEEDEQKEPMLKESFEGMKMRSTKQEPNGNSKVNKAQEDDLKWVEENVPSSVTDVALPALLDSDEERMITHFERSKME

SEQ ID NO: 7077 - protein, 38 aa, Homo sapiens
MLRIKSCLLLFFIFFPFNIKDSQVPANYIATFSRKCSF

SEQ ID NO: 7078 - protein, 209 aa, Homo sapiens
MEPLAAYPLKCSGPRAKVFAVLLSIVLCTVTLFLLQLKFLKPKINSFYAFEVKDAKGRTVSLEKYKGKVSLVVNVASDCQLTDRNYLGLKELHKEFGPSHFSVLAFPCNQFGESEPRPSKEVESFARKNYGVTFPIFHKIKILGSEGEPAFRFLVDSSKKEPRWNFWKYLVNPEGQVVKFWRPEEPIEVIRPDIAALVRQVIIKKKEDL

SEQ ID NO: 7079 - protein, 34 aa, Homo sapiens
MVFSARVSLYTRFKVILLSLLIMILHVCWVWVIL

SEQ ID NO: 7080 - protein, 103 aa, Homo sapiens
MSICHRGTGIALSAGVSLFGMSALLLPGNFESYLELVKSLCLGPALIHTAKFALVFPLMYHTWNGIRHLMWDLGKGLKIPQLYQSGVVVLVLTVLSSMGLAAM

SEQ ID NO: 7081 - protein, 445 aa, Homo sapiens
  SITE (147): Xaa equals any amino acid
  SITE (288): Xaa equals any amino acid
  SITE (293): Xaa equals any amino acid
  SITE (332): Xaa equals any amino acid
  SITE (443): Xaa equals any amino acid
MLWFSGVGALAERYCRRSPGITCCVLLLLNCSGVPMSLASSFLTGSVAKCENEGEVLQIPFITDNPCIMCVCLNKEVTCKREKCPVLSRDCALAIKQRGACCEQCKGCTYEGNTYNSSFKWQSPAEPCVLRQCQEGVVTESGVRCVXHCKNPLEHLGMCCPTCPGCVFEGVQYQEGEEFQPEGSKCTKCSCTGGRTQCVREVCPILSCPQHLSHIPPGQCCPKCLGQRKVFDLPFGSCLFRSDVYDNGSSFLYDNCTACTCRDSTVVCKRKCSHPGGCDQGQEGCCEXCLLRXPPEDIKVCKFGNKIFQDGEMWSSINCTICACVKGRTECXNKQCIPISSCPQGKILNRKGCCPICTEKPGVCTVFGDPHYNTFDGRTFNFQGTCQYVLTKDCSSPASPFQVLVKNDARRTRSFSWTKSVELVLGETGSACSSTSPCAGTAXAS

SEQ ID NO: 7082 - protein, 56 aa, Homo sapiens
MRLFSQMLKSWMALFMRNVWLEMTIATAHTVSTVHWRKWTKMLVQSPTQVKMNVSQ

SEQ ID NO: 7083 - protein, 257 aa, Homo sapiens
MRGPAQAKLLPGSAIQALVGLARPLVLALLLVSAALSSVVSRTDSPSPTVLNSHISTPNVNALTHENQTKPSISQISTTLPPTTSTKKSGGASVVPHPSPTPLSQEEADNNEDPSIEEEDLLMLNSSPSTAKDTLDNGDYGEPDYDWTTGPRDDDESDDTLEENRGYMEIEQSVKSFKMPSSNIEEEDSHFFFHLIIFAFCIAVVYITYHNKRKIFLLVQSRKWRDGLCSKTVEYHRLDQNVNEAMPSLKITNDYIF

SEQ ID NO: 7084 - protein, 37 aa, Homo sapiens
MKATLKLLPTIVVIYCLLCPVPRQILGVPSWAPGKCL

SEQ ID NO: 7085 - protein, 63 aa, Homo sapiens
MNHCCSSQRFLNILSFCISPPFPLTFIYLIMYLFIYLYTFAPFSTNTKQSKKKKYIYISVYVL

SEQ ID NO: 7086 - protein, 71 aa, Homo sapiens
MFLSLPTLTVLIPLVSLAGLFYSASVEENFPQGCTSTASLCFYSLLLPITIPVYVFFHLWTWMGIKLFRHN

SEQ ID NO: 7087 - protein, 317 aa, Homo sapiens
MAKNPPENCEDCHILNAEAFKSKKICKSLKICGLVFGILALTLIVLFWGSKHFWPEVPKKAYDMEHTFYSNGEKKKIYMEIDPVTRTEIFRSGNGTDETLEVHDFKNGYTGIYFVGLQKCFIKTQIKVIPEFSEPEEEIDENEEITTTFFEQSVIWVPAEKPIENRDFLKNSKILEICDNVTMYWINPTLISVSELQDFEEEGEDLHFPANEKKGIEQNEQWVVPQVKVEKTRHARQASEEELPINDYTENGIEFDPMLDERGYCCIYCRRGNRYCRRVCEPLLGYYPYPYCYQGGRVICRVIMPCNWWVARMLGRV

SEQ ID NO: 7088 - protein, 84 aa, Homo sapiens
MIMSSVTLLWSILHQADSSEKMTIAASASLTTINLGATKNLRQQILELLGPISMNHGVHFMAAIAFVWNERRQNKTTTRTKVCI

SEQ ID NO: 7089 - protein, 84 aa, Homo sapiens
MGTFSLMLLLLPSVVCFSFKVRPLFCRAAVVCSGSTSDPIHLGPSHTWRCHQWRLQNSKDGCLLLPPGSPSQRETDLMLAGMLL

SEQ ID NO: 7090 - protein, 66 aa, Homo sapiens [sequence omitted]

SEQ ID NO: 7091 - protein, 275 aa, Homo sapiens [sequence omitted]

SEQ ID NO: 7092 - protein, 54 aa, Homo sapiens
MVGLPAVVQLFWGLCLCTCGAVSCPTELAVQWRIQSDIWCSLRKNVAPEACQWL

SEQ ID NO: 7093 - protein, 353 aa, Homo sapiens [sequence omitted]

SEQ ID NO: 7094 - protein, 265 aa, Homo sapiens
KYDSKWIKEPHFLHAIEYGNYVYFFFREIAVEHNNLGKAVYSRVARICKNDMGGSQRVLEKHWTSFLKARLNCSVPGDSFFYFDVLQSITDIIQISGIPTVVGVFTTQLNSIPGSAVCAFSMDDIEKVFKGRFKEQKTPDSVWTAVPEDKVPKPRPGCCAKHGLAEAYKTSIDFPDETLSFIKSHPLMDSAVPPIADEPWFTKTRVRYRLTAISVDHSAGPYQNYTVIFVGSEAGMVLKVLAKTSPFSLNDSVLLEEIEAYNHAK

SEQ ID NO: 7095 - protein, 81 aa, Homo sapiens
MILGIHWGIFLLLLLSWLELQRTVIFFFSPFPIQKHYTLGHFSFSQRRFMDSQTELCATGKVKREKAADEVTWLHVLHHAE

SEQ ID NO: 7096 - protein, 58 aa, Homo sapiens [sequence omitted]

SEQ ID NO: 7097 - protein, 86 aa, Homo sapiens
  SITE (75): Xaa equals any amino acid
MSLGGSQSSLVSWRATQIACMTLSWPLWTCWLAAPLSLTKSPWRQWSTHVKGFNLASSQAEVQPVGQTLASEKKXLQEVLARAIQH

SEQ ID NO: 7098 - protein, 370 aa, Homo sapiens
MHRLIFVYTLICANFCSCRDTSATPQSASIKALRNANLRRDESNHLTDLYRRDETIQVKGNGYVQSPRFPNSYPRNLLLTWRLHSQENTRIQLVFDNQFGLEEAENDICRYDFVEVEDISETSTIIRGRWCGHKEVPPRIKSRTNQIKITFKSDDYFVAKPGFKIYYSLLEDFQPAAASETNWESVTSSISGVSYNSPSVTDPTLIADALDKKIAEFDTVEDLLKYFNPESWQEDLENMYLDTPRYRGRSYHDRKSKVDLDRLNDDAKRYSCTPRNYSVNIREELKLANVVFFPRCLLVQRCGGNCGCGTVNWRSCTCNSGKTVKKYHEVLQFEPGHIKRRGRAKTMALVDIQLDHHERCDCICSSRPPR

SEQ ID NO: 7099 - protein, 38 aa, Homo sapiens
MSWRVWALLFFPAVCVCVCVCVCACTRTRVCDETIKLV

SEQ ID NO: 7100 - protein, 37 aa, Homo sapiens
MVESPVCGLLEGWFFLLFSLAFLSTHLFSEASPLSIL

SEQ ID NO: 7101 - protein, 35 aa, Homo sapiens
MKERTRIPCAFPFLLFQTRVQTSPAFQPHPLYFTA

SEQ ID NO: 7102 - protein, 40 aa, Homo sapiens
MTTPGLLILFLAHVCLVNHQQAAEPGWKQHCCNWEGHRVL

SEQ ID NO: 7103 - protein, 704 aa, Homo sapiens
MWYRLRLLKPQPNIIPTVKKIVLLAGWALFLFLAYKVSKTDREYQEYNPYEVLNLDPGATVAEIKKQYRLLSLKYHPDKGGDEVMFMRIAKAYAALTDEESRKNWEEFGNPDGPQATSFGIALPAWIVDQKNSILVLLVYGLAFMVILPVVVGSWWYRSIRYSGDQILIRTTQIYTYFVYKTRNMDMKRLIMVLAGASEFDPQYNKDATSRPTDNILIPQLIREIGSINLKKNEPPLTCPYSLKARVLLLSHLARMKIPETLEEDQQFMLKKCPALLQEMVNVICQLIVMARNREEREFRAPTLASLENCMKLSQMAVQGLQQFKSPLLQLPHIEEDNLRRVSNHKKYKIKTIQDLVSLKESDRHTLLHFLEDEKYEEVMAVLGSFPYVTMDIKSQVLDDEDSNNITVGSLVTVLVKLTRQTMAEVFEKEQSICAAEEQPAEDGQGETNKNRTKGGWQQKSKGPKKTAKSKKKKPLKKKPTPVLLPQSKQQKQKQANGVVGNEAAVKEDEEEVSDKGSDSEEEETNRDSQSEKDDGSDRDSDREQDEKQNKDDEAEWQELQQSIQRKERALLETKSKITHPVYSLYFPEEKQEWWWLYIADRKEQTLISMPYHVCTLKDTEEVELKFPAPGKPGNYQYTVFLRSDSYMGLDQIKPLKLEVHEAKPVPENHPQWDTAIEGDEDQEDSEGFEDSFEEEEEEEEDDD

SEQ ID NO: 7104 - protein, 23 aa, Homo sapiens
MFLFLFFLLIIASYISSFSFGQS

SEQ ID NO: 7105 - protein, 59 aa, Homo sapiens
MVVVSTNGFLLLLLFLNRKSGLCSYRKAVHRLSSCPSRHQAGPRIKCDFKWGKLCYSCA

SEQ ID NO: 7106 - protein, 48 aa, Homo sapiens
  SITE (43): Xaa equals any amino acid
MHATCTRTWRAQVSLHQPPCSRDWKICHLLVVLSLPPPTPARXPEFLN

SEQ ID NO: 7107 - protein, 14 aa, Homo sapiens
MSESACILNNQKEL

SEQ ID NO: 7108 - protein, 34 aa, Homo sapiens
MGWGKEVVSLIVLLVNLFLCPWALGLCLLSVSSL

SEQ ID NO: 7109 - protein, 87 aa, Homo sapiens
  SITE (86): Xaa equals any amino acid
MLLLYLGIEVIRLFFGTKGNLCQRKMPLSISVALTFPSAMMASYYLLLQTYVLRLEAIMNGILLFFCGSELLLEVLTLAAFSSMDXI

SEQ ID NO: 7110 - protein, 38 aa, Homo sapiens
  SITE (16): Xaa equals any amino acid
MSTVKQIVMGLYFVYXYVCFFYSTFCGSSVLLVASSLL

SEQ ID NO: 7111 - protein, 52 aa, Homo sapiens
MCLFFENVTLLFVIVLHFSAFRPLYFHKTPKTAFNYIIMSVFLDTNFCSRMT

SEQ ID NO: 7112 - protein, 192 aa, Homo sapiens
MIRNDQDSLMQLLQLGLVVLGSQESQESDLSKQLISVIIGLGVALLLVLVIMTMAFVCVRKSYNRKLQAMKAAKEARKTAAGVMPSAPAIPGTNMYNTERANPMLNLPNKDLGLEYLSPSNDLDSVSVNSLDDNSVDVDKNSQEIKEHRPPHTPPEPDPEPLSVVLLGRQAGASGQLEGPSYTNAGLDTTDL

SEQ ID NO: 7113 - protein, 43 aa, Homo sapiens
MDLDRVKAEATEDITSGVLCLLFLRLPPNSCIFPSAVLGSTRT

SEQ ID NO: 7114 - protein, 38 aa, Homo sapiens
MYKFLYLVLEDFVAFIRGSFPPQHTRSLVFWHVCQLEY

SEQ ID NO: 7115 - protein, 53 aa, Homo sapiens
MNLLHCLYMINIIIYIFCIKLIWLHLSCILSHISFISSMDMSRSLYWSPVCAV

SEQ ID NO: 7116 - protein, 289 aa, Homo sapiens
MAALAYNLGKREINHYFSVRSAKVLALVAVLLLAACHLASRRYRGNDSCEYLLSSGRFLGEKVWQPHSCMMHKYKISEAKNCLVDKHIAFIGDSRIRQLFYSFVKIINPQFKEEGNKHENIPFEDKTASVKVDFLWHPEVNGSMKQCIKVWTEDSIAKPHVIVAGAATWSIKIHNGSSEALSQYKMNITSIAPLLEKLAKTSDVYWVLQDPVYEDLLSENRKMITNEKIDAYNEAAVSILNSSTRNSKSNVKMFSVSKLIAQETIMESLDGLHLPESSRETVRNFYICQ

SEQ ID NO: 7117 - protein, 167 aa, Homo sapiens
MAASVCSGLLGPRVLSWSRELPCAWRALHTSPVCAKNRAARVRVSKGDKPVTYEEAHAPHYIAHRKGWLSLHTGNLDGEDHAAERTVEDVFLRKFMWGTFPGCLADQLVLKRRGNQLEICAVVLRQLSPHKYYFLVGYSETLLSYFYKCPVRLHLQTVPSKVVYKYL

SEQ ID NO: 7118 - protein, 305 aa, Homo sapiens [sequence omitted]

SEQ ID NO: 7119 - protein, 870 aa, Homo sapiens
MGPPSLVLCLLSATVFSLLGGSSAFLSHHRLKGRFQRDRRNIRPNIILVLTDDQDVELGSMQVMNKTRRIMEQGGAHFINAFVTTPMCCPSRSSILTGKYVHNHNTYTNNENCSSPSWQAQHESRTFAVYLNSTGYRTAFFGKYLNEYNGSYVPPGWKEWVGLLKNSRFYNYTLCRNGVKEKHGSDYSKDYLTDLITNDSVSFFRTSKKMYPHRPVLMVISHAAPHGPEDSAPQYSRLFPNASQHITPSYNYAPNPDKHWIMRYTGPMKPIHMEFTNMLQRKRLQTLMSVDDSMETIYNMLVETGELDNTYIVYTADHGYHIGQFGLVKGKSMPYEFDIRVPFYVRGPNVEAGCLNPHIVLNIDLAPTILDIAGLDIPADMDGKSILKLLDTERPVNRFHLKKKMRVWRDSFLVERGKLLHKRDNDKVDAQEENFLPKYQRVKDLCQRAEYQTACEQLGQKWQCVEDATGKLKLHKCKGPMRLGGSRALSNLVPKYYGQGSEACTCDSGDYKLSLAGRRKKLFKKKYKASYVRSRSIRSVAIEVDGRVYHVGLGDAAQPRNLTKRHWPGAPEDQDDKDGGDFSGTGGLPDYSAANPIKVTHRCYILENDTVQCDLDLYKSLQAWKDHKLHIDHEIETLQNKIKNLREVRGHLKKKRPEECDCHKISYHTQHKGRLKHRGSSLHPFRKGLQEKDKVWLLREQKRKKKLRKLLKRLQNNDTCSMPGLTCFTHDNQHWQTAPFWTLGPFCACTSANNNTYWCMRTINETHNFLFCEFATGFLEYFDLNTDPYQLMNAVNTLDRDVLNQLHVQLMELRSCKGYKQCNPRTRNMDLGLKDGGSYEQYRQFQRRKWPEMKRPSSKSLGQLWEGWEG

SEQ ID NO: 7120 - protein, 228 aa, Homo sapiens
  SITE (207): Xaa equals any amino acid
  SITE (217): Xaa equals any amino acid
  SITE (218): Xaa equals any amino acid
MNILCTCLLCVLQHQSASASYALGNTPRHRQSLPRPSGQTSVTTSCCNLLTELRHPSSADFGHQSSRFSLLELRHPSAAACGHQNSRFSLLELRRPSSDAFGHQSSRLSLLDLRHTSAAAFGHQNSRFSLVELRHPSSDAFGHQNSRFCFLDLRHPSAAAFGHQNSRFSHVEPRHPSSAAFGHQNSRFSGLCTLGCVAATPAPGFQXFGLRLQATPXXSLVLRLLDLD

SEQ ID NO: 7121 - protein, 38 aa, Homo sapiens
MLRWRLLATALIALCRRSASSVASGEPPDSPPCPWRRR

SEQ ID NO: 7122 - protein, 737 aa, Homo sapiens
MEVRKLSISWQFLIVLVLILQILSALDFDPYRVLGVSRTASQADIKKAYKKLAREWHPDKNKDPGAEDKFIQISKAYEILSNEEKRSNYDQYGDAGENQGYQKQQQQREYRFRHFHENFYFDESFFHFPFNSERRDSIDEKYLLHFSHYVNEVVPDSFKKPYLIKITSDWCFSCIHIEPVWKEVIQELEELGVGIGVVHAGYERRLAHHLGAHSTPSILGIINGKISFFHNAVVRENLRQFVESLLPGNLVEKVTNKNYVRFLSGWQQENKPHVLLFDQTPIVPLLYKLTAFAYKDYLSFGYVYVGLRGTEEMTRRYNINIYAPTLLVFKEHINRPADVIQARGMKKQIIDDFITRNKYLLAARLTSQKLFHELCPVKRSHRQRKYCVVLLTAETTKLSKPFEAFLSFALANTQDTVRFVHVYSNRQQEFADTLLPDSEAFQGKSAVSILERRNTAGRVVYKTLEDPWIGSESDKFILLGYLDQLRKDPALLSSEAVLPDLTDELAPVFLLRWFYSASDYISDCWDSIFHNNWREMMPLLSLIFSALFILFGTVIVQAFSDSNDERESSPPEKEEAQEKTGKTEPSFTKENSSKIPKKGFVEVTELTDVTYTSNLVRLRPGHMNVVLILSNSTKTSLLQKFALEVYTFTGSSCLHFSFLSLDKHREWLEYLLEFAQDAAPIPNQYDKHFMERDYTGYVLALNGHKKYFCLFKPQKTVEEEEAIGSCSDVDSSLYLGE

SEQ ID NO: 7123 - protein, 42 aa, Homo sapiens
MNSSFFISLPALIWSVCLILGWWQVSSGKVAHCGFIFCFPNN

SEQ ID NO: 7124 - protein, 422 aa, Homo sapiens
  SITE (9): Xaa equals any amino acid
  SITE (19): Xaa equals any amino acid
  SITE (37): Xaa equals any amino acid
  SITE (277): Xaa equals any amino acid
  SITE (278): Xaa equals any amino acid
MIYKMDCLXRVENFLEPLXNWNEAWREYDKLEYDVTXTRNQMQEQLDHLGEVQTESAGIQRAQIQKELWRIQDVMEGLSKHKQQRGTTEIGMIGSKPFSTVKYKNEGPDYRLYKSEPELTTVAEVDESNGEEKSEPVSEIETSVVKGSHFPVGVVPPRAKSPTPESSTIASYVTLRKTKKMMDLRTERPRSAVEQLCLAESTRPRMTVEEQMERIRRHQQACLREKKKGLNVIGASDQSPLQSPSNLRDNPFRTTQTRRRDDKELDTAIRENDVKPXXETPATEIVQLKETEPQNVDFSKELKKTENISYEMLFEPEPNGVNSVEMMDKERNKDKMPEDVTFSPQDETQTANHKPEEHPEENTKNSVDEQEETVISYESTPEVSRGNQTMAVKSLSPSPESSASPVPSTQPQLTEGSHFMCV

SEQ ID NO: 7125 - protein, 71 aa, Homo sapiens
MENPTSTPTLPCFLFFFSPRSLDVLTPPHCLSSLGQAGTFEEDKAFLDYPSYSVSLFLTQRGRQNQSGLFQ

SEQ ID NO: 7126 - protein, 67 aa, Homo sapiens
MLFSLPRTFSSHSSPAQLIFIHAASVLMAFPPRPSKTTLPQAAFLTSLACPLMLSTFFLYQNAFVCK

SEQ ID NO: 7127 - protein, 48 aa, Homo sapiens
MLPYSLPFHISCTSSLSHHLHPHLLSLLLSFSPKGVTADVKISLMMAK

SEQ ID NO: 7128 - protein, 56 aa, Homo sapiens
MMIYFALLLASLFFLLKVKSHFGCKNVTTTSARIFLKPLCTPKSIFPLSRYGRMSS

SEQ ID NO: 7129 - protein, 53 aa, Homo sapiens
MVLLLLLQRNPGTPLFCLVFWAGLRKPAQFRPILGPSCPCAASVKRGVDIPSS

SEQ ID NO: 7130 - protein, 137 aa, Homo sapiens
MMVVGTGTSLALSSLLSLLLFAGMQMYSRQLASTEWLTIQGGLLGSGLFVFSLTAFNNLENLVFGKGFQAKIFPEILLCLLLALFASGLIHRVCVTTCFIFSMVGLYYINKISSTLYQAAAPVLTPAKVTGKSKKRN

SEQ ID NO: 7131 - protein, 431 aa, Homo sapiens
MKNPILERLAEQIATLCATLKEYPAVRYRGEYKDNALLAQLIQDKLDAYKADDPTMGEGPDKARSQLLILDRGFDPSSPVLHELTFQAMSYDLLPIENDVYKYETSGIGEARVKEVLLDEDDDLWIALRHKHIAEVSQEVTRSLKDFSSSKRMNTGEKTTMRDLSQMLKKMPQYQKELSKYSTHLHLAEDCMKHYQGTVDKLCRVEQDLAMGTDAEGEKIKDPMRAIVPILLDANVSTYDKIRIILLYIFLKNGITEENLNKLIQHAQIPPEDSEIITNMAHLGVPIVTDSTLRRRSKPERKERISEQTYQLSRWTPIIKDIMEDTIEDKLDTKHYPYISTRSSASFSTTAVSARYGHWHKNKAPGEYRSGPRLIIFILGGVSLNEMRCAYEVTQANGKWEVLIGSTHILTPQKLLDTLKKLNKTDEEISS

SEQ ID NO: 7132 - protein, 55 aa, Homo sapiens
MIYFALLLASLFFLLKVKSHFGCKNVTTTSARIFLKPLCTPKSIFPLSRYGRMSS

SEQ ID NO: 7133 - protein, 43 aa, Homo sapiens
MAIHFHIIQWLLLCYNCHHAQWGLWHTTAEVSGCGRNHLAFKA

SEQ ID NO: 7134 - protein, 38 aa, Homo sapiens
MMNILLLKYILEILILSENLNLFNITYGKYNLFFLYRY

SEQ ID NO: 7135 - protein, 25 aa, Homo sapiens
MFVLLLSHDFFFLCQTYKLNLVVMF

SEQ ID NO: 7136 - protein, 48 aa, Homo sapiens
MTKASSLWPLKTTCQISGTVFFFLFLFSCFLMQAQCDKFVGWDFFFFL

SEQ ID NO: 7137 - protein, 318 aa, Homo sapiens
MRLLAGWLCLSLASVWLARRMWTLRSPLTRSLYVNMTSGPGGPAAAAGGRKENHQWYVCNREKLCESLQAVFVQSYLDQGTQIFLNNSIEKSGWLFIQLYHSFVSSVFSLFMSRTSINGLLGRGSMFVFSPDQFQRLLKINPDWKTHRLLDLGAGDGEVTKIMSPHFEEIYATELSETMIWQLQKKKYRVLGINEWQNTGFQYDVISCLNLLDRCDQPLTLLKDIRSVLEPTRGRVILALVLPFHPYVENVGGKWEKPSEILEIKGQNWEEQVNSLPEVFRKAGFVIEAFTRLPYLCEGDMYNAYYVLDDAVFVLKPV

SEQ ID NO: 7138 - protein, 155 aa, Homo sapiens
  SITE (92): Xaa equals any amino acid
  SITE (105): Xaa equals any amino acid
  SITE (125): Xaa equals any amino acid
  SITE (130): Xaa equals any amino acid
MQHQLHLLICWGKGSKSNTSCLGPVLSCSNMWSLALLVVAGSMGVAYSSVVMYVLLWVPLPLPSHFLPSGAPEAQPTTWAQSPHSVCKCGTXLGPAKPQGPSLPXPPCLIMLLSCRRQLGLAPSXWLPGXGSHGGELRGCSQGWAPGIAHLNICT

SEQ ID NO: 7139 - protein, 37 aa, Homo sapiens
MRGAHLTALEMLTAFASHIRARDAAGSGDKPGADTGR

SEQ ID NO: 7140 - protein, 180 aa, Homo sapiens
MWTLFALSGPLFLFQVLTFMIYIVSTVFCGHLGKVELASVTLAVAFVNVCGVSVGVGLSSACDTLMSQSFGSPNKKHVGVILQRGALVLLLCCLPCWALFLNTQHILLLFRQDPDVSRLTQDYVMIFIPGLPVIFLYNLLAKYLQNQVQVFECVGRPFSQHTALFQWEGGLGLSPSLHHL

SEQ ID NO: 7141 - protein, 160 aa, Homo sapiens
MRLLCGLWLWLSLLKVLQAQTPTPLPLPPPMQSFQGNQFQGEWFVLGLAGNSFRPEHRALLNAFTATFELSDDGRFEVWNAMTRGQHCDTWSYVLIPAAQPGQFTVDHGVGRSWLLPPGTLDQFICLGRAQGLSDDNIVFPDVTGGALDLSSLPWVAAPA

SEQ ID NO: 7142 - protein, 110 aa, Homo sapiens
MRWPCPTSKPAPPPVLWSHLCQHRWGLTPASTLLCWLLLFNLGTCLSFSHLKQNNNNSNTSKISFDPASLCWVIISLSFPPFPSKHLKRVVYTQHSPFPHYPLTPQPAAI

SEQ ID NO: 7143 - protein, 159 aa, Homo sapiens [sequence omitted]

SEQ ID NO: 7144 - protein, 28 aa, Homo sapiens
MLFKLFFSLILFSFVVSCIFSVSINIPL

SEQ ID NO: 7145 - protein, 587 aa, Homo sapiens
MRPRGLPPLLVVLLGCWASVSAQTDATPAVTTEGLNSTEAALATFGTFPSTRPPGTPRAPGPSSGPRPTPVTDVAVLCVCDLSPAQCDINCCCDPDCSSVDFSVFSACSVPVVTGDSQFCSQKAVIYSLNFTANPPQRVFELVDQINPSIFCIHITNYKPALSFINPEVPDENNFDTLMKTSDGFTLNAESYVSFTTKLDIPTAAKYEYGVPLQTSDSFLRFPSSLTSSLCTDNNPAAFLVNQAVKCTRKINLEQCEEIEALSMAFYSSPEILRVPDSRKKVPITVQSIVIQSLNKTLTRREDTDVLQPTLVNAGHFSLCVNVVLEVKYSLTYTDAGEVTKADLSFVLGTVSSVVVPLQQKFEIHFLQENTQPVPLSGNPGYVVGLPLAAGFQPHKGSGIIQTTNRYGQLTILHSTTEQDCLALEGVRTPVLFGYTMQSGCKLRLTGALPCQLVAQKVKSLLWGQGFPDYVAPFGNSQAQDMLDWVPIHFITQSFNRKDSCQLPGALVIEVKWTKYGSLLNPQAKIVNVTANLISSSFPEANSGNERTILISTAVTFVDVSAPAEAGFRAPPAINARLPFNFFFPFV

SEQ ID NO: 7146 - protein, 347 aa, Homo sapiens
MVTRAGAGTAVAGAVVVALLSAALALYGPPLDAVLERAFSLRKAHSIKDMENTLQLVRNIIPPLSSTKHKGQDGRIGVVGGCQEYTGAPYFAAISALKVGADLSHVFCASAAAPVIKAYSPELIVHPVLDSPNAVHEVEKWLPRLHALVVGPGLGRDDALLRNVQGILEVSKARDIPVVIDADGLWLVAQQPALIHGYRKAVLTPNHVEFSRLYDAVLRGPMDSDDSHGSVLRLSQALGNVTVVQKGERDILSNGQQVLVCSQEGSSRRCGGQGDLLSGSLGVLVHWALLAGPQKTNGSSPLLVAAFGACSLTRQCNHQAFQKHGRSTTTSDMIAEVGAAFSKLFET

SEQ ID NO: 7147 - protein, 347 aa, Homo sapiens; identical to SEQ ID NO: 7146

SEQ ID NO: 7148 - protein, 340 aa, Homo sapiens
  SITE (221): Xaa equals any amino acid
  SITE (224): Xaa equals any amino acid
MTSQLRWSWSSPTCTHASRYWLWYTTKNCVGGLARKAWERLRLHRVNLIALQRRRDPEQVLLQCLPRNKVDATLRRLLERYRGPEPSDTVEMFEGEEFFAAFERGIDVDADRPDCVEGRICFVFYSHLKNVKEVYVTTTLDREAQAVRGQVSFYRGAVPVRVPEEAEAARQRKGADALWMATLPIKLPRLRGSEGPRRGAGLSLAPLNLGDAETGFLTQSXLLXVAGRLGLDWPAVALHLGVSYREVQRIRHEFRDDLDEQIRHMLFSWAERQAGQPGAVGLLVQALEQSDRQDVAEEVRAVLELGRRKYQDSIRRMGLAPKDPALPGSSAPQPPEPAQA

SEQ ID NO: 7149 - protein, 156 aa, Homo sapiens
  SITE (92): Xaa equals any amino acid
  SITE (114): Xaa equals any amino acid
  SITE (122): Xaa equals any amino acid
  SITE (134): Xaa equals any amino acid
MLQGHSSVFQALLGTFFTWGMTAAGAALVFVFSSGQRRILDGSLGFAAGVMLAASYWSLLAPAVEMATSSGGFGAFAFFPVAVGFTLGAAFXYLADLLMPHLGAAEDPQTALAXNFGSTLMXKKSDPEGPALLXPESELFIRIGRLASFSSSLLQH

SEQ ID NO: 7150 - protein, 60 aa, Homo sapiens
  SITE (51): Xaa equals any amino acid
MLLESWMGIWGERGRTGQVSPSPFCSCLLVSALLELHLPLGFSAPAHFPSXFTCFVSFPC

SEQ ID NO: 7151 - protein, 52 aa, Homo sapiens
MPAVSAFFSLAALAEVAAMENVHRGQRSTPLTHDGQPKEMPQLPVLISCADQ

SEQ ID NO: 7152 - protein, 35 aa, Homo sapiens
MPFMFLSLPRDTFLMLELVLGTFTCNGSFFIHKAS

SEQ ID NO: 7153 - protein, 60 aa, Homo sapiens [sequence omitted]

SEQ ID NO: 7154 - protein, 216 aa, Homo sapiens
MFLRLYLIARVMLLHSKLFTDASSRSIGALNKINFNTRFVMKTLMTICPGTVLLVFSISLWIIAAWTVRVCESPESPAQPSGSSLPAWYHDQQDVTSNFLGAMWLISITFLSIGYGDMVPHTYCGKGVCLLTGIMGAGCTALVVAVVARKLELTKAEKHVHNFMMDTQLTKRIKNAAANVLRETWLIYKHTKLLKKIDHAKVRKHQRKFLPSYPPV

SEQ ID NO: 7155 - protein, 324 aa, Homo sapiens
  SITE (3): Xaa equals any amino acid
MEXAKVYVAKVDCTAHSDVCSAQGVRGYPTLKLFKPGQEAVKYQGPRDFQTLENWMLQTLNEEPVTPEPEVEPPSAPELKQGLYELSASNFELHVAQGDHFIKFFAPWCGHCKALAPTWEQLALGLEHSETVKIGKVDCTQHYELCSGNQVRGYPTLLWFRDGKKVDQYKGKRDLESLREYVESQLQRTETGATETVTPSEAPVLAAEPEADKGTVLALTENNFDDTIAEGITFIKFYAPWCGHCKTLAPTWEELSKKEFPGLAGVKIAEVDCTAERNICSKYSVRGYPTLLLFRGGKKVSEHSGGRDLDSLHRFVLSQAKDEL

SEQ ID NO: 7156 - protein, 13 aa, Homo sapiens
VIELCVSLRSLNF

SEQ ID NO: 7157 - protein, 112 aa, Homo sapiens
MRECQEESFWKRALPFSLVSMLVTQGLVYQGYLAANSRFGSLPKVALAGLLGFGLGKVSYIGVCQSKFHFFEDQLRGAGFGPQHNRHCLLTCEECKIKHGLSEKGDSQPSAS

SEQ ID NO: 7158 - protein, 34 aa, Homo sapiens
  SITE (8): Xaa equals any amino acid
MPYNIGYXTFYFILFYFILFYLETRSCSVTQARG

SEQ ID NO: 7159 - protein, 36 aa, Homo sapiens
  SITE (8): Xaa equals any amino acid
  SITE (19): Xaa equals any amino acid
  SITE (28): Xaa equals any amino acid
MNPFSVFXSLCLKQFEDVXLFLGLMFGXSLNGQEGT

SEQ ID NO: 7160 - protein, 317 aa, Homo sapiens [sequence omitted]

SEQ ID NO: 7161 - protein, 33 aa, Homo sapiens
MFIFLFLCVLSRKIQEEYYRLFKNVPCCFGCLR

SEQ ID NO: 7162 - protein, 22 aa, Homo sapiens
MVIFIILLTCFGFSNGSFSFSL

SEQ ID NO: 7163 - protein, 91 aa, Homo sapiens
  SITE (79): Xaa equals any amino acid
MQCIRWTVLFLFILWVLVFVFFFAFTVRLQMIVLITYIINKCGPIIYTEITLGYFCIILSYCLHSINFSRDNCLCVTGXKCRITSFIIWKN

SEQ ID NO: 7164 - protein, 413 aa, Homo sapiens
MLKALFLTMLTLALVKSQDTEETITYTQCTDGYEWDPVRQQCKDIDECDIVPDACKGGMKCVNHYGGYLCLPKTAQIIVNNEQPQQETQPAEGTSGATTGVVAASSMATSGVLPGGGFVASAAAVAGPEMQTGRNNFVIRRNPADPQRIPSNPSHRIQCAAGYEQSEHNVCQDIDECTAGTHNCRADQVCINLRGSFACQCPPGYQKRGEQCVDIDECRTSSYLCQYQCVNEPGKFSCMCPQGYQVVRSRTCQDINECETTNECREDEMCWNYHGGFRCYPRNPCQDPYILTPENRCVCPVSNAMCRELPQSIVYKYMSIRSDRSVPSDIFQIQATTIYANTINTFRIKSGNENGEFYLRQTSPVSAMLVLVKSLSGPREHIVDLEMLTVSSIGTFRTSSVLRLTIIVGPFSF

SEQ ID NO: 7165 - protein, 310 aa, Homo sapiens
  SITE (142): Xaa equals any amino acid
MLLWLLGWLECVHNSRRSQGLPPHYDDVEVFILQLEGEKHWRLYHPTVPLAREYSVEAEERIGRPVHEFMLKPGDLLYFPRGTIHQADTPAGLAHSTHVTISTYQNNSWGDFLLDTISGLVFDTAKEDVELRTGIPRQLLLXVESTTVATRRLSGFLRTLADRLEGTKELLSSDMKKDFIMHRLPPYSAGDGAELSTPGGKLPRLDSVVRLQFKDHIVLTVLPDQDQSDEAQEKMVYIYHSLKNSRETHMMGNEEETEFHGLRFPLSHLDALKQIWNSPAISVKDLKLTTDEEKESLVLSLWTECLIQVV

SEQ ID NO: 7166 - protein, 599 aa, Homo sapiens
MHPIPSSFMIKAVSSFLTAEEASVGNPEGAFMKVLQARKNYTSTELIVEPEEPSDSSGINLSGFGSEQLDTNDESDVISTLSYILPYFSAVNLDVKSLLLPFIKLPTTGNSLAKIQTVGKNRQRLNRVLMGPRSIQKRHFKEVGRQSIRREQGAQASVENAAEEKRLGSPAPRELEQPHTQQGPEKLAGNAVYTKPSFTQEHKAAVSVLKPFSKGAPSTSSPAKALPQVRDRWKDLTHAISILESAKARVTNTKTSKPIVHARKKYRFHKTRSHVTHRTPKVKKSPKVRKKSYLSRLMLANRLPFSAAKSLINSPSQGAFSSLGDLSPQENPFLEVSAPSEHFIEKNNTKHTTARNAFEENDFMENTNMPEGTISENTNYNHPPEADSAGTAFNLGPTVKQTETKWEYNNVGTDLSPEPKSFNYPLLSSPGDQFEIQLTQQLQSLIPNNNVRRLIAHVIRTLKMDCSGAHVQVTCAKLISRTGHLMKLLSGQQEVKASKIEWDTDQWKTENYINESTEAQSEQKEKSLELTKEVPGYGYTDKLILALIVTEILMILIILFCLIVVRTIINSGCQNAVLFLCGFRAHKLKTKATFPPAAT

SEQ ID NO: 7167 - protein, 599 aa, Homo sapiens; identical to SEQ ID NO: 7166

SEQ ID NO: 7168 - protein, 136 aa, Homo sapiens
MRTPGPLPVLLLLLAGAPAARPTPPTCYSRMRALSQEITRDFNLLQVSEPSEPCVRYLPRLYLDIHNYCVLDKLRDFVASPPCWKVAQVDSLKDKARKLYTIMNSFCRRDLVFLLDDCNALEYPIPVTTVLPDRQR

SEQ ID NO: 7169 - protein, 129 aa, Homo sapiens; identical to SEQ ID NO: 5827

SEQ ID NO: 7170 - protein, 181 aa, Homo sapiens
  SITE (153): Xaa equals any amino acid
  SITE (171): Xaa equals any amino acid
MSPSGRLCLLTIVGLILPTRGQTLKDTTSSSSADATIMDIQVPTRAPDAVYTELQPTSPTPTWPADETPQPQTQTQQLEGTDGPLVTYPETHKSTKAAHPTDDTTTLSERPSPSTDVQTDPQTLKPSGFHEDDPFFYDEHTLRKRGLLVAAVXVHHRAYYSSPVGKCRAAXPGYCRNSFAG

SEQ ID NO: 7171 - protein, 40 aa, Homo sapiens
MFKCLQTTFLFILDFTWESKVQFHKASVYLSLSIYIDCHA

SEQ ID NO: 7172 - protein, 257 aa, Homo sapiens
MLLTLAGGALFFPGLFALCTWALRRSQPGWSRTDCVMISTRLVSSVHAVLATGSGIVIIRSCDDVITGRHWLAREYVWFLIPYMIYDSYAMYLCEWCRTRDQNRAPSLTLRNFLSRNRLMITHHAVILFVLVPVAQRLRGDLGDFFVGCIFTAELSTPFVSLGRVLIQLKQQHTLLYKVNGILTLATFLSCRILLFPFMYWSYGRQQGLSLLQVPFSIPFYCNVANAFLVAPQIYWFCLLCRKAVRLFDTPQAKKDG

SEQ ID NO: 7173 - protein, 205 aa, Homo sapiens
MGTAGAMQLCWVILGFLLFRGHNSQPTMTQTSSSQGGLGGLSLTTEPVSSNPGYIPSSEANRPSHLSSTGTPGAGVPSSGRDGGTSRDTFQTVPPNSTTMSLSMREDATILPSPTSETVLTVAAFGVISFIVILVVVVIILVGVVSLRFKCRKSKESEDPQKPGSSGLSESCSTANGEKDSITLISMKNINMNNGKQSLSAEKVL

SEQ ID NO: 7174 - protein, 264 aa, Homo sapiens
MRPLLGLLLVFAGCTFALYLLSTRLPRGRRLGSTEEAGGRSLWFPSDLAELRELSEVLREYRKEHQAYVFLLFCGAYLYKQGFAIPGSSFLNVLAGALFGPWLGLLLCCVLTSVGATCCYLLSSIFGKQLVVSYFPDKVALLQRKVEENRNSLFFFLLFLRLFPMTPNWFLNLSAPILNIPIVQFFFSVLIGLIPYNFICVQTGSILSTLTSLDALFSWDTVFKLLAIAMVALIPGTLIKKFSQKHLQLNETSTANHIHSRKDT

SEQ ID NO: 7175 - protein, 62 aa, Homo sapiens
MYFYLAVKPPLLWARPQVSCRLSVSLAWSYHLHLWALFLFSILLQCRARFLLLLVLSQTQDL

SEQ ID NO: 7176 - protein, 181 aa, Homo sapiens
MAALCRTRAVAAESHFLRVFLFFRPFRGVGTESGSESGSSNAKEPKTRAGGFASALERHSELLQKGSPKNVESFASMLRHSPLTQMGPAKDKLVIGRIFHIVENDLYIDFGGKFHCVCRRPEVDGEKYQKGTRVRLRLLDLELTSRFLGATTDTTVLEANAVLLGIQESKDSRSKEEHHEK

SEQ ID NO: 7177 - protein, 52 aa, Homo sapiens
MGTEASPKRYFFVVVVVLGIIVPILRAFPPPVPTHPNKMWWCCLQKREVLCH

SEQ ID NO: 7178 - protein, 87 aa, Homo sapiens
MVASGWLLLAQASFLPLAPPGALGAGCWMDGRPLAPPGALGAGCWMGGRPLAPPGALGAGCWMGGRHGAPLLGCLCPSGLCSSYVCL

SEQ ID NO: 7179 - protein, 44 aa, Homo sapiens
  SITE (18): Xaa equals any amino acid
  SITE (25): Xaa equals any amino acid
MSPSPRWGFLCVLFTAVXPAPSTAXVQDKCPVNTWEAMQACVHG

SEQ ID NO: 7180 - protein, 220 aa, Homo sapiens
MPPRRPWDREAGTLQVLGALAVLWLGSVALICLLWQVPRPPTWGQVQPKDVPRSWEHGFQPSLGAPGSRGPGSRGTPASLSLWKASPRTCHLQPAAPLPSLWARPGCSCWTLPRRASTWLHTTGPSQGLTSGSTTRLPSWERLFCRSCSSCWAGTFPWLWPPAARHWPGHPPTCRFWLPEVPMYDRCPWGGSPWVFCTPNSGLWMDGTYTWAVPTWTGGL

SEQ ID NO: 7181 - protein, 199 aa, Homo sapiens
  SITE (195): Xaa equals any amino acid
KAGTPAGTGPEFPGRPTRPIYIRRYVFKLGVLGWGAPALLVLLSLSVKSSVYGPCTIPVFDSWENGTGFQNMSICWVRSPVVHSVLVMGYGGLTSLFNLVVLAWALWTLRRLRERADAPSVRACHDTVTVLGLTVLLGTTWALAFFSFGVFLLPQLFLFTILNSLYGFFLFLWFCSQRCRSEAEAKAQIEAFSSXQTTQ

SEQ ID NO: 7182 - protein, 160 aa, Homo sapiens
  SITE (133): Xaa equals any amino acid
  SITE (146): Xaa equals any amino acid
MSSLASWWPSYGRTQMNSRASVAGPSWLFCSAPFPHCLSYRSHCSSSCLTRPPGAWQRCASTSCWGPWSSRSWPRGPLGPTPRPSWSGWPDGGGAAWRWMCSPSARSATRPRWSLGPPGSSWLGGSCRAEAWXRLPGAGLCHCTPXTHGRTWLAATLCWT

SEQ ID NO: 7183 - protein, 166 aa, Homo sapiens
MGSRFLLVLLSGLTVLLALPGSEAKNSGASCPPCPKYASCHNSTHCTCEDGFRARSGRTYFHDSSEKCEDINECETGLAKCKYKAYCRNKVGGYICSCLVKYTLFNFLAGIIDYDHPDCYENNSQGTTQSNVDIWVSGVKPGFGKQLVRITMPFSYPNINMSSCDF

SEQ ID NO: 7184 - protein, 31 aa, Homo sapiens
  SITE (26): Xaa equals any amino acid
MVCILVLTLVSYSSLVNSPLPFVHLXVGISA

SEQ ID NO: 7185 - protein, 698 aa, Homo sapiens
MLPARLPFRLLSLFLRGSAPTAARHGLREPLLERRCAAASSFQHSSSLGRELPYDPVDTEGFGEGGDMQERFLFPEYILDPEPQPTREKQLQELQQQQEEEERQRQQRREERRQQNLRARSREHPVVGHPDPALPPSGVNCSGCGAELHCQDAGVPGYLPREKFLRTAEADGGLARTVCQRCWLLSHHRRALRLQVSREQYLELVSAALRRPGPSLVLYMVDLLDLPDALLPDLPALVGPKQLIVLGNKVDLLPQDAPGYRQRLRERLWEDCARAGLLLAPGHQGPQRPVKDEPQDGENPNPPNWSRTVVRDVRLISAKTGYGVEELISALQRSWRYRGDVYLVGATNAGKSTLFNTLLESDYCTAKGSDAIDRATISPWPGTTLNLLKFPICNPTPYRMFKRHQRLKKDSTQAEEDLSEQEQNQLNVLKKHGYVVGRVGRTFLYSEEQKDNIPFEFDADSLAFDMENDPVMGTHKSTKQVELTAQDVKDAHWFYDTPGITKENCILNLLTEKEVNIVLPTQSIVPRTFVLKPGMVLFLGAIGRIDFLQGNQSAWFTVVASNILPVHITSLDRADALYQKHAGHTLLQIPMGGKERMAGFPPLVAEDIMLKEGLGASEAVADIKFSSAGWVSVTPNFKDRLHLRGYTPEGTVLTVRPPLLPYIVNIKGQRIKKSVAYKTKKPPSLMYNVRKKKGKINV

SEQ ID NO: 7186 - protein, 118 aa, Homo sapiens
MVFVHLYLGNVLALLLFVHYSNGDESSDPGPQHRAQGPGPEPTLGPLTRLEGIKVGHERKVQLVTDRDHFIRTLSLKPLLFEIPGFLTDEECRLIIHLAQMKGLQRTRSCLLKSMKRQ

SEQ ID NO: 7187 - protein, 503 aa, Homo sapiens
MEQRHVLLKQKELGGEEPEPSLREGPGGLVMEGHLFKRASNAFKTWSRRWFTIQSNQLVYQKKYKDPVTVVVDDLRLCTVKLCPDSERRFCFEVVSTSKSCLLQADSERLLQLWVSAVQSSIASAFSQARLDDSPRGPGQGSGHLAIGSAATLGSGGMARGREPGGVGHVVAQVQSVDGNAQCCDCREPAPEWASINLGVTLCIQCSGIHRSLGVHFSKVRSLTLDSWEPELVKLMCELGNVIINQIYEARVEAMAVKKPGPSCSRQEKEAWIHAKYVEKKFLTKLPEIRGRRGGRGRPRGQPPVPPKPSIRPRPGSLRSKPEPPSEDLGSLHPGALLFRASGHPPSLPTMADALAHGADVNWVNGGQDNATPLIQATAANSLLACEFLLQNGANVNQADSAGRGPLHHATILGHTGLACLFLKRGADLGARDSEGRDPLTIAMETANADIVTLLRLAKMREAEAAQGQAGDETYLDIFRDFSLMASDDPEKLSRRSHDLHTL

SEQ ID NO: 7188 - protein, 100 aa, Homo sapiens
MGDDGSIDYTVHEAWNEATNVYLIVILVSFGLFMYAKRNKRRIMRIFSVPPTEETLSEPNFYDTISKIRLRQQLEMYSISRKYDYQQPQNQADSVQLSLE

SEQ ID NO: 7189 - protein, 24 aa, Homo sapiens
MSLQPPFVMLLLSTAQHHELGADT

SEQ ID NO: 7190 - protein, 37 aa, Homo sapiens
MTSVIVLFILKVFFKYFSTTSFLNACIHFIHKCKLVN

SEQ ID NO: 7191 - protein, 91 aa, Homo sapiens
MEKTLFLYHYLPALTFQILLLPVVLQHISDHLCRSQLQRSIFSALVVAWYSSACHVSNTLRPLTYGDKSLSPHELKALRWKDSWDILIRKH

SEQ ID NO: 7192 - protein, 294 aa, Homo sapiens [sequence omitted]

SEQ ID NO: 7193 - protein, 47 aa, Homo sapiens
MLQFLLGFTLGNVVGMYLAQNYDIPNLAKKLEEIKKDLDAKKKPPSA

SEQ ID NO: 7194 - protein, 160 aa, Homo sapiens
MQRVSGLLSWTLSRVLWLSGLSEPGAARQPRIMEEKALEVYDLIRTIRDPEKPNTLEELEVVSESCVEVQEINEEEYLVIIRFTPTVPHCSLATLIGLCLRVKLQRCLPFKHKLEIYISEGTHSTEEDINKQINDKERVAAAMENPNLREIVEQCVLEPD

SEQ ID NO: 7195 - protein, 113 aa, Homo sapiens
MWIAGPSWVPLRYVVWLMHLERICALHNCRGNMLSWPLQIRVAVLGCCTKTPAVGFLQVAGSPHSCQDPGPCSHSAAIFPPCERGLCGDGPRCVRGCVHCHRSLLHEPAWTQG

SEQ ID NO: 7196 - protein, 239 aa, Homo sapiens [sequence omitted]

SEQ ID NO: 7197 - protein, 83 aa, Homo sapiens
MNVLVYSDKEKKNQKSGLNLIVFIIKILKMTLIARKTGWGISPLLSVTMRIIPALVFNTRLPTFIISLIFLLFSCICELVQEC

SEQ ID NO: 7198 - protein, 64 aa, Homo sapiens
MVWSAAPAPCCLLGVLGLVQVLGAQAVGPWTASACLGAAQAQPCRPCKESSLRLFSASAPSMTH

SEQ ID NO: 7199 - protein, 22 aa, Homo sapiens
  SITE (6): Xaa equals any amino acid
MLNPFXQLLLVLLFPEWPTPLH

SEQ ID NO: 7200 - protein, 17 aa, Homo sapiens
  SITE (5): Xaa equals any amino acid
  SITE (6): Xaa equals any amino acid
  SITE (7): Xaa equals any amino acid
  SITE (10): Xaa equals any amino acid
MCEFXXXIMXLAGYFAC

SEQ ID NO: 7201 - protein, 53 aa, Homo sapiens
  SITE (30): Xaa equals any amino acid
  SITE (34): Xaa equals any amino acid
  SITE (38): Xaa equals any amino acid
MLVLAWITFPPCKACCMMCIFSSRLLQQEXVCTXVQGXEPRGMAQRDRGFESL

SEQ ID NO: 7202 - protein, 40 aa, Homo sapiens
MVHVSNLPWCLMTLSIFALLCNHHCHPSTERLSSCKTETP

SEQ ID NO: 7203 - protein, 98 aa, Homo sapiens
  SITE (74): Xaa equals any amino acid
MAHVVVARNECLIRAFLFLLHCVSLLPSPGEVNIRHTLFTVEERLTTPRALKLSLSLIVSLHATCRKQECSSIXEEVCPTTLEGCGTVVHGSSNAFNS

SEQ ID NO: 7204 - protein, 43 aa, Homo sapiens
MDYGYYSAGQFLLHLFLADLTQATTQQKTNTSENGCKFVCAVF

SEQ ID NO: 7205 - protein, 69 aa, Homo sapiens
MAARHLPGFHTYTNLLFLLLPSLLMGYSESPPPITDSWAPFISLTHHVLSQSQSPLSSNCWICLSTHTQ

SEQ ID NO: 7206 - protein, 99 aa, Homo sapiens
MLLLLVFLVACFINRKCQKQRKKKPAEDILEEYPLNTKVEVPKRHPDRVEKNVNRHYCTVRNVNILSEPEAAYTFKGAKVKRLNLEVRVHNNLQDGTEV

SEQ ID NO: 7207 - protein, 56 aa, Homo sapiens [sequence omitted]

SEQ ID NO: 7208 - protein, 232 aa, Homo sapiens
MLAGKLIPVHQVRGLKEKIVRSFEVSPDGSFLLINGIAGYLHLLAMKTKELIGSMKINGRVAASTFSSDSKKVYASSGDGEVYVWDVNSRKCLNRFVDEGSLYGLSIATSRNGQYVACGSNCGVVNIYNQDSCLQETNPKPIKAIMNLVTGVTSLTFNPTTEILAIASEKMKEAVRLVHLPSCTVFSNFPVIKNKNISHVHTMDFSPRSGYFALGNEKGKALMYRLHHYSDF

SEQ ID NO: 7209 - protein, 257 aa, Homo sapiens
MEMIIQFGFVTLFVASFPLAPLFALLNNIIEIRLDAKKFVTELRRPVAVRAKDIGIWYNILRGIGKLAVIINAFVISFTSDFIPRLVYLYMYSKNGTMHGFVNHTLSSFNVSDFQNGTAPNDPLDLGYEVQICRYKDYREPPWSENKYDISKDFWAVLAARLAFVIVFQNLVMFMSDFVDWVIPDIPKDISQQIHKEKVLMVELFMREEQDKQQLLETWMEKERQKDEPPCNHHNTKACPDSLGSPAPSHAYHGGVL

SEQ ID NO: 7210 - protein, 163 aa, Homo sapiens [sequence omitted]

SEQ ID NO: 7211 - protein, 57 aa, Homo sapiens
MVKMNWCNLLTFMVVLWLCRENVLAGRKYTEAFGDRGYISLATYYQTVQARGKLFVL

SEQ ID NO: 7212 - protein, 250 aa, Homo sapiens
MRILQLILLALATGLVGGETRIIKGFECKPHSQPWQAALFEKTRLLCGATLIAPRWLLTAAHCLKPRYIVHLGQHNLQKEEGCEQTRTATESFPHPGFNNSLPNKDHRNDIMLVKMASPVSITWAVRPLTLSSRCVTAGTSCLISGWGSTSSPQLRLPHTLRCANITIIEHQKCENAYPGNITDTMVCASVQEGGKDSCQGDSGGPLVCNQSLQGIISWGQDPCAITRKPGVYTKVCKYVDWIQETMKNN

SEQ ID NO: 7213 - protein, 76 aa, Homo sapiens
MTSIFTSLAVVTGVLILVGCCITPSVHGLVQRLTETALTKTSLNSSPPYSDKLPLLDHQEEQQSQIMFEKFEEGKL

SEQ ID NO: 7214 - protein, 129 aa, Homo sapiens [sequence omitted]

SEQ ID NO: 7215 - protein, 438 aa, Homo sapiens
LTITVHDPNAAQWYYGMSWGLRLYIPGFDVGTMFTIQKKILVSWSPPKPIRPLTDLGDPIFQKHPDKVDLTVPQPFLVPRPQLQQQHLQPSLMSILGGVHHLLNLTQPKLAQDCWLCLKAKPPYYVGLGVEATLKRGPLSCHTRPRALTIGDVSGNASCLISTGYNLSASPFQATCNQSLLTYISTSVSYQAPNNTWLACTSGLTRCINGTEPGPLLCVLVHVLPQVYVYSGPEGRQLIAPPELHPRLHQAVPLLVPLLAGLSIAGSAAIGTAALVQGETGLISLSQQVDADFSNLQSAIDILHSQVESLAEVVLQNCRCLDLLFLSQGGLCAALGESCCFYANQSGVIKGTVKKVRENLDRHQQERENNIPWYQSMFNWNPWLTTLITGLAGPLLILLLSLIFGPCILNSFLNFIKQRIASVKLTYLKTQYDTLVNN

SEQ ID NO: 7216 - protein, 561 aa, Homo sapiens
MDILMLLLLLCVIYGRFSQDEYSLNQAIRKEFTRNARNCLGGLRNIADWWDWSLTTLLDGLYPGGTPSARVPGAQPGALGGKCYLIGSSVIRQLKVFPRHLCKPPRPFSALIEDSIPTCSPEVGGPENPYLIDPENQNVTLNGPGGCGTREDCVLSLGRTRTEAHTALSRLRASMWIDRSTRAVSVHFTLYNPPTQLFTSVSLRVEILPTGSLVPSSLVESFSIFRSDSALQYHLMLPQLVFLALSLIHLCVQLYRMMDKGVLSYWRKPRNWLELSVVGVSLTYYAVSGHLVTLAGDVTNQFHRGLCRAFMDLTLMASWNQRARWLRGILLFLFTLKCVYLPGIQNTMASCSSMMRHSLPSIFVAGLVGALMLAALSHLHRFLLSMWVLPPGTFTDAFPGLLFHFPRRSQKDCLLGLSKSDQRAMACYFGILLIVSATLCFGMLRGFLMTLPQKRKSFQSKSFVRLKDVTAYMWEKVLTFLRLETPKLEEAEMVENHNYYLDEFANLLDELLMKINGLSDSLQLPLLEKTSNNTGEARTEESPLVDISSYQAAEPADIKDF

SEQ ID NO: 7217 - protein, 139 aa, Homo sapiens
MLLGPVPILHIKSQLWLLVLILVVSGLSAGMSIIPTFPEILSCAHENGFEEGLSTLGLVSGLFSAMWSIGAFMGPTLGGFLYEKIGFEWAAAIQGLWALISGLAMGLFYLLEYSRRKRSKSQNILSTEEERTTLLPNET

SEQ ID NO: 7218 - protein, 41 aa, Homo sapiens
MSWGIWKGLDLFPLIKGNSSLCLFLLVVPKGYSSSEITRAL

SEQ ID NO: 7219 - protein, 66 aa, Homo sapiens [sequence omitted]

SEQ ID NO: 7220 - protein, 683 aa, Homo sapiens
MLFIFNFLFSPLPTPALICILTFGAAIFLWLITRPQPVLPLLDLNNQSVGIEGGARKGVSQKNNDLTSCCFSDAKTMYEVFQRGLAVSDNGPCLGYRKPNQPYRWLSYKQVSDRAEYLGSCLLHKGYKSSPDQFVGIFAQNRPEWIISELACYTYSMVAVPLYDTLGPEAIVHIVNKADIAMVICDTPQKALVLIGNVEKGFTPSLKVIILMDPFDDDLKQRGEKSGIEILSLYDAENLGKEHFRKPVPPSPEDLSVICFTSGTTGDPKGAMITHQNIVSNAAAFLKCVEHAYEPTPDDVAISYLPLAHMFERIVQAVVYSCGARVGFFQGDIRLLADDMKTLKPTLFPAVPRLLNRIYDKVQNEAKTPLKKFLLKLAVSSKFKELQKGIIRHDSFWDKLIFAKIQDSLGGRVRVIVTGAAPMSTSVMTFFRAAMGCQVYEAYGQTECTGGCTFTLPGDWTSGHVGVPLACNYVKLEDVADMNYFTVNNEGEVCIKGTNVFKGYLKDPEKTQEALDSDGWLHTGDIGRWLPNGTLKIIDRKKNIFKLAQGEYIAPEKIENIYNRSQPVLQIFVHGESLRSSLVGVVVPDTDVLPSFAAKLGVKGSFEELCQNQVVREAILEDLQKIGKESGLKTFEQVKAIFLHPEPFSIENGLLTPTLKAKRGELSKYFRTQIDSLYEHIQD

SEQ ID NO: 7221 - protein, 61 aa, Homo sapiens
MPLALLATWLSCLPSLVLTYYSRSNQKMPWTLASPFSSMASTMEFWNGTLQKCVQTTWHLP

SEQ ID NO: 7222 - protein, 173 aa, Homo sapiens
  SITE (18): Xaa equals any amino acid
  SITE (21): Xaa equals any amino acid
  SITE (80): Xaa equals any amino acid
  SITE (102): Xaa equals any amino acid
MKTLFLGVTLGLAAALSXTLXEEDITGTWYVKAMVVDKTFRRQEAQKVSPVKVTALGGGKLEATFTFMREDRCIQKKILXRKTEEPGKYSACEPLPHSHPHXPPPPTPVHQPPQVESAQAALLPGPQLCPPPRRGWPLLPGGLVALTSDTGCDRLVRSRDGPDHACPLGGPSH

SEQ ID NO: 7223 - protein, 397 aa, Homo sapiens
  SITE (13): Xaa equals any amino acid
  SITE (258): Xaa equals any amino acid
MLRGPWRQLWLFXLLLLPGAPEPRGASRPWEGTDEPGSAWAWPGFQRLQEQLRAAGALSKRYWTLFSCQVWPDDCDEDEEAATGPLGWRLPLLGQRYLDLLTTWYCSFKDCCPRGDCRISNNFTGLEWDLNVRLHGQHLVQQLVLRTVRGYLETPQPEKALALSFHGWSGTGKNFVARMLVENLYRDGLMSDCVRMFIATFHFPHPKYVDLYKEQLMSQIRETQQLCHQTLFIFDEAEKLHPGLLEVLGPHLERRAPXGHRAESPWTIFLFLSNLRGDIINEVVLKLLKAGWSREEITMEHLEPHLQAEIVETIDNGFGHSRLVKENLIDYFIPFLPLEYRHVRLCARDAFLSQELLYKEETLDEIAQMMVYVPKEEQLFSSQGCKSISQRINYFLS

SEQ ID NO: 7224 - protein, 334 aa, Homo sapiens
MKMASSLAFLLLNFHVSLLLVQLLTPCSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSNLHVEVKGYEDGGIHLECRSTGWYPQPQIQWSNAKGENIPAVEAPVVADGVGLYEVAASVIMRGGSGEGVSCIIRNSLLGLEKTASISIADPFFRSAQPWIAALAGTLPILLLLLAGASYFLWRQQKEITALSSEIESEQEMKEMGYAATEREISLRESLQEELKRKKIQYLTRGEESSSDTNKSA

SEQ ID NO: 7225 - protein, 20 aa, Homo sapiens
MKNDRNQGFSLLQLIDWNKP

SEQ ID NO: 7226 - protein, 48 aa, Homo sapiens
MPSEGRLVLLSAFCPAFFPPWVLSGSFAFSLCAESHLNSSHRRIAVWT

SEQ ID NO: 7227 - protein, 563 aa, Homo sapiens
MGSLSNYALLQLTLTAFLTILVQPQHLLAPVFRTLSILTNQSNCWLCEHLDNAEQPELVFVPASASTWWTYSGQWMYERVWYPQAEVQNHSTSSYRKVTWHWEASMEAQGLSFAQVRLLEGNFSLCVENKNGSGPFLGNIPKQYCNQILWFDSTDGTFMPSIDVTNESRNDDDDPSVCLGTRQCSWFAGCTNRTWNSSAVPLIGLPNTQDYKWVDRNSGLTWSGNDTCLYSCQNQTKGLLYQLFRNLFCSYGLTEAHGKWRCADASITNDKGHDGHRTPTWWLTGSNLTLSVNNSGLFFLCGNGVYKGFPPKWSGRCGLGYLVPSLTRYLTLNASQITNLRSFIHKVTPHRCTQGDTDNPPLYCNPKDNSTIRALFPSLGTYDLEKAILNISKAMEQEFSATKQTLEAHQSKVSSLASASRKDHVLDIPTTQRQTACGTVGKQCCLYINYSEEIKSNIQRLHEASENLKNVPLLDWQGIFAKVGDWFRSWGYVLLIVLFCLFIFVLIYVRVFRKSRRSLNSQPLNLALSPQQSAQLLVSETSCQVSNRAMKGLTTHQYDTSLL

SEQ ID NO: 7228 - protein, 264 aa, Homo sapiens
MLRLFETFLETAPQLTLVLAIMLQSGRAEYYQWVGICTSFLGISWALLDYHRALRTCLPSKPLLGLGSSVIYFLWNLLLLWPRVLAVALFSALFPSYVALHFLGLWLVLLLWVWLQGTDFMPDPSSEWLYRVTVATILYFSWFNVAEGRTRGRAIIHFAFLLSDSILLVATWVTHSSWLPSGIPLQLWLPVGCGCFFLGLALRLVYYHWLHPSCCWKPDPDQVDGARSLLSPEGYQLPQNRRMTHLAQKFFPKAKDEAASPVKG

SEQ ID NO: 7229 - protein, 160 aa, Homo sapiens
  SITE (136): Xaa equals any amino acid
MAFTFAAFCYMLSLVLCAALIFFAIWHIIAFDELRTDFKSPIDQCNPVHARERLRNIERICFLLRKLVLPEYSIHSLFCIMFLCAQEWLTLGLNVPLLFYHFWRYFHCPADSSELAYDPPVVMNADTLSYCQKEAXCKLAFYLLSFFYYLYCMIYTLVSS

SEQ ID NO: 7230 - protein, 458 aa, Homo sapiens
MAWASRLGLLLALLLPVVGASTPGTVVRLNKAALSYVSEIGKAPLQRALQVTVPHFLDWSGEALQPTRIRILNVHVPRLHLKFIAGFGVRLLAAANFTFKVFRAPEPLELTLPVELLADTRVTQSSIRTPVVSISACSLFSGHANEFDGSNSTSHALLVLVQKHIKAVLSNKLCLSISNLVQGVNVHLGTLIGLNPVGPESQIRYSMVSVPTVTSDYISLEVNAVLFLLGKPIILPTDATPFVLPRHVGTEGSMATVGLSQQLFDSALLLLQKAGALNLDITGQLRSDDNLLNTSALGRLIPEVARQFPEPMPVVLKVRLGATPVAMLHTNNATLRLQPFVEVLATASNSAFQSLFSLDVVVNLRLQLSVSKVKLQGTTSVLGDVQLTVASSNVGFIDTDQVRTLMGTVFEKPLLDHLNALLAMGIALPGVVNLHYVAPEIFVYEGYVVISSGLFYQS

SEQ ID NO: 7231 - protein, 246 aa, Homo sapiens
MAAAAATKILLCLPLLLLLSGWSRAGRADPHSLCYDITVIPKFRPGPRWCAVQGQVDEKTFLHYDCGNKTVTPVSPLGKKLNVTTAWKAQNPVLREVVDILTEQLRDIQLENYTPKEPLTLQARMSCEQKAEGHSSGSWQFSFDGQIFLLFDSEKRMWTTVHPGARKMKEKWENDKVVAMSFHYFSMGDCIGWLEDFLMGMDSTLEPSAGAPLAMSSGTTQLRATATTLILCCLLIILPCFILPGI

SEQ ID NO: 7232 - protein, 176 aa, Homo sapiens
MSAGGASVPPPPNPAVSFPPPRVTLPAGPDILRTYSGAFVCLEILFGGLVWILVASSNVPLPLLQGWVMFVSVTAFFFSLLFLGMFLSGMVAQIDANWNFLDFAYHFTVFVFYFGAFLLEAAATSLHDLHCNTTITGQPLLSDNQYNINVAASIFAFMTTACYGCSLGLALRRWRP

SEQ ID NO: 7233 - protein, 409 aa, Homo sapiens
MDRLKSHLTVCFLPSVPFLILVSTLATAKSVTNSTLNGTNVVLGSVPVIIARTDHIIVKEGNSALINCSVYGIPDPQFKWYNSIGKLLKEEEDEKERGGGKWQMHDSGLLNITKVSFSDRGKYTCVASNIYGTVNNTVTLRVIFTSGDMGVYYMVVCLVAFTIVMVLNITRLCMMSSHLKKTEKAINEFFRTEGAEKLQKAFEIAKRIPIITSAKTLELAKVTQFKTMEFARYIEELARSVPLPPLIMNCRTIMEEIMEVVGLEEQGQNFVRHTPEGQEAADRDEVYTIPNSLKRSDSPAADSDASSLHEQPQQIAIKVSVHPQSKKEHADDQEGGQFEVKDVEETELSAEHSPETAEPSTDVTSTELTSEEPTPVEVPDKVLPPAYLEATEPAVTHDKNTCIIYESHV

SEQ ID NO: 7234 - protein, 29 aa, Homo sapiens
MQMTVVWYVITAIIWWRMSMCEALSQNCF

SEQ ID NO: 7235 - protein, 127 aa, Homo sapiens
MLHSGYQATFFSPKIGCSSILVFVCLLVFLRQSLALLPRLEYSGAILAHCNLHLLGSSDSPASASPVAGITGMHHHTQLFFCTFSRDGILPCWPGWSPTPDLRQSTLLSLPKCWDYRHEPLRPAQAF

SEQ ID NO: 7236 - protein, 121 aa, Homo sapiens
MLSTRWMGLHLVQILWRCWTSSATITSRKLSTALRSPVLSGTQTSRSSGDSGWSMKTSVKATPHQMSLRSGKETPSADIPRIHHQLVRLRHQAHGGWSPHGVPEQGTMPLVLPPVSCDIQP

SEQ ID NO: 7237 - protein, 117 aa, Homo sapiens
MWRVSISVPWLWSAWPISSVGFLCLPASPHPSLPPSSTLHDLAVTSGPERWRQLTAAARTVSRVRSAAGWGSWPCPASMNSCPRTVCLWNLRSIYCVCSSRLSTSCRKSPRITMPTQ

SEQ ID NO: 7238 - protein, 58 aa, Homo sapiens
MAWSRAAWTVMRSLLICWLVSAYILATVTDVQGSHIGIPGSLLELRHHPRSNESESAC

SEQ ID NO: 7239 - protein, 60 aa, Homo sapiens
MFECVILVSFLVVFVVVRCVGLIPTGQSKEFQHPLPACSCYPTDQTLNSSWGCCLAPHHD

SEQ ID NO: 7240 - protein, 71 aa, Homo sapiens
MWCLVFCSCVSLPRMMASSFIHDIAKDMISFLFMSAWYYTYFNSFEIYRFQFTFIEYSLWVKHHASLPGVQ

SEQ ID NO: 7241 - protein, 21 aa, Homo sapiens
MSLSLISLSFLFPAGAGRRSC

SEQ ID NO: 7242 - protein, 49 aa, Homo sapiens
MPKGILVSFLCALSPRTGMLGVSFLLFIGILLRHTSCLFCMVFAKMPLA

SEQ ID NO: 7243 - protein, 39 aa, Homo sapiens
MLEWTEMTFMPKTMLTCYLYICSKFRKKKSLQFILQQSS

SEQ ID NO: 7244 - protein, 83 aa, Homo sapiens
  SITE (65): Xaa equals any amino acid
MAPAIVTLGLLLPLAPADLCLPALGSSRLPRGPPQLPSIPVSQPLPRGFLREHPQPHKLQPIPPXSQKALFLEPRRRLWPPSP

SEQ ID NO: 7245 - protein, 50 aa, Homo sapiens
MLFFSLKESLYIFHTAILLVVCFACAVVCQYVIVRVCAVVFCFSKSQSLI

SEQ ID NO: 7246 - protein, 80 aa, Homo sapiens
  SITE (19): Xaa equals any amino acid
  SITE (33): Xaa equals any amino acid
MTGGFLSCILGLVLPLAYXSSLTWCWWRWGLPXPAGPPRCTPGCNASGAGRGPSPGPPGGELHTPASRDPGPGAEWRGTS

SEQ ID NO: 7247 - protein, 134 aa, Homo sapiens
MVENSPSPLPERAIYGFVLFLSSQFGFILYLVWAFIPESWLNSLGLTYWPQKYWAVALPVYLLIAIVIGYVLLFGINMMSTSPLDSIHTITDNYAKNQQQKKYQEEAIPALRDISISEVNQMFFLAAKELYTKN

SEQ ID NO: 7248 - protein, 49 aa, Homo sapiens
MATDERVLRKAHSTPALFQLVLNLVQCPSPASGVKSHLLPHKERHKSME

SEQ ID NO: 7249 - protein, 71 aa, Homo sapiens
MQNRSPAFCFLLMYLLCTCVTRVLLSIIFNLIRAYLWSWHDVTPCVRVGITPVYLFLSSAAHNARHIVGTL

SEQ ID NO: 7250 - protein, 209 aa, Homo sapiens
  SITE (181): Xaa equals any amino acid
  SITE (200): Xaa equals any amino acid
  SITE (207): Xaa equals any amino acid
MYFLFFFAFFFFPLFCYCFNYNKRARGSQALARSWRPMGVLGRGRGEVSGGQRWRVKNEKVGELGLAQEPCVPAHSPPSLPLPTSLPLHGFSPPLPESYGTGPCSSGIQLLPAHSSSWATSPPTFDVSPPVATLQLAFQAPSRGRPLPRPLTHVAIPTWLPVMSLLSKPSCPLFLPPRHAXTKWWKPPLSPSLPCAEFSXVLNEGEXDK

SEQ ID NO: 7251 - protein, 24 aa, Homo sapiens
MQVLMLAHFLILLEHVQGRCSDNN

SEQ ID NO: 7252 - protein, 45 aa, Homo sapiens
MVQWKNWPESLEVWVLVLAVPLTHCDLGILCCEDISQVLHVSQQI

SEQ ID NO: 7253 - protein, 45 aa, Homo sapiens; identical to SEQ ID NO: 7252

SEQ ID NO: 7254 - protein, 99 aa, Homo sapiens
MKIPVLPAVVLLSLLVLHSAQGATLGGPEEESTIENYASRPEAFNTPFLNIDKLRSAFKADEFLNWHALFESIKRKLPFLNWDAFPKLKGLRSATPDAQ

SEQ ID NO: 7255 - protein, 177 aa, Homo sapiens
  SITE (67): Xaa equals any amino acid
MFQVRPGWQLLLVMFSSCAVSNQLLVWYPATALADNKPVAPDRRISGHVGIIFSMSYLESKGLLATXSEDRSVRIWKVGDLRVPGGRVQNIGHCFGHSARVWQVKLLENYLISAGEDCVCLVWSHEGEILQAFRGHQDVYPVVVGAEIHAELYQELAYLETETESLAHLFALVPRPE

SEQ ID NO: 7256 - protein, 381 aa, Homo sapiens
  SITE (67): Xaa equals any amino acid
  SITE (139): Xaa equals any amino acid
  SITE (141): Xaa equals any amino acid
  SITE (165): Xaa equals any amino acid
  SITE (194): Xaa equals any amino acid
  SITE (344): Xaa equals any amino acid
  SITE (361): Xaa equals any amino acid
MFQVRPGWQLLLVMFSSCAVSNQLLVWYPATALADNKPVAPDRRISGHVGIIFSMSYLESKGLLATXSEDRSVRIWKVGDLRVPGGRVQNIGHCFGHSARVWQVKLLENYLISAGEDCVCLVWSHEGEILQAFRGHQGXGXRAIAAHERQAWVITGGDDSRHRLXHLVGRGYRGLGVSALCFKSRSRPGTLKAXTLAGSWRLLAVTDTGALYLYDVEVKCWEQLLEDKHFQSYCLLEAAPGPEGFGLCAMANGEGRVKVVPINTPTAAVDQTLFPGKVHSLSWALRGYEELLLLASGPGGVVACLEISAAPSGKAIFVKERCRYLLPPSKQRWHTCSAFLPPGXFLVCGDRRGSVLLFPSXPGLLKDPGVGGKARAGAGAL

SEQ ID NO: 7257 - protein, 83 aa, Homo sapiens
  SITE (36): Xaa equals any amino acid
MSLIWEQGLQLCGFCLFYLVFCFCISSLRVMAFSCXHVACCKGYDFVLFYGCVVFHGVYGPHFLYPIHHIWAPRLIPCLCYCE

SEQ ID NO: 7258 - protein, 57 aa, Homo sapiens
  SITE (14): Xaa equals any amino acid
  SITE (37): Xaa equals any amino acid
MWLLKPSAHSPVHXLVLLFPRGWSQPGTHKRQILVNXASLPGGCLLPWIWSGAALRF

SEQ ID NO: 7259 - protein, 238 aa, Homo sapiens
MLGSPCLLWLLAVTFLVPRAQPLAPQDFEEEEADETETAWPPLPAVPCDYDHCRHLQVPCKELQRVGPAACLCPGLSSPAQPPDPPRMGEVRIAAEEGRAVVHWCAPFSPVLHYWLLLWDGSEAAQKGPPLNATVRRAELKGLKPGGIYVVCVVAANEAGASRVPQAGGEGLEGADIPAFGPCSRLAVPPNPRTLVHAAVGVGTALALLSCAALVWHFCLRDRWGCPRRAAARAAGAL

SEQ ID NO: 7260 - protein, 105 aa, Homo sapiens [sequence omitted]

SEQ ID NO: 7261 - protein, 52 aa, Homo sapiens
MAVSLWPEGSGPLCALSLLTCCLVLRPASSSGFLWSLEETPALQGLCEIAQP

SEQ ID NO: 7262 - protein, 125 aa, Homo sapiens [sequence omitted]

SEQ ID NO: 7263 - protein, 156 aa, Homo sapiens
MPALLPVASRLLLLPRVLLTMASGSPPTQPSPASDSGSGYVPGSVSAAFVTCPNEKVAKEIARAVVEKRLAACVNLIPQITSIYEWKGKIEEDSEVLMMIKTQSSLVPALTDFVRSVHPYEVAEVIALPVEQGNFPYLQWVRQVTESVSDSITVLP

SEQ ID NO: 7264 - protein, 20 aa, Homo sapiens
GDWAFLFWMWLAGAALGSPA

SEQ ID NO: 7265 - protein, 47 aa, Homo sapiens
MGFLFLHILPSIINTRSAPQPTSCRMQPEQQPHSTLKPVILGMMIIS

SEQ ID NO: 7266 - protein, 151 aa, Homo sapiens
MHHQMTRTTLMTKQHELGGLLALVQNCQSEMNIKDSRAVGLSVKRLCISFVDEFCERTERPLYLAQGLFMKRETYWEVQDSGISPLLLLLSTALDCSPEAETRQSPGGRKMLQEPTLSMSLQILTGFLWVQLWNWETFLRIRTHSTDASCP

SEQ ID NO: 7267 - protein, 60 aa, Homo sapiens [sequence omitted]

SEQ ID NO: 7268 - protein, 34 aa, Homo sapiens
MSRRAEASIFVLPKTLLFVLFPAFPSPAVGCPVP

SEQ ID NO: 7269 - protein, 299 aa, Homo sapiens
  SITE (211): Xaa equals any amino acid
MAQNLKDLAGRLPAGPRGMGTALKLLLGAGAVAYGVRESVFTVEGGHRAIFFNRIGGVQQDTILAEGLHFRIPWFQYPIIYDIRARPRKISSPTGSKDLQMVNISLRVLSRPNAQELPSMYQRLGLDYEERVLPSIVNEVLKSVVAKFNASQLITQRAQVSLLIRRELTERAKDFSLILDDVAITELSFSREYTAAVEAKQVAQQEAQRAXFLVEKAKQEQRQKIVQAEGEAEAAKMLGEALSKNPGYIKLRKIRAAQNISKTIATSQNRIYLTADNLVLNLQDESFTRGSDSLIKGKK

SEQ ID NO: 7270 - protein, 58 aa, Homo sapiens
MHHICGSIVLLLCLFDLCMAAVGQLHIWSPYSKMQSTLLTAHIPSPKQNLNFQLCPLK

SEQ ID NO: 7271 - protein, 96 aa, Homo sapiens
  SITE (30): Xaa equals any amino acid
  SITE (35): Xaa equals any amino acid
  SITE (64): Xaa equals any amino acid
  SITE (83): Xaa equals any amino acid
MCFILVVCFASLITECPCHCKCCRDVGRGXTVLYXCSMVQNKLLTQVSLVRNLWAMEVRHPSCXSIGKKCFQILWKGGHGAGXWRVAFEQSDPISV

SEQ ID NO: 7272 - protein, 68 aa, Homo sapiens
MAAPLVLVLVVAVTVRAALFRSSLAEFISERVEVVSPLSSWKRVVEGLSLLGLGSISVFWSSISWKLH

SEQ ID NO: 7273 - protein, 50 aa, Homo sapiens
  SITE (5): Xaa equals any amino acid
MLSSXYVPMCQHFIYPVLWVLVHFFSFIQIQKNTDGSNVKLTRNPGTFIS

SEQ ID NO: 7274 - protein, 60 aa, Homo sapiens
MTSSLFIFLFLWFCPPPRISFVLCWPQPHSQVHIQHEKADHLFQSLKQKAPGLLQWARIV

SEQ ID NO: 7275 - protein, 36 aa, Homo sapiens
MLRLEVLLLFFSKVTDQIITQIIQENRSEIKNNIIF

SEQ ID NO: 7276 - protein, 632 aa, Homo sapiens
MKALLLLVLPWLSPANYIDNVGNLHFLYSELCKGASHYGLTKDRKRRSQDGCPDGCASLTATAPSPEVSAAATISLMTDEPGLDNPAYVSSAEDGQPAISPVDSGRSNRTRARPFERSTIRSRSFKKINRALSVLRRTKSGSAVANHADQGRENSENTTAPEVFPRLYHLIPDGEITSIKINRVDPSESLSIRLVGGSETPLVHIIIQHIYRDGVIARDGRLLPGDIILKVNGMDISNVPHNYAVRLLRQPCQVLWLTVMREQKFRSRNNGQAPDAYRPRDDSFHVILNKSSPEEQLGIKLVRKVDEPGVFIFNVLDGGVAYRHGQLEENDRVLAINGHDLRYGSPESAAHLIQASERRVHLVVSRQVRQRSPDIFQEAGWNSNGSWSPGPGERSNTPKPLHPTITCHEKVVNIQKDPGESLGMTVAGGASHREWDLPIYVISVEPGGVISRDGRIKTGDILLNVDGVELTEVSRSEAVALLKRTSSSIVLKALEVKEYEPQEDCSSPAALDSNHNMAPPSDWSPSWVMWLELPRCLYNCKDIVLRRNTAGSLGFCIVGGYEEYNGNKPFFIKSIVEGTPAYNDGRIRCGDILLAVNGRSTSGMIHACLARLLKELKGRITLTIVSWPGTFL

SEQ ID NO: 7277 - protein, 50 aa, Homo sapiens
MTHGCLSLASMAAGLGSVSLFLFVQQWTPTTASTGETPSSWQKTTSCVRR

SEQ ID NO: 7278 - protein, 492 aa, Homo sapiens
  SITE (89): Xaa equals any amino acid
MGSAPWAPVLLLALGLRGLQAGARRAPDPGFQERFFQQRLDHFNFERFGNKTFPQRFLVSDRFWVRGEGPIFFYTGNEGDVWAFANNSXFVAELAAERGALLVFAEHRYYGKSLPFGAQSTQRGHTELLTVEQALADFAELLRALRRDLGAQDAPAIAFGGSYGGMLSAYLRMKYPHLVAGALAASAPVLAVAGLGDSNQFFRDVTADFEGQSPKCTQGVREAFRQIKDLFLQGAYDTVRWEFGTCQPLSDEKDLTQLFMFARNAFTVLAMMDYPYPTDFLGPLPANPVKVGCDRLLSEAQRITGLRALAGLVYNASGSEHCYDIYRLYHSCADPTGCGTGPDARAWDYQACTEINLTFASNNVTDMFPDLPFTDELRQRYCLDTWGVWPRPDWLLTSFWGGDLRAASNIIFSNGNLDPWAGGGIRRNLSASVIAVTIQGGAHHLDLRASHPEDPASVVEARKLEATIIGEWVKAARREQQPALRGGPRLSL

SEQ ID NO: 7279 - protein, 70 aa, Homo sapiens [sequence omitted]

SEQ ID NO: 7280 - protein, 243 aa, Homo sapiens
MRPQGPAASPQRLRGLLLLLLLQLPAPSSASEIPKGKQKAQLRQREVVDLYNGMCLQGPAGVPGRDGSPGANGIPGTPGIPGRDGFKGEKGECLRESFEESWTPNYKQCSWSSLNYGIDLGKIAECTFTKMRSNSALRVLFSGSLRLKCRNACCQRWYFTFNGAECSGPLPIEAIIYLDQGSPEMNSTINIHRTSSVEGLCEGIGAGLVDVAIWVGTCSDYPKGDASTGWNSVSRIIIEELPK

SEQ ID NO: 7281 - protein, 237 aa, Homo sapiens
MPLCSLLTCLGLNVLFLTLNEGAWYSVGALMISVPALLGYLQEVCRARLPDSELMRRKYHSVRQEDLQRVRLSRPEAVAEVKSFLIQLEAFLSRLCCTCEAAYRVLHWENPVVSSQFYGALLGTVCMLYLLPLCWVLTLLNSTLFLGNVEFFRVVSEYRASLQQRMNPKQEEHAFESPPPPDVGGKDGLMDSTPALTPTEDLTPGSVEEAEEAEPDEEFKDAIDEDDEGAPCPALFL

SEQ ID NO: 7282 - protein, 64 aa, Homo sapiens
MLGSVCRALHVLTCLLLSSNPVVQAPCSLNEESKSQGVTCAVLPAGDLNPGSLVSACVPLTVTL

SEQ ID NO: 7283 - protein, 90 aa, Homo sapiens
  SITE (5): Xaa equals any amino acid
VTCQXVLPSPVYLCNYFCKHCILCGRHLLAPSLGFSLSSRPACTSLGCSGVSAPHSRPGCQAQPAGARDPAACPKHLFLGDGVGAAPQEV

SEQ ID NO: 7284 - protein, 95 aa, Homo sapiens
MILIRKLFLRRCHWGGWLLPPARASCSGKHSLSHSCRGPRVQRPPHPRFWAGTLAPGPCPGLWCLPGLVQVDVLAAGRCDHLSCLPPLCPQAFLL

SEQ ID NO: 7285 - protein, 251 aa, Homo sapiens
MAPASRLLALWALAAVALPGSGAEGDGGWRPGGPGAVAEEERCTVERRADLTYAEFVQQYAFVRPVILQGLTDNSRFRALCSRDRLLASFGDRVVRLSTANTYSYHKVDLPFQEYVEQLLHPQDPTSLGNDTLYFFGDNNFTEWASLFRHYSPPPFGLLGTAPAYSFGIAGAGSGVPFHWHGPGYSEVIYGRKRWFLYPPEKTPEFHPNKTTLAWLRDTYPACTVCTALECTIRAGEVLTSRPLVACYAQP

SEQ ID NO: 7286 - protein, 54 aa, Homo sapiens
MVYCVHLNPFTDLCCIFFMPLLCFLLRSRVDSISIPSLTLLEACNSIYCSGSSA

SEQ ID NO: 7287 - protein, 25 aa, Homo sapiens
MHKIGHCFMSLFSIKKHTYDDCKMK

SEQ ID NO: 7288 - protein, 70 aa, Homo sapiens
MWRVTRRGELTSCLSGATYLFFYGVSTPHALATYLRKLLDLKSESFKQMNVCFVLHLPWEILNIYRNRVS

SEQ ID NO: 7289 - protein, 599 aa, Homo sapiens
MELLGPVPPEQQFINQKMRPGSGMLSIRVIPDGPTRALQITDFCHRKSSRSYEVDELPVTEQELQKLKNPDTEQELEVLVRLEGGIGLSLINKVPEELVFASLTGINVHYTQLATSHMLELSIQDVQVDNQLIGTTQPFMLYVTPLSNENEVIETGPAVQVNAVKFPSKSALTNIYKHLMITAQRFTVQIEEKLLLKLLSFFGYDQAESEVEKYDENLHEKTAEQGGTPIRYYFENLKISIPQIKLSVFTSNKLPLDLKALKSTLGFPLIRFEDAVINLDPFTRVHPYETKEFIINDILKHFQEELLSQAARILGSVDFLGNPMGLLNDVSEGVTGLIKYGNVGGLIRNVTHGVSNSAGKFAGTLSDGLGKTMDNRHQSEREYIRYHAATSGEHLVAGIHGLAHGIIGGLTSVITSTVEGVKTEGGVSGFISGLGKGLVGTVTKPVAGALDFASETAQAVRDTATLSGPRTQAQRVRKPRCCTGPQGLLPRYSESQAEGQEQLFKLTDNIQDEFFIAVENIDSYCVLISSKAVYFLKSGDYVDREAIFLEVKYDDLLPLPCLQRPWEGVCAGDQESREHEQWSVHPRPLPPEAHGPCEI

SEQ ID NO: 7290 - protein, 113 aa, Homo sapiens
  SITE (27): Xaa equals any amino acid
  SITE (103): Xaa equals any amino acid
GRGLSSLTPYIVLCVFIMLSCETDSLXVWRSIQVMIPGRARWLTPVIPKCWDRRRESPRPVKTVLLKGCLPSGGCQSPGTPPGVSAFIPSCGRKCSVRNRILXVRLSAGYRMG

SEQ ID NO: 7291 - protein, 38 aa, Homo sapiens
MYIFYLYKIYIYTHICIYIPLFLCLLILAIKEGAAFNV

SEQ ID NO: 7292 - protein, 31 aa, Homo sapiens
MDCMCIYMFLIILINVCRFQGTNFSPLYVYS

SEQ ID NO: 7293 - protein, 50 aa, Homo sapiens
  SITE (17): Xaa equals any amino acid
MFLFFYLSLAVYAQRQXSGSCRQTDHRWKSRGARRCFLEPRDPGSVPGHP

SEQ ID NO: 7294 - protein, 26 aa, Homo sapiens
MMMMIQTLMVMAKILCLKQPLSMAGS

SEQ ID NO: 7295 - protein, 65 aa, Homo sapiens
MVENWVLEESPGRLLALFVVRRALAQGQREEKGQPAAVESAGWLPTRFLSSQDSLPLSSRISNGL

SEQ ID NO: 7296 - protein, 381 aa, Homo sapiens
MLLSIGMLMLSATQVYTILTVQLFAFLNLLPVEADILAYNFENASQTFDDLPARFGYRLPAEGLKGFLINSKPENACEPIVPPPVKDNSSGTFIVLIRRLDCNFDIKVLNAQRAGYKAAIVHNVDSDDLISMGSNDIEVLKKIDIPSVFIGESSANSLKDEFTYEKGGHLILVPEFSLPLEYYLIPFLIIVGICLILIVIFMITKFVQDRHRARRNRLRKDQLKKLPVHKFKKGDEYDVCAICLDEYEDGDKLRILPCSHAYHCKCVDPWLTKTKKTCPVCKQKVVPSQGDSDSDTDSSQEENEVTEHTPLLRPLASVSAQSFGALSESRSHQNMTESSDYEEDDNEDTDSSDAENEINEHDVVVQLQPNGERDYNIANTV

SEQ ID NO: 7297 - protein, 446 aa, Homo sapiens [sequence omitted]

SEQ ID NO: 7298 - protein, 54 aa, Homo sapiens
MSWALPSLFFLLFSPFLLPSGLTVIRRYTNNSNNYLKNHTHQKNKRQQKITRYS

SEQ ID NO: 7299 - protein, 47 aa, Homo sapiens
  SITE (8): Xaa equals any amino acid
  SITE (19): Xaa equals any amino acid
MKLTIFFXFPQTITGLLQXLMSRQVEDVAFLPLPHPVFSFSFFFPLV

SEQ ID NO: 7300 - protein, 544 aa, Homo sapiens
  SITE (251): Xaa equals any amino acid
  SITE (257): Xaa equals any amino acid
MPPNLGNAGLLGRMLDEKTPPSPSGQPEEPGMVRLVCGHHNWIAVAYTQFLVCYRLKEASGWQLVFSSPRLDWPIERLALTARVHGGALGEHDKMVAAATGSEILLWALQAEGGGSEIGVFHLGVPVEALFFVGNQLIATSHTGRIGVWNAVTKHWQVQEVQPITSYDAAGSFLLLGCNNGSIYYVDVQKFPLRMKDNDLLVSELYRDPAEDGVTALSVYLTPKTSDSGNWIEIAYGTSSGGVRVIVQHPXTVGSGXQLFQTFTVHRSPVTKIMLSEKHLISVCADNNHVRTWSVTRFRGMISTQPGSTPLASFKILALESADGHGGCSAGNDIGPYGERDDQQVFIQKVVPSASQLFVRLSSTGQRVCSVRSVDGSPTTAFTVLECEGSRRLGSRPRRYLLTGQANGSLAMWDLTTAMDGLGQAPAGGLTEQELMEQLEHCELAPPAPSAPSWGCLPSPSPRISLTSLHSASSNTSLSGHRGSPSPPQAEARRRGGGSFVERCQELVRSGPDLRRPPTPAPWPSSGLGTPLTPPKMKLNETSF

SEQ ID NO: 7301 - protein, 218 aa, Homo sapiens
  SITE (61): Xaa equals any amino acid
  SITE (105): Xaa equals any amino acid
  SITE (117): Xaa equals any amino acid
MAVVLLANLAQGDSLAARAIAVQKGSIGNLLGFLEDSLAATQFQQSQASLLHMQNPPFEPXSVDMMRRAARALLALAKVDENHSEFTLYESRLLDISVSPLMNSXVSQVICDVLFLXWPVMTAVGHLPPPCVCACVENLETDCCPLFMQNHLRIQFTLCCPASPLGKSLSCFSLLLPPPLPPSPHAFLFLVLTLLPSGPYPTLFEKTKLCLHRRLFLF

SEQ ID NO: 7302 - protein, 254 aa, Homo sapiens
MVTALTLLAFPLLLLHAERISLVFLLLFLQSFLLLHLLAAGIPVTTPGPFTVPWQAVSAWALMATQTFYSTGHQPVFPAIHWHAAFVGFPEGHGSCTWLPALLVGANTFASHLLFAVGCPLLLLWPFLCESQGLRKRQQPPGNEADARVRPEEEEEPLMEMRLRDAPQHFYAALLQLGLKYLFILGIQILACALAASILRRHLMVWKVFAPKFIFEAVGFIVSSVGLLLGIALVMRVDGAVSSWFRQLFLAQQR

SEQ ID NO: 7303 - protein, 8 aa, Homo sapiens
MVWGLLLG

SEQ ID NO: 7304 - protein, 137 aa, Homo sapiens
MLSGRLVLGLVSMAGRVCLCQGSAGSGAIGPVEAAIRTKLEEALSPEVLELRNESGGHAVPPGSETHFRVAVVSSRFEGLSPLQRHRLVHAALAEELGGPVHALAIQARTPAQWRENSQLDTSPPCLGGNKKTLGTP

SEQ ID NO: 7305 - protein, 175 aa, Homo sapiens
MASLRVERAGGPRLPRTRVGRPAALRLLLLLGAVLNPHEALAQPLPTTGTPGSEGGTVKNYETAVQFCWNHYKDQMDPIEKDWCDWAMISRPYSTLRDCLEHFAELFDLGFPNPLAERIIFETHQIHFANCSLVQPTFSDPPEDVLLAMIIAPICLIPFLITLVVWRSKDSEAQA

SEQ ID NO: 7306 - protein, 19 aa, Homo sapiens
MVYHGYNIYLVVFLLLYLD

SEQ ID NO: 7307 - protein, 159 aa, Homo sapiens
MGVLAEHGGHPAQEHFPKLLGLLFPLLARERHDRVRDNICGALARLLMASPTRKPEPQVLAALLHALPLKEDLEEWVTIGRLFSFLYQSSPDQVIDVAPELLRICSLILADNKIPPDTKAALLLLLTFLAKQHTDSFQAALGSLPVDKAQELQAVLGLS

SEQ ID NO: 7308 - protein, 380 aa, Homo sapiens
MARLGAVRSHYCALLLAAALAVCAFYYLGSGRETFSSATKRLKEARAGAPAAPSPPALELARGSVAPAPGAKAKSLEGGGAGPVDYHLLMMFTKAEHNAALQAKARVALRSLLRLAKFEAHEVLNLHFVSEEASREVAKGLLRELLPPAAGFKCKVIFHDVAVLTDKLFPIVEAMQKHFSAGLGTYYSDSIFFLSVAMHQIMPKEILQIIQLDLDLKFKTNIRELFEEFDSFLPGAIIGIAREMQPVYRHTFWQFRHENPQTRVGGPPPEGLPGFNSGVMLLNLEAMRQSPLYSRLLEPAQVQQLADKYHFRGHLGDQDFFTMIGMEHPKLFHVLDCTWNRQLCTWWRDHGYSDVFEAYFRCEGHVKIYHGNCNTPIPED

SEQ ID NO: 7309 - protein, 239 aa, Homo sapiens
MAPLLPSLPLHLHTSLCLRLCLSLSLSAWLSWSLPLCVSLSASYPAWRLLPQLHGRSREQRYTKLADWQYIEECVQAASPMPLFGNGDILSFEDANRAMQTGVTGIMIARGALLKPWLFTEIKEQRHWDISSSERLDILRDFTNYGLEHWGSDTQGVEKTRRFLLEWLSFLCRYVPVGLLERLPQRINERPPYYLGRDYLETLMASQKAADWIRISEMLLGPVPPSFAFLPKHKANAYK

SEQ ID NO: 7310 - protein, 226 aa, Homo sapiens
MDQALSLWFLLGWIGGDSCNLIGSFLADQLPLQTYTAVYYVLADLVMLTLYFYYKFRTRPSLLSAPINSVLLFLMGMACATPLLSAAGPVAAPREAFRGRALLSVESGSKPFTRQEVIGFVIGSISSVLYLLSRLPQIRTNFLRKSTQGISYSLFALVMLGNTLYGLSVLLKNPEEGQSEGSYLLHHLPWLVGSLGVLLLDTIISIQFLVYRRSTAASELEPLLPS

SEQ ID NO: 7311 - protein, 128 aa, Homo sapiens
MVVAVLLGFVAMVLSVVGMKCTRVGDSNPIAKGRVAIAGGALFILAGLCTLTAVSWYATLVTQEFFNPSTPVNARYEFGPALFVGWASAGLAVLGGSFLCCTCPEPERPNSSPQPYRPGPSAAAREYV

SEQ ID NO: 7312 - protein, 100 aa, Homo sapiens
MVRTRALFYIFFQLSLTSGLIEDSCILIIIYLFFFRWCLALSPMLECSGVTLAHCNHHLLGRLRQENRLNLGGGDCSELRLHHCTLACVTSKTLSHTHTK

SEQ ID NO: 7313 - protein, 379 aa, Homo sapiens
MPTSSSSNAAERQRRNTRSPKGQKKKKIVKYGMGGLIILFLIAIIWFPLLFMSLVRSVVGVVNQPIDVTVTLKLGGYEPLFTMSAQQPSIIPFTAQAYEELSRQFDPQPLAMQFISQYSPEDIVTAQIEGSSGALWRISPPSRAQMKRELYNGTADITLRFTWNFQRDLAKGGTVEYANEKHMLALAPNSTARRQLASLLEGTSDQSVVIPNLFPKYIRAPNGPEANPVKQLQPNEEADYLGVRIQLRREQGAGATGFLEWWVIELQECRTDCNLLPMVIFSDKVSPPSLGFLAGYGIMGLYVSIVLVIGKFVRGFFSEISHSIMFEELPCVDRILKLCQDIFLVRETRELELEEELYAKLIFLYRSPETMIKWTREKE

SEQ ID NO: 7314 - protein, 81 aa, Homo sapiens
MWGGSVFLKPKLLQAGGFLHFLFVLFLTADSVHLSVGGELLLRTGFKRHIPVTFKNLHGGRSFSRSVGWSTLGPTTLRRGR

SEQ ID NO: 7315 - protein, 53 aa, Homo sapiens [sequence omitted]

SEQ ID NO: 7316 - protein, 84 aa, Homo sapiens
MAVPALTPAAVRATGLLGVSWTWALFTPLVALGREGGSQDSATTPSRPPGRPRIVDIATIVTAMQKNGSQRKTTRRKRAIGRGG

SEQ ID NO: 7317 - protein, 154 aa, Homo sapiens
MPAEKRIFGAVLLFSWTVYLWETFLAQRQRRIYKTTTHVPPELGQIMDSETFEKSRLYQLDKSTFSFWSGLYSETEGTLNLLFGGIPYLWRLSGRFCGYAGFGPEYEITQSLVFLLLATLFSALTGVPWSLYNTFVIKKTWLQSTDFGVLHMEI

SEQ ID NO: 7318 - protein, 317 aa, Homo sapiens
  SITE (254): Xaa equals any amino acid
MGYDVTRFQGDVDEDLICPICSGVLEEPVQAPHCEHAFCNACITQWFSQQQTCPVDRSVVTVAHLRPVPRIMRNMLSKLQIACDNAVFGCSAVVRLDNLMSHLSDCEHNPKRPVTCEQGCGLEMPKDELPNHNCIKHLRSVVQQQQTRIAELEKTSAEHKHQLAEQKRDIQLLKAYMRAIRSVNPNLQNLEETIEYNEILEWVNSLQPARVTRWGGMISTPDAVLQAVIKRSLVESGCPASIVNELIENAHERXWPQGLATLETRQMNRRYYENYVAKRIPGKQAVVVMACENQHMGDDMVQEPGLVMIFAHGVEEI

SEQ ID NO: 7319 - protein, 103 aa, Homo sapiens
MGMAGALSILLFSLPSHGWPSPPKPPFPCCQPLCHSLILGRRKGRFEGEGEKAYGWVWFLPFPEGLTVPGWPQGRQGPHYACALVKVTPAIYQQPWHVPAPQE

SEQ ID NO: 7320 - protein, 222 aa, Homo sapiens
MGLFGKTQEKPPKELVNEWSLKIRKEMRVVDRQIRDIQREEEKVKRSVKDAAKKGQKDVCIVLAKEMIRSRKAVSKLYASKAHMNSVLMGMKNQLAVLRVAGSLQKSTEVMKAMQSLVKIPEIQATMRELSKEMMKAGIIEEMLEDTFESMDDQEEMEEEAEMEIDRILFEITAGALGKAPSKVTDALPEPEPPGAMAASEDEEEEEEALEAMQSRLATLRS

SEQ ID NO: 7321 - protein, 73 aa, Homo sapiens
MRLQPDICNLPTNPLSLKLGLMLLSLTLCLEKTVQGLKLGLCLFKLSFSEHMVCPTHPQSIRWFYFMFRLQCC

SEQ ID NO: 7322 - protein, 195 aa, Homo sapiens
MAPAASRLRAEAGLGALPRRALAQYLLFLRLYPVLTKAATSGILSALGNFLAQMIEKKRKKENSRSLDVGGPLRYAVYGFFFTGPLSHFFYFFMEHWIPPEVPLAGLRRLLLDRLVFAPAFLMLFFLIMNFLEGKDASAFAAKMRGGFWPALRMNWRVWTPLQFININYVPLKFRVLFANLAALFWYAYLASLGK

SEQ ID NO: 7323 - protein, 46 aa, Homo sapiens
MVWFIYFVLQGLFCPKNEGASPGLQFPTLSLAGHASPALVPHGMGG

SEQ ID NO: 7324 - protein, 40 aa, Homo sapiens
MALGLCSSGALSTLCLSSVTCLAIMVLMAVDGLHGTSGLG

SEQ ID NO: 7325 - protein, 62 aa, Homo sapiens
MRKKSFHAEYYNSLLLLLFLPENNDSRQDIGRVIFGESDQPKSKYLKVLILEIPRKWLSQTY

SEQ ID NO: 7326 - protein, 53 aa, Homo sapiens
MPASCPGPGGGNQGLLLFFVCLFVCLFLTAWGSRRTLKAEFCCPKGWTAMIPK

SEQ ID NO: 7327 - protein, 63 aa, Homo sapiens
MHWNLPQVNLFALLLLTILTLVPHLVVPYHHRHYQAQQNNREPYLQNCQAHHLHQLLPFHRDQ

SEQ ID NO: 7328 - protein, 61 aa, Homo sapiens
MHECQSFPLCVHLRLVLLLSFKTQVHEFHEVFPHYSHFNFPSLNNYDINLLLNHELWHTTP

SEQ ID NO: 7329 - protein, 58 aa, Homo sapiens
  SITE (56): Xaa equals any amino acid
MVATLCLENSSVSLWFIFLSSLSSFPWCGALSDNWPSGGAVARCHSGRRWFPEGSXCL

SEQ ID NO: 7330 - protein, 127 aa, Homo sapiens [sequence omitted]

SEQ ID NO: 7331 - protein, 54 aa, Homo sapiens
MSALLSHHVPLFYLTGCLFSLLASWDCNGKEGAGRAIKGKNNTWNCMILSKVKF

SEQ ID NO: 7332 - protein, 61 aa, Homo sapiens
MNESVYDDSTSSYTPSLHILGCLLLLFLGVERALEPFSGLCASLHDVRPIVNPLTSFSLIY

SEQ ID NO: 7333 - protein, 16 aa, Homo sapiens
MLLSIICLVRSLFHHL

SEQ ID NO: 7334 - protein, 119 aa, Homo sapiens [sequence omitted]

SEQ ID NO: 7335 - protein, 127 aa, Homo sapiens [sequence omitted]

SEQ ID NO: 7336 - protein, 107 aa, Homo sapiens
MITTAGKVVVTILLGSSGMMLPSLTSSVYFFVFLGLCTWWSWCRTFDPLLFSCLCVLLAIFTAGHLIGLYLYQFQFFQEAVPPNDYYASFGQSEEFFYSTGTELIIP

SEQ ID NO: 7337 - protein, 115 aa, Homo sapiens; identical to SEQ ID NO: 6746

SEQ ID NO: 7338 - protein, 182 aa, Homo sapiens
  SITE (119): Xaa equals any amino acid
  SITE (120): Xaa equals any amino acid
  SITE (149): Xaa equals any amino acid
  SITE (151): Xaa equals any amino acid
  SITE (154): Xaa equals any amino acid
MVIYVTLALWPQIIQKKANGNCFWHFGLLLKLGFLLLFICFLAYSQGAFEKIFSLWPLSKCFELKGNVYEWWFRWRLDRYVVFHGMLFAFIYLALQKRQILSEGKGEPLFSNKISNFLXXISVVSFLTYSIWASSCKNKAECNELHPSXSXVQXLAFILIRNIPGYARQFTVHFLLGLEKFH

SEQ ID NO: 7339 - protein, 19 aa, Homo sapiens
MVGTWRMLFLLPSYSSGQV

SEQ ID NO: 7340 - protein, 63 aa, Homo sapiens
  SITE (26): Xaa equals any amino acid
  SITE (41): Xaa equals any amino acid
MVHKAILALLPWGFSADELLASLMMXLTEKYQNCSSTTDIXNQQLRSLGQNFMFQQNLQLILM

SEQ ID NO: 7341 - protein, 76 aa, Homo sapiens
MSGLVGGGSRCSKVRFRCFNGDSLLVLVLQHHFRLCSWCLAPSLFLLLSCQVVSTMMEQDPVIYDDDDDLPNYFSV

SEQ ID NO: 7342 - protein, 56 aa, Homo sapiens
MVAILLRELPLAFLLVGSSGDKFCFTSSENVLLSFSFLKDIFAGYKNSGLMVLFIV

SEQ ID NO: 7343 - protein, 95 aa, Homo sapiens
  SITE (70): Xaa equals any amino acid
MLETTKHVQIACMLLLTCQIFLPSSLSPSFIHSLTDSFIPLKKLYVCFVQSTLLKAAGYKSISEALGFDXLLCSSARFVWICHTYSRPLVTCALH

SEQ ID NO: 7344 - protein, 161 aa, Homo sapiens [sequence omitted]

SEQ ID NO: 7345 - protein, 39 aa, Homo sapiens
  SITE (30): Xaa equals any amino acid
MLPLLSLLFLFFSTVSSFCGMPLRAHTRAXAHTRTFASR

SEQ ID NO: 7346 - protein, 43 aa, Homo sapiens
MSSWFTLLASCFHLLWPLSRSSHVPSSFQPPDLSATFLLQILG

SEQ ID NO: 7347 - protein, 131 aa, Homo sapiens
MICETKARKSSGQPGRLPPPTLAPPQPPLPETIERPVGTGAMVARSSDLPYLIVGVVLGSIVLIIVTFIPFCLWRAWSKQKHTTDLGFPRSALPPSCPYTMVPLGGLPGHQAVDSPTSVASVDGPVLMGST

SEQ ID NO: 7348 - protein, 903 aa, Homo sapiens
MSYYMADRKHRKAFLEARQSLEVKMNLEEQSQQQENLMLSILPKHVADEMLKDMKKDESQKDQQQFNTMYMYRHENVSILFADIVGFTQLSSACSAQELVKLLNELFARFDKLAAKYHQLRIKILGDCYYCICGLPDYREDHAVCSILMGLAMVEAISYVREKTKTGVDMRVGVHTGTVLGGVLGQKRWQYDVWSTDVTVANKMEAGGIPGRVHISQSTMDCLKGEFDVEPGDGGSRCDYLEEKGIETYLIIASKPEVKKTATQNGLNGSALPNGAPASSKSSSPALIETKEPNGSAHSSGSTSEKPEEQDAQADNPSFPNPRRRLRLQDLADRVVDASEDEHELNQLLNEALLERESAQVVKKRNTFLLSMRFMDPEMETRYSVEKEKQSGAAFSCSCVVLLCTALVEILIDPWLMTNYVTFMVGEILLLILTICSLAAIFPRAFPKKLVAFSTWIDRTRWARNTWAMLAIFILVMANVVDMLSCLQYYTGPSNATAGMETEGSCLENPKYYNYVAVLSLIATIMLVQVSHMVKLTLMLLVAGAVATINLYAWRPVFDEYDHKRFREHDLPMVALEQMQGFNPGLNGTDRLPLVPSKYSMTVMVFLMMLSFYYFSRHVEKLARTLFLWKIEVHDQKERVYEMRRWNEALVTNMLPEHVARHFLGSKKRDEELYSQTYDEIGVMFASLPNFADFYTEESINNGGIECLRFLNEIISDFDSLLDNPKFRVITKIKTIGSTYMAASGVTPDVNTNGFASSNKEDKSERERWQHLADLADFALAMKDTLTNINNQSFNNFMLRIGMNKGGVLAGVIGARKPHYDIWGNTVNVASRMESTGVMGNIQVVEETQVILREYGFRFVRRGPIFVKGKGELLTFFLKGRDKLATFPNGPSVTLPHQVVDNS

SEQ ID NO: 7349 - protein, 188 aa, Homo sapiens
MVPGAAGWCCLVLWLPACVAAHGFRIHDYLYFQVLSPGDIRYIFTATPAKDFGGIFHTRYEQIHLVPAEPPEACGELSNGFFIQDQIALVERGGCSFLSKTRVVQEHGGRAVIISDNAVDNDSFYVEMIQDSTQRTADIPALFLLGRDGYMIRRSLEQHGLPWAIISIPVNVTSIPTFELLQPPWTFW

SEQ ID NO: 7350 - protein, 30 aa, Homo sapiens
MRKEEQVFFVMLLRKYPESQHHDLLVKQNK

SEQ ID NO: 7351 - protein, 29 aa, Homo sapiens
  SITE (9): Xaa equals any amino acid
  SITE (14): Xaa equals any amino acid
MGVLHLLAXFLLVXGRVPGLGGVPGGGEG

SEQ ID NO: 7352 - protein, 41 aa, Homo sapiens
MFAFLLGIYLGVKLLDNMFNYLRTDRLLCKVANMSKFSSHL

SEQ ID NO: 7353 - protein, 38 aa, Homo sapiens
MGPAVCFRACEMCSLSGLLLNLCFQSCLSVPLSGVPRV

SEQ ID NO: 7354 - protein, 63 aa, Homo sapiens
MNNGLLQQPSALMLLPCRPVLTSVALNANFVSWKSRTKYTITPVKMRKSGGRDHTGGNKDRGI

SEQ ID NO: 7355 - protein, 32 aa, Homo sapiens
MGAPSLTMLLLLKVQPRRTQAFDAHWVGLPLL

SEQ ID NO: 7356 - protein, 177 aa, Homo sapiens
MRGSVECTWGWGHCAPSPLLLWTLLLFAAPFGLLGEKTRQVSLEVIPNWLGPLQNLLHIRAVGTNSTLHYVWSSLGPLAVVMVATNTPHSTLSVNWSLLLSPEPDGGLMVLPKDSIQFSSALVFTRLLEFDSTNVSDTAAKPLGRPYPPYSLADFSWNNITDSLDPATLSATFQGTP

SEQ ID NO: 7357 - protein, 57 aa, Homo sapiens
MSLPCHLLPGLLQQLLTSLPAFQFSAPLQVFSLDGLSLPAPKLLTASLCLQDEVRAV

SEQ ID NO: 7358 - protein, 188 aa, Homo sapiens
MFHQIWAALLYFYGIILNSIYQCPEHSQLTTLGVDGKEFPEVHLGQWYFIAGAAPTKEELATFDPVDNIVFNMAAGSAPMQLHLRATIRMKDGLCVPRKWIYHLTEGSTDLRTEGRPDMKTELFSSSCPGGIMLNETGQGYQRFLLYNRSPHPPEKCVEEFKSLTSCLDSKAFLLTPRNQEACELSNN

SEQ ID NO: 7359 - protein, 27 aa, Homo sapiens
MSVIGGLLLVVALGPGGVSMDEKKKEW

SEQ ID NO: 7360 - protein, 31 aa, Homo sapiens
MRIVVLVTFMCLGRLRCSTSLRHSQNANLLF

SEQ ID NO: 7361 - protein, 113 aa, Homo sapiens
MAIWVVFIYWLLLVFCEHSCISFRVDVCIHFSCNKFYLGVELLDHMAALLTLWGTARLLFKVSAPCSLSSAVYDGSVSSQPHQYLFSVCRWGLLEHHHIHSFTYYLWLLLQYS

SEQ ID NO: 7362 - protein, 90 aa, Homo sapiens
  SITE (90): Xaa equals any amino acid
MALEMVWGSVYHCSCYITPWSKIQSFSLSLFQFILQEVNITLPENSVWYERYKFDIPVFHLNGQFLMMHRVNTSKLEKQLLKLEQQSTGX

SEQ ID NO: 7363 - protein, 56 aa, Homo sapiens [sequence omitted]

SEQ ID NO: 7364 - protein, 138 aa, Homo sapiens
MKMMVVLLMLSSLSRLLGLMRPSSLRQYLDSVPLPPCQEQQPKASAELDHKACYLCHSLLMLAGVVVSCQDITPDQWGELQLLCMQLDRHISTQIRESPQAMHRTMLKDLATQTYIRWQELLTHCQPQAQYFSPWKDI

SEQ ID NO: 7365 - protein, 377 aa, Homo sapiens
  SITE (327): Xaa equals any amino acid
MPAKVCVQYMKDTNMLFLGGLIVAVAVERWNLHKRIALRTLLWVGAKPARLMLGFMGVTALLSMWISNTATTAMMVPIVEAILQQMEATSAATEAGLELVDKGKAKELPGSQVIFEGPTLGQQEDQERKRLCKAMTLCICYAASIGGTATLTGTGPNVVLLGQMNELFPDSKDLVNFASWFAFAFPNMLVMLLFAWLWLQFVYMRFKYVSDATVAIFVATLLFIVPSQKPKFNFRSQTEEERKTPFYPPPLLDWKVTQEKVPWGIVLLLGGGFALAKGSEASGLSVWMGKQMEPLHAVPPAAITLILSLLVAVFTECTSNVATTTLXLPIFASMVKTGVIMNIIGVFCVFLAVNTWGRAIFDLDHFPDWANVTHIET

SEQ ID NO: 7366 - protein, 69 aa, Homo sapiens [sequence omitted]

SEQ ID NO: 7367 - protein, 1 aa, Homo sapiens
S

SEQ ID NO: 7368 - protein, 129 aa, Homo sapiens [sequence omitted]

SEQ ID NO: 7369 - protein, 51 aa, Homo sapiens
MYCLCGLLLQALLRLCNGYKTQKNHRELRMCGIIAQGKSRWQLHCYPGMKS

SEQ ID NO: 7370 - protein, 47 aa, Homo sapiens
MERPASLWASVSILFTSWGLALPSLQVASLSDSSPHPPLLGPSRPIR

SEQ ID NO: 7371 - protein, 188 aa, Homo sapiens [sequence omitted]

SEQ ID NO: 7372 - protein, 66 aa, Homo sapiens
MRACGWDLSILLVGLVMGREGCYSRLPPTEYQKQAGSSGVCKDVRPRNQPSPSYPCKSLSPHAPLL

SEQ ID NO: 7373 - protein, 51 aa, Homo sapiens
MCPFHKAYLDCFFQISLLLLIFLTYLDIGKCGLWSHEWRIRELGKHERWWN

SEQ ID NO: 7374 - protein, 61 aa, Homo sapiens
MVGGYVSSFSFPPVSSSLLLPASFAFPFLPGTPCPFLYFLPSPFSPLPLSLTRSNSFLLNG

SEQ ID NO: 7375 - protein, 65 aa, Homo sapiens [sequence omitted]

SEQ ID NO: 7376 - protein, 66 aa, Homo sapiens
MLNQPCILGMKPTWLWWISFLMCCWVWLASVLLGIFASIFIRDIGLEFSFFVMCLPGFGIRVMLAS

SEQ ID NO: 7377 - protein, 230 aa, Homo sapiens
  SITE (63): Xaa equals any amino acid
  SITE (66): Xaa equals any amino acid
MGNSLSVFCSWFCRRSWPCHRQPARLVREAFPAGRAHPAAPAPVPARGIVGRFPLLFNRQRHXGPXFPVRWDGAPMRLCLIPRNTGTPQRVLRPVVWSPPSRKKPVLSPHNSIMFGHLSPVRIPCLRGKFNLQLPSLDDQVIPARLPKTEVSAEEPKEATEVKDQVETQGQEDNKRGPCSNGEAASTSRPLETQGNLTSSWYNPRPLEGNVHLKSLTEKNQTDKAQVHAV

SEQ ID NO: 7378 - protein, 94 aa, Homo sapiens
MWPWWLMVERTVVLLLITYLVPVGGSAVGPPGPGCNVSTSPPPPATRCPDESELYRDPGEAPLEADQAERGAAHEGGHPGRDPWGARRGPPRCG

SEQ ID NO: 7379 - protein, 69 aa, Homo sapiens
MWSLVSVSVLVLTCAVDVAEGLGWGEVSTGGIELPRHMVLVVLVEREFPEVSDMLPLKPFPQGDRYVSR

SEQ ID NO: 7380 - protein, 115 aa, Homo sapiens
MPSSSSGLGSPSRPPSSFLCLLLLLLPPAALALLLFFLDFFPPRAAVSPFLPDHCSARQPRVWRRETLNRSASGLGCWARSTEQGAVGVATGTVLDISLPASCLSLWPPGPSGGI

SEQ ID NO: 7381 - protein, 44 aa, Homo sapiens
MICLCSIKMLLLFCQLTFALITCINLQSLYLFSYQQIIGIHSHV

SEQ ID NO: 7382 - protein, 96 aa, Homo sapiens [sequence omitted]

SEQ ID NO: 7383 - protein, 46 aa, Homo sapiens
MLFLTCRSPHSCCVITWFFLCACALVSSSYQDNNPIGFRPEPYNPI

SEQ ID NO: 7384 - protein, 60 aa, Homo sapiens
MWDLSPSTLSLLLLLSPCDVPALALPSAMSKSLLSLLRSRCCHASWTACRTVNQLNLFSL

SEQ ID NO: 7385 - protein, 52 aa, Homo sapiens
MVEHLHLTYHYLKLPCIFACLLLYWFSPLLNSKLQDSRDLVCFLNQWHTVCA

SEQ ID NO: 7386 - protein, 21 aa, Homo sapiens
MYFIYLKYILLTPGVGMNETR

SEQ ID NO: 7387 - protein, 46 aa, Homo sapiens
MTTFSLCSQLALLCACTSLVSLPPFVDYKDTSPVGPEPHCKGLILT

SEQ ID NO: 7388 - protein, 152 aa, Homo sapiens
  SITE (73): Xaa equals any amino acid
  SITE (106): Xaa equals any amino acid
MRTCGIWFCFCTSSLRIMASSFTYVAAKNMISLLLWLHSEMGKVPLSPSQGVRWGCDSLLQCPAAQTSMGGMXTGRLWGSDPKAVSRGEAPVGVCYRVLFQFSRPXAACVLSSIRPLPYRKDRGLSVSLGSCLGVLEESDHTWAWRLSTRFC

SEQ ID NO: 7389 - protein, 443 aa, Homo sapiens
MPGWLTLPTLCRFLLWAFTIFHKAQGDPASHPGPHYLLPPIHEVIHSHRGATATLPCVLGTTPPSYKVRWSKVEPGELRETLILITNGLHARGYGPLGGRARMRRGHRLDASLVIAGVRLEDEGRYRCELINGIEDESVALTLSLEGVVFPYQPSRGRYQFNYYEAKQACEEQDGRLATYSQLYQAWTEGLDWCNAGWLLEGSVRYPVLTARAPCGGRGRPGIRSYGPRDRMRDRYDAFCFTSALAGQVFFVPGRLTLSEAHAACRRRGAVVAKVGHLYAAWKFSGLDQCDGGWLADGSVRFPITTPRPRCGGLPDPGVRSFGFPRPQQAAYGTYCTPRIRRPPCPLQRARRSLGVVAGVSRHPFPESLPSLQTRSGLSRPAFPAGGCGPRTPAGPGGGEGRRGPPAARCRGDPRTRCRSRTLAEDSATAEGRVRRPGALTDL

SEQ ID NO: 7390 - protein, 85 aa, Homo sapiens
MYACVCRVLQPGCGRVLVCARVPAWLWVCVCVCVCVCVCVLASGAVRPLRVGALFSAHWKPSPFSQMPGRGGAAVGTHLVLLSDL

SEQ ID NO: 7391 - protein, 57 aa, Homo sapiens
MLTSHQPTSLIHILLVSLFLSNPLCFGLLSVCPLQNSYVEALTPNMTLFGDEALIII

SEQ ID NO: 7392 - protein, 64 aa, Homo sapiens
MSATHPVPWSVTTWCFFCTWNATCSAGPSPGHRVSSSTASFIRVSYFPSYFSSPLSVTCVPVSS

SEQ ID NO: 7393 - protein, 91 aa, Homo sapiens
  SITE (53): Xaa equals any amino acid
MVVDQKEDLITGLGIKMVRKWLQGSQAWPLEREEREGLGSLCTCCPWGLVRFXESLTHFTGEAIEPLRAEVTDPKHPCSCVAEPEVKSRSL

SEQ ID NO: 7394 - protein, 50 aa, Homo sapiens
MLPDESFGLLLSIPSLTPSAAAPSFCVHLMQASRSSKRASHVPVHLLWGD

SEQ ID NO: 7395 - protein, 48 aa, Homo sapiens
MFLILVAFISGVSPSFVHISVSGLHCKISLTIVAFPFSTAQYKAVLLS

SEQ ID NO: 7396 - protein, 46 aa, Homo sapiens [sequence omitted]

SEQ ID NO: 7397 - protein, 87 aa, Homo sapiens [sequence omitted]

SEQ ID NO: 7398 - protein, 355 aa, Homo sapiens [sequence omitted]

SEQ ID NO: 7399 - protein, 167 aa, Homo sapiens
  SITE (140): Xaa equals any amino acid
MLQGHSSVFQALLGTFFTWGMTAAGAALVFVFSSGQRRILDGSLGFAAGVMLAASYWSLLAPAVEMATSSGGFGAFAFFPVAVGFTLGAAFVYLADLLMPHLGAAEDPQTALALNFGSTLMKKKSDPEGHALLFPERIHXIDKSENGEAYQRKKAAATGLPEGPAVP

SEQ ID NO: 7400 - protein, 31 aa, Homo sapiens
MCKFIYVPHSVLLVYVFTFVLIPNCYNSVAL

SEQ ID NO: 7401 - protein, 57 aa, Homo sapiens
MIVSYRIVSLPSSVLCLFIPPFLLIFYCLHSFVFSQMLYSWNYHVTFQMAFSLIICV

SEQ ID NO: 7402 - protein, 56 aa, Homo sapiens
MRSSFLYAIPAVFFFLTGPCLRINKSVMSETKVYSSVCRCVAPPFSPAAPHIQSRS

SEQ ID NO: 7403 - protein, 67 aa, Homo sapiens
MCTQILVFMLLIKCIFSINTHPIMPYLYMKNKVTMLYCYVLKFKSLFEKPSNWCFHYIMIHLDKTPN

SEQ ID NO: 7404 - protein, 93 aa, Homo sapiens
MKEQSLPSFLWKMLLWYCLVCCDTLESFVSVFSLYPGTALGIWEALTVYGRCAQFFCFQGAKEVAVHMETFLFLECEGWGPKQVPNAAAFLLV

SEQ ID NO: 7405 - protein, 149 aa, Homo sapiens
  SITE (15): Xaa equals any amino acid
  SITE (39): Xaa equals any amino acid
  SITE (64): Xaa equals any amino acid
  SITE (67): Xaa equals any amino acid
  SITE (99): Xaa equals any amino acid
  SITE (124): Xaa equals any amino acid
  SITE (125): Xaa equals any amino acid
MAAWVFPLLSVIHTXLPQASPEIWVTQSEGGDQGVACEXVGGVLSTLDRIELCFLSDRASSGCXDKXPQTGVLFLGAGICHEGVGRAGSSRALSPGPAXAVFPSFPCAFPGPSCVCLCPRLSWXXYRSQGPWSYWIRATLMASCHCSYL

SEQ ID NO: 7406 - protein, 111 aa, Homo sapiens
MCILTELERGMVGPVTLHKKIHTTTVLFIVQIHILLIQAITQAKLQMHLMILQMTGLSILALLGKSTTTIVEQKFHNGKNQKSGLKENRDKKKQTRWQSTASQKIGITEER

SEQ ID NO: 7407 - protein, 260 aa, Homo sapiens [sequence omitted]

SEQ ID NO: 7408 - protein, 94 aa, Homo sapiens
MFVLFSLPKYAGLRLPIPGLSALLVFLLSLFSRRAQVELTTGRETLPKNLQGYFPEFGFQVQNFLSCKIYAASQKQPLPPLYQLRFYLKHMGLP

SEQ ID NO: 7409 - protein, 83 aa, Homo sapiens
MGLKALPEPFMSLVSHLLRTFFLVWFVGLPVAILGNLLECYANVFTGNGGGPEPWGGHLVSECLALPQLGIQYLALSGGIIWL

SEQ ID NO: 7410 - protein, 43 aa, Homo sapiens
MSSHWTLKILLVPLFYLSLEFPSGFVLCLANDLGYHFSSRVRS

SEQ ID NO: 7411 - protein, 66 aa, Homo sapiens
  SITE (8): Xaa equals any amino acid
  SITE (11): Xaa equals any amino acid
  SITE (18): Xaa equals any amino acid
  SITE (61): Xaa equals any amino acid
MLLLCYHXFLXFVLGTGXVNIEEAEKLLKPYLNRYPKGAIFLFFAGRIEVIKGNIDAAIRXFEECC

SEQ ID NO: 7412 - protein, 123 aa, Homo sapiens
MGGYYCNVCDCVVKDSINFLDHINGKKHQRNLGMSMRVERSTLDQVKKRFEVNKKKMEEKQKDYDFEERMKELREEEEKAKAYKKEKQKEKKRRAEEDLTFEEDDEMAAVMGFSGFGSTKKSY

SEQ ID NO: 7413 - protein, 53 aa, Homo sapiens
MNLETVLLSRTSSLGFAVCLPCFFCWFYLVLFLELTSITFAMYDIIPCMTLGK

SEQ ID NO: 7414 - protein, 71 aa, Homo sapiens
MLFLNLTVTCIFLFCFYFNVLVAHLMNVNLKNSVQLSRYNSAKQILKLHITLQHMVPHTLIVAFYIFSYYY

SEQ ID NO: 7415 - protein, 70 aa, Homo sapiens
MHWLGRGWRLLEGGEKELPTWSLLLLYPGCLQSCSTTPWTTPSQMPEATGGQGRQGGLPALLQQRATTLG

SEQ ID NO: 7416 - protein, 197 aa, Homo sapiens
MCTGKCARCVGLSLITLCLVCIVANALLLVPNGETSWTNTNHLSLQVWLMGGFIGGGLMVLCPGIAAVRAGGKGCCGAGCCGNRCRMLRSVFSSAFGVLGAIYCLSVSGAGLRNGPRCLMNGEWGYHFEDTAGAYLLNRTLWDRCEAPPRVVPWNVTLFSLLVAASCLEIVLCGIQLVNATIGVFCGDCRKKQDTPH

SEQ ID NO: 7417 - protein, 21 aa, Homo sapiens
MLLSNLVVSALYNPVLGLSCF

SEQ ID NO: 7418 - protein, 170 aa, Homo sapiens
MVPVLLSLLLLLGPAVPQENQDGRYSLTYIYTGLSKHVEDVPAFQALGSLNDLQFFRYNSKDRKSQPMGLWRQVEGMEDWKQDSQLQKAREDIFMETLKDIVEYYNDSNGSHVLQGRFGCEIENNRSSGAFWKYYYDGKDYIEFNKEIPAWVPFDPAAQITKQKWDACLE

SEQ ID NO: 7419 - protein, 54 aa, Homo sapiens
  SITE (32): Xaa equals any amino acid
  SITE (39): Xaa equals any amino acid
MFLELPMQHSDVLLFLVCWKAMGSKKSPSHFXPEVGGIXPSFGMLNVTLLRSLT

SEQ ID NO: 7420 - protein, 85 aa, Homo sapiens
MSASSLHRLPVLMALFPFQAAAAGSLGLQPPPTPMKGKPSIMLPPQYKRREGLKKKKKKKKKSCSCQLWEGRLHSWRWASNQPRR

SEQ ID NO: 7421 - protein, 622 aa, Homo sapiens
  SITE (544): Xaa equals any amino acid
MGLLSDPVRRRALARLVLRLNAPLCVLSYVAGIAWFLALVFPPLTQRTYMSENAMGSTMVEEQFAGGDRARAFARDFAAHRKKSGALPVAWLERTMRSVGLEVYTQSFSRKLPFPDETHERYMVSGTNVYGILRAPRAASTESLVLTVPCGSDSTNSQAVGLLLALAAHFRGQIYWAKDIVFLVTEHDLLGTEAWLEAYHDVNVTGMQSSPLQGRAGAIQAAVALELSSDVVTSLDVAVEGLNGQLPNLDLLNLFQTFCQKGGLLCTLQGKLQPEDWTSLDGPLQGLQTLLLMVLRQASGRPHGSHGLFLRYRVEALTLRGINSFRQYKYDLVAVGKALEGMFRKLNHLLERLHQSFFLYLLPGLSRFVSIGLYMPAVGFLLLVLGLKALELWMQLHEAGMGLEEPGGAPGPSVPLPPSQGVGLASLVAPLLISQAMGLALYVLPVLGQHVATQHFPVAEAEAVVLTLLAIYAAGLALPHNTHRVVSTQAPDRGWMALKLVALIYLALQLGCIALTNFSLGFLLATTMVPTAALAKPHGPRTLXYAALLVLTSPAATLLGSLFLWRELQEAPLSLAEGWQLFLAALAQGVLEHHTYGALLFPLLSLGLYPCWLLFWNVLFWK

SEQ ID NO: 7422 - protein, 31 aa, Homo sapiens
MPLSRFWLLLLFLPSHISVLSLIRYPSVKEY

SEQ ID NO: 7423 - protein, 82 aa, Homo sapiens
MASHSFLLDIYLVLSLWKCIPGLVQDVFLEMKVLTESALCKVMTLEPLQHSVLVFRCWQSPFQAKSSRPCQASIFAYYTLNF

SEQ ID NO: 7424 - protein, 42 aa, Homo sapiens
MWDYKTVLLAFKQLMNCIRSCLILIVLLLILNALPCKELIAT

SEQ ID NO: 7425 - protein, 18 aa, Homo sapiens
MRKQRLVPMYLGLIYILL

SEQ ID NO: 7426 - protein, 74 aa, Homo sapiens
  SITE (51): Xaa equals any amino acid
MENDWGFQTTFFSLGLYLFTIWWSTVGLPWTSSTQRELDMKLEAAALEGKXGSLGQPRPWQEESLPLGVLDGHV

SEQ ID NO: 7427 - protein, 69 aa, Homo sapiens
  SITE (33): Xaa equals any amino acid
  SITE (39): Xaa equals any amino acid
  SITE (55): Xaa equals any amino acid
DRPCPSSLWKVFPLLLLLMRLFPLPVPGNQRAXLPHPFXAPRLPCLLCLCTQQFXVCSHYLPAGYRVNS

SEQ ID NO: 7428 - protein, 68 aa, Homo sapiens
MSHLQTLHLIGLSCSFLYFPTSQAVEAAEPGMMLSLRQMTNPLVARNQTAPRAGVSVFCTDCLFGLDI

SEQ ID NO: 7429 - protein, 35 aa, Homo sapiens
MRLTEKDTVLFTKGVLFLHLFINALFWYCKFGHNF

SEQ ID NO: 7430 - protein, 61 aa, Homo sapiens
MSQLFLIMLTFIFLNNMFIMHLTSFHGKRVFGFLNQSSHMHAFPLPRWTTSIFSVSIFINR

SEQ ID NO: 7431 - protein, 65 aa, Homo sapiens
MGAQGGPPEEPLFYVALVVFHGWCSGSPYQEEAPPCEGGGPEGGPRKPDQEPGNQVQDLPGHARV

SEQ ID NO: 7432 - protein, 125 aa, Homo sapiens
MMTQTCIILLIHTMQVCTTHPTVLSHTLLQRPKPTDLFPKATPTTAPMPLRMRPPQCLPHMFHLQSRRFDQEIGLQQKSMTGILQTEKWTQENFGLSQGVFLNMNLASHQFFSMKDQLPSLKLPD

SEQ ID NO: 7433 - protein, 240 aa, Homo sapiens
MTAPVPAPRILLPLLLLLLLTPPPGARGEVCMASRGLSLFPESCPDFCCGTCDDQYCCSDVLKKFVWSEERCAVPEASVPASVEPVEQLGSALRFRPGYNDPMSGFGATLAVGLTIFVLSVVTIIICFTCSCCCLYKTCRRPRPVVTTTTSTTVVHAPYPQPPSVPPSYPGPSYQGYHTMPPQPGMPAAPYPMQYPPPYPAQPMGPPAYHETLAGGAAAPYPASQPPYNPAYMDAPKAAL

SEQ ID NO: 7434 - protein, 148 aa, Homo sapiens
MTWKIKLRSAVYLSDATVTTLGNLVPFTLTLLCFLLLICSLCKHLKKMQLHGKGSQDPSTKVHIKVLQTVIFFLLLCAIYFLSIMISVWSFGSLENKPVFMFCKAIRFSYPSIHPFILIWGNKKLKQTFLSVLRQVRYWVKGEKPSSP

SEQ ID NO: 7435 - protein, 59 aa, Homo sapiens
MTSVSTQLSLVLMSLLLVLPVVEAVEAGDAIALLLGVVLSITGICACLGVYARKRNGQM

SEQ ID NO: 7436 - protein, 40 aa, Homo sapiens
MILRGVYSMVPIYTHMIFLFTFFLTISGKYFKIFEKHSRI

SEQ ID NO: 7437 - protein, 278 aa, Homo sapiens
MLIFGAIFGCLDPVATLAAVMTEKSPFTTPIGRKDEADLAKSALAMADSDHLTIYNAYLGWKKARQEGGYRSEITYCRRNFLNRTSLLTLEDVKQELIKLVKAAGFSSSTTSTSWEGNRASQTLSFQEIALLKAVLVAGLYDNVGKIIYTKSVDVTEKLACIVETAQGKAQVHPSSVNRDLQTHGWLLYQEKIRYARVYLRETTLITPFPVLLFGGDIEVQHRERLLSIDGWIYFQAPVKIAVIFKQLRVLIDSVLRKKLENPKMSLEMTRFCRSLRN

SEQ ID NO: 7438 - protein, 330 aa, Homo sapiens
  SITE (38): Xaa equals any amino acid
  SITE (247): Xaa equals any amino acid
MSPLSAARAALRVYAVGAAVILAQLLRRCRGGFLEPVXPPRPDRVAIVTGGTDGIGYSTAKHLARLGMHVIIAGNNDSKAKQVVSKIKEETLNDKVEFLYCDLASMTSIRQFVQKFKMKKIPLHVLINNAGVMMVPQRKTRDGFEEHFGLNYLGHFLLTNLLLDTLKESGSPGHSARVVTVSSATHYVAELNMDDLQSSACYSPHAAYAQSKLALVLFTYHLQRLLAAEGSHVTANVVDPGVVNTDXYKHVFWATRLAKKLLGWLLFKTPDEGAWTSIYAAVTPELEGVGGRYLYNEKETKSLHVTYNQKLQQQLWSKSCEMTGVLDVTL

SEQ ID NO: 7439 - protein, 64 aa, Homo sapiens
MYLSLFFFCFSLQASAVEERSAESSREGPVRTDNWQRCFGDIPGTPTHLVQRSLVLTCFGRVLS

SEQ ID NO: 7440 - protein, 71 aa, Homo sapiens
MFPSCLPLLFNAKVLAKDIFLLLLCFSILFCTVGWLSAPTLGTGPWLGHFMAQSLWGLKEGWAAQSLHGSC

SEQ ID NO: 7441 - protein, 41 aa, Homo sapiens
MASGPGEVCYSVLTAEHPACIRKLRSSLPCQINLNGPCPHN

SEQ ID NO: 7442 - protein, 88 aa, Homo sapiens
MDWWFLAIAMALLWLTTSRKQCCSTWALLNYMALMILIGENPDLLVNLDSLQEPVCVILVKGLLFQRIAANLQPLVLHHHTIQMMNKK

SEQ ID NO: 7443 - protein, 445 aa, Homo sapiens
MAAPEERDLTQEQTEKLLQFQDLTGIESMDQCRHTLEQHNWNIEAAVQDRLNEQEGVPSVFNPPPSRPLQVNTADHRIYSYVVSRPQPRGLLGWGYYLIMLPFRFTYYTILDIFRFALRFIRPDPRSRVTDPVGDIVSFMHSFEEKYGRAHPVFYQGTYSQALNDAKRELRFLLVYLHGDDHQDSDEFCRNTLCAPEVISLINTRMLFWACSTNKPEGYRVSQALRENTYPFLAMIMLKDRRMTVVGRLEGLIQPDDLINQLTFIMDANQTYLVSERLEREERNQTQVLRQQQDEAYLASLRADQEKERKKREERERKRRKEEEVQQQKLAEERRRQNLQEEKERKLECLPPEPSPDDPESVKIIFKLPNDSRVERRFHFSQSLTVIHDFLFSLKESPEKFQIEANFPRRVLPCIPSEEWPNPPTLQEAGLSHTEVLFVQDLTDE

SEQ ID NO: 7444 - protein, 115 aa, Homo sapiens
MACRSWCFTLLANVSFTLLLPVHWGSAEAVFSVSITLGCRPPSSLLCATQQREKRPGEPRAGSCCFSLEVTPSLSHMFHQPEKVSYGWLNRASKSNPPEAEALQREEPNILNIIQ

SEQ ID NO: 7445 - protein, 58 aa, Homo sapiens
MGKICKNWVSFLDNVLLLILFLYGLCLGWLCIYHQSYSTACICVVTDAEIQQKSLHSI

SEQ ID NO: 7446 - protein, 225 aa, Homo sapiens [sequence omitted]

SEQ ID NO: 7447 - protein, 46 aa, Homo sapiens
MNATTSFQFTTPTRLWLMLLLNYQIFCCYTVTFKEFGKLVSTANLG

SEQ ID NO: 7448 - protein, 42 aa, Homo sapiens
MLVATAVCCYLFWLIAILAQLNPLFGPQLKNETIWYVRFLWE

SEQ ID NO: 7449 - protein, 4 aa, Homo sapiens
VLRN

SEQ ID NO: 7450 - protein, 63 aa, Homo sapiens
MWKRVCVCVFLYIAWVQLWMCAKECECVCVCVKGSVLEPTSVCCESGKRVGEGREMLTLVGAG

SEQ ID NO: 7451 - protein, 20 aa, Homo sapiens
MNVRLVLNPFPLYSVYVIPN

SEQ ID NO: 7452 - protein, 70 aa, Homo sapiens
MNLLGMIFSMCGLMLKLKWCAWVAVYCSFISFANSRSSEDTKQMMSSFMLSISAVVMSYLQNPQPMTPPW

SEQ ID NO: 7453 - protein, 62 aa, Homo sapiens
MLCPALGPFLLFLLSSTLMASFMGDTPCHPGELSAFGVAPSRVFTSSFLFTVFTPSYPSLPG

SEQ ID NO: 7454 - protein, 25 aa, Homo sapiens
MTSYIINLSFFLPLATRKVSAKPCG

SEQ ID NO: 7455 - protein, 450 aa, Homo sapiens
MLVTAYLAFVGLLASCLGLELSRCRAKPPGRACSNPSFLRFQLDFYQVYFLALAADWLQAPYLYKLYQHYYFLEGQIAILYVCGLASTVLFGLVASSLVDWLGRKNSCVLFSLTYSLCCLTKLSQDYFVLLVGRALGGLSTALLFSAFEAWYIHEHVERHDFPAEWIPATFARAAFWNHVLAVVAGVAAEAVASWIGLGPVAPFVAAIPLLALAGALALRNWGENYDRQRAFSRTCAGGLRCLLSDRRVLLLGTIQALFESVIFIFVFLWTPVLDPHGAPLGIIFSSFMAASLLGSSLYRIATSKRYHLQPMHLLSLAVLIVVFSLFMLTFSTSPGQESPVESFIAFLLIELACGLYFPSMSFLRRKVIPETEQAGVLNWFRVPLHSLACLGLLVLHDSDRKTGTRNMFSICSAVMVMALLAVVGLFTVVRHDAELRVPSPTEEPYAPEL

SEQ ID NO: 7456 - protein, 45 aa, Homo sapiens
  SITE (37): Xaa equals any amino acid
  SITE (42): Xaa equals any amino acid
MILFLLLPLPCGAFLQFFTWLTLTQPLKFSSGAISSXKGTSXSPD

SEQ ID NO: 7457 - protein, 58 aa, Homo sapiens [sequence omitted]

SEQ ID NO: 7458 - protein, 88 aa, Homo sapiens
MKSLIKTYFLLWTLKKLLPLSTLIPIMLSPLDIFFSDNPHIDCSGHHFVPYLLIGLDTDPQFTCLYLLILTLLVFVFSLTLLSPPSPG

SEQ ID NO: 7459 - protein, 399 aa, Homo sapiens
MAIHKALVMCLGLPLFLFPGAWAQGHVPPGCSQGLNPLYYNLCDRSGAWGIVLEAVAGAGIVTTFVLTIILVASLPFVQDTKKRSLLGTQVFFLLGTLGLFCLVFACVVKPDFSTCASRRFLFGVLFAICFSCLAAHVFALNFLARKNHGPRGWVIFTVALLLTLVEVIINTEWLIITLVRGSGEGGPQGNSSAGWAVASPCAIANMDFVMALIYVMLLLLGAFLGAWPALCGRYKRWRKHGVFVLLTTATSVAIWVVWIVMYTYGNKQHNSPTWDDPTLAIALAANAWAFVLFYVIPEVSQVTKSSPEQSYQGDMYPTRGVGYETILKEQKGQSMFVENKAFSMDEPVAAKRPVSPYSGYNGQLLTSVYQPTEMALMHKVPSEELTTSSSHGPPPTAR

SEQ ID NO: 7460 - protein, 253 aa, Homo sapiens
MRSGKMAPKPQSRCTSTRSAGEAPSENQSPSKGPEEASSEVQDTNEVHVPGDQDEPQTLGKKGSKNNISVYMTLNQKKSDSSSASVCSIDSTDDLKSSNSECSSSESFDFPPGSMHAPSTSSTSSSSKEEKKLSNSLKMKVFSKNVSKCVTPDGRTICVGDIVWAKIYGFPWWPARILTITVSRKDNGLLVRQEARISWFGSPTTSFLALSQLSPFLENFQSRFNKKRKGLYRKAITEAAKAAKQLTPEVRAC

SEQ ID NO: 7461 - protein, 30 aa, Homo sapiens
MLVVNINLVFLLFFIFLCYLDACINVFCFY

SEQ ID NO: 7462 - protein, 45 aa, Homo sapiens
MQLLQLSFQLLVSLILPTIYTLPQFQIWKQVPDINIISSSTFQYA

SEQ ID NO: 7463 - protein, 95 aa, Homo sapiens
  SITE (13): Xaa equals any amino acid
MRACLCAGVCMCXASCLGLPMNVVECYTWRVLVFHQFQDEELHDTVDLETIPLERQPRDVQHPVSTRILYLHVYFVAVTLTLIRILQLWTEAFSP

SEQ ID NO: 7464 - protein, 41 aa, Homo sapiens
MMLPVISLFLISLHLPIFCFQRLLLFKGFLFIANSSNLHIK

SEQ ID NO: 7465 - protein, 21 aa, Homo sapiens
  SITE (13): Xaa equals any amino acid
MKENPLLLLICIXGHLVVPPN

SEQ ID NO: 7466 - protein, 45 aa, Homo sapiens
MARWLLPCLPPLHSVTSWLLTVPTSCGAMGSAVCLCGRGLCRQNC

SEQ ID NO: 7467 - protein, 89 aa, Homo sapiens
MLLLVYFLLMSVIFGTKFFPLIIHMFNPCILNLIKLVFSLMPGSHQTPNVQATRASDDGSALLGTPSRPLGSIRQQFTPKECPLSAGSS

SEQ ID NO: 7468 - protein, 613 aa, Homo sapiens [sequence omitted]

SEQ ID NO: 7469 - protein, 39 aa, Homo sapiens
MPLFRTFKQLGLFLFLIIPIICSSLPPLGPVQSFLGCLY

SEQ ID NO: 7470 - protein, 140 aa, Homo sapiens
MCYSCARRDQAPVGWTAHLPVASWRRRAGSTCPAPLSVGLVFGLAAALVLADCGLMDQALFISYTASGSALSHACFCYALICSIPVSTYIVLVTSLRYHLFICECIFSKTSLRGNAPAYYSCCLCILHGNGSNQTHTVLD

SEQ ID NO: 7471 - protein, 45 aa, Homo sapiens
MQAHPIFIYHKRVFFLLKFIFYIIFCFFFLDISTLYCSLSTFCKK

SEQ ID NO: 7472 - protein, 50 aa, Homo sapiens
MLLLVVTLVNLSIYKLIKLVTALSKKLGAKGVLKNAHFMRCNCGEMRTRS

SEQ ID NO: 7473 - protein, 77 aa, Homo sapiens [sequence omitted]

SEQ ID NO: 7474 - protein, 26 aa, Homo sapiens
MCVSPVSVCPFLPSLHFINNWCNVSS

SEQ ID NO: 7475 - protein, 330 aa, Homo sapiens
MAKDQAVENILVSPVVVASSLGLVSLGGKATTASQAKAVLSAEQLRDEEVHAGLGELLRSLSNSTARNVTWKLGSRLYGPSSVSFADDFVRSSKQHYNCEHSKINFRDKRSALQSINEWAAQTTDGKLPEVTKDVERTDGALLVNAMFFKPHWDEKFHHKMVDNRGFMVTRSYTVGVMMMHRTGLYNYYDDEKEKLQIVEMPLAHKLSSLIILMPHHVEPLERLEKLLTKEQLKIWMGKMQKKAVAISLPKGVVEVTHDLQKHLAGLGLTEAIDKNKADLSRMSGKKDLYLASVFHATAFELDTDGNPLTRITGGGVRTQVFYADHPFIS

SEQ ID NO: 7476 - protein, 41 aa, Homo sapiens
MPTIWVKLCLLQVCHGLFPLLKHWSQPMPLCVTLAPVSYWL

SEQ ID NO: 7477 - protein, 43 aa, Homo sapiens [sequence omitted]

SEQ ID NO: 7478 - protein, 253 aa, Homo sapiens
MIVGSPRALTQPLGLLRLLQLVSTCVAFSLVASVGAWTGSMGNWSMFTWCFCFSVTLIILIVELCGLQARFPLSWRNFPITFACYAALFCLSASIIYPTTYVQFLSHGRSRDHAIAATFFSCIACVAYATEVAWTRARPGEITGYMATVPGLLKVLETFVACIIFAFISDPNLYQHQPALEWCVAVYAICFILAAIAILLNLGECTNVLPIPFPSFLSGLALLSVLLYATALVLWPLYQFDEKYGGSLGAREM

SEQ ID NO: 7479 - protein, 70 aa, Homo sapiens
MKFAPVYMYLSFICLCLFYCNSIDTHHCFVSDYLAFESSMREAFTELLILIKGESNVLKKMQNHHLCQSY

SEQ ID NO: 7480 - protein, 477 aa, Homo sapiens
  SITE (49): Xaa equals any amino acid
  SITE (57): Xaa equals any amino acid
  SITE (105): Xaa equals any amino acid
  SITE (109): Xaa equals any amino acid
  SITE (152): Xaa equals any amino acid
  SITE (194): Xaa equals any amino acid
  SITE (197): Xaa equals any amino acid
  SITE (198): Xaa equals any amino acid
  SITE (203): Xaa equals any amino acid
  SITE (459): Xaa equals any amino acid
  SITE (463): Xaa equals any amino acid
  SITE (468): Xaa equals any amino acid
MVNACWCGLLAALSLLLDASTDEAATENILKAELTMAALCGKLGLVTSXNAFITAIXKGSLPPHYALTVLNTTTAATLSNKSYSVQGQSVMMISPSSESHQQVVXVGQXLAVQPQGTVMLTSKNIQCMRTLLNLAHCHGAVLGTSWQLVLAXLQHLVWILGLKPSSGGALKPGRAVEGPSTVLTTAVMTDLPVXSNXXSRLFXSSQYLDDVSLHHLINALCSLSLEAMDMAYGNNKEPSLFAVAKLLETGLVNMHRIEILWRPLTGHLLEVCQHPNSRMREWGAEALTSLIKAGLTFNHDPPLSQNQRLQLLLLNPLKEMSNINHPDIRLKQLECVLQILQSQGDSLGPGWPLVLGVMGAIRNDQGESLIRTAFQCLQLVVTDFLPTMPCTCLQIVVDVAGSFGLHNQELNISLTSIGLLWNISDYFFQRGETIEKELNKEEAAQQKQAEEKGVGLNRXFHPXPAFDXWGYALCKIG

SEQ ID NO: 7481 - protein, 43 aa, Homo sapiens
MVDLILLLFHSAVGCNLKSRGALQTLHDSMTLSSFYSSKTSLI

SEQ ID NO: 7482 - protein, 21 aa, Homo sapiens
  SITE (20): Xaa equals any amino acid
MFTLAFFFLINFLNVKYDRXS

SEQ ID NO: 7483 - protein, 461 aa, Homo sapiens
  SITE (424): Xaa equals any amino acid
  SITE (459): Xaa equals any amino acid
MAVYVGMLRLGRLCAGSSGVLGARAALSRSWQEARLQGVRFLSSREVDRMVSTPIGGLSYVQGCTKKHLNSKTVGQCLETTAQRVPEREALVVLHEDVRLTFAQLKEEVDKAASGLLSIGLCKGDRLGMWGPNSYAWVLMQLATAQAGIILVSVNPAYQAMELEYVLKKVGCKALVFPKQFKTQQYYNVLKQICPEVENAQPGALKSQRLPDLTTVISVDAPLPGTLLLDEVVAAGSTRQHLDQLQYNQQFLSCHDPINIQFTSGTTGSPKGATLSHYNIVNNSNILGERLKLHEKTPEQLRMILPNPLYHCLGSVAGTMMCLMYGATLILASPIFNGKKALEAISRERGTFLYGTPTMFVDILNQPDFSSYDISTMCGGVIAGSPAPPELIRAIINKINMKDLVVAYGTTENSPVTFAHFPEXTPKPLDKEKRAEYASHGGEPLTKTSKSHLPSPSWXGS

SEQ ID NO: 7484 - protein, 89 aa, Homo sapiens; identical to SEQ ID NO: 6086

SEQ ID NO: 7485 - protein, 255 aa, Homo sapiens
MKVLATSFVLGSLGLAFYLPLVVTTPKTLAIPEKLQEAVGKVIINATTCTVTCGLGYKEETVCEVGPDGVRRKCQTRRLECLTNWICGMLHFTILIGKEFELSCLSSDILEFGQEAFRFTWRLARGVISTDDEVFKPFQANSHFVKFKYAQEYDSGTYRCDVQLVKNLRLVKRLYFGLRVLPPNLVNLNFHQSLTEDQKLIDEGLEVNLDSYSKPHHPKWKKKVASALGIGIAIGVVGGVLVRIVLCALRGGLQQ

SEQ ID NO: 7486 - protein, 975 aa, Homo sapiens [sequence omitted]

SEQ ID NO: 7487 - protein, 5 aa, Homo sapiens
MSRLL

SEQ ID NO: 7488 - protein, 170 aa, Homo sapiens
MRPPSSSGAAASQTVDTFVTVGNVEKEVFFMVFLVQLTHCGTGGWNDIVDKEKQGILSSEMNSLPDQEVELTNCEIRRHQVFLFVQVSYPSFGSLFYYHRHPVRVFLSDLLALRAALLERMLFFVHELHPPGNRAGQGWAEGTQGGRDGGRRRRRRRAGGFSGADPRICA

SEQ ID NO: 7489 - protein, 166 aa, Homo sapiens
  SITE (150): Xaa equals any amino acid
MNIKHLVDPIDDLFLAAKKIPGISSTGVGDGGNELGMGKVKEAVRRHIRHGDVIACDVEADFAVIAGVSNWGGYALACALYILYSCAVHSQYLRKAVGPSRAPGDQAWTQALPSVIKEEKMLGILVQHKVRSGVSGIVGMEVDGLPFHNXHAEMIQKLVDVTTAQV

SEQ ID NO: 7490 - protein, 28 aa, Homo sapiens
MLIFILLATNLFVSSLFEILMYRSFQNN

SEQ ID NO: 7491 - protein, 145 aa, Homo sapiens
MPSGFQTCLLFTLSPFSLSKIVGVPSQQLPGQLSEQGGLCGHEGEPARTVPETQLPLPFNSAGPPHLKCTGAGKRVWSPPRRAAQEVSLQLVSCHPCRQHTSRAFSLATDRTASARVCCRSPLSTLIHHTRGGQRCREHGLSLPL

SEQ ID NO: 7492 - protein, 74 aa, Homo sapiens
  SITE (17): Xaa equals any amino acid
FLKSKAGALPTGSPTVXILNILLSVSGCLLSCYRGSNCLHPLQNMGAPKLWIFSHRKTRLGAVAPTYNPSTLGG

SEQ ID NO: 7493 - protein, 26 aa, Homo sapiens
MKWSLLKVVLVFVFVCGFLKRAYPAT

SEQ ID NO: 7494 - protein, 43 aa, Homo sapiens
MEISVIKIFQDETTLKIKLCLVSLSSLLVSLLLLILPESTSLW

SEQ ID NO: 7495 - protein, 65 aa, Homo sapiens
MLGITRLWVLLKPCFPRCYSSTGGEVLPRCCEVEAEVQVPHSAPMDSREGGTVPYFGGCGSPRFY

SEQ ID NO: 7496 - protein, 34 aa, Homo sapiens
MENFFFSFYLFLITLIPNGRTLSTTADHCKIPCI

SEQ ID NO: 7497 - protein, 65 aa, Homo sapiens
MFADFIVVTATVQRCPGSPPLSEILWKDEPFAISSHAGLPWLSSWPAPPWTWSWISRRREHGRGS

SEQ ID NO: 7498 - protein, 105 aa, Homo sapiens
MSALTRLASFARVGGRLFRSGCARTAGDGGVRHAGGGVHIEPRYRQFPQLTRSQVFQSEFFSGLMWFWILWRFWHDSEEVLGHFPYPDPSQWTDEELGIPPDDED

SEQ ID NO: 7499 - protein, 40 aa, Homo sapiens
MIPLRRGMVGGLLLLLATANKLLAASFRDLMDVLTCPRPR

SEQ ID NO: 7500 - protein, 95 aa, Homo sapiens
MPWLTILRFLQASGHVRAQDLALLGDTSVCIRCGCGGCSLSIANYEWVPLRRKDCKRYETSEKTSCLLLPSACSRQNAVGFSRLPVPKLSCLLHG

SEQ ID NO: 7501 - protein, 132 aa, Homo sapiens
MDVLFVAIFAVPLILGQEYEDEERLGEDEYYQVVYYYTVTPSYDDFSADFTIDYSIFESEDRLNRLDKDITEAIETTISLETARADHPKPVTVKPVTTEPQSPDLNDAVSSLRSPIPLLLSCAFVQVGMYFM

SEQ ID NO: 7502 - protein, 83 aa, Homo sapiens
MKCLAPMWVSLWDSDPLRSCLLLLIPHFSVFLILAAVSCLPLSTATRWRGRDPVLLIICLLKNLQNGKITICAELIISLKFKT

SEQ ID NO: 7503 - protein, 52 aa, Homo sapiens
MGGCLLSLSLCFVPVVRLAASVARWAWLEPWVRQVAGGDRERLRGKWWHLLL

SEQ ID NO: 7504 - protein, 69 aa, Homo sapiens
MPCQPGQVPSCQCTFGLLLMLPSLPSPASQPRPFCSSMEYFHGCASPSQAIIGGFPFASVALADILCLQ

SEQ ID NO: 7505 - protein, 86 aa, Homo sapiens
MTLPSRALASLGVGVWGMLRLNQVTVSCGGSRWSSRVALGAFSWVCGVALVLQPSGGGLGLTSPSEGCWEGELALAVLRAPGGSPS

SEQ ID NO: 7506 - protein, 34 aa, Homo sapiens [sequence omitted]

SEQ ID NO: 7507 - protein, 80 aa, Homo sapiens
MAFLPLTLTFCLAPLAPLLPSIWGPTPASCVVWPLLTILPVPAQASPSTDTAHLWQRPTTGSPTRLVRPLPRPGLPPMWA

SEQ ID NO: 7508 - protein, 69 aa, Homo sapiens
MFESAGQVLLHIAGLQVWVFLTCLSSFLVPLSYSGYIPLMVMAEAHQMASPTTQALFKLLFASHLLTFY

SEQ ID NO: 7509 - protein, 52 aa, Homo sapiens
MTLHILLNLLYFSLVAFTTWLTVYLPICYCLPIPAGTQTLGRQRLCLIHYCI

SEQ ID NO: 7510 - protein, 48 aa, Homo sapiens
MHFSVAHSIWGILILLSLYEGVISWVFNFQMFTKLLLCAKHYSHCFES

SEQ ID NO: 7511 - protein, 39 aa, Homo sapiens
MHEKAWNLILLWWLSLDLLGVAKTAMWAQWCGLNDHKGK

SEQ ID NO: 7512 - protein, 36 aa, Homo sapiens
MLYILLKPLLCLSVNCTNIYQMLTKSQGLDLALGRN

SEQ ID NO: 7513 - protein, 64 aa, Homo sapiens [sequence omitted]

SEQ ID NO: 7514 - protein, 47 aa, Homo sapiens
MPKTCLPILCLPLTQAVVLAQLNNFSSLNIFIFKIKNKMYYIWIYDK

SEQ ID NO: 7515 - protein, 118 aa, Homo sapiens
MEFVSGGKTEILMLFTLLVSCYVFLPLALPCFAFFFSFWPIPFYMCPQQRWGDTEHPGSFPALLGRPRLQAPAVETLKGNKQPSTLPDPRLFREAAHFHPGPRTPSLCPTRISLNGRD

SEQ ID NO: 7516 - protein, 21 aa, Homo sapiens
MAFVLLFCFVGLQSSRGRAVQ

SEQ ID NO: 7517 - protein, 81 aa, Homo sapiens
MGAGILALLLPLESVLTCSWISVSTSERQLWQSSQKATILSLKLDSCFCGHSGLKGKNEDTDSSVPIIPSKTHTHLGKHLI

SEQ ID NO: 7518 - protein, 25 aa, Homo sapiens
MISLLWTLKLFSRNLDYSQKRKSWC

SEQ ID NO: 7519 - protein, 37 aa, Homo sapiens
MFSLLWLVCVPSNSSVANVTASRGGVFKRSLGHEGFS

SEQ ID NO: 7520 - protein, 34 aa, Homo sapiens
KWLLFIFLLCLQLVNALLSLFQERFVHCPARFVS

SEQ ID NO: 7521 - protein, 32 aa, Homo sapiens
EKKSMSVSDIYALESLGRSLFTLNSMCLPLSF

SEQ ID NO: 7522 - protein, 31 aa, Homo sapiens
MLLFLSITNSLSFISVDKPFGQSEDVCPVIS

SEQ ID NO: 7523 - protein, 56 aa, Homo sapiens
MGIQLALAPALSWGCSSASCPVCCGKTEPLVRLARRRRSRRQAAQIWELSAIVPSV

SEQ ID NO: 7524 - protein, 45 aa, Homo sapiens
MSLLSPAIPALTLIFILMFFSFPFRAHTVVTIVASGFLGLSPLCG

SEQ ID NO: 7525 - protein, 170 aa, Homo sapiens
  SITE (14): Xaa equals any amino acid
  SITE (95): Xaa equals any amino acid
  SITE (146): Xaa equals any amino acid
  SITE (158): Xaa equals any amino acid
MNHPPEGSTVVFFXLFFFFETVLLCCPGWSAVVQSRLAATSASWFKRFSFLSLLSSWEYGCAPPRLANFCIFSRDGVSPCWPGWSRMPDLVVHPXRPPKVLGLQVCAAAPGQAFFSLGLLWPPRLGTRGPPGTGIPSCTLIHGALXEMQVLQGTGFHXFWGDQPSSPRIP

SEQ ID NO: 7526 - protein, 63 aa, Homo sapiens [sequence omitted]

SEQ ID NO: 7527 - protein, 33 aa, Homo sapiens
MSSGLFLVLFCFLCVFVGFFDFHCWCDILVKSS

SEQ ID NO: 7528 - protein, 65 aa, Homo sapiens [sequence omitted]

SEQ ID NO: 7529 - protein, 71 aa, Homo sapiens
  SITE (47): Xaa equals any amino acid
  SITE (70): Xaa equals any amino acid
MFYFVLFIYSSSETWSGSVAQDGVHGVIIGHCSVELPGSGDPPASAXLVAGTIGTCPTMPGFVYFLNDVXN

SEQ ID NO: 7530 - protein, 27 aa, Homo sapiens
MRVTVSSHPCQRLVLSVFWLLAILIGV

SEQ ID NO: 7531 - protein, 47 aa, Homo sapiens
MFLCLFFFFFNATQGNIFISFLSGLPQCIFISFETKRFWKLFFCSFK

SEQ ID NO: 7532 - protein, 40 aa, Homo sapiens
MRSDCVLIWQLVGVLLASGLSGDRAPLIVLTACDKAWATV

SEQ ID NO: 7533 - protein, 36 aa, Homo sapiens
  SITE (32): Xaa equals any amino acid
MPHLFFLFLSTNHFLLSTPYLISLITGPPNSXLRQH

SEQ ID NO: 7534 - protein, 46 aa, Homo sapiens
MKAQMLLSLAWPLPLSTANSCLPQFPRGLYSAHYCPSCLLFLEALS

SEQ ID NO: 7535 - protein, 465 aa, Homo sapiens
MEEEDEEARALLAGGPDEADRGAPAAPGALPALCDPSRLAHRLLVLLLMCFLGFGSYFCYDNPAALQTQVKRDMQVNTTKFMLLYAWYSWPNVVLCFFGGFLIDRVFGIRWGTIIFSCFVCIGQVVFALGGIFNAFWLMEFGRFVFGIGGESLAVAQNTYAVSWFKGKELNLVFGLQLSMARIGSTVNMNLMGWLYSKIEALLGSAGHTTLGITLMIGGITCILSLICALALAYLDQRAERILHKEQGKTGEVIKLTDVKDFSLPLWLIFIICVCYYVAVFPFIGLGKVFFTEKFGFSSQAASAINSVVYVISAPMSPVFGLLVDKTGKNIIWVLCAVAATLVSHMMLAFTMWNPWIAMCLLGLSYSLLACALWPMVAFVVPEHQLGTAYGFMQSIQNLGLAIISIIAGMILDSRGYLFLEVFFIACVSLSLLSVVLLYLVNRAQGGNLNYSARQREEIKFSHTE

SEQ ID NO: 7536 - protein, 126 aa, Homo sapiens
MEFLFNKTGWAFAALCFVLAMTSGQMWNHIRGPPYAHKNPHTGHVNYIHGSSQAQFVAETHIVLLFNGGVTLGMVLLCEAATSDMDIGKRKIMCVAGIGLVVLFFSWMLSIFRSKYHGYPYSFLMS

SEQ ID NO: 7537 - protein, 50 aa, Homo sapiens
MTFGIVVDLTPVFVLVLFLPAFLFLSLPSWSLPRDPTHVKYGLEDCMNAS

SEQ ID NO: 7538 - protein, 65 aa, Homo sapiens
MGARTPHWGQGQCWRILIPFLLSFTFVFNLGVRGEALLGNISRAFLHLPWFPAQPKIIWQPSGWN

SEQ ID NO: 7539 - protein, 52 aa, Homo sapiens
MSSWPFCPSLCFSLSNLIPGSGLLPVETGELGLLSAAYLLPFTCIQLLGLGP

SEQ ID NO: 7540 - protein, 107 aa, Homo sapiens
MGFVPTPEILWETNSFNSLSSRHQESLNNHGLLCLGFFFFLALFLVFVCVCVCCMHMRPRLTGGLGESASNSVNVIVNYISYLRSHCFQINSVFHEKKKKKNSCGRQ

SEQ ID NO: 7541 - protein, 155 aa, Homo sapiens [sequence omitted]

SEQ ID NO: 7542 - protein, 245 aa, Homo sapiens
  SITE (79): Xaa equals any amino acid
MGGASRRVESGAWAYLSPLVLRKELESLVENEGSEVLALPELPSAHPIIFWNLLWYFQRLRLPSILPGLVLASCDGPSXSQAPSPWLTPDPASVQVRLLWDVLTPDPNSCPPLYVLWRVHSQIPQRVVWPGPVPASLSLALLESVLRHVGLNEVHKAVGLLLETLGPPPTGLHLQRGIYREILFLTMAALGKDHVDIVAFDKKYKSAFNKLASSMGKEELRHRRAQMPTPKAIDCRKCFGAPPEC

SEQ ID NO: 7543 - protein, 322 aa, Homo sapiens
MAVIIGVAVGAGVAFLVLMATIVAFCCARSQRNLKGVVSAKNDIRVEIVHKEPASGREGEEHSTIKQLMMDRGEFQQDSVLKQLEVLKEEEKEFQNLKDPTNGYYSVNTFKEHHSTPTISLSSCQPDLRPAGKQRVPTGMSFTNIYSTLSGQGRLYDYGSGLCWAWAARPSSFVSGSSREAPSATAAPSWTRSVTAASAAAASRMAMCSSTRPARLLLPPPTTPSPRPRTLTPVDPCSGGCRLTSKDHTPRVGTGQGRGQGTFWLSRDEGYFAEDTRIGHFQDSLPAPLPLPSFEALIKHKSGSPGAVCQRWAGGETDRGCG

SEQ ID NO: 7544 - protein, 470 aa, Homo sapiens
MSRLGALGGARAGLGLLLGTAAGLGFLCLLYSQRWKRTQRHGRSQSLPNSLDYTQTSDPGRHVMLLRAVPGGAGDASVLPSLPREGQEKVLDRLDFVLTSLVALRREVEELRSSLRGLAGEIVGEVRCHMEENQRVARRRRFPFVRERSDSTGSSSVYFTASSGATFTDAESEGGYTTANAESDNERDSDKESEDGEDEVSCETVKMGRKDSLDLEEEAASGASSALEAGGSSGLEDVLPLLQQADELHRGDEQGKREGFQLLLNNKLVYGSRQDFLWRLARAYSDMCELTEEVSEKKSYALDGKEEAEAALEKGDESADCHLWYAVLCGQLAEHESIQRRIQSGFSFKEHVDKAIALQPENPMAHFLLGRWCYQVSHLSWLEKKTATALLESPLSATVEDALQSFLKAEELQPGFSKAGRVYISKCYRELGKNSEARWWMKLALELPDVTKEDLAIQKDLEELEVILRD

SEQ ID NO: 7545 - protein, 364 aa, Homo sapiens
  SITE (297): Xaa equals any amino acid
MLPTFLLMNLLSLAGDVALQQLVHLEQAVSGELCRRRVLREEQEHKTKDPKEKNTSSETTMEEELGLVGATADDTEAELIRGICEMELLDGKQTLAAFVPLLLKVCNNPGLYSNPDLSAAASLALGKFCMISATFCDSQLRLLFTMLEKSPLPIVRSNLMVATGDLAIRFPNLVDPWTPHLYARLRDPAQQVRKTAGLVMTHLILKDMVKVKGQVSEMAVLLIDPEPQIAALAKNFFNELSHKGNAIYNLLPDIISRLSDPELGVEEEPFHTIMKQLLSYITKDKQTESLVEKLCQXFRTSRTERHSETWPTVCHSCPSQSEASVRCLTILTVLETNCQMSPSSVLFCQLWASCDVGPSLRARL

SEQ ID NO: 7546 - protein, 95 aa, Homo sapiens
MRSQHITWCLLFSSPLATLPAALPLGACAAVFTVIGSEKQSECSLLRESRAKYHGCTHGQISSSLKQHPRWMYSHQEDLKVWSLVEKKQKQCMGD

SEQ ID NO: 7547 - protein, 118 aa, Homo sapiens
MKDLWFLLLVVAAPTWVLSQVRLQESGPGLVSPSQTLSLTCSVSGINIGGGKYYWAWVRQRPGEGPEWVGYISYTGVADYNPSLRGRLTISLGESNSFSLTLTSMTAADAVVYYCATD

SEQ ID NO: 7548 - protein, 65 aa, Homo sapiens
MTNGHQVLLLLLLTSAVAAGPWPQVHAGQWGWMCLPPGLPSVQARSGLGGLPGGPQWVPGGARGY

SEQ ID NO: 7549 - protein, 40 aa, Homo sapiens
MSASLCLFTQVLKGIVWLPILMFHVGATKTSGFSVEQLYS

SEQ ID NO: 7550 - protein, 78 aa, Homo sapiens [sequence omitted]

SEQ ID NO: 7551 - protein, 67 aa, Homo sapiens
MSLFLTLALCSVLLVHLNVLARNCFYDSGFVVHPWIWLGHSLPYFYFSPLSQRLFSYLWTFIFPCRL

SEQ ID NO: 7552 - protein, 50 aa, Homo sapiens
MQPPFVLTTTTMISLFLALISTKKVHLTIPQPFTSHSRLSFDVFKRKARA

SEQ ID NO: 7553 - protein, 82 aa, Homo sapiens
MGQMQLCWGHWETFLPLLRLLVAIVLCKVSIMKEVISFGRLLETMLIPWPCVTLMVMERKSFLLDLRILISEFLRKMRLWQK

SEQ ID NO: 7554 - protein, 139 aa, Homo sapiens
MCVWGVCVCVVARVCVWLGLAELFRGRVRDCGKITHFPTYLLYWTLKNNNKHQVKFLNHVLCVCVCVCVCVCICKCICICMLLYFQVNNYIEDCIAQKHSLIKVLRLVCLQSVCNSGLKQKVLDYYKREILQVSIFLNY

SEQ ID NO: 7555 - protein, 41 aa, Homo sapiens
MGLKLPIFLWFLYFFIPLSSCYLLLLPHLPSGSWDSMLSFP

SEQ ID NO: 7556 - protein, 106 aa, Homo sapiens
  SITE (14): Xaa equals any amino acid
  SITE (29): Xaa equals any amino acid
MGSLSGCALPFCLXVFFLTVSPSAVGLLXFAGGPLQTLFAWVSPVEAAEQQRLLPVLSSGSFVSEGTCQMPARALLYEVSVGPYWEIPPSQDTRRSGTYLRRQSDP

SEQ ID NO: 7557 - protein, 128 aa, Homo sapiens
MPVFVCSIGLCFLFSILLLFPPFQFSYICWLSQASVYSPSPSLSNLEVLLCLSILLMIIFPFLISIIHIFSIGRLSTHMGAHTHTHTHTHTHTHTQVCYWPLLLISQENEPFRMFLPLHSALTQNFCS

SEQ ID NO: 7558 - protein, 514 aa, Homo sapiens
MSWPRRLLLRYLFPALLLHGLGEGSALLHPDSRSHPRSLEKSAWRAFKESQCHHMLKHLHNGARITVQMPPTIEGHWVSTGCEVRSGPEFITRSYRFYHNNTFKAYQFYYGSNRCTNPTYTLIIRGKIRLRQASWIIRGGTEADYQLHNVQVICHTEAVAEKLGQQVNRTCPGFLADGGPWVQDVAYDLWREENGCECTKAVNFAMHELQLIRVEKQYLHHNLDHLVEELFLGDIHTDATQRMFYRPSSYQPPLQNAKNHDHACIACRIIYRSDEHHPPILPPKADLTIGLHGEWVSQRCEVRPEVLFLTRHFIFHDNNNTWEGHYYHYSDPVCKHPTFSIYARGRYSRGVLSSRVMGGTEFVFKVNHMKVTPMDAATASLLNVFNGNECGAEGSWQVGIQQDVTHTNGCVALGIKLPHTEYEIFKMEQDARGRYLLFNGQRPSDGSSPDRPEKRATSYQMPLVQCASSSPRAEDLAEDSGSSLYGRAPGRHTWSLLLAALACLVPLLHWNIRR

SEQ ID NO: 7559 - protein, 93 aa, Homo sapiens
MATFSLCYLMAFPLCAGIAGISVCVKISCFYKDISQTGLRPTLKAYLNFNLLFSGPISKYSLILRYWYLGLQHTNFGVDTIQPITNCAHEMIY

SEQ ID NO: 7560 - protein, 105 aa, Homo sapiens [sequence omitted]

SEQ ID NO: 7561 - protein, 52 aa, Homo sapiens
  SITE (39): Xaa equals any amino acid
MVAVDFSCLSFILLGILVLYIYFVMYACSIPTLFSVFYXEEMLNLSKLSCIY

SEQ ID NO: 7562 - protein, 72 aa, Homo sapiens
MPLGVVPRAVWSTLAWVCIILQTLKTSLFCQTTFCGEPEDSGFFEGILDVCVLVKEAVIRLNHNPQDLLDSD

SEQ ID NO: 7563 - protein, 57 aa, Homo sapiens
MHKCNTVTRELLQLSLLILPSQCGNCATSTKRGPRLLKYFRTSPQEQTPLHLDSDCS

SEQ ID NO: 7564 - protein, 16 aa, Homo sapiens
LLLPVLASSVPSHSAT

SEQ ID NO: 7565 - protein, 28 aa, Homo sapiens
MNSFWSKLLVLPLLAPLSMARASACQRW

SEQ ID NO: 7566 - protein, 58 aa, Homo sapiens
MVSLCSGLPSSCLLLGSTAAIIQRQVCLFQGARQWNPVSEFLRAHHHCGNRAGLPAVL

SEQ ID NO: 7567 - protein, 68 aa, Homo sapiens
  SITE (10): Xaa equals any amino acid
MTWHSRESFXLLRVVAPSQAPGMQVSPSQRAWRRPLHRCHVAAPRPHHFAFFRNPFSWSFIKLLYRYL

SEQ ID NO: 7568 - protein, 333 aa, Homo sapiens
  SITE (97): Xaa equals any amino acid
MLMFAVIVASSGLLLMIERGILAEMKPLPLHPPGREGTAWRGKAPKPGGLSLRAGDADLQVRQDVRNRTLRAVCGQPGMPRDPWDLPVGQRRTLLRXILVSDRYRFLYCYVPKVACSNWKRVMKVLAGVLDSVDVRLKMDHRSDLVFLADLRPEEIRYRLQHYFKFLFVREPLERLLSAYRNKFGEIREYQQRYGAEIVRRYRAGAGPSPAGDDVTFPEFLRYLVDEDPERMNEHWMPVYHLCQPCAVHYDFVGSYERLEADANQVLEWVRAPPHVRFPARQAWYRPASPESLHYHLCSAPRALLQDVLPKYILDFSLFAYPLPNVTKEACQQ

SEQ ID NO: 7569 - protein, 72 aa, Homo sapiens [sequence omitted]

SEQ ID NO: 7570 - protein, 108 aa, Homo sapiens
MKALCLLLLPVLGLLVSSKTLCSMEEAINERIQEVAGSLIFRAISSIGLECQSVTSRGDLATCPRGFAVTGCTCGSACGSWDVRAETTCHCQCAGMDWTGARCCRVQP

SEQ ID NO: 7571 - protein, 46 aa, Homo sapiens
MVTASLLLLPAVMAIVFPITWAVQSQSWAAEFNGACFQVLHGKLYS

SEQ ID NO: 7572 - protein, 42 aa, Homo sapiens
MDQFLQYLLECMLLCTTAGASGAHLCTNEMTLLEAILYLQWM

SEQ ID NO: 7573 - protein, 296 aa, Homo sapiens
  SITE (281): Xaa equals any amino acid
MAVLAPLIALVYSVPRLSRWLAQPYYLLSALLSAAFLLVRKLPPLCHGLPTQREDGNPCDFDWREVEILMFLSAIVMMKNRRSITVEQHIGNIFMFSKVANTILFFRLDIRMGLLYITLCIVFLMTCKPPLYMGPEYIKYFNDKTIDEELERDKRVTWIVEFFANWSNDCQSFAPIYADLSLKYNCTGLNFGKVDVGRYTDVSTRYKVSTSPLTKQLPTLILFQGGKEAMRRPQIDKKGRAVSWTFSEENVIREFNLNELYQRAKKLSKAGDNIPEEQPVXSTPTTVSDGENKKDK

SEQ ID NO: 7574 - protein, 56 aa, Homo sapiens
MRVKISYLMIALTVVGCIFMVIEGKKAAQRHETLTSLNLEKKARLKEEAAMKAKTE

SEQ ID NO: 7575 - protein, 570 aa, Homo sapiens
MGFLQLLVVAVLASEHRVAGAAEVFGNSSEGLIEFSVGKFRYFELNRPFPEEAILHDISSNVTFLIFQIHSQYQNTTVSFSPTLLSNSSETGTASGLVFILRPEQSTCTWYLGTSGIQPVQNMAILLSYSERDPVPGGCNLEFDLDIDPNIYLEYNFFETTIKFAPANLGYARGVDPPPCDAGTDQDSRWRLQYDVYQYFLPENDLTEEMLLKHLQRMVSVPQVKASALKVVTLTANDKTSVSFSSLPGQGVIYNVIVWDPFLNTSAAYIPAHTYACSFEAGEGSCASLGRVSSKVFFTLFALLGFFICFFGHRFWKTELFFIGFIIMGFFFYILITRLTPIKYDVNLILTAVTGSVGGMFLVAVWWRFGILSICMLCVGLVLGFLISSVTFFTPLGNLKIFHDDGVFWVTFSCIAILIPVVFMGCLRILNILTCGVIGSYSVVLAIDSYWSTSLSYITLNVLKRALNKDFHRAFTNVPFQTNDFIILAVWGMLAVSGITLQIRRERGRPFFPPHPYKLWKQERERRVTNILDPSYHIPPLRERLYGRLTQIKGLFQKEQPAGERTPLLL

SEQ ID NO: 7576 - protein, 47 aa, Homo sapiens; identical to SEQ ID NO: 6347

SEQ ID NO: 7577 - protein, 210 aa, Homo sapiens
  SITE (127): Xaa equals any amino acid
MRCLTTPMLLRALAQAARAGPPGGRSLHSSAVAATYKYVNMQDPEMDMKSVTDRAARTLLWTELFRGLGMTLSYLFREPATINYPFEKGPLSPRFRGEHALRRYPSGEERCIACKLCEAICPAQAIXIEAEPRADGSRRTTRYDIDMTKCIYCGFCQEACPVDAIVEGPNFEFSTETHEELLYNKEKLLNNGDKWEAEIAANIQADYLYR

SEQ ID NO: 7578 - protein, 32 aa, Homo sapiens
MQRMLVLLFFFFSLLAINPAETICGYGSTWKF

SEQ ID NO: 7579 - protein, 126 aa, Homo sapiens [sequence omitted]

SEQ ID NO: 7580 - protein, 33 aa, Homo sapiens
  SITE (10): Xaa equals any amino acid
MDSTLRQGRXLLTLVPASLFSLTLGGPGPWKDP

SEQ ID NO: 7581 - protein, 217 aa, Homo sapiens
MVPGAAGWCCLVLWLPACVAAHGFRIHDYLYFQVLSPGDIRYIFTATPAKDFGGIFHTRYEQIHLVPAEPPEACGELSNGFFIQDQIALVERGGCSFLSKTRVVQEHGGRAVIISDNAVDNDSFYVEMIQDSTQRTADIPALFLLGRDGYMIRRSLEQHGLPWAIISIPVNVTSIPTFELLQPPWTFWEKSLSHIPAISDSELGRGNPGILLLGIWR

SEQ ID NO: 7582 - protein, 93 aa, Homo sapiens
MGLKLNGRYISLILAVQIAYLVQAVRAAGKCDAVFKGFSDCLLKLGDSMANYPQAWTTRRTSRPCAHTGRISTAARSQPLRIARKGRKICGIN

SEQ ID NO: 7583 - protein, 127 aa, Homo sapiens
LPTKILVKPDRTFEIKIGQPTVSYFLKAAAGIEKGARQTGKEVAGLVTLKHVYEIARIKAQDEAFALQDVPLSSVVRSIIGSARSLGIRVVKDLSSEELAAFQKERAIFLAAQKEADLAAQEEAAKK

SEQ ID NO: 7584 - protein, 49 aa, Homo sapiens
MGGTCVLLLSSHTQSCLFVSCCHCQLIVETAISFSYSALPSAFWPLQLP

SEQ ID NO: 7585 - protein, 75 aa, Homo sapiens
MSWLFPATILFEEKICFSLFPRKLVGQHGHYSSCAVTPAPRCLELSVLTFMHDCKASWSIFYGASVCFRPMTFVR

SEQ ID NO: 7586 - protein, 188 aa, Homo sapiens
VLGAAHPVPPGLPLFLPYYICVADEDDYRDFVNLDHAHSLLRDYQQREGIAMDQLLSQSLPNDGDEKYEKTIIKSGDQTFYKFMKRIAACQEQILRYSWSGEPLFLTCPTSEVTELPACSQCGGQRIFEFQLMPALVSMLKSANLGLSVEFGTILVYTCEKSCWPPNHQTPMEEFCIIQEDPDELLFK

SEQ ID NO: 7587 - protein, 198 aa, Homo sapiens
MYRERLRTLLVIAVVMSLLNALSTSGGSISWNDFVHEMLAKGEVQRVQVVPESDVVEVYLHPGAVVFGRPRLALMYRMQVANIDKFEEKLRAAEDELNIEAKDRIPVSYKRTGFFGKCPVLCGDDGSGPGHPVVCFPSGRDDWRHRRRWTSRSRLLCWKALMGSVGADHTRELRKPSGSHRPPFNVVIPWWWKQDDGP

SEQ ID NO: 7588 - protein, 37 aa, Homo sapiens
MLFPILLQTMFSAYLGSEQYKLLIKALQLSEPGKEIH

SEQ ID NO: 7589 - protein, 100 aa, Homo sapiens [sequence omitted]

SEQ ID NO: 7590 - protein, 326 aa, Homo sapiens
MRTEAQVPALQPPEPGLEGAMGHRTLVLPWVLLTLCVTAGTPEVWVQVRMEATELSSFTIRCGFLGSGSISLVTVSWGGPDGAGGTTLAVLHPERGIRQWAPARQARWETQSSISLILEGSGASSPCANTTFCCKFASFPEGSWEACGSLPPSSDPGLSAPPTPAPILRADLAGILGVSGVLLFGCVYLLHLLRRHKHRPAPRLQPSRTSPQAPRARAWAPSQASQAALHVPYATINTSCRPATLDTAHPHGGPSWWASLPTHAAHRPQGPAAWASTPIPARGSFVSVENGLYAQAGERPPHTGPGLTLFPDPRGPRAMEGPLGVR

SEQ ID NO: 7591 - protein, 383 aa, Homo sapiens
MPSGCRCLHLVCLLCILGAPGQPVRADDCSSHCDLAHGCCAPDGSCRCDPGWEGLHCERCVRMPGCQHGTCHQPWQCICHSGWAGKFCDKDEHICTTQSPCQNGGQCMYDGGGEYHCVCLPGFHGRDCERKAGPCEQAGSPCRNGGQCQDDQGFALNFTCRCLVGFVGARCEVNVDDCLMRPCANGATCLDGINRFSCLCPEGFAGRFCTINLDDCASRPCQRGARCRDRVHDFDCLCPSGYGGKTCELVLPVPDPPTTVDTPLGPTSAVVVPATGPAPHSAGAGLLRISVKEVVRRQEAGLGEPSLVALVVFGALTAALVLATVLLTLRAWRRGVCPPGPCCYPAPHYAPACQDQECQVSMLPAGLPLPRDLPPEPGKTTAL

SEQ ID NO: 7592 - protein, 42 aa, Homo sapiens
MNLLLLVSTWMMLIQEGSCFHMTLMNELAKRCYWSYFVRSHI

SEQ ID NO: 7593 - protein, 549 aa, Homo sapiens
  SITE (452): Xaa equals any amino acid
MKIATVSVLLPLALCLIQDAASKNEDQEMCHEFQAFMKNGKLFCPQDKKFFQSLDGIMFINKCATCKMILEKEAKSQKRARHLARAPKATAPTELNCDDFKKGERDGDFICPDYYEAVCGTDGKTYDNRCALCAENAKTGSQIGVKSEGECKSSNPEQDVCSAFRPFVRDGRLGCTRENDPVLGPDGKTHGNKCAMCAELFLKEAENAKREGETRIRRNAEKDFCKEYEKQVRNGRLFCTRESDPVRGPDGRMHGNKCALCAEIFKQRFSEENSKTDQNLGKAEEKTKVKREIVKLCSQYQNQAKNGILFCTRENDPIRGPDGKMHGNLCSMCQAYFQAENEEKKKAEARARNKRESGKATSYAELCSEYRKLVRNGKLACTRENNPIQGPDGKVHGNTCSMCEVFFQAEEEEKKKKEGKSRNKRQSKSTASFVELCSEYRKSRKNGRLFCXRENDPIQGPDGKMHGNTCSMCEAFFQQEERARAKAKREAAKEICSEFRDQVRNGTLICTREHNPVRGPDGKMHGNKCAMCASVFKLEKKKKKKKKKK

SEQ ID NO: 7594 - protein, 105 aa, Homo sapiens [sequence omitted]

SEQ ID NO: 7595 - protein, 357 aa, Homo sapiens
  SITE (44): Xaa equals any amino acid
MCFATAAFFFFFTLLMLCVSSSRDPRAAIQNGFWFFKFLILVGXTVGAFYIPDGSFTNIWFYFGVVGSFLFILIQLVLLIDFAHSWNQRWLGKAEECDSRAWYAGLFFFTLLFYLLSIAAVALMFMYYTEPSGCHEGKVFISLNLTFCVCVSIAAVLPKVQDAQPNSGLLQASVITLYTMFVTWSALSSIPEQKCNPHLPTQLGNETVVAGPEGYETQWWDAPSIVGLIIFLLCTLFISLRSSDHRQVNSLMQTEECPPMLDATQQQQQQVAACEGRAFDNEQDGVTYSYSFFHFCLVLASLHVMMTLTNWYKPGETRKMISTWTAVWVKICASWAGLLLYLWTLVAPLLLRNRDFS

SEQ ID NO: 7596 - protein, 490 aa, Homo sapiens
MGKNKYCFDFGISSRSHFSAKEECMLIQRNTAFQPSSPSPLQPQGPVKSNNIVTVTGISLCLFIIIATVLITLWRRFGRPAKCSTPARHNSIHSPSFRKNSDEENICELSEQRGSFSDGGDGPTGSPGDTGIPLTYRRSGPVPPEDDASGSESFQSNAQKIIPPLFSYRLAQQQLKEMKKKGLTETTKVYHVSQSPLTDTAIDAAPSAPLDLESPEEAAANKFRIKSPFPEQPAVSAGERPPSRLDLNVTQASCAISPSQTLIRKSQARHVGSRGGPSERSHARNAHFRRTASFHEARQARPFRERSMSTLTPRQAPAYSSRTRTCEQAEDRFRPQSRGAHLFPEKLEHFQEASGTRGPLNPLPKSYTLGQPLRKPDLGDHQAGLVAGIERTEPHRARRGPSPSHKSVSRKQSSPISPKDNYQRVSSLSPSQCRKDKCQSFPTHPEFAFYDNTSFGLTEAEQRMLDLPGYFGSNEEDETTSTLSVEKLVI

SEQ ID NO: 7597 - protein, 431 aa, Homo sapiens
MSWVQATLLARGLCRAWGGTCGAALTGTSISQVPRRLPRGLHCSAAAHSSEQSLVPSPPEPRQRPTKALVPFEDLFGQAPGGERDKASFLQTVQKFAEHSVRKRGHIDFIYLALRKMREYGVERDLAVYNQLLNIFPKEVFRPRNIIQRIFVHYPRQQECGIAVLEQMENHGVMPNKETEFLLIQIFGRKSYPMLKLVRLKLWFPRFMNVNPFPVPRDLPQDPVELAMFGLRHMEPDLSARVTIYQVPLPKDSTGAADPPQPHIVGIQSPDQQAALARHNPARPVFVEGPFSLWLRNKCVYYHILRADLLPPEEREVEETPEEWNLYYPMQLDLEYVRSGWDNYEFDINEVEEGPVFAMCMAGAHDQATMAKWIQGLQETNPTLAQIPVVFRLAGSTRELQTSSAGLEEPPLPEDHQEEDDNLQRQQQGQS

SEQ ID NO: 7598 - protein, 58 aa, Homo sapiens
MEGIITFLILPLPCSPGCPVLTMQKAVSCTLEVSVLLSWGLGYSGSCLSLVPKAYQVI

SEQ ID NO: 7599 - protein, 106 aa, Homo sapiens
MSLSWMVHLLGLPNGTVWYLPFVCFTRGSPMGGGSGQWRWDRKFSKTLLGNLFVAFKEMCGEDIWMLAAILELRTQEWWKGRRNRVFVAVVKLLKFPSCQASCYMR

SEQ ID NO: 7600 - protein, 89 aa, Homo sapiens
  SITE (10): Xaa equals any amino acid
  SITE (13): Xaa equals any amino acid
MGFLQLLVVXVLXSEHRVAGAAEVFGNSSEGLIEFSVGKFRYFELNRPFPEEAILHDISSNVTFLIFQIHSQYQNTTVSFSPRRRSPTM

SEQ ID NO: 7601 - protein, 200 aa, Homo sapiens [sequence omitted]

SEQ ID NO: 7602 - protein, 228 aa, Homo sapiens
  SITE (134): Xaa equals any amino acid
MVLGLFVPPVFVVSYAKDLGVPDTKAAFLLTILGFIDIFARPAAGFVAGLGKVRPYSVYLFSFSMFFNGLADLAGSTAGDYGGLVVFCIFFGISYGMVGALQFEVLMAIVGTHKFSSAIGLVLLMEAVAVLVGXPSGGKLLDATHVYMYVFILAGAEVLTSSLILLLGNFFCIRKKPKEPQPEVAAAEEEKLHKPPADSGVDLREVEHFLKAEPEKNGEVVHTPETSV

SEQ ID NO: 7603 - protein, 362 aa, Homo sapiens
MTLIEGVGDEVTVLFSVLACLLVLALAWVSTHTAEGGDPLPQPSGTPTPSQPSAAMAATDSMRGEAPGAETPSLRHRGQAAQPEPSTGFTATPPAPDSPQEPLVLRLKFLNDSEQVARAWPHDTIGSLKRTQFPGREQQVRLIYQGQLLGDDTQTLGSLHLPPNCVLHCHVSTRVGPPNPPCPPGSEPRPLRAGNRQPAAAPAAPAVAAALVLPDPVPALLSPDRHSGPGRLHPAPQSPGLCHVPPVVPPRALGSVAGPSGPCSPRRGGSCCLPRPASPACLFPLPWSPALRRRGLPGLAEAPPCDRRGSGPPPGAADPQPALGVGSSGSGICCRCLGPGQSRAAPGARLSVLPEDPAASNP

SEQ ID NO: 7604 - protein, 832 aa, Homo sapiens
MGLRSWLAAPWGALPPRPPLLLLLLLLLLLQPPPPTWALSPRISLPLGSEERPFLRFEAEHISNYTALLLSRDGRTLYVGAREALFALSSNLSFLPGGEYQELLWGADAEKKQQCSFKGKDPQRDCQNYIKILLPLSGSHLFTCGTAAFSPMCTYINMENFTLARDEKGNVLLEDGKGRCPFDPNFKSTALVVDGELYTGTVSSFQGNDPAISRSQSLRPTKTESSLNWLQDPAFVASAYIPESLGSLQGDDDKIYFFFSETGQEFEFFENTIVSRIARICKGDEGGERVLQQRWTSFLKAQLLCSRPDDGFPFNVLQDVFTLSPSPQDWRDTLFYGVFTSQWHRGTTEGSAVCVFTMKDVQRVFSGLYKEVNRETQQWYTVTHPVPTPRPGACITNSARERKINSSLQLPDRVLNFLKDHFLMDGQVRSRMLLLQPQARYQRVAVHRVPGLHHTYDVLFLGTGDGRLHKAVSVGPRVHIIEELQIFSSGQPVQNLLLDTHRGLLYAASHSGVVQVPMANCSLYRSCGDCLLARDPYCAWSGSSCKHVSLYQPQLATRPWIQDIEGASAKDLCSASSVVSPSFVPTGEKPCEQVQFQPNTVNTLACPLLSNLATRLWLRNGAPVNASASCHVLPTGDLLLVGTQQLGEFQCWSLEEGFQQLVASYCPEVVEDGVADQTDEGGSVPVIISTSRVSAPAGGKASWGADRSYWKEFLVMCTLFVLAVLLPVLFLLYRHRNSMKVFLKQGECASVHPKTCPVVLPPETRPLNGLGPPSTPLDHRGYQSLSDSPPGARVFTESEKRPLSIQDSFVEVSPVCPRPRVRLGSEIRDSVV

SEQ ID NO: 7605 - protein, 123 aa, Homo sapiens
MRTDYPRSVLAPAYVSVCLLLLCPREVIAPAGSEPWLCQPAPRCGDKIYNPLEQCCYNDAIVSLSETRQCGPPCTFWPCFELCCLDSFGLTNDFVVKLKVQGVNSQCHSSPISSKCESRRRFP

SEQ ID NO: 7606 - protein, 468 aa, Homo sapiens
MGRGWGFLFGLLGAVWLLSSGHGEEQPPETAAQRCFCQVSGYLDDCTCDVETIDRFNNYRLFPRLQKLLESDYFRYYKVNLKRPCPFWNDISQCGRRDCAVKPCQSDEVPDGIKSASYKYSEEANNLIEECEQAERLGAVDESLSEETQKAVLQWTKHDDSSDNFCEADDIQSPEAEYVDLLLNPERYTGYKGPDAWKIWNVIYEENCFKPQTIKRPLNPLASGQGTSEENTFYSWLEGLCVEKRAFYRLISGLHASINVHLSARYLLQETWLEKKWGHNITEFQQRFDGILTEGEGPRRLKNLYFLYLIELRALSKVLPFFERPDFQLFTGNKIQDEENKMLLLEILHEIKSFPLHFDENSFFAGDKKEAHKLKEDFRLHFRNISRIMDCVGCFKCRLWGKLQTQGLGTALKILFSEKLIANMPESGPSYEFHLTRQEIVSLFNAFGRISTSVKELENFRNLLQNIH

SEQ ID NO: 7607 - protein, 157 aa, Homo sapiens
MQAPRAALVFALVIALVPVGRGNYEELENSGDTTVESERPNKVTIPSTFAAVTIKETLNANINSTNFAPDENQLEFILMVLIPLILLVLLLLSVVFLATYYKRKRTKQEPSSQGSQSALQTCEYYPKTCLQVGVGLEKEQRCFKIKQQGLHIIVSDK

SEQ ID NO: 7608 - protein, 443 aa, Homo sapiens
MKFQGPLACLLLALCLGSGEAGPLQSGEESTGTNIGEALGHGLGDALSEGVGKAIGKEAGGAAGSKVSEALGQGTREAVGTGVRQVPGFGAADALGNRVGEAAHALGNTGHEIGRQAEDVIRHGADAVRGSWQGVPGHNGAWETSGGHGIFGSQGGLGGQGQGNPGGLGTPWVHGYPGNSAGSFGMNPQGAPWGQGGNGGPPNFGTNTQGAVAQPGYGSVRASNQNEGCTNPPPSGSGGGSSNSGGGSGSQSGSSGSGSNGDNNNGSSSGGSGGSGGGSRGDSGSESSWNGSSTGSSSGNHGGSGGGNGHKPGNSETSPGMFNFDTFWKNFKSKLGFINWDAINKNQVPPPSTRALLYFSRLWEDFKQNTPFLNWKAIIEGADASSLQKRAGRADQNYNYNQHAYPTAYGGKYSVKTPAKGGVSPSSSASRVQPGLLQWVKFW

SEQ ID NO: 7609 - protein, 107 aa, Homo sapiens [sequence omitted]

SEQ ID NO: 7610 - protein, 119 aa, Homo sapiens
MVPRIFAPAYVSVCLLLLCPREVIAPAGSEPWLCQPAPRCGDKIYNPLEQCCYNDAIVSLSETRQCGPPCTFWPCFELCCLDSFGLTNDFVVKLKVQGVNSQCHSSPISSKCESRRRFP

SEQ ID NO: 7611 - protein, 46 aa, Homo sapiens
MSGVKASVSFLLFLTPSIALCYSQQAVINSMIAAETRVGVAFGGFW

SEQ ID NO: 7612 - protein, 834 aa, Homo sapiens
MKHTLALLAPLLGLGLGLALSQLAAGATDCKFLGPAEHLTFTPAARARWLAPRVRAPGLLDSLYGTVRRFLSVVQLNPFPSELVKALLNELASVKVNEVVRYEAGYVVCAVIAGLYLLLVPTAGLCFCCCRCHRRCGGRVKTEHKALACERAALMVFLLLTTLLLLIGVVCAFVTNQRTHEQMGPSIEAMPETLLSLWGLVSDVPQELQAVAQQFSLPQEQVSEELDGVGVSIGSAIHTQLRSSVYPLLAAVGSLGQVLQVSVHHLQTLNATVVELQAGQQDLEPAIREHRDRLLELLQEARCQGDCAGALSWARTLELGADFSQVPSVDHVLHQLKGVPEANFSSMVQEENSTFNALPALAAMQTSSVVQELKKAVAQQPEGVRTLAEGFPGLEAASRWAQALQEVEESSRPYLQEVQRYETYRWIVGCVLCSVVLFVVLCNLLGLNLGIWGLSARDDPSHPEAKGEAGARFLMAGVGLSFLFAAPLILLVFATFLVGGNVQTLVCRSWENGELFEFADTPGNLPPSMNLSQLLGLRKNISIHQAYQQCKEGAALWTVLQLNDSYDLEEHLDINQYTNKLRQELQSLKVDTQSLDLLSSAARRDLEALQSSGLQRIHYPDFLVQIQRPVVKTSMEQLAQELQGLAQAQDNSVLGQRLQEEAQGLRNLHQEKVVPQQSLVAKLNLSVRALESSAPNLQLETSDVLANVTYLKGELPAWAARILRNVSECFLAREMGYFSQYVAWVREEVTQRIATCQPLSGALDNSRVILCDMMADPWNAFWFCLAWCTFFLIPSIIFAVKTSKYFRPIRKRLSSTSSEETQLFHIPRVTSLKL

SEQ ID NO: 7613 - protein, 81 aa, Homo sapiens [sequence omitted]

SEQ ID NO: 7614 - protein, 617 aa, Homo sapiens [sequence omitted]

SEQ ID NO: 7615 - protein, 75 aa, Homo sapiens
MVLPATGGLRVVSAPCISPSLLTFLLCFPPSVCQRGGTGNRTAVAALSLLSTVYSGLSGDSREPGHLAAVRPLNL

SEQ ID NO: 7616 - protein, 44 aa, Homo sapiens
MKSHATLTGGSGFYFIELSFLLLRSVLLVLVLLWQFPKSLTGQE

SEQ ID NO: 7617 - protein, 70 aa, Homo sapiens
  SITE (43): Xaa equals any amino acid
  SITE (44): Xaa equals any amino acid
  SITE (49): Xaa equals any amino acid
  SITE (52): Xaa equals any amino acid
  SITE (56): Xaa equals any amino acid
MGIFSTLLLASDSLLNLILFFFIFAFSVKLSSSSFPSCCVSVXXLSVIXESXSSHXATCAHTSLSGTPVM

SEQ ID NO: 7618 - protein, 72 aa, Homo sapiens
MIVIYLTLTWTFLINLLACPLYHLPQMQKKAKPETKKAKPETKETIQRQRNLFLVLLKQLAGKKCSALFLIV

SEQ ID NO: 7619 - protein, 96 aa, Homo sapiens [sequence omitted]

SEQ ID NO: 7620 - protein, 69 aa, Homo sapiens
MRDLSFLYTLLWLPEIWQALAGGIRLDEVELLENEAVLGEEMRLYRKINEVVLSGNEVVLGGKVSCIIR

SEQ ID NO: 7621 - protein, 340 aa, Homo sapiens [sequence omitted]

SEQ ID NO: 7622 - protein, 94 aa, Homo sapiens
MAILHLFKFFSFFNFVISASPIYLLYHYLRSDKRVLVGQVLQSLSGNNICHITLLICLLLIWEAKHWCLRGLPIINCHYHYSPLLFVWKLNKGQ

SEQ ID NO: 7623 - protein, 72 aa, Homo sapiens
MLWMTSEYMNLLLFQMFLVFPGSQAGLFQPLIVYRGKICTVQCMKLFSTSLPSSKTIQSELSWAKQYIRVKF

SEQ ID NO: 7624 - protein, 92 aa, Homo sapiens
MPGCVFCFLTLLFHSLSVGQYCCLICVCFVLYVYTQIHTRIHIHTHKHFFFPWRQGIALSPRLEYSSAIMTHRLIAALASQAQAILPPQPSE

SEQ ID NO: 7625 - protein, 59 aa, Homo sapiens
MLLCILIFKVHLLLFCRSFSAFLNLKERFLFLILVWIFVAFYGCKYSPLSFDSFKSLGS

SEQ ID NO: 7626 - protein, 47 aa, Homo sapiens [sequence omitted]

SEQ ID NO: 7627 - protein, 58 aa, Homo sapiens
  SITE (52): Xaa equals any amino acid
MAVFLISSSYFLLCVFTIRSLRAWVLPFTSVPRAQGGSCCRSQWLYKTLPPXLVCKPV

SEQ ID NO: 7628 - protein, 41 aa, Homo sapiens
MGFLLLFFVISSTCYTLLAQSIFLEHFCISYGNKFYTLIKM

SEQ ID NO: 7629 - protein, 50 aa, Homo sapiens [sequence omitted]

SEQ ID NO: 7630 - protein, 43 aa, Homo sapiens
MMSPSGIIVYVSATPHILLCILITFMLAIPSIHNGRVCVLFIF

SEQ ID NO: 7631 - protein, 443 aa, Homo sapiens
MRLTRKRLCSFLIALYCLFSLYAAYHVFFGRRRQAPAGSPRGLRKGAAPARERRGREQSTLESEEWNPWEGDEKNEQQHRFKTSLQILDKSTKGKTDLSVQIWGKAAIGLYLWEHIFEGLLDPSDVTAQWREGKSIVGRTQYSFITGPAVIPGYFSVDVNNVVLILNGREKAKIFYATQWLLYAQNLVQIQKLQHLAVVLLGNEHCDNEWINPFLKRNGGFVELLFIIYDSPWINDVDVFQWPLGVATYRNFPVVEASWSMLHDERPYLCNFLGTIYENSSRQALMNILKKDGNDKLCWVSAREHWQPQETNESLKNYQDALLQSDLTLCPVGVNTECYRIYEACSYGSIPVVEDVMTAGNCGNTSVHHGAPLQLLKSMGAPFIFIKNWKELPAVLEKEKTIILQEKIERRKMLLQWYQHFKTELKMKFTNILESSFLMNNKS

SEQ ID NO: 7632 - protein, 139 aa, Homo sapiens
MVTVGLVICFSEWCCAGGLSAEQTVSDKHIDALMKEKEAGKSSGHYDPRHQGQALEEPSVHSCIYYLLTEQTQKVSTRTSLLRYRWPCEEVGWCWGLDLTGCPVVIQHEGVAGSEIIISDYPLTNENIKGIPEICLFHI

SEQ ID NO: 7633 - protein, 346 aa, Homo sapiens
MVEKEEAGGGISEEEAAQYDRQIRLWGLEAQKRLRASRVLLVGLKGLGAEIAKNLILAGVKGLTMLDHEQVTPEDPGAQFLIRTGSVGRNRAEASLERAQNLNPMVDVKVDTEDIEKKPESFFTQFDAVCLTCCSRDVIVKVDQICHKNSIKFFTGDVFGYHGYTFANLGEHEFVEEKTKVAKVSQGVEDGPDTKRAKLDSSETTMVKKKVVFCPVKEALEVDWSSEKAKAALKRTTSDYFLLQVLLKFRTDKGRDPSSDTYEEDSELLLQIRNDVLDSLGISPDLLPEDFVRYCFSEMAPVCAVVGGILAQEIVKALSQRDPPHNNFFFFDGMKGNGIVECLGPK

SEQ ID NO: 7634 - protein, 43 aa, Homo sapiens [sequence omitted]

SEQ ID NO: 7635 - protein, 114 aa, Homo sapiens
  SITE (77): Xaa equals any amino acid
MLPGLRRLLQAPASACLLLMLLALPLAAPSCPMLCTCYSSPPTVKLPGQQLLLCAAVPATQHSATLPAEQPHPHAAXRHLWVQPAHPVALLQQPLHHLPGHFPPLASPGGSGPR

SEQ ID NO: 7636 - protein, 42 aa, Homo sapiens
MHVHCFAIHVLFHFCSTISADALSFCIFCYGPQTLIDMYWNS

SEQ ID NO: 7637 - protein, 155 aa, Homo sapiens
MRLWKAVVVTLAFMSVDICVTTAIYVFSHLDRSLLEDIRHFNIFDSVLDLWAACLYRSCLLLGSHHWCGQEQCAGAPAAAGLVAGHHPRVPLRGHLCHGEAAALLRGAQAHPGPLVLGPVRVDVHFTRRILPALVAAVHRAARHPGPGARGGHRG

SEQ ID NO: 7638 - protein, 74 aa, Homo sapiens
MDPLCLPIILFSAVVLRNLFHLLILTFHYLPLFCDNPLILEDLSCIHLRVNIFKAKQPKFYGNQLQPCVMKSSA

SEQ ID NO: 7639 - protein, 322 aa, Homo sapiens
MPPRGPASELLLLRLLLLGAATAAPLAPRPSKEELTRCLAEVVTEVLTVGQVQRGPCTALLHKELCGTEPHGCASTEEKGLLLGDFKKQEAGKMRSSQEVRDEEEEEVAERTHKSEVQEQAIRMQGHRQLHQEEDEEEEKEERKRGPMETFEDLWQRHLENGGDLQKRVAEKASDKETAQFQAEEKGVRVLGGDRSLWQGAERGGGERREDLPHHHHHHHQPEAEPRQEKEEASEREVSRGMKEEHQHSLEAGLMMVSGVTTHSHRCWPCTTRSITSGSQWPRLTPRLANNFRARPLPYTSTLLYGLQQPRWHHCTEASHHH

SEQ ID NO: 7640 - protein, 32 aa, Homo sapiens
MLINVYLFIIFVFIQLLHSSFLRLGHVDTYSN

SEQ ID NO: 7641 - protein, 110 aa, Homo sapiens
MYPLYCKILLSFLFLLLSSNHTYVANHIYSFWLILYMFLLANISKLYIFNILTYRKCSIYTPLHLVFLFVYLRIYSRNHSTLVHRHLFDYYYGQFLKWLHSTLLYGWILL

SEQ ID NO: 7642 - protein, 339 aa, Homo sapiens
MAAACGPGAAGYCLLLGLHLFLLTAGPALGWNDPDRMLLRDVKALTLHYDRYTTSRRLDPIPQLKCVGGTAGCDSYTPKVIQCQNKGWDGYDVQWECKTDLDIAYKFGKTVVSCEGYESSEDQYVLRGSCGLEYNLDYTELGLQKLKESGKQHGFASFSDYYYKWSSADSCNMSGLITIVVLLGIAFVVYKLFLSDGQYSPPPYSEYPPFSHRYQRFTNSAGPPPPGFKSEFTGPQNTGHGATSGFGSAFTGQQGYENSGPGFWTGLGTGGILGYLFGSNRAATPFSDSWYYPSYPPSYPGTWNRAYSPLHGGSGSYSVCSNSDTKTRTASGYGGTRRR

SEQ ID NO: 7643 - protein, 291 aa, Homo sapiens [sequence omitted]

SEQ ID NO: 7644 - protein, 26 aa, Homo sapiens
MHALILQFIFSLCMYISLFSAARFLF

SEQ ID NO: 7645 - protein, 114 aa, Homo sapiens
MHQVSTCFGPGRGLALTFMTLHSFREAITLDCNTNDRRPSGQRPPRPSAPQRRGPRGRRCPSCSPCALSLTSPGSCLLKTPVFTPYKASSEQTGRPLVEPAHPVPSAWRPGPRA

SEQ ID NO: 7646 - protein, 71 aa, Homo sapiens
MSASLKNHLTHCFLLLLLKELVSPTMISFVPTLRHSYRFFNLFSCDAESTKESPGRTVQFSKTPRGVTMFI

SEQ ID NO: 7647 - protein, 115 aa, Homo sapiens
  SITE (111): Xaa equals any amino acid
  SITE (112): Xaa equals any amino acid
  SITE (115): Xaa equals any amino acid
MQVVGSWPGRVGVVGLAFSLVIPPPAICIAGPAPGLGGGERQQKGLGRGGGGLRNCPGRVGMAAEPGALLCLTSRDGSLLLSCVRPHHVIKPKGTAKKKKKKKKKKKKKKXXGGX

SEQ ID NO: 7648 - protein, 53 aa, Homo sapiens
  SITE (13): Xaa equals any amino acid
MCPPSQRAPTHLXCPWVDPGPVVLGLSLWVLAGGMGEGGEQLPAPLLCGSSFF

SEQ ID NO: 7649 - protein, 97 aa, Homo sapiens
  SITE (70): Xaa equals any amino acid
MILLFLLSLSLSLLSLSLSFSPLNCLFSFWGSPPTRCSWCRLGSQGEAWWPGLGRGTLSLAKAESEIVVXLCKSYFQYFLAASEVSLTPCRALLLLS

SEQ ID NO: 7650 - protein, 245 aa, Homo sapiens
MLQARNQSPSSQRPLDVLRRNQDPQSPASISVIIFITPKEEPALQEGLHLQEDGLPATAEDAATCLTVLSSQPASCRASCCLRADGPGMLAHTCEHSTGKWEHSTRKWEHSTGKWEHSTGKWGLTALQNGSTVLGNGSTVLGSGSTVLRSGSTVLRNGSTLLRNGSTVLGNGHTVLGNGHTVLRNGSTVLGNGSTVLGNGSPQYWERGVHSTRKWEHSTGKWEHSTGKWEHSTGKPQTWILSFSA

SEQ ID NO: 7651 - protein, 37 aa, Homo sapiens
MAFLLTLVPLLPSRCLGLEEMAVPNSTCISPFSCCYG

SEQ ID NO: 7652 - protein, 30 aa, Homo sapiens
MAILMLLAGSPCTLSFSTDTGSSAPGPKIP

SEQ ID NO: 7653 - protein, 20 aa, Homo sapiens
  SITE (19): Xaa equals any amino acid
MKLSLFLILSDVFYLGSPXT

SEQ ID NO: 7654 - protein, 41 aa, Homo sapiens
  SITE (4): Xaa equals any amino acid
  SITE (10): Xaa equals any amino acid
  SITE (14): Xaa equals any amino acid
  SITE (19): Xaa equals any amino acid
MLLXPDVADXPCGXKRKPXLLMLIIPLSSQPLYIKASGTKR

SEQ ID NO: 7655 - protein, 56 aa, Homo sapiens
MLMNPIRRRFQQVPHPPLLLLLLLLTARTGGGQGDTWADPPALPPPHPAPHIILQS

SEQ ID NO: 7656 - protein, 57 aa, Homo sapiens
MICPQCPLSLLCLISSLCSLVIQISLKTIRDITLLNMVGIKFSISLSNKININSRTW

SEQ ID NO: 7657 - protein, 26 aa, Homo sapiens
MVLVLTTLSLLPLLISPCNYEINFSL

SEQ ID NO: 7658 - protein, 27 aa, Homo sapiens
MPKTLLRSFLLLFFLLQTHSSSLRKVK

SEQ ID NO: 7659 - protein, 180 aa, Homo sapiens
MAICSCQCPAAMAFCFLETLWWEFTASYDTTCIGLASRPYAFLEFDSIIQKVKWHFNYVSSSQMECSLEKIQEELKLQPPAVLTLEDTDVANGVMNGHTPMHLEPAPNFRMEPVTALGILSLILNIMCAALNLIRGVHLAEHSLQVAHEEIGNILAFLVPFVACIFQDPRSWFCWLDQTS

SEQ ID NO: 7660 - protein, 62 aa, Homo sapiens
MFGCRAVKTQKETLPSAPGSPPLVALFSVALWPVALSNEATPHSCGQAPGAPGQMRTLFPPT

SEQ ID NO: 7661 - protein, 73 aa, Homo sapiens [sequence omitted]

SEQ ID NO: 7662 - protein, 46 aa, Homo sapiens
MSRTNTWVSWQASRADWPETDPQEALQPALVPSHSDLNPGSSRSAV

SEQ ID NO: 7663 - protein, 108 aa, Homo sapiens
  SITE (98): Xaa equals any amino acid
  SITE (99): Xaa equals any amino acid
  SITE (100): Xaa equals any amino acid
MDLPQFIYLFIFCFCCLAIVNNASINIHIQVSMWLYVFISLGYLHGSRILGHNIILCLTSQRIAKRFFIVAASFTFPPAMYKDFYFSISLHLPTLLFXXXFVFSLLPP

SEQ ID NO: 7664 - protein, 52 aa, Homo sapiens
MNSWILNMRVRFTFLSQLLTLIPRTSHSATSVGNSQIELPREKHHMTYWENG

SEQ ID NO: 7665 - protein, 24 aa, Homo sapiens
MMRLLDLRIFLMIHHKAKSWESHT

SEQ ID NO: 7666 - protein, 42 aa, Homo sapiens
MEGTFTVWSGGLAVYVWAVWCSVHGWCFLCGCLQSALLKLFM

SEQ ID NO: 7667 - protein, 167 aa, Homo sapiens
MCGFLSLQIMGPLIVLVGLCFFVVAHVKKRNTLNAGQDASEREEGQIQIMEPVQVTVGDSVIIFPPPPPPYFPESSASAVAESPGTNSLLPNENPPSYYSIFNYGTPTSEGAASERDCESIYTISGTNSSSEASHTPHLPSELPPRYEEKENAAATFLPLSSEPSPP

SEQ ID NO: 7668 - protein, 14 aa, Homo sapiens
MCLIFLLLLLLSFS

SEQ ID NO: 7669 - protein, 34 aa, Homo sapiens
MPLSLLLIVWKLELCVGSALVLIHTQRRYIILQV

SEQ ID NO: 7670 - protein, 108 aa, Homo sapiens
  SITE (76): Xaa equals any amino acid
  SITE (106): Xaa equals any amino acid
MLCMQTVMPQHTYLQHLVFGFCLLILCINLSVLAHRYTLCYFSMTGEYSIINGQLLVYLSNLSAQWKYRYFQTLLXLKKKKKKKKKKKKKKKKKKKKKKKKKKKKXKK

SEQ ID NO: 7671 - protein, 75 aa, Homo sapiens
MPLAPSPVMLILVILLLFCPSFQFLPISFYSFNVYAFAFSGISPPSCLHGWLHFIQSSFFLLYSDNILFSPSLYL

SEQ ID NO: 7672 - protein, 103 aa, Homo sapiens
MCFLLFGSLCIYYFSLFLVFFFFLFLFCLVFCSCLHCFRYFFTPLDSPRAGSRWSSYAQLLPPPPPPLVEHSCDADTANLQYPHPRRRYLSRPLNPLPENEGI

SEQ ID NO: 7673 - protein, 81 aa, Homo sapiens
MLYPRIFTNRGELLPFLFLTVWLWLYKLLFGESPRYPNVIGKTYFFFWTDQISRESRFLERLAFIVSENCLIFLIHAITGQ

SEQ ID NO: 7674 - protein, 140 aa, Homo sapiens
IPLCSIFGALIAVCLIMGLFDGCFISIMAPIAFELVGAQDVSQAIGFLLGFMSIPMTVGPPIAGLLRDKLGSYDVAFYLAGVPPLIGGAVLCFIPWIHSKKQREISKTTGKEKMEKMLENQNSLLSSSSGMFKKESDSII

SEQ ID NO: 7675 - protein, 58 aa, Homo sapiens
MEKYCLGNNMLSRFCLFLIMLLHILLFLVIFIQRHTVVSLSKHHPFVPTNGSKSYSSF

SEQ ID NO: 7676 - protein, 280 aa, Homo sapiens
MAPSGSLAVPLAVLVLLLWGAPWTHGRRSNVRVITDENWRELLEGDWMIEFYAPWCPACQNLQPEWESFAEWGEDLEVNIAKVDVTEQPGLSGRFIITALPTIYHCKDGEFRRYQGPRTKKDFINFISDKEWKSIEPVSSWFGPGSVLMSSMSALFQLSMWIRTCHNYFIEDLGLPVWGSYTVFALATLFSGLLLGLCMIFVADCLCPSKRRRPQPYPYPSKKLLSESAQPLKKVEEEQEADEEDVSEEEAESKEGTNKDFPQNAIRQRSLGPSLATDKS

SEQ ID NO: 7677 - protein, 351 aa, Homo sapiens
MLTLRSLLFWSLVYCYCGLCASIHLLKLLWSLGKGPAQTFRRPAREHPPACLSDPSLGTHCYVRIKDSGLRFHYVAAGERGKPLMLLLHGFPEFWYSWRYQLREFKSEYRVVALDLRGYGETDAPIHRQNYKLDCLITDIKDILDSLGYSKCVLIGHDWGGMIAWLIAICYPEMVMKLIVINFPHPNVFTEYILRHPAQLLKSSYYYFFQIPWFPEFMFSINDFKVLKHLFTSHSTGIGRKGCQLTTEDLEAYIYVFSQPGALSGPINHYRNIFSCLPLKHHMVTTPTLLLWGENDAFMEVEMAEVTKIYVKNYFRLTILSEASHWLQQDQPDIVNKLIWTFLKEETRKKD

SEQ ID NO: 7678 - protein, 32 aa, Homo sapiens
MVFHLPLSDLFFMLLLAPKKSRMAKEPRTYWN

SEQ ID NO: 7679 - protein, 56 aa, Homo sapiens
  SITE (5): Xaa equals any amino acid
  SITE (11): Xaa equals any amino acid
  SITE (45): Xaa equals any amino acid
MMLHXKLLLFXEALWYYGGGAFLCCAGSVPTDCYFGGLDQRRLVXDKCTEKSTGLL

SEQ ID NO: 7680 - protein, 78 aa, Homo sapiens
MTLIQNCWYSWLFFGFFFHFLRKSISIFSIFLVCFRILALGPTCFLVWFWKAFFRHILIFICLSREVFRPRCFLVYFR

SEQ ID NO: 7681 - protein, 495 aa, Homo sapiens [sequence omitted]

SEQ ID NO: 7682 - protein, 128 aa, Homo sapiens
  SITE (68): Xaa equals any amino acid
  SITE (98): Xaa equals any amino acid
  SITE (103): Xaa equals any amino acid
  SITE (104): Xaa equals any amino acid
  SITE (112): Xaa equals any amino acid
  SITE (114): Xaa equals any amino acid
  SITE (124): Xaa equals any amino acid
MAYRHFWMLVLFVIFNSLQGLYVFMVYFILHNQMCCPMKASYTVEMNGHPGPSTAFFTPGSGMPPAGXEISKSTQNLNRWYGGRCHLTGREHPSKQGXQGQPXXKAKSTKWXHXPVLWRIWPGXTDSR

SEQ ID NO: 7683 - protein, 171 aa, Homo sapiens [sequence omitted]

SEQ ID NO: 7684 - protein, 170 aa, Homo sapiens [sequence omitted]

SEQ ID NO: 7685 - protein, 132 aa, Homo sapiens
MTYFSGLLVILAFAAWVALAEGLGVAVYAAAVLLGAGCATILVTSLAMTADLIGPHTNSGAFVYGSMSFLDKVANGLAVMAIQSLHPCPSELCCRACVSFYHWAMVAVTGGVGVAAALCLCSLLLWPTRLRR

SEQ ID NO: 7686 - protein, 463 aa, Homo sapiens
MLPTWWIVSSWLVWGVILFVYLVIRALRLWRTAKLQVTLKKYSVHLEDMATNSRAFTNLVRKALRLIQETEVISRGFTLVSAACPFNKAGQHPSQHLIGLRKAVYRTLRANFQAARLATLYMLKNYPLNSESDNVTNYICVVPFKELGLGLSEEQISEEEAHNFTDGFSLPALKVLFQLWVAQSSEFFRRLALLLSTANSPPGPLLTPALLPHRILSDVTQGLPHAHSACLEELKRSYEFYRYFETQHQSVPQCLSKTQQKSRELNNVHTAVRSLQLHLKALLNEVIILEDELEKLVCTKETQELVSEAYPILEQKLKLIQPHVQASNNCWEEAISQVDKLLRRNTDKKGKPEIACENPHCTVVPLKQPTLHIADKDPIPEEQELEAYVDDIDIDSDFRKDDFYYLSQEDKERQKREHEESKRVLQELKSVLGFKASEAERQKWKQLLFSDHVFLHIALKLCY

SEQ ID NO: 7687 - protein, 105 aa, Homo sapiens
  SITE (96): Xaa equals any amino acid
  SITE (104): Xaa equals any amino acid
MVLVISLAAQVQSPRRAGPITGPLPLPLLLLLPFGPPPPAKPAPEAALPSAATRGRAGALRALEPADPASVSWEGPAPAQSTHGNKGQAATVKKKXKKKRAAAXK

SEQ ID NO: 7688 - protein, 56 aa, Homo sapiens
MWTCPGIAALVLMIVPGCSPMPSASGTPCWPTRKPQLRVLGSQRRWGCCWSMRPRS

SEQ ID NO: 7689 - protein, 371 aa, Homo sapiens
  SITE (31): Xaa equals any amino acid
  SITE (193): Xaa equals any amino acid
MGLKLLQKPGSLKTLIAIILVMYIFMTISVXCWNWKVFPKARFASEYGYQSWPSFSTLEKVSSTEDWSFNSKFSLHRQHHEGGNKQMLYQAGLHFKLPQSTDPLRTFKDTIYLTQVMQAQCVKTETEFYRRSRSEIVDQQGHTMGALYWQLNDIWQAPSWASLEYGGKWKMLHYFAQNFFAPLLPVGFENENXFYIYGVSDLHSDYSMTLSVRVHTWSSLEPVCSRVTERFVMKGGEAVCLYEEPVSELLRRCGNCTRESCVVSFYLSADHELLSPTNYHFLSSPKEAVGLCKAQITAIISQQGDIFVFDLETSAVAPFVWLDVGSIPGRFSDNGFLMTEKTRTILFYPWEPTSKNELEQSFHVTSLTDIY

SEQ ID NO: 7690 - protein, 101 aa, Homo sapiens
MFQQGWSSPLLTPAFTILPMSSLLTSLHPAPRLPTLLAASSPQLAPLTCCFQYPFLLSASSLGDIHPSSRDFSCHINSNVSELYFLPPTSVSLNVRIFYFQ

SEQ ID NO: 7691 - protein, 227 aa, Homo sapiens [sequence omitted]

SEQ ID NO: 7692 - protein, 40 aa, Homo sapiens
MIIVLFSLSFLPLLPSLLLSSYLCLFFFPSQSPSSFFFHL

SEQ ID NO: 7693 - protein, 30 aa, Homo sapiens
MQSYSLVFLVVYLILPYSSFKENSIFITVN

SEQ ID NO: 7694 - protein, 304 aa, Homo sapiens [sequence omitted]

SEQ ID NO: 7695 - protein, 72 aa, Homo sapiens
MAGNIQAVETGYVLICLIVPLLLCGLREGQEVPFDVNKAKYLPTFLKKKKKKKKKKKKKKKKKKKKKKKKKK

SEQ ID NO: 7696 - protein, 342 aa, Homo sapiens
  SITE (150): Xaa equals any amino acid
  SITE (271): Xaa equals any amino acid
MWTALVLIWIFSLSLSESHAASNDPRNFVPNKMWKGLVKRNASVETVDNKTSEDVTMAAASPVTLTKGTSAAHLNSMEVTTEDTSRTDVSEPATSGGAADGVTSIAPTAVASSTTAASITTAASSMTVASSAPTTAASSTTVASIAPTTXASSMTAASSTPMTLALPAPTSTSTGRTPSTTATGHPSLSTALAQVPKSSALPRTATLATLATRAQTVATTANTSSPMSTRPSPSKHMPSDTAASPVPPMRPQAQGPISQVSVDQPVVNTTXKSTPMPSNTTTEPLTQAVVDKTLLLVVLLLGVTLFITVLVLFALQAYESYKKKDYTQVDYLINGMYADSEM

SEQ ID NO: 7697 - protein, 240 aa, Homo sapiens
MSRYLLPLSALGTVAGAAVLLKDYVTGGACPSKATIPGKTVIVTGANTGIGKQTALELARRGGNIILACRDMEKCEAAAKDIRGETLNHHVNARHLDLASLKSIREFAAKIIEEEERVDILINNAGVMRCPHWTTEDGFEMQFGVNHLGHFLLTNLLLDKLKASAPSRIINLSSLAHVAGHIDFDDLNWQTRKYNTKAAYCQSKLAIVLFTKELSRRLQGTGALGSASLLLYSEPRAAFP

SEQ ID NO: 7698 - protein, 45 aa, Homo sapiens
MNALPNLAWLPFVPALAAASPAGLAAPESRDVPFPVSPATQLNIG

SEQ ID NO: 7699 - protein, 29 aa, Homo sapiens
  SITE (26): Xaa equals any amino acid
  SITE (29): Xaa equals any amino acid
MGNAFEVTGLMLALLCYVVDGQKPKXGFX

SEQ ID NO: 7700 - protein, 28 aa, Homo sapiens
MVFLNFLIYLLLVFFYISLFHSRDNFIL

SEQ ID NO: 7701 - protein, 215 aa, Homo sapiens
MLLQVVREGKFSGFLTSCSLLLPRAAQILAAEAGLPSSRSFMGFAAPFTNKRKAYSERRIMGYSMQEMYEVVSNVQEYREFVPWCKKSLVVSSRKGHLKAQLEVGFPPVMERYTSAVSMVKPHMVKAVCTDGKLFNHLETIWRFSPGIPAYPRTCTVDFSISFEFRSLLHSQLATMFFDEVVKQNVAAFERRAATKFGPETAIPRELMFHEVHQT

SEQ ID NO: 7702 - protein, 49 aa, Homo sapiens
MRQTKLEGWLIFPLFSCFSFISLGSDEGPEIFISHLKSLADYSRALVEV

SEQ ID NO: 7703 - protein, 184 aa, Homo sapiens
MLMLAVLMAATHAVYGKLLLFEYRHRKMKPVQMVPAISQNWTFHGPGATGQAAANWIAGFGRGPMPPTLLGIRQNGHAASRRLLGMDEVKGEKQLGRMFYAITLLFLLLWSPYIVACYWRVFVKACAVPHRYLATAVWMSFAQAAVNPIVCFLLNKDLKKCLRTHAPCWGTGGAPAPREPYCVM

SEQ ID NO: 7704 - protein, 47 aa, Homo sapiens
MFLVTPATLWSVPCFLLHSWPPSPAPHTQMLSLREAGTAWQSEKSVS

SEQ ID NO: 7705 - protein, 119 aa, Homo sapiens
MKVLISSLLLLLPLMLMSMVSSSLNPGVARGHRDRGQASRRWLQEGGQECECKDWFLRAPRRKFMTVSGLPKKQCPCDHFKGNVKKTRHQRHHRKPNKHSRACQQFLKQCQLRSFALPL

SEQ ID NO: 7706 - protein, 53 aa, Homo sapiens
MGQRGVFLLILDAFSVPSTASCLITPLPPPHPQPSQFFLASALQPYLGKEEWV

SEQ ID NO: 7707 - protein, 43 aa, Homo sapiens [sequence omitted]

SEQ ID NO: 7708 - protein, 412 aa, Homo sapiens
MCCWPLLLLWGLLPGTAAGGSGRTYPHRTLLDSEGKYWLGWSQRGSQIAFRLQVRTAGYVGFGFSPTGAMASADIVVGGVAHGRPYLQDYFTNANRELKKDAQQDYHLEYAMENSTHTIIEFTRELHTCDINDKSITDSTVRVIWAYHHEDAGEAGPKYHDSNRGTKSLRLLNPEKTSVLSTALPYFDLVNQDVPIPNKDTTYWCQMFKIPVFQEKHHVIKVEPVIQRGHESLVHHILLYQCSNNFNDSVLESGHECYHPNMPDAFLTCETVIFAWAIGGEGFSYPPHVGLSLGTPLDPHYVLLEVHYDNPTYEEGLIDNSGLRLFYTMDIRKYDAGVIEAGLWVSLFHTIPPGMPEFQSEGHCTLECLEELWKPKSQVEFMCLLFFSMLTWLAEHQAASFSKREGNEITCL

SEQ ID NO: 7709 - protein, 60 aa, Homo sapiens
MLQPTHLSLQLRLQCLAASHLVTLLICLMAPASQQEDQLIYSEDLLTLAQLLHQAVSLPK

SEQ ID NO: 7710 - protein, 30 aa, Homo sapiens
MLSTGIEVARPPATLLGLMFVLTGMPRGLR

SEQ ID NO: 7711 - protein, 44 aa, Homo sapiens [sequence omitted]

SEQ ID NO: 7712 - protein, 34 aa, Homo sapiens
MNCAKASPVVILPLVALPVLAPHPTPMPLFPYRF

SEQ ID NO: 7713 - protein, 115 aa, Homo sapiens
  SITE (36): Xaa equals any amino acid
  SITE (78): Xaa equals any amino acid
MNVVIVIILFSFDSVGTMFSCNRIPKITVLNKLKFXCEVLLRIQTIQGFYRCTRISRYKGIFPDFCQSQCMGCNPESXMAVPALVTPILAHRKKEKGMCLFTLIIAPTRCTHYFC

SEQ ID NO: 7714 - protein, 68 aa, Homo sapiens
MKEALHWALFSMQATGHVLLHLLLPAAAPRCHRGRASPQGQGLIPHPDLSEDTAVKAQALAFPSEGLD

SEQ ID NO: 7715 - protein, 155 aa, Homo sapiens
  SITE (64): Xaa equals any amino acid
  SITE (139): Xaa equals any amino acid
MCCSLSMIGAASSPSSGCSARARASSGLPWLWQPCPGPRFRCSLWMRRSQIVAPSTCAPRSGAXGLAVGCGAIGALVLGAGLLFSLRSVRSVVLRAGGQQVTLTTHAPFGLGAHFTVPLKQVSCMAHRGEVPAMLPLKXKGRRFYFLLDKTGHFP

SEQ ID NO: 7716 - protein, 76 aa, Homo sapiens
  SITE (60): Xaa equals any amino acid
MNGQRMDELFVLIRDGFLLPTGLSSLAQLLLLEIIEFRAAGWKTTPAAHKYYYSESPTRXPDQGFLTSTGLSSTHL

SEQ ID NO: 7717 - protein, 119 aa, Homo sapiens
MTVYALVVVSYFLITGGIIYDVIVEPPSVGSMTDEHGHQRPVAFLAYRVNGQYIMEGLASSFLFTMGGLGFIILDRSNAPNIPKLNRFLLLFIGFVCVLLSFFMARVFMRMKLPGYLMG

SEQ ID NO: 7718 - protein, 44 aa, Homo sapiens
MLCFSPLCRRLFFPLLFQCRWFLLNLTPFSCAQCGNKSSERIHL

SEQ ID NO: 7719 - protein, 39 aa, Homo sapiens
MFLVSPSVSSVVSSLLSIFWLMHLGQVWLGSMETHPITS

SEQ ID NO: 7720 - protein, 208 aa, Homo sapiens
  SITE (153): Xaa equals any amino acid
  SITE (154): Xaa equals any amino acid
MLHSGLVHGLAFWFDVAFIGSIMTVWLSTAPTEPLTHWYQVRCLFQSPLFAKAGDTLSGTCLLIANKRQSYDISIVAQVDQTGSKSSNLLDLKNPFFRYTGTTPSPPPGSHYTSPSENMWNTGSTYNLSSGMAVAGMPTAYDLSSVIASGSSXXHNNLIPLGSSGAQGSGGGSTSAHYAVNSQFTMGGPAFSMASPMSIPTNTMHYGS

SEQ ID NO: 7721 - protein, 46 aa, Homo sapiens
MCMCVGVCLITLLDRFLWFGTAGAKFIQKSTFLSKLPMTLVSFHSI

SEQ ID NO: 7722 - protein, 157 aa, Homo sapiens
MLRGTMTAWRGMRPEVTLACLLLATAGCFADLNEVPQVTVQPASTVQKPGGTVILGCVVEPPRMNVTWRLNGKELNGSDDALGVLITHGTLVITALNNHTVGRYQCVARMPAGAVASVPATVTLASESAPLPPCHGAVPPHLSHPEAPTIHAASCYS

SEQ ID NO: 7723 - protein, 329 aa, Homo sapiens
MEVAEPSSPTEEEEEEEEHSAEPRPRTRSNPEGAEDRAVGAQASVGSRSEGEGEAASADDGSLNTSGAGPKSWQVPPPAPEVQIRTPRVNCPEKVIICLDLSEEMSLPKLESFNGSKTNALNVSQKMIEMFVRTKHKIDKSHEFALVVVNDDTAWLSGLTSDPRELCSCLYDLETASCSTFNLEGLFSLIQQKTELPVTENVQTIPPPYVVRTILVYSRPPCQPQFSLTEPMKKMFQCPYFFFDVVYIHNGTEEKEEEMSWKDMFAFMGSLDTKGTSYKYEVALAGPALELHNCMAKLLAHPLQRPCQSHASYSLLEEEDEAIEVEATV

SEQ ID NO: 7724 - protein, 8 aa, Homo sapiens
HPHQDSQP

SEQ ID NO: 7725 - protein, 379 aa, Homo sapiens
MARRSAFPAAALWLWSILLCLLALRAEAGPPQEESLYLWIDAHQARVLIGFEEDILIVSEGKMAPFTHDFRKAQQRMPAIPVNIHSMNFTWQAAGQAEYFYEFLSLRSLDKGIMADPTVNVPLLGTVPHKASVVQVGFPCLGKQDGVAAFEVDVIVMNSEGNTILQTPQNAIFFKTCQQAECPGGCRNGGFCNERRICECPDGFHGPHCEKALCTPRCMNGGLCVTPGFCICPPGFYGVNCDKANCSTTCFNGGTCFYPGKCICPPGLEGEQCEISKCPQPCRNGGKCIGKSKCKCSKGYQGDLCSKPVCEPGCGAHGTCHEPNKCQCQEGWHGRHCNKRYEASLIHALRPAGAQLRQHTPSLKKAEERRDPPESNYIW

SEQ ID NO: 7726 - protein, 68 aa, Homo sapiens [sequence omitted]

SEQ ID NO: 7727 - protein, 23 aa, Homo sapiens
  SITE (17): Xaa equals any amino acid
  SITE (21): Xaa equals any amino acid
  SITE (23): Xaa equals any amino acid
MTSNLLLLTLLLKDTLXLAKXNX

SEQ ID NO: 7728 - protein, 83 aa, Homo sapiens
  SITE (45): Xaa equals any amino acid
  SITE (63): Xaa equals any amino acid
  SITE (64): Xaa equals any amino acid
  SITE (78): Xaa equals any amino acid
MGHFAPGVFHLGIMFTGLIPVVVCSSPAFLPVAEYLIHCVGIHHXLVDGTFGVVFHLLVMMGXXPQQTFVLQSFAVAXGRFFL

SEQ ID NO: 7729 - protein, 142 aa, Homo sapiens
MCLQEKCGLPSSPWMPVGCLPHPGCLWAAFLTLDACGQPSSPWMPVGCLPHPGCLWAAFLTLDACGLPSSPWMPVGCLPHPGCLWAAFLTLDACGLPSSPWMPVGSLPHPGCLWAAFLTLDACGQPSSPWMPVGSLPHPGCL

SEQ ID NO: 7730 - protein, 54 aa, Homo sapiens
MLLGLQARLVSSLLCSVVGCLGCSFFCPRRYYKKLNLHKACMENSVSAEIRSDR

SEQ ID NO: 7731 - protein, 71 aa, Homo sapiens
MLPLKIAAPYLLENCSCPIYISTSPHLFLSTMFVFLSVLYSLSLEYMFLFVFGKKISFTSLHSDQLGKKKA

SEQ ID NO: 7732 - protein, 270 aa, Homo sapiens [sequence omitted]

SEQ ID NO: 7733 - protein, 62 aa, Homo sapiens
MVSSCWPGWSPSLDLVILALWEAKAGGSFELRSSRPPSQHNESTLEARSGWITRSGDRDHPG

SEQ ID NO: 7734 - protein, 54 aa, Homo sapiens
MLVLFPLLYRGWSPVPGTAEGGMCCCCLCISRYSLLTSSQDKEPPYEMSSSELS

SEQ ID NO: 7735 - protein, 41 aa, Homo sapiens
MSCLWAGIKFLGFGFCWMDCSLCEPIWVCQIQSLGCHGNLA

SEQ ID NO: 7736 - protein, 84 aa, Homo sapiens
MNVFLPPALGTWGVARFFPHLVPERWCLVFCCWIFFFFFFFCTKVATRSVLGDQAGLGVGGPHLPLPGSHSVSVPEKTIFSLKQ

SEQ ID NO: 7737 - protein, 227 aa, Homo sapiens
  SITE (67): Xaa equals any amino acid
  SITE (170): Xaa equals any amino acid
MLGLLLLCTPRAWLTLSGPVCFQGRGPSEVPQRPPQLWVVSISVLQGQHRGRAGPRDEQERGRDQHXLPAHGRLHLSPRPEPGCRPACAAPGGQPGVVSGLPALGQPREASAPCHISRLRTASLAVVMGAEKGGAEMRPWPAVQAPAPLPSVGGTPICAPGCGSKDTVPXLQPSVPKGRAESGFVSARFLCPHPPRSLLCLGPGPSLSGLPGPPIPALLQGPLGLGC

SEQ ID NO: 7738 - protein, 68 aa, Homo sapiens
  SITE (37): Xaa equals any amino acid
  SITE (62): Xaa equals any amino acid
  SITE (64): Xaa equals any amino acid
MALGALSLNAALAPWASSPGPDLPILKEKQPLSSYPXSGGARFRLPTTSLGTRESSSFTTCXVXGAGL

SEQ ID NO: 7739 - protein, 99 aa, Homo sapiens
  SITE (5): Xaa equals any amino acid
MLWYXFPTTPLPAQVQFWWCLCCCYIHGSWWGPLSQSSSSCNASVTALSSGCCRPRASSPTVPHHRLFPMPAHTSVNSPFISHPSVRPFEYAICFRSGQ

SEQ ID NO: 7740 - protein, 70 aa, Homo sapiens [sequence omitted]

SEQ ID NO: 7741 - protein, 114 aa, Homo sapiens
MKTSALLPFSSSQQPGILKPRGAGTCNAQEPSSHLESTSDPRVGRPLQACSARRPEHGCVESVGGRHVALLAAPQPEILLGDLMAAGSHHCLVDAALSWTGGVRAGDSWGSGPC

SEQ ID NO: 7742 - protein, 36 aa, Homo sapiens
MGKLLFPLLLAPFSPINKYILHFARDGVEEVLKFVS

SEQ ID NO: 7743 - protein, 35 aa, Homo sapiens
MLFQCQVLLSIFSFLEPVLSSGSSRLVFYNLSNIM

SEQ ID NO: 7744 - protein, 50 aa, Homo sapiens
GRIRFYAFFVFCFVLRQSLTLSPRLEYSGMISAHCSLCLPGSSDSLASAS

SEQ ID NO: 7745 - protein, 46 aa, Homo sapiens
  SITE (33): Xaa equals any amino acid
MRHHTQLNFIFLVEMVFLHVGQAGLKLPTSGDXACFGLPKVLGLQA

SEQ ID NO: 7746 - protein, 76 aa, Homo sapiens
  SITE (64): Xaa equals any amino acid
  SITE (65): Xaa equals any amino acid
MSQSVSSSFLILTLLLSVGFQCLTLYTTVTTTCLWGPPRAAGRLFVQSLPSCECCCRARRGAVXXSPPWRPWPEQV

SEQ ID NO: 7747 - protein, 102 aa, Homo sapiens
MSSAKIVRQRGAVPTYYTTEAGEIIFLVLNWSLSILHIVDVLCSKPEKSVTEDAASGLSQRMTALVWRKGPDGGSRKPILLLFFFLPLILCFHSFIHSSNIC

SEQ ID NO: 7748 - protein, 61 aa, Homo sapiens [sequence omitted]

SEQ ID NO: 7749 - protein, 25 aa, Homo sapiens
MITSHLREAKLKVHLQEELWPDIAN

SEQ ID NO: 7750 - protein, 28 aa, Homo sapiens
MGTRRKGVAWLSLAPLITGLAPAHITAV

SEQ ID NO: 7751 - protein, 43 aa, Homo sapiens
MLTWLDLDLLFCFLFLFLFILFYFLQLNEFWGGNSILISLLGF

SEQ ID NO: 7752 - protein, 55 aa, Homo sapiens
MPCGKFLFPVSPVSSLSLHWSAVLLLLLADFPRVHGSPPGVSRVSILHCLFPFLS

SEQ ID NO: 7753 - protein, 41 aa, Homo sapiens
MKVQLSLGNPRGQQRTPELIQALLLVLNYTLGFFLLSKTFH

SEQ ID NO: 7754 - protein, 45 aa, Homo sapiens
  SITE (41): Xaa equals any amino acid
MGFFETIKLLLWVVLIDCVGVGLLIATLMWFISNKYLVKRXEQRL

SEQ ID NO: 7755 - protein, 26 aa, Homo sapiens
MLKIFKEWENLNLILTSIRILERQNM

SEQ ID NO: 7756 - protein, 55 aa, Homo sapiens
MCALHWLHWLASWLCSQPCLLLPSSPVLCQAFSPSPVSSPLRQAIAPIWLGRHRQ

SEQ ID NO: 7757 - protein, 89 aa, Homo sapiens [sequence omitted]

SEQ ID NO: 7758 - protein, 46 aa, Homo sapiens
GKTLYLPVCLSFLHSPASTFLPWNQGFLSPFAFSTLGTPGAKQFSI

SEQ ID NO: 7759 - protein, 61 aa, Homo sapiens
MWRVMLAWLAMVNSPMAMESQVGHIIAVKDTLTQMTLPGARIEPVRKESKAGSAGKREGFC

SEQ ID NO: 7760 - protein, 34 aa, Homo sapiens
MIADWMFFVYALCIDVTANEFCLTLTFLTSKVSK

SEQ ID NO: 7761 - protein, 41 aa, Homo sapiens
MLHLLCLGLHLVPPGLLSVNSLQSTQCSLFSAAKFFSIVQV

SEQ ID NO: 7762 - protein, 93 aa, Homo sapiens [sequence omitted]

SEQ ID NO: 7763 - protein, 188 aa, Homo sapiens
MFLLRPLPILLVTGGGYAGYRQYEKYRERELEKLGLEIPPKLAGHWEVALYKSVPTRLLSRAWGRLNQVELPHWLRRPVYSLYIWTFGVNMKEAAVEDLHHYRNLSEFFRRKLKPQARPVCGLHSVISPSDGRILNFGQVKNCEVEQVKGVTYSLESFLGPRMCTEDLPSHQPRRVTPSRPAGHPGRE

SEQ ID NO: 7764 - protein, 43 aa, Homo sapiens [sequence omitted]

SEQ ID NO: 7765 - protein, 125 aa, Homo sapiens
MATPHPHPAAQLLCLLFCLPHLSVAVFVLSSPAPHFVKWPLGECFCWICSLSLSHSTTFWNKVMAECGGGGGLLYCWINKMILKSQKKKKKKKKKKKKKKKKKKKKKKKKKKKKKKKKKKKKGGP

SEQ ID NO: 7766 - protein, 55 aa, Homo sapiens
MCLLSFNCKAVLSLSLISLSFLCCLELCLARCGGRRNVSAPLKMFIYLNHYTILM

SEQ ID NO: 7767 - protein, 44 aa, Homo sapiens
MFHVFVLLLTFIALSPSGIRLLFGFIQKGLNLNSFMFRLELLHF

SEQ ID NO: 7768 - protein, 60 aa, Homo sapiens [sequence omitted]

SEQ ID NO: 7769 - protein, 42 aa, Homo sapiens
MSVAHMHACVFLCACVFCLAENALESVIILCYSYNKDEVREH

SEQ ID NO: 7770 - protein, 47 aa, Homo sapiens
MIQLILQFWYLFSMLLKPVQQCQHCSQITPSGTMPTSETVFLILFLP

SEQ ID NO: 7771 - protein, 66 aa, Homo sapiens
MSLILLGSPIIPLWSYTSATQAAALVTSHVWKPSLEAHQINISPEPSIHYDRWHTQSNCSLINSLQ

SEQ ID NO: 7772 - protein, 195 aa, Homo sapiens
MDCEVNNGSSLRDECITNLLVFGFLQSCSDNSFRRELDALGHELPVLAPQWEGYDELQTDGNRSSHSRLGRIEADSESQEDIIRNIARHLAQVGDSMDRSIPPGLVNGLALQLRNTSRSEEDRNRDLATALEQLLQAYPRDMEKEKTMLVLALLLAKKVASHTPSLLRDVFHTTVNFINQNLRTYVRSLARNGMD

SEQ ID NO: 7773 - protein, 91 aa, Homo sapiens
  SITE (85): Xaa equals any amino acid
  SITE (87): Xaa equals any amino acid
MSLSLVSVSVGPSTLACSFLRPKARPSKRSPRNYTDSTSPGGPRAPRGGAWRLSSQQNSSPKGVAVAKASYRPVLCFLPGPWSSXPXAFLI

SEQ ID NO: 7774 - protein, 43 aa, Homo sapiens
MGNQKLLLSLEVLPQLLLVLILMPWFLLVGKGHSYHSEEQEKS

SEQ ID NO: 7775 - protein, 24 aa, Homo sapiens
MQLLIVWNESLTNSVPASVDTSQC

SEQ ID NO: 7776 - protein, 214 aa, Homo sapiens
MQVTITLTSPIIREENMREGDVTSGMVKDPPDVLDRQKCLDALAALRHAKWFQARANGLQSCVIIIRILRDLCQRVPTWSDFPSWAMELLVEKAISSASSPQSPGDALRRVFECISSGIILKGSPGLLDPCEKDPFDTLATMTDQQREDITSSAQFALRLLAFRQIHKVLGMDPLPQMSQRFNIHNNRKRRRDSDGVDGFEAEGKKDKKDYDNF

SEQ ID NO: 7777 - protein, 143 aa, Homo sapiens
LLSILLCLLASGLVVFFLFPHSVLVDDDGIKVVKVTFNKQDSLVILTIMATLKIRNSNFYTVAVTSLSSQIQYMNTVVNFTGKAEMGGPFSYVYFFCTVPEILVHNIVIFMRTSVKISYIGLMTQSSLETHHYVDCGGNSTAI

SEQ ID NO: 7778 - protein, 236 aa, Homo sapiens
MEVRLIFLSGLCIAVAVVWAVFRNEDRWAWILQDILGIAFCLNLIKTLKLPNFKSCVILLGLLLLYDVFFVFITPFITKNGESIMVELAAGPFGNNEKLPVVIRVPKLIYFSVMSVCLMPVSILGFGDIIVPGLLIAYCRRFDVQTGSSYIYYVSSTVAYAIGMILTFVVLVLMKKGQPALLYLVPCTLITASVVAWRRKEMKKFWKGNSYQMMDHLDCATNEENPVISGEQIVQQ

SEQ ID NO: 7779 - protein, 9 aa, Homo sapiens
MWVCSITDQ

SEQ ID NO: 7780 - protein, 10 aa, Homo sapiens
MCSLSSEHLA

SEQ ID NO: 7781 - protein, 44 aa, Homo sapiens
MSTGSLMTWWLRSSSLRVALCGPARTMTEMCSQTSWPRALAPLA

SEQ ID NO: 7782 - protein, 42 aa, Homo sapiens
  SITE (7): Xaa equals any amino acid
  SITE (13): Xaa equals any amino acid
  SITE (22): Xaa equals any amino acid
MILFPQXALRLGXWPRTWSILXKYSVNFFSAYSPMGAVGTEF

SEQ ID NO: 7783 - protein, 47 aa, Homo sapiens
MWLLIIFCKSASASVLCWIKKFHPVFQESLLYLVQEGSLCYVQQKVP

SEQ ID NO: 7784 - protein, 34 aa, Homo sapiens
MKFSLLFLPMLLILKPDLFHISICTLAACGLTFP

SEQ ID NO: 7785 - protein, 36 aa, Homo sapiens
MSHEKSNELVLLIVTVMRSLTYNIAVVAAWFNGCIR

SEQ ID NO: 7786 - protein, 82 aa, Homo sapiens
  SITE (12): Xaa equals any amino acid
MAFTLYSLLQAXLLCVNAIAVLHEERFLKNIGWGTDQGIGGFGEEPGIKSQLMNLIRSVRTVMRVPLIIVNSIAIVLLLLFG

SEQ ID NO: 7787 - protein, 43 aa, Homo sapiens
MYTKTHKFKFYNFLSLWIWKIFFLLFFILIVALAFPIPCLSIF

SEQ ID NO: 7788 - protein, 103 aa, Homo sapiens
MQSFHHPLRILLWLPLVTKKSLCPVHKTMTQLSLVLASLSNSLSFGYPGFVRANRQTSLIGEFLGGGGWHAFAYCFLSAENASLSLAVSATPPDLVSLICLSQ

SEQ ID NO: 7789 - protein, 122 aa, Homo sapiens
MTTASSLISPFFPLPPPAHFSQCRMTFCLFVLFCLRWSLALLPRVECSGAISAHCNLHLPGSSGFSCLSLLSSWDYRHAPPCPDNFCIFSRDGVSLCWPGWSRTPDLVVHPPRPPKALGLQA

SEQ ID NO: 7790 - protein, 56 aa, Homo sapiens
MNLWLGALIPVTVHLKRMWSHPKFQAQKTFPLSKSPKYHPVFLLVIIMARSSQLKR

SEQ ID NO: 7791 - protein, 99 aa, Homo sapiens
MTTRQPTAVSWPCWLMSSSLSTACLAWTLTGSLAREATRRARSLSPTWNCSARQVPPSPPHSGLGRRGWAQPCHLTCLLVTQLFRVGRIHPILSLPLVT

SEQ ID NO: 7792 - protein, 37 aa, Homo sapiens
MVFSAKIGVRYFLVLSCLPNCCLPADWWHAQWLWGQG

SEQ ID NO: 7793 - protein, 41 aa, Homo sapiens
MTFSPLMCYCCCWVGWAFCLFVWWQSVVVGSGRAYIGFSSY

SEQ ID NO: 7794 - protein, 379 aa, Homo sapiens
MNLCVILLILVFMVPFYIGYFIVSNIRLLHKQRLLFSCLLWLTFMYFFWKLGDPFPILSPKHGILSIEQLISRVGVIGVTLMALLSGFGAVNCPYTYMSYFLRNVTDTDILALERRLLQTMDMIISKKKRMAMARRTMFQKGEVHNKPSGFWGMIKSVTTSASGSENLTLIQQEVDALEELSRQLFLETADLYATKERIEYSKTFKGKYFNFLGYFFSIYCVWKIFMATINIVFDRVGKTDPVTRGIEITVNYLGIQFDVKFWSQHISFILVGIIIVTSIRGLLITLTKFFYAISSSKSSNVIVLLLAQIMGMYFVSSVLLIRMSMPLEYRTIITEVLGELQFNFYHRWFDVIFLVSALSSILFLYLAHKQAPEKQMAP

SEQ ID NO: 7795 - protein, 29 aa, Homo sapiens
MYFSLLVLLFSPSVLFLARKKCTRNNTLN

SEQ ID NO: 7796 - protein, 19 aa, Homo sapiens
KLGFSTILLLSIFIMSEAN

SEQ ID NO: 7797 - protein, 307 aa, Homo sapiens
MNTVLLSLLFSLPRIVYAMAADGLFFQVFAHVHPRTQVPVAGTLAFGLLTAFLALLLDLESLVQFLSLGTLLAYTFVATSIIVLRFQKSSPPSSPGPASPGPLTKQQSSFSDHLQLVGTVHASVPEPGELKPALRPYLGFLDGYSPGAVVTWALGVMLASAITIGCVLVFGNSTLHLPHWGYILLLLLTSVMFLLSLLVLGAHQQQYREDLFQIPMVPLIPALSIVLNICLMLKLSYLTWVRFSIWLLMGLAVYFGYGIRHSKENQRELPGLNSTHYVVFPRGSLEETVQAMQPPSQAPAQDPGHME

SEQ ID NO: 7798 - protein, 56 aa, Homo sapiens
MRASGVYVSECSFVFMCVCVCMSDCTGVLLYLCVCVVARVCLCVSLTLAGCVCKSV

SEQ ID NO: 7799 - protein, 125 aa, Homo sapiens
  SITE (37): Xaa equals any amino acid
MWPRLAFCCWGLALVSGWATFQQMSPSRNFSFRLFPXDRARGPREYPRAARSLATKRRGAEWSGWARRSGDACGCCGSSASAWSLSSWWMIRPAWAKSTSAASSCSSASCCPTSPWCPRPRAWPS

SEQ ID NO: 7800 - protein, 515 aa, Homo sapiens
  SITE (145): Xaa equals any amino acid
  SITE (151): Xaa equals any amino acid
  SITE (168): Xaa equals any amino acid
MAFSKLLEQAGGVGLFQTLQVLTFILPCLMIPSQMLLENFSAAIPGHRCWTHMLDNGSAVSTNMTPKALLTISIPPGPNQGPHQCRRFRQPQWQLLDPNATATSWSEADTEPCVDGWVYDRSVFTSTIVAKWDLVCSSQGLKPLXQSIFMXGILVGSFIWGLLSYRFXRKPMLSWCCLQLAVAGTSTIFAPTFVIYCGLRFVAAFGMAGIFLSSLTLMVEWTTTSRRAVTMTVVGCAFSAGQAALGGLAFALRDWRTLQLAASVPFFAISLISWWLPESARWLIIKGKPDQALQELRKVARINGHKEAKNLTIEVLMSSVKEEVASAKEPRSVLDLFCVPVLRWRSCAMLVVNFSLLISYYGLVFDLQSLGRDIFLLQALFGAVDFLGRATTALLLSFLGRRTIQAGSQAMGGLAILANMLVPQVRMTADGILHTVGRLGAMMGPLILMSRQALPLLPPLLYGVISIASSLVVLFFLPETQGLPLPDTIQDLESQKSTAAQGNRQEAVTVESTSL

SEQ ID NO: 7801 - protein, 212 aa, Homo sapiens
MKVFKFIGLMILLTSAFSAGSGQSPMTVLCSIDWFMVTVHPFMLNNDVCVHFHELHLGLGCPPNHVQPHAYQFTYRVTECGIRAKAVSQDMVIYSTEIHYSSKGTPSKFVIPVSCAAPQKSPWLTKPCSMRVASKSRATAQKDEKCYEVFSLSQSSQRPNCDCPPCVFSEEEHTQVPCHQAGAQEAQPLQPSHFLDISEDWSLHTDDMIGSM

SEQ ID NO: 7802 - protein, 62 aa, Homo sapiens
MREDPTWGRSLKSSLKILSDLSYSLVLWLTAILGLTAQKSQEKSGRARIQSICSYNVATSFA

SEQ ID NO: 7803 - protein, 59 aa, Homo sapiens
MLCQTIPLCNRLHIVFMILIKLYVETECEVKSEHKKIMHDEIAYHFIGYLLCIYTLRPL

SEQ ID NO: 7804 - protein, 23 aa, Homo sapiens
MFLKAQWLYSLLLNCLLPEGTSS

SEQ ID NO: 7805 - protein, 151 aa, Homo sapiens
  SITE (137): Xaa equals any amino acid
MLLFNWICIVITGLAMDMQLLMIPLIMSVLYVWAQLNRDMIVSFWFGTRFKACYLPWVILGFNYIIGGSVINELIGNLVGHLYFFLMFRYPMDLGGRNFLSTPQFLYRWLPSRRGGVSGFGVPPASMRRAADQNGGXGRHNWGQGFRLGDQ

SEQ ID NO: 7806 - protein, 568 aa, Homo sapiens
MVLLHWCLLWLLFPLSSRTQKLPTRDEELFQMQIRDKAFFHDSSVIPDGAEISSYLFRDTPKRYFFVVEEDNTPLSVTVTPCDAPLEWKLSLQELPEDRSGEGSGDLEPLEQQKQQIINEEGTELFSYKGNDVEYLISSSSPSGLYQLDLLSTEKDTHFKVYATTTPESDQPYPELPYDPRVDVTSLGRTTVTLAWKPSPTASLLKQPIQYCVVINKEHNFKSLCAVEAKLSADDAFMMAPKPGLDFSPFDFAHFGFPSDNSGKERSFQAKPSPKLGRHVYSRPKVDIQKICIGNKNIFTVSDLKPDTQYYFDVFVVNINSNMSTAYVGTFARTKEEAKQKTVELKDGKITDVFVKRKGAKFLRFAPVSSHQKVTFFIHSCLDAVQIQVRRDGKLLLSQNVEGIQQFQLRGKPKAKYLVRLKGNKKGASMLKILATTRPTKQSFPSLPEDTRIKAFDKLRTCSSATVAWLGTQERNKFCIYKKEVDDNYNEDQKKREQNQCLGPDIRKKSEKSSVNISTVKNLQKAVTTETIKGLQPGKSYLLDVYVIGHGGHSVKYQSKVVKTRKFC

SEQ ID NO: 7807 - protein, 37 aa, Homo sapiens
MYSFKAALGVKHRRYMQHLVIISALFCSLLGTLITKC

SEQ ID NO: 7808 - protein, 55 aa, Homo sapiens
MVKLSKEAKQRLQQLFKGSQFAIRWGFIPLVIYLGFKRGADPGMPEPTVLSLLWG

SEQ ID NO: 7809 - protein, 69 aa, Homo sapiens
MLGFAFRDKRWWIYFACSKDSQGVRAAYCQILLLFYVSVYSLSFSYLLDHFCSLPKPLLFGTVSQIPHF

SEQ ID NO: 7810 - protein, 32 aa, Homo sapiens
MGVNKVLFTFFFFSSLLDGVGTSHSLASFPHT

SEQ ID NO: 7811 - protein, 46 aa, Homo sapiens
MQPSCVNFRLKLFYSHTFMLRLGFLFGLLDAHFDIDIRGFKPSLKG

SEQ ID NO: 7812 - protein, 51 aa, Homo sapiens
MAGWFRGFFGFLFFFLCLFNLKLFKLKHSQMFGGKHPLKMGPCACLLGRRS

SEQ ID NO: 7813 - protein, 50 aa, Homo sapiens
MHFKRTQNHLNIVTWLLQVMIIVMLIIMRISCTHQPVESKKFPFRNFLSC

SEQ ID NO: 7814 - protein, 34 aa, Homo sapiens
MLSLMSHLHVQQHLSSILLILIVFAFLSNPFLNQ

SEQ ID NO: 7815 - protein, 51 aa, Homo sapiens
MSFDAEKFLILKFILQFFLLLYVLFLVLYLRICCHTQGHEDLPVCYLLRVL

SEQ ID NO: 7816 - protein, 25 aa, Homo sapiens
MLNKCQTIFYITLLLFNFVTFRGGG

SEQ ID NO: 7817 - protein, 51 aa, Homo sapiens
MCSYCMPYLIIFLSVIHNHKTIPLLKVLVDKLNCIITDLCISRDDVFPTTC

SEQ ID NO: 7818 - protein, 105 aa, Homo sapiens
MNLGVSMLRILFLLDVGGAQVLATGKTPGAEIDFKYALIGTAVGVAISAGFLALKICMIRRHLFDDDSSDLKSTPGGLSDTIPLKKRAPRRNHNFSKRDAQVIEL

SEQ ID NO: 7819 - protein, 83 aa, Homo sapiens
MGVRVWELPAQPTGLHLLCFCTRTMLLALKLPKTKHSFPDPYTSILSFIHPAFTENLTLCQVSVFLSSSNTEMNQMFHGVSFR

SEQ ID NO: 7820 - protein, 40 aa, Homo sapiens
MTFSPLSSTFWWSSRFHCEMLWFVSLLVTFTAHSVEYSQY

SEQ ID NO: 7821 - protein, 64 aa, Homo sapiens
MFCPSQMDLEPFWFCLMAALFIFYCLLLYFLHIFKDGVSRLPSTEYKYKSLSVLVFCKKHDCSF

SEQ ID NO: 7822 - protein, 44 aa, Homo sapiens
MPHFLRWLLTTFRIRASCGSTPCWSPSHLGCLQPALPRDLSHLE

SEQ ID NO: 7823 - protein, 68 aa, Homo sapiens
MKRLRFVLRVFQMTAFITGAHTITNYSDRRLYISPLSHFFMNSGSSAQSVLSHSYVSQIFFKNVSKYF

SEQ ID NO: 7824 - protein, 40 aa, Homo sapiens
MKLLFCLRYYMLLSVVVKATSTIPSNIEITSLSWVCHNST

SEQ ID NO: 7825 - protein, 108 aa, Homo sapiens [sequence omitted]

SEQ ID NO: 7826 - protein, 288 aa, Homo sapiens
  SITE (23): Xaa equals any amino acid
MKTLATGTKNRRRRPAAAAAACXVQGPEPARVEKIFTPAAPVHTNKEDPATQTNLGFIHAFVAAISVIIVSELGDKTFFIAAIMAMRYNRLTVLAGAMLALGLMTCLSVLFGYATTVIPRVYTYYVSTVLFAIFGIRMLREGLKMSPDEGQEELEEVQAELKKKDEEFQRTKLLNGPGDVETGTSITVPQKKWLHFISPIFVQALTLTFLAEWGDRSQLTTIVLAAREDPYGVAVGGTVGHCLCTGLAVIGGRMIAQKISVRTVTIIGGIVFLAFAFSALFISPDSGF

SEQ ID NO: 7827 - protein, 85 aa, Homo sapiens
  SITE (44): Xaa equals any amino acid
  SITE (57): Xaa equals any amino acid
MLLQLLHVFWSCLILRMLYSFMKKGQMEKDIRSDVEESDSSEEXAAAQEPLQLKNGXAGGPRPAPTDGPRSRVAGRLTNRHTTAT

SEQ ID NO: 7828 - protein, 67 aa, Homo sapiens
MYFLLSVTSESVWRSWTLTFHSFAILSLRCWTSLLLLIPLTSCNFSSPSWRMTASQVPSKRKASMTL

SEQ ID NO: 7829 - protein, 352 aa, Homo sapiens
  SITE (284): Xaa equals any amino acid
MDFIQHLGVCCLVALISVGLLSVAACWFLPSIIAAAASWIITCVLLCCSKHARCFILLVFLSCGLREGRNALIAAGTGIVILGHVENIFHNFKGLLDGMTCNLRAKSFSIHFPLLKKYIEAIQWIYGLATPLSVFDDLVSWNQTLAVSLFSPSHVLEAQLNDSKGEVLSVLYQMATTTEVLSSLGQKLLAFAGLSLVLLGTGLFMKRFLGPCGWKYENIYITRQFVQFDERERHQQRPCVLPLNKEERRKYVIIPTFWPTPKERKNLGLFFLPILIHLCIWVLXAAVDYLLYRLIFSVSKQFQSLPGFEVHLKLHGEKQGTQDIIHDSSFNISVFEPNCIPKPWQALKLLAH

SEQ ID NO: 7830 - protein, 58 aa, Homo sapiens; identical to SEQ ID NO: 7566

SEQ ID NO: 7831 - protein, 287 aa, Homo sapiens
MRPDPRLKWAVLVLVLVQMLACWLVRGLAWRWLLFWAYAFGGCVNHSLTLAIHDISHNAAFGTGRAARNRWLAVFANLPVGVPYAASFKKYHVDHHRYLGGDGLDVDVPTRLEGWFFCTPARKLLWLVLQPFFYSLRPLCVHPKAVTRMEVLNTLVQLAADLAIFALWGLKPVVYLLASSFLGLGLHPISGHFVAEHYMFLKGHETYSYYGPLNWITFNVGYHVEHHDFPSIPGYNLPLVRKIAPEYYDHLPQHHSWVKVLWDFVFEDSLGPYARVKRVYRLAKDGL

SEQ ID NO: 7832 - protein, 171 aa, Homo sapiens
MGRLPLLRRVLKGLQLLLSLLAFICEEVVSQCTLCGGLYFFEFVSCSAFLLSLLILIVYCTPFYERVDTTKVKSSDFYITLGTGCVFLLASIIFVSTHDRTSAEIAAIVFGFIASFMFLLDFITMLYEKRQESQLRKPENTTRAEALTEPLMPKDSGEQMLPKVVTLHCGA

SEQ ID NO: 7833 - protein, 302 aa, Homo sapiens
  SITE (237): Xaa equals any amino acid
MKAPGRLVLIILCSVVFSAVYILLCCWAGLPLCLATCLDHHFPTGSRPTVPGPLHFSGYSSVPDGKPLVREPCRSCAVVSSSGQMLGSGLGAEIDSAECVFRMNQAPTVGFEADVGQRSTLRVVSHTSVPLLLRNYSHYFQKARDTLYMVWGQGRHMDRVLGGRTYRTLLQLTRMYPGLQVYTFTERMMAYCDQIFQDETGKNRRQSGSFLSTGWFTMILALELCEEIVVYGMVSDXYCREKSHPSVPYHYFEKGRLDECQMYLAHEQAPRSAHRFITEKAVFSRWAKKRPIVFAHPSWRTE

SEQ ID NO: 7834 - protein, 32 aa, Homo sapiens
MTRWLVQHHTSLVQVLAVSFPAEGPGTEFPTS

SEQ ID NO: 7835 - protein, 48 aa, Homo sapiens
MRLLLLLLVAASAMVRSEASANLGGVPSKRLKMQYATGPLLKFQICVS

SEQ ID NO: 7836 - protein, 113 aa, Homo sapiens
MSPSPRWGFLCVLFTAVHPAPSTAPVQDKCPVNTWEAMQASSQQLLQTDPRPKPFLLPPLPPLLLISAGTEVSSLVFQKSPLHTQPEGAIKTAGQPTSVHSKVLSKGSLLLGE

SEQ ID NO: 7837 - protein, 556 aa, Homo sapiens
MARFGLPALLCTLAVLSAALLAAELKSKSCSEVRRLYVSKGFNKNDAPLHEINGDHLKICPQGSTCCSQEMEEKYSLQSKDDFKSVVSEQCNHLQAVFASRYKKFDEFFKELLENAEKSLNDMFVKTYGHLYMQNSELFKDLFVELKRYYVVGNVNLEEMLNDFWARLLERMFRLVNSQYHFTDEYLECVSKYTEQLKPFGDVPRKLKLQVTRAFVAARTFAQGLAVAGDVVSKVSVVNPTAQCTHALLKMIYCSHCRGLVTVKPCYNYCSNIMRGCLANQGDLDFEWNNFIDAMLMVAERLEGPFNIESVMDPIDVKISDAIMNMQDNSVQVSQKVFQGCGPPKPLPAGRISRSISESAFSARFRPHHPEERPTTAAGTSLDRLVTDVKEKLKQAKKFWSSLPSNVCNDERMAAGNGNEDDCWNGKGKSRYLFAVTGNGLANQGNNPEVQVDTSKPDILILRQIMALRVMTSKMKNAYNGNDVDFFDISDESSGEGSGSGCEYQQCPSEFDYNATDHAGKSANEKADSAGVRPGAQAYLLTVFCILFLVMQREWR

SEQ ID NO: 7838 - protein, 117 aa, Homo sapiens
MGVLCRSLAGLGGLSLLGVFCGGYLMALAVLSPCPPLVGTSAGVVLVVLSWVLCLGVFSYVKVAASSLLHGGGRPALLAAGVAIQVGSLLGAVAMFPPTSIYHVFHSRKDCADPCDS

SEQ ID NO: 7839 - protein, 145 aa, Homo sapiens
MLTRLVLSAHLSSTTSPPWTHAAISWELDNVLMPSPRIWPQVTPTGRSASVRSEGNTSSLWNFSAGQDVHAIVTRTCESVLSSAVYTHGCGCVRSATNITCQSSGQQRQAARQEEENSICKAHDSREGRLGYPLSAHQPGSGGPN

SEQ ID NO: 7840 - protein, 96 aa, Homo sapiens
MIGDILLFGTLLMNAGAVLNFKLKKKDTQGFGEESREPSTGDNIREFLLSLRYFRIFIALWNIFMMFCMIVLRKLKQIAFPSSTGAITLNTTVNEL

SEQ ID NO: 7841 - protein, 144 aa, Homo sapiens
MAFTFAAFCYMLALLLTAALIFFAIWHIIAFDELKTDYKNPIDQCNTLNPLVLPEYLIHAFFCVMFLCAAEWLTLGLNMPLLAYHIWRYMSRPVMSGPGLYDPTTIMNADILAYCQKEGWCKLAFYLLAFFYYLYGMIYVLVSS

SEQ ID NO: 7842 - protein, 170 aa, Homo sapiens
MISIHNEEENAFILDTLKKQWKGPDDILLGMFYDTDDASFKWFDNSNMTFDKWTDQDDDEDLVDTCAFLHIKTGEWKKGNCEVSSVEGTLCKTAIPYKRKYLSDNHILISALVIASTVILTVLGAIIWFLYKKHSDSRFTTVFSTAPQSPYNEDCVLVVGEENEYPVQFD

SEQ ID NO: 7843 - protein, 12 aa, Homo sapiens
GGNVLIFHFRCL

SEQ ID NO: 7844 - protein, 70 aa, Homo sapiens
MSHCTWPLDYSFLFMSCASICGQHGASVGNTGRKQVQIWLGLLAWQLGKPPLLWLLPRLFMTVAAHQLQL

SEQ ID NO: 7845 - protein, 31 aa, Homo sapiens
MITLCIFLLFKVFVGIILHYLIGKNIYVYSV

SEQ ID NO: 7846 - protein, 44 aa, Homo sapiens
MTSLPILAFGAVYWPDLASHSFSPSRSLAQTPHMSVLRVAFQEG

SEQ ID NO: 7847 - protein, 43 aa, Homo sapiens
KGKIHFLFVLFLTDLTITFFKIVITTMHSIRYKCILFCMFMHK

SEQ ID NO: 7848 - protein, 57 aa, Homo sapiens [sequence omitted]

SEQ ID NO: 7849 - protein, 52 aa, Homo sapiens
MKSHISWRLCSLLLILFSLILSACFISARWSSNSDIFFSAWSIQLLILVYAS

SEQ ID NO: 7850 - protein, 50 aa, Homo sapiens
MTYHVVCAFLIVVLKKQFILALQTISTSLRSKQILMVLSSTIIADSTFYY

SEQ ID NO: 7851 - protein, 43 aa, Homo sapiens [sequence omitted]

SEQ ID NO: 7852 - protein, 129 aa, Homo sapiens [sequence omitted]

SEQ ID NO: 7853 - protein, 167 aa, Homo sapiens [sequence omitted]

SEQ ID NO: 7854 - protein, 44 aa, Homo sapiens
MNRILSYLETGFFSLPLYFFLTYELHVPLMKTMNWTCTTVHVID

SEQ ID NO: 7855 - protein, 467 aa, Homo sapiens
MWRCPLGLLLLLPLAGHLALGAQQGRGRRELAPGLHLRGIRDAGGRYCQEQDLCCRGRADDCALPYLGAICYCDLFCNRTVSDCCPDFWDFCLGVPPPFPPIQGCMHGGRIYPVLGTYWDNCNRCTCQENRQWQCDQEPCLVDPDMIKAINQGNYGWQAGNHSAFWGMTLDEGIRYRLGTIRPSSSVMNMHEIYTVLNPGEVLPTAFEASEKWPNLIHEPLDQGNCAGSWAFSTAAVASDRVSIHSLGHMTPVLSPQNLLSCDTHQQQGCRGGRLDGAWWFLRRRGVVSDHCYPFSGRERDEAGPAPPCMMHSRAMGRGKRQATAHCPNSYVNNNDIYQVTPVYRLGSNDKEIMKELMENGPVQALMEVHEDFFLYKGGIYSHTPVSLGRPERYRRHGTHSVKITGWGEETLPDGRTLKYWTAANSWGPAWGERGHFRIVRGVNECDIESFVLGVWGRVGMEDMGHH

SEQ ID NO: 7856 - protein, 166 aa, Homo sapiens
  SITE (59): Xaa equals any amino acid
METVILHTALMLKKRIVVYHPKIEAVQEFTRTLPALQMCTGYVAGFVDLEVSNRPDLYXVFVNLAESEITIAPLAKEAMAMGKLHKEMGQLIVQSAEDPEKSESHVIQDIALKTREIFTNLAPFSEVSADGEKRVLNLEALKQKRFPPATENFLYHLAAAEQMLKI

SEQ ID NO: 7857 - protein, 392 aa, Homo sapiens
MEWWASSPLRLWLLLFLLPSAQGRQKESGSKWKVFIDQINRSLENYEPCSSQNCSCYHGVIEEDLTPFRGGISRKMMAEVVRRKLGTHYQITKNRLYRENDCMFPSRCSGVEHFILEVIGRLPDMEMVINVRDYPQVPKWMEPAIPVFSFSKTSEYHDIMYPAWTFWEGGPAVWPIYPTGLGRWDLFREDLVRSAAQWPWKKKNSTAYFRGSRTSPERDPLILLSRKNPKLVDAEYTKNQAWKSMKDTLGKPAAKDVHLVDHCKYKYLFNFRGVAASFRFKHLFLCGSLVFHVGDEWLEFFYPQLKPWVHYIPVKTDLSNVQELLQFVKANDDVAQEIAERGSQFIRNHLQMDDITCYWENLLSEYSKFLSYNVTRRKGYDQIIPKMLKTEL

SEQ ID NO: 7858 - protein, 55 aa, Homo sapiens
MFASYHIQFFTWLIQKLSLVWKSVVAIREQGKELVWKQHLPLRSYSPNNAKSLGL

SEQ ID NO: 7859 - protein, 64 aa, Homo sapiens
  SITE (36): Xaa equals any amino acid
MCSPSLSSSPPPLLQVFFFFFFSPHWAAKVVPQWKXRHPQVSSQLLLCFLRVNCQFLFLQEILF

SEQ ID NO: 7860 - protein, 47 aa, Homo sapiens
MAPPRGTWFLLLSLRLPYGAACWVFLPFPASCRAEGVAAPIKCSRNE

SEQ ID NO: 7861 - protein, 234 aa, Homo sapiens
MAASRWARKAVVLLCASDLLLLLLLLPPPGSCAAEGSPGTPDESTPPPRKKKKDIRDYNDADMARLLEQWEKDDDIEEGDLPEHKRPSAPVDFSKIDPSKPESILKMTKKGKTLMMFVTVSGSPTEKETEEITSLWQGSLFNANYDVQRFIVGSDRAIFMLRDGSYAWEIKDFLVGQDRCADVTLEGQVYPGKGGGSKEKNKTKQDKGKKKKEGDLKSRSSKEENRAGNKREDL

SEQ ID NO: 7862 - protein, 122 aa, Homo sapiens
MLMVRLFNSFPHALLILFLWGEQSPLTKPCPTHWAPVWMVPGPQVLWGTHWGLPGNHFCRIRSHTRRAQCPREGPFPTTLPHWGWVTGTYRGWCCLASPACGGSWVLLPFGFVFYLSGWASF

SEQ ID NO: 7863 - protein, 50 aa, Homo sapiens
MIIPKFYLFKLLLLLQKITHFICGKTLNNLNFRCESYFLFLYLYCAYILY

SEQ ID NO: 7864 - protein, 60 aa, Homo sapiens
MGPWCLTLLSTTSGFFSENLYLTLILSFLLSIESVNTDPFIFQFPKSCFAIASILLSGGV

SEQ ID NO: 7865 - protein, 133 aa, Homo sapiens
  SITE (114): Xaa equals any amino acid
MALMEVNLLSGFMVPSEAISLSETVKKVEYDHGKLNLYLDSVNETQFCVNIPAVRNFKVSNTQDASVSIVDYYEPRRQAVRSYNSEVKLSSCDLCSDVQGCRPCEDGASGSHHXSSVIFIFCFKLLYFMELWL

SEQ ID NO: 7866 - protein, 48 aa, Homo sapiens
MSTLRRMALLYIETPLLRALMVQGPRLVSVRAAMHGKCGGRALWALWQ

SEQ ID NO: 7867 - protein, 194 aa, Homo sapiens
MSTAFCPIHSSLGSMVMCLCILSPLCIASKSLRVCTKSYMEGHGKTRVPVVLVGNKADLSPEREVQAVEGKKLAESWGATFMESSARENQLTQGIFTKVIQEIARVGEFLWARASLPSHVSPWVWGNCLASAPGTCHVPVGGRSSGLHGYGCQLCSWPLDTQCGILMFAHFPQAPVAWMSMFTKGQGPLMDTGL

SEQ ID NO: 7868 - protein, 49 aa, Homo sapiens [sequence omitted]

SEQ ID NO: 7869 - protein, 173 aa, Homo sapiens
  SITE (83): Xaa equals any amino acid
  SITE (110): Xaa equals any amino acid
  SITE (115): Xaa equals any amino acid
  SITE (118): Xaa equals any amino acid
  SITE (168): Xaa equals any amino acid
MQLIPLEQLCMLLLMSDNVDRCFETCPPRTFLPALCKIFLDESAPDNVLEVTARAITYYLDVSAECTRRIVGVDGAIKALCNXLVVVELNNRTSRDLAEQCVKVLELICXPESGXVFXAGGLNRVAYLPSVNSGHLVHKDTLHSAMAVVSRLCGKMEPQDSSLEICVXSLSSL

SEQ ID NO: 7870 - protein, 123 aa, Homo sapiens
MQAQFCCSAVCSAFLHILASPSGAKMAAAFQASHPDSDPEKLPIPTWVSLCRNEKPHPAAETSPSSVFSGLIHQRRPPLNQSLAKRMGPPGRLDQTGPALWGWGEAQMKAAGQDGLLDLCYQQ

SEQ ID NO: 7871 - protein, 407 aa, Homo sapiens
  SITE (114): Xaa equals any amino acid
MGFLFLLGLYISSLASCMGGLYGAPRILQCIAQEKVIPALACLGQGKGPNKTPVAAICLTSLVTMAFVFVGQVNVLAPIVTINFMLTYVAVDYSYFSLSMCSCSLTPVPEPVLXEGAEGLHCSEHLLLEKAPSYGSEGPAQRVLEGTLLEFTKDMDQLLQLTRKLESSQPRQGEGNRTPESQKRKSKKATKQTLQDSFLLDLKSPPSFPVEISDRLPAASWEGQESCWNKQTSKSEGTQPEGTYGEQLVPELCNQSESSGEDFFLKSRLQEQDVWRRSTSFYTHMCNPWVSLLGAVGSLLIMFVIQWVYTLVNMGVAAIVYFYIGRASPGLHLGSASNFSFFRWMRSLLLPSCRSLQSPQEQIILAPSLAKVDMEMTQLTQENADFATRDRYHHSSLVNREQLMPHY

SEQ ID NO: 7872 - protein, 845 aa, Homo sapiens
  SITE (477): Xaa equals any amino acid
MLSGVWFLSVLTVAGILQTESRKTAKDICKIRCLCEEKENVLNINCENKGFTTVSLLQPPQYRIYQLFLNGNLLTRLYPNEFVNYSNAVTLHLGNNGLQEIRTGAFSGLKTLKRLHLNNNKLEILREDTFLGLESLEYLQADYNYISAIEAGAFSKLNKLKVLILNDNLLLSLPSNVFRFVLLTHLDLRGNRLKVMPFAGVLEHIGGIMEIQLEENPWNCTCDLLPLKAWLDTITVFVGEIVCETPFRLHGKDVTQLTRQDLCPRKSASDSSQRGSHADTHVQRLSPTMNPALNPTRAPKASRPPKMRNRPTPRVTVSKDRQSFGPIMVYQTKSPVPLTCPSSCVCTSQSSDNGLNVNCQERKFTNISDLQPKPTSPKKLYLTGNYLQTVYKNDLLEYSSLDLLHLGNNRIAVIQEGAFTNLTSLRRLYLNGNYLEVLYPSMFDGLQSLQYLYLEYNVIKEIKPLTFDALINLQLLXLNNNLLRSLPDNIFGGTALTRLNLRNNHFSHLPVKGVLDQLPAFIQIDLQENPWDCTCDIMGLKDWTEHANSPVIINEVTCESPAKHAGEILKFLGREAICPDSPNLSDGTVLSMNHNTDTPRSLSVSPSSYPELHTEVPLSVLILGLLVVFILSVCFGAGLFVFVLKRRKGVPSVPRNTNNLDVSSFQLQYGSYNTETHDKTDGHVYNYIPPPVGQMCQNPIYMQKEGDPVAYYRNLQEFSYSNLEEKKEEPATPAYTISATELLEKQATPREPELLYQNIAERVKELPSAGLVHYNFCTLPKRQFAPSYESRRQNQDRINKTVLYGTPRKCFVGQSKPNHPLLQAKPQSEPDYLEVLEKQTAISQL

SEQ ID NO: 7873 - protein, 42 aa, Homo sapiens
MPVAFHLPFLLILPYRVLPVGQVTQLTPRAVEVKIHNHGRLP

SEQ ID NO: 7874 - protein, 48 aa, Homo sapiens
MCIHYSRVIFSFLKLRIKSISWYAMWLYFFCYLNCLAKVRSATTYLYV

SEQ ID NO: 7875 - protein, 44 aa, Homo sapiens
MLQPGTFNSIFSLFFLFVTLVFHLYQLFLYLLYLQFYKLPQILF

SEQ ID NO: 7876 - protein, 65 aa, Homo sapiens
MYLLHSILFMLCLVGMVEFNKSTRECILFKTLWLIPLFTYKLAYLCEKLKFVKFCASLLIAVFDH

SEQ ID NO: 7877 - protein, 42 aa, Homo sapiens
MGLKNSSLITCFLLAFVVFVLFCLFCFVFLCYFIGKVSGMCS

SEQ ID NO: 7878 - protein, 46 aa, Homo sapiens
MNPLSFLFCFIICRLLAENAINIEILTGTYENFPTKAYYFRQRSRK

SEQ ID NO: 7879 - protein, 71 aa, Homo sapiens [sequence omitted]

SEQ ID NO: 7880 - protein, 47 aa, Homo sapiens
MALHPGSSHLLVAVPVSWFLFCIPGISFITLSWSYQESPVSFLSVEG

SEQ ID NO: 7881 - protein, 56 aa, Homo sapiens
MESGHLLWALLFMQSLWPQLTDGATRVYYLGIRDVQWNYAPKGRNVITNQPLDSDM

SEQ ID NO: 7882 - protein, 26 aa, Homo sapiens
MRHRARRFFFFFFLSGIWAGHGGSCL

SEQ ID NO: 7883 - protein, 45 aa, Homo sapiens
  SITE (18): Xaa equals any amino acid
MPICEHFIWPLLAFIPQXLSSGLRVFLSFTQQNHQERDFKRDYQA

SEQ ID NO: 7884 - protein, 44 aa, Homo sapiens
MNNAAKNINVQVSVWTYAFISLIFILFHLGVELLGCMVVLCLTV

SEQ ID NO: 7885 - protein, 54 aa, Homo sapiens
MFEDTLRTLYILLFYLRYICLLSPHIALMTLILIDGFLQCYYCALHVPCIIAFL

SEQ ID NO: 7886 - protein, 31 aa, Homo sapiens [sequence omitted]

SEQ ID NO: 7887 - protein, 435 aa, Homo sapiens
MRPWRFGWPRTLASQLSLIFLISLVCAHGLSFSAQFYERYISARTVMLGNLENDVSTSVAILDRLPANERASWLARLDRQNYRYLLNAGEAGEPMTSNDVPMAATSIADALGEHYALTFRDIPGIQKHFQVHLTLADGNPITLDVRPAALPVAYWLPVVLVLQLALLLGCTWVAVRLAVRPLTRLARAVETLDPNAHPTPLDETGPSEVAHAAAAFNAMQQRIAEYLKERMQILAAISHDLQTPITRMKLRAEFMDDSADREKLWSDLSEMEHLVREGVAYARSVHGATEASHRIDLDAFLDSLVFDYQDMQKQVSLRGKSALILDTRPHALRRVLVNLVDNALKFAGNAELEVGSTANGQLSIKVLDQGPGIAEDELAQVLQPFYRVESSRNRGTGGTGLGLAIAQQLAVAIGGTLTLSNRVEGGLCAEIRLSL

SEQ ID NO: 7888 - protein, 61 aa, Homo sapiens
MLFWAYPICVFIDSLSCQPCLWSTGATSHFNSPTTSPLFTLFMPCALAPNPFTQLGKLDDR

SEQ ID NO: 7889 - protein, 40 aa, Homo sapiens
  SITE (35): Xaa equals any amino acid
MNEATMAFSVLILPVFYAQIRNKSFLCLSDILPLXLILLF

SEQ ID NO: 7890 - protein, 98 aa, Homo sapiens
MFPRVEFFFLLRTSVALPALALSGKDSRGDTAVPAVTMCSDHREAFTLHPNSQSQLSQPRIWFSVYQMHDAHNCFIKHETKPRSITVLYSSSLNSGLV

SEQ ID NO: 7891 - protein, 344 aa, Homo sapiens
  SITE (126): Xaa equals any amino acid
  SITE (128): Xaa equals any amino acid
MEKIGSSLPQDDDAPKKQALYLMFDTSQESPVKSSPVRMSESPTPCSGSSFEETEALVNTAAKNQHPVPRGLAPNQESHLQVPEKSSQKELEAMGLGTPSEAIEIREAAHPTDVSISKTALYSRIXTXEVEKPAGLLFQQPDLDSALQIARAEIITKEREVSEWKDKYEESRREVMEMRKIVAEYEKTIAQMIEDEQREKSVSHQTVQQLVLEKEQALADLNSVEKSLADLFRRYEKMKEVLEGFRKNEEVLKRCAQEYLSRVKKEEQRYQALKVHAEEKLDRANAEIAQVRGKAQQEQAAHQASLRKEQLRVDALERTLEQKNKEIEELTKICDELIAKMGKS

SEQ ID NO: 7892 - protein, 34 aa, Homo sapiens
MTLYLCLLFPYFTFFPLSALLPRDCTPQQIINYH

SEQ ID NO: 7893 - protein, 63 aa, Homo sapiens [sequence omitted]

SEQ ID NO: 7894 - protein, 67 aa, Homo sapiens [sequence omitted]

SEQ ID NO: 7895 - protein, 25 aa, Homo sapiens
MQKRERKLYVIFLYLAFILLHWQSG

SEQ ID NO: 7896 - protein, 62 aa, Homo sapiens
MFFRMQVCEHHGFWVILLLLSLKMEIPLAAYPTAEYSSIGSGFTPLHPSRTFTQASPLPSIF

SEQ ID NO: 7897 - protein, 117 aa, Homo sapiens
MARSALRLEILGQLLVGVSSCCAEIRSRSYLGFCWKNIQDERKKKIILRGSRNLLCPRLLRPLEPVQAKGTQSVDPREVVRETRSMSTLPADFCLLPQASRMAQKGSPSRSSLQLLF

SEQ ID NO: 7898 - protein, 40 aa, Homo sapiens
MCRRIQRLRAMLHMLLVSMLPTVGKPNMYQPPQNYDILLQ

SEQ ID NO: 7899 - protein, 41 aa, Homo sapiens
MASLLRTCCVPYIVLSIYLDYLIKSSQSLYLTDGEIKAHGT

SEQ ID NO: 7900 - protein, 66 aa, Homo sapiens
MYLAVYLLLFLCICFYFIALFSHALVPHCFNYPGFSFNLVHWSSLIPPLPTFFFFNSFSNCSYFSI

SEQ ID NO: 7901 - protein, 90 aa, Homo sapiens
MKFLAVLVLLGVSIFLVSAQNPTTAAPADTYPATGPADDEAPDAETTAAATTATTAAPTTATTAASTTARKDIPVLPKWVGDLPNGRVCP

SEQ ID NO: 7902 - protein, 63 aa, Homo sapiens
MLYFCSSIWFGIYFVALITVFLKTLPPLTVGKGPFSGKFVAFFFFLKGKLLFAQYSVLKVEHR

SEQ ID NO: 7903 - protein, 410 aa, Homo sapiens
MELPSGPGPERLFDSHRLPGDCFLLLVLLLYAPVGFCLLVLRLFLGIHVFLVSCALPDSVLRRFVVRTMCAVLGLVARQEDSGLRDHSVRVLISNHVTPFDHNIVNLLTTCSTPLLNSPPSFVCWSRGFMEMNGRGELVESLKRFCASTRLPPTPLLLFPEEEATNGREGLLRFSSWPFSIQDVVQPLTLQVQRPLVSVTVSDASWVSELLWSLFVPFTVYQVRWLRPVHRQLGEANEEFALRVQQLVAKELGQTGTRLTPADKAEHMKRQRHPRLRPQSAQSSFPPSPGPSPDVQLATLAQRVKEVLPHVPLGVIQRDLAKTGCVDLTITNLLEGAVAFMPEDITKGTQSLPTASASKFPSSGPVTPQPTALTFAKSSWARQESLQERKQALYEYARRRFTERRAQEAD

SEQ ID NO: 7904 - protein, 100 aa, Homo sapiens [sequence omitted]

SEQ ID NO: 7905 - protein, 86 aa, Homo sapiens
MTVSLFLLLATSQSQDGCCDSGSCPNSRQQEGHGAAPASRCPCRPSLQAQEPKEESTQMWWLTPVIPPLWEAEARGSLEPRSWRPT

SEQ ID NO: 7906 - protein, 16 aa, Homo sapiens
MSHRARPMILFFFFFF

SEQ ID NO: 7907 - protein, 145 aa, Homo sapiens
  SITE (123): Xaa equals any amino acid
  SITE (135): Xaa equals any amino acid
  SITE (137): Xaa equals any amino acid
MYLQVETRTSSRLHLKRAPGIRSWSLLVGILSIGLAAAYYSGDSLGWKLFYVTGCLFVAVQNLEDWEEAIFDKSTGKVVLKTFSLYKKLLTLFRAGHDQVVVLLHDVRDVSVEEEKVRYFGKXYMVVLRLATGFXHXLTQSADMG

SEQ ID NO: 7908 - protein, 367 aa, Homo sapiens
MAPSGPGSSARRRCRRVLYWIPVVFITLLLGWSYYAYAIQLCIVSMENTGEQVVCLMAYHLLFAMFVWSYWKTIFTLPMNPSKEFHLSYAEKDLLEREPRGEAHQEVLRRAAKDLPIYTRTMSGAIRYCDRCQLIKPDRCHHCSVCDKCILKMDHHCPWVNNCVGFSNYKFFLLFLAYSLLYCLFIAATDLQYFIKFWTNGLPDTQAKFHIMFLFFAAAMFSVSLSSLFGYHCWLVSKNKSTLEAFRSPVFRHGTDKNGFSLGFSKNMRQVFGDEKKYWLLPIFSSLGDGCSFPTCLVNQDPEQASTPAGLNSTAKNLENHQFPAKPLRESQSHLLTDSQSWTESSINPGKCKAGMSNPALTMENET

SEQ ID NO: 7909 - protein, 468 aa, Homo sapiens; identical to SEQ ID NO: 7606

SEQ ID NO: 7910 - protein, 42 aa, Homo sapiens [sequence omitted]

SEQ ID NO: 7911 - protein, 36 aa, Homo sapiens
MYLPVYAFKVLVTLSYRALTPVSEKSQTLMTIKASS

SEQ ID NO: 7912 - protein, 80 aa, Homo sapiens
MWPRMLAFSTWLEWLLFSPLPQSVGCPGPLEFYCVQDRRPPSLPDGADHFSSPTRITSSSISPALSLQAPEAGGFLSIPG

SEQ ID NO: 7913 - protein, 15 aa, Homo sapiens
NATKSQPCLSSLLLF

SEQ ID NO: 7914 - protein, 49 aa, Homo sapiens
MLLTCILLHLWIVVDSVIYMKPTSRDGCLLSALQMARSLIIQLNHSSSN

SEQ ID NO: 7915 - protein, 35 aa, Homo sapiens
  SITE (33): Xaa equals any amino acid
MTCYEVILFFIKLFSDMGKYKECKEFKKQRTKXYM

SEQ ID NO: 7916 - protein, 42 aa, Homo sapiens
MKIVTTLYCLFVFLLNCFGVGGSCIFLSNRTPGFSWAHDCPQ

SEQ ID NO: 7917 - protein, 255 aa, Homo sapiens
MRIPVESAPMFSAKVAVTVQELFRAPVLRVMGPREARGAALGGVVLRCDTRLHPQKRDTPLQFAFYKYSRAVRRFDWGAEYTVPEPEVEELESYWCEAATATRSVRKRSPWLQLPGPGSPLDPASTTAPAPWAAALAPGNRPLSFRKPPVSRSVPLVTSVRNTTSTGLQFPASGAPTAGPPACAPPTPLEQSAGALKPDVDLLLREMQLLKGLLSRVVLELKEPQALRELRGTPETPTSHFAVSPGTPETTPVES

SEQ ID NO: 7918 - protein, 600 aa, Homo sapiens
MLSNTQFIENRVYDEEVEEPVLKAEAEKTEQEKTREQKEVDLIPKVQEAVNYGLQVLDSAFEQLDIKAGNSDSEEDDANGRVELILEPKDLYIDRPLPYLIGSKLFMEQEDVGLGELSSEEGSVGSDRGSIVDTEEEKEEEESDEDFAHHSDNEQNQHTTQMSDEEEDDDGCDLFADSEKEEEDIEDIEENTRPKRSRPTSFADELAARIKGDAMGRVDEEPTTLPSGEAKPRKTLKEKKERRTPSDDEEDNLFAPPKLTDEDFSPFGSGGGLFSGGKGLFDDEDEESDLFMEAPQDRQAGASVKEESSSSKPGKKIPAGAVSVFLGDTDVFGAASVPSLKEPQKPEQPTPRKSPYGPPPTGLFDDDDGDDDDDFFSAPHSKPSKTRKVQSTADIFGDEEGDLFKEKAVASPEATVSQTDENKARAEKKDLFSSQSASNLKGASLLPGKLPTSVSLFDDEDEEDNLFGGTAAKKQTLSLQAQREEKAKASELSKKKASALLFSSDEEDQWNIPASQTHLASDSRSKGEPRDSGTLQSQEAKAVKKTSLFEEDKEDDLFAIAKDSQKKTQRVSLLFEDDVDSGGSLFGSPPTSVPPATKKK

SEQ ID NO: 7919 - protein, 314 aa, Homo sapiens
MLLAQGLILHFLGRAWTWPDALNIENSDSESWTSHTVKKFTASFEASLSGEREFKTPTISLKETIGKYSDDHEMRNEVYHRKIISWFGDSPLALFGLHQLIEYGKKSGKKAGDWYGPAVVAHILRKAVEEARHPDLQGITIYVAQDCTVPVRLGGERTNTDYLEFVKGILSLEYCVGIIGGKPKQSYYFAGFQDDSLIYMDPHYCQSFVDVSIKDFPLETFHCPSPRKMSFRKMDPSCTIGFYCRNVQDFKRASEEITKMLKFSSKEKYPLFTFVNGHSRDYDFTSTTTNEEDLFSEDEKKQLKRFSTEEFVLL

SEQ ID NO: 7920 - protein, 36 aa, Homo sapiens
MFFFLYVYSVLCGLLVYPSLPSHSVSLVTSLVASAL

SEQ ID NO: 7921 - protein, 36 aa, Homo sapiens
  SITE (31): Xaa equals any amino acid
MASINAVYIHVFLGVCVQATAACPWCSQCRXGSVPS

SEQ ID NO: 7922 - protein, 154 aa, Homo sapiens
MNPQTVLLLRVIAAFCFLGILCSLSAFLLDVFGPKHPALKITRRYAFAHILTVLQCATVIGFSYWASELILAQQQQHKKYHGSQVYVTFAVSFYLVAGAGGASILATAANLLRHYPTEEEEQALELLSEMEENEPYPAEYEVINQFQPPPAYTP

SEQ ID NO: 7923 - protein, 511 aa, Homo sapiens
  SITE (135): Xaa equals any amino acid
MVKILVVTVQLILFGLSNQLAVTFREENTIAFRHLFLLGYSDGADDTFAAYTREQLYQAIFHAVDQYLALPDVSLGRYAYVRGGGDPWTNGSGLALCQRYYHRGHVDPANDTFDIDPMVVTDCIQVDPPERPPPXPSDDLTLLESSSSYKNLTLKFHKLVNVTIHFRLKTINLQSLINNEIPDCYTFSVLITFDNKAHSGRIPISLETQAHIQECKHPSVFQHGDNSFRLLFDVVVILTCSLSFLLCARSLLRGFLLQNEFVGFMWRQRGRVISLWERLEFVNGWYILLVTSDVLTISGTIMKIGIEAKNLASYDVCSILLGTSTLLVWVGVIRYLTFFHNYNILIATLRVALPSVMRFCCCVAVIYLGYCFCGWIVLGPYHVKFRSLSMVSECLFSLINGDDMFVTFAAMQAQQGRSSLVWLFSQLYLYSFISLFIYMVLSLFIALITGAYDTIKHPGGAGAEESELQAYIAQCQDSPTSGKFRRGSARACSLLCCCGRDPSEEHSLLVN

SEQ ID NO: 7924 - protein, 40 aa, Homo sapiens
MLLLWAFSGVCAVPARATPVPSSFCPQGPSLCPKQPASLA

SEQ ID NO: 7925 - protein, 68 aa, Homo sapiens
MSGSFILCLALVTRWSPQASSVPLAVYESKTRKSYRSQRDRDGKDRSQGMGLSLLVETRKLLLSANQG

SEQ ID NO: 7926 - protein, 50 aa, Homo sapiens
  SITE (25): Xaa equals any amino acid
  SITE (32): Xaa equals any amino acid
  SITE (45): Xaa equals any amino acid
MGWVNQRIFLFLFFLSQGLALSPRXERTGVIXAHCSLDLPGSSNXPSSAS

SEQ ID NO: 7927 - protein, 63 aa, Homo sapiens [sequence omitted]

SEQ ID NO: 7928 - protein, 89 aa, Homo sapiens
MYHYAWLIFVFLVEMGFCHVGQAGLKLLTSSDPPASASQSAGITGVSHHAWGKRYFQNIVNNFSPKPRQGLILLPRLEWQGHHRSSLQP

SEQ ID NO: 7929 - protein, 36 aa, Homo sapiens
  SITE (32): Xaa equals any amino acid
MIILLLFMLLNNVVLVQEDNCQRKNTVQERRXWSQW

SEQ ID NO: 7930 - protein, 125 aa, Homo sapiens [sequence omitted]

SEQ ID NO: 7931 - protein, 79 aa, Homo sapiens [sequence omitted]

SEQ ID NO: 7932 - protein, 47 aa, Homo sapiens
MSFGISIHTCTYLIFIAFHFIALCKVTFFTDSRFGNPMSISLSAPFF

SEQ ID NO: 7933 - protein, 33 aa, Homo sapiens
MKDLLQRNPWKNSLLLLQVCQAFLVCSLTQLAV

SEQ ID NO: 7934 - protein, 49 aa, Homo sapiens
MCLSRWKIFYTLLILFAFFSITSENETFYMIIIHHNPTQITASCSFTFL

SEQ ID NO: 7935 - protein, 37 aa, Homo sapiens
  SITE (34): Xaa equals any amino acid
  SITE (36): Xaa equals any amino acid
MQQFLFFFLFLEMESRPFARAGVQWCDLGPLHSXLXE

SEQ ID NO: 7936 - protein, 90 aa, Homo sapiens [sequence omitted]

SEQ ID NO: 7937 - protein, 111 aa, Homo sapiens
MRMSLADSLACSVCVALTAAARLLRSRPSSCSSFSWISGTSSSPSFLGSFTSLLGSSLSSLGDSLLGRGTLGNFWEVLISTSTSSWADFSSLVSTSPKVRVPLRPIFTCFL

SEQ ID NO: 7938 - protein, 399 aa, Homo sapiens; identical to SEQ ID NO: 6180

SEQ ID NO: 7939 - protein, 25 aa, Homo sapiens
MLVLLLFWSLGWNKKVVLPLDSLCP

SEQ ID NO: 7940 - protein, 317 aa, Homo sapiens [sequence omitted]

SEQ ID NO: 7941 - protein, 332 aa, Homo sapiens
MLPRLLLLICAPLCEPAELFLIASPSHPTEGSPVTLTCKMPFLQSSDAQFQFCFFRDTRALGPGWSSSPKLQIAAMWKEDTGSYWCEAQTMASKVLRSRRSQINVHIPVSRPILMLRAPRAQAAVEDVLELHCEALRGSPPILYWFYHEDITLGSRSAPSGGGASFNLSLTEEHSGNYSCEANNGLGAQRSEAVTLNFTVPTGARSNHLTSGVIEGLLSTLGPATVALLFCYGLKRKIGRRSARDPLRSLPALPQEFTYLNSPTPGQLQPIYENVNVVSGDEVYSLAYYNQPEQESVAAETLGTHMEDKVSLDIYSRLRKANITDVDYEDAM

SEQ ID NO: 7942 - protein, 86 aa, Homo sapiens
  SITE (2): Xaa equals any amino acid
  SITE (25): Xaa equals any amino acid
SXIVGLAIWRGGLCQELPLERFLLXTVFGSDLSLLSGGDLCLELLGGLCLEVCLRGDICLGPLRVSVSELSLLCLSVQGQQKVCPF

SEQ ID NO: 7943 - protein, 224 aa, Homo sapiens
  SITE (183): Xaa equals any amino acid
  SITE (214): Xaa equals any amino acid
MVLVALILLHSALAQSRRDFAPPGQQKREAPVDVLTQIGRSVRGTLDAWIGPETMHLVSESSSQVLWAISSAISVAFFALSGIAAQLLNALGLAGDYLAQGLKLSPGQVQTFLLWGAGALVVYWLLSLLLGLVLALLGRILWGLKLVIFLAGFVALMRSVPDPSTRALLLLALLILYALLSRXTGSRASGAQLEAKVRGLERQVEELRWRQRQXAKGARSVEEE

SEQ ID NO: 7944 - protein, 118 aa, Homo sapiens
MSRSVALAVLALLSLSGLEAIQRESSPTLPALVLPLPLCTLCGPRCALSLRDFPSPSSPWWPAVGLVQGWISGKRRGGLGVGKGVRTRDARYLPLSAGSRGDLWPTATGGSGQSLGRR

SEQ ID NO: 7945 - protein, 140 aa, Homo sapiens
MAASLGQVLALVLVAALWGGTQPLLKRASAGLQRVHEPTWAQQLLQEMKTLFLNTEYLMPFLLNQCGSLLYYLTLASTDLTLAVPICNSLAIIFTLIVGKALGEDIGGKRAVAGMVLTVIGISLCITSSVSKTQGQQSTL

SEQ ID NO: 7946 - protein, 101 aa, Homo sapiens
MSSSDSDSDWDGGSRLSPFLPHDHLGLAVFSMLCCFWPVGIAAFCLAQKTNKAWAKGDIQGAGAASRRAFLLGVLAVGLGVCTYAAALVTLAAYLASRDPP

SEQ ID NO: 7947 - protein, 67 aa, Homo sapiens
MQTSQQLCCLAISILATLLPSGASEERSGLRPGMRLQEREQRRATFGASVHSSFISFCLLHGVLNKF

SEQ ID NO: 7948 - protein, 128 aa, Homo sapiens
MCADDLLSVLLYLLVKTEIPNWMANLSYIKNFRFSSLAKDELGYCLTSFEAAIEYIRQGSLSAKPPESEGFGDRLFLKQRMSLLSQMTSSPTDCLFKHIASGNQKEVERLLSQEDHDKDTVQKMCHPL

SEQ ID NO: 7949 - protein, 195 aa, Homo sapiens
MELSESVQKGFQMLADPRSFDSNAFTLLLRAAFQSLLDAQADEAVLDHPDLKHIDPVVLKHCHAAAATYILEAGKHRADKSTLSTYLEDCKFDRERIELFCTEYQNNKNSLEILLGSIGRSLPHITDVSWRLEYQIKTNQLHRMYRPAYLVTLSVQNTDSPSYPEISFSCSMEQLQDLVGKLKDASKSLERATQL

SEQ ID NO: 7950 - protein, 56 aa, Homo sapiens [sequence omitted]

SEQ ID NO: 7951 - protein, 151 aa, Homo sapiens [sequence omitted]

SEQ ID NO: 7952 - protein, 50 aa, Homo sapiens
MRRCFLVLEISVCLMVIIVFLDFWVGGPGRGRLRNKSVPQITSIWKEFFV

SEQ ID NO: 7953 - protein, 973 aa, Homo sapiens
MMASIQSFSAMALLFYTVFMFVIVLSSLKHGLFSGQWLRRVSYVRWEGVFRCIPIFGMSFACQSQVLPTYDSLDEPSVKTMSSIFASSLNVVTTFYVMVGFFGYVSFTEATAGNVLMHFPSNLVTEMLRVGFMMSVAVGFPMMILPCRQALSTLLCEQQQKDGTFAAGGYMPPLRFKALTLSVVFGTMVGGILIPNVETILGLTGATMGSLICFICPALIYKKIHKNALSSQVVLWVGLGVLVVSTVTTLSVSEEVPEDLAEEAPGGRLGEAEGLMKVEAARLSAQDPVVAVAEDGREKPKLPKEREELEQAQIKGPVDVPGREDGKEAPEEAQLDRPGQGIAVPVGEAHRHEPPVPHDKVVVDEGQDREVPEENKPPSRHAGGKAPGVQGQMAPPLPDSEREKQEPEQGEVGKRPGQAQALEEAGDLPEDPQKVPEADGQPAVQPAKEDLGPGDRGLHPRPQAVLSEQQNGLAVGGGEKAKGGPPPGNAAGDTGQPAEDSDHGGKPPLPAEKPAPGPGLPPEPREQRDVERAGGNQAASQLEEAGRAEMLDHAVLLQVIKEQQVQQKRLLDQQEKLLAVIEEQHKEIHQQRQEDEEDKPRQVEVHQEPGAAVPRGQEAPEGKARETVENLPPLPLDPVLRAPGGRPAPSQDLNQRSLEHSEGPVGRDPAGPPDGGPDTEPRAAQGKLRDGQKDAAPRAAGTVKELPKGPEQVPVPDPAREAGGPEERLAEEFPGQSQDVTGGSQDRKKPGKEVAATGTSILKEANWLVAGPGAETGDPRMKPKQVSRDLGLAADLPGGAEGAAAQPQAVLRQPELRVISDGEQGGQQGHRLDHGGHLEMRKARGGDHVPVSHEQPRGGEDAAVQEPRQRPEPELGLKRAVPGGQRPDNAKPNRDLKLQAGSDLRRRRRDLGPHAEGQLAPRDGVIGLNPLPDVQVNDLRGALDAQLRQAAGGALQVVHSRQLRQAPGPPEES

SEQ ID NO: 7954 - protein, 55 aa, Homo sapiens
MEQLLAAVVFFSIFFLNLLALKMNKVYRCICLLFSKNMHTNVCFYKSNTHVIICM

SEQ ID NO: 7955 - protein, 55 aa, Homo sapiens
MLFLRSILWLSSLFFCHFVPTSHSLGFQNITSVYNATLQQTVFQHDSKTVTTCFT

SEQ ID NO: 7956 - protein, 138 aa, Homo sapiens
MCLLFLLPRFPVSWRAGVDGAAPSSQDLWRIRSPCGDCEGFDVHIMDDMIKVGRATLCIVPPTCSCIAGLSQGPSLGSTGSSVGGSEVRCCHFVWFNMSIAWYQPCSWLRAVTLCQNLHWACTSCHCNCPCQCPQLLF

SEQ ID NO: 7957 - protein, 403 aa, Homo sapiens
MKYLFFSWLVVFVGSWIIYVQYSTYTELCRGKDCKKIICDKYKTGVIDGPACNSLCVTETLYFGKCLSTKPNNQMYLGIWDNLPGVVKCQMEQALHLDFGTELEPRKEIVLFDKPTRGTTVQKFKEMVYSLFKAKLGDQGNLSELVNLILTVADGDKDGQVSLGEAKSAWALLQLNEFLLMVILQDKEHTPKLMGFCGDLYVMESVEYTSLYGISLPWVIELFIPSGFRRSMDQLFTPSWPRKAKIAIGLLEFVEDVFHGPYGNFLMCDTSAKNLGYNDKYDLKMVDMRKIVPETNLKELIKDRHCESDLDCVYGTDCRTSCDQSTMKCTSEVIQPNLAKACQLLKDYLLRGAPSEIREELEKQLYSCIALKVTANQMEMEHSLILNNLKTLLWKKISYTNDS

SEQ ID NO: 7958 - protein, 207 aa, Homo sapiens
MALRHLALLAGLLVGVASKSMENTAQLPECCVDVVGVNASCPGASLCGPGCYRRWNADGSASCVRCGNGTLPAYNGSECRSFAGPGAPFPMNRSSGTPGRPHPGAPRVAGSLFLGTFFISSGLILSVAGFFYLKRSSKLPRACYRRNKAPALQPGEAAAMDPPATVLRRGVCRKGGPSTTGQTPNTCSSLKSSSTRGQTQPASARPS

SEQ ID NO: 7959 - protein, 54 aa, Homo sapiens [sequence omitted]

SEQ ID NO: 7960 - protein, 48 aa, Homo sapiens [sequence omitted]

SEQ ID NO: 7961 - protein, 73 aa, Homo sapiens
MFYLYSIFQVLVWLCQAKHLSQISARSSRRLWRLSLITFPPYLATSLSHGPHVCLQTLGYESCEHTDLCFLHD

SEQ ID NO: 7962 - protein, 39 aa, Homo sapiens
MYYTAACLFISVLFLGLSVLISVAVVHSFFKHCIVFHDD

SEQ ID NO: 7963 - protein, 80 aa, Homo sapiens [sequence omitted]

SEQ ID NO: 7964 - protein, 57 aa, Homo sapiens
MTLAYLLLFLCFVILSPKPTMDPMLERAKTSFSSCPRSQVMLVYHLFLMDFQCVMLC

SEQ ID NO: 7965 - protein, 31 aa, Homo sapiens
  SITE (31): Xaa equals any amino acid
MIQSGLIAILLSFLKVYVEGRPCVCFSKGLX

SEQ ID NO: 7966 - protein, 67 aa, Homo sapiens
MLVLLWLGWISSKSMLAAYFVAPKYPLKLALVSEPESSSLILKFLSLKDFLCCYTTKLSVNPPLLND

SEQ ID NO: 7967 - protein, 25 aa, Homo sapiens
LELWLFIFILPFLFLGKRQGLAFCP

SEQ ID NO: 7968 - protein, 51 aa, Homo sapiens [sequence omitted]

SEQ ID NO: 7969 - protein, 184 aa, Homo sapiens
MDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIATGILHLLADTML

SEQ ID NO: 7970 - protein, 511 aa, Homo sapiens
MAGLRRPQPGCYCRTAAAVNLLLGVFQVLLPCCRPGGAQGQAIEPLPNVVELWQAEEGELLLPTQGDSEEGLEEPSQEQSFSDKLFSGKGLHFQPSVLDFGIQFLGHPVAKILHAYNPSRDSEVVVNSVFAAAGHFHVPPVPCRVIPAMGKTSFRIIFLPTEEGSIESSLFINTSSYGVLSYHVSGIGTRRISTEGSAKQLPNAYFLLPKVQSIQLSQMQAETTNTSLLQVQLECSLHNKVCQQLKGCYLESDDVLRLQMSIMVTMENFSKEFEENTQHLLDHLSIVYVATDESETSDDSAVNMYILHSGNSLIWIQDIRHFSQRDALSLQFEPVLLPTSTTNFTKIASFTCKAATSCDSGIIEDVKKTTHTPTLKACLFSSVAQGYFRMDSSATQFHIETHENTSGLWSIWYRNHFDRSVVLNDVFLSKETKHMLKILNFTGPLFLPPGCWNIFSLKLAVKDIAINLFTNVFLTTNIGAIFAIPLQISHCLETRVTVGMCENNWIFKQCE

SEQ ID NO: 7971 - protein, 57 aa, Homo sapiens
  SITE (37): Xaa equals any amino acid
MDMKWFLIVVLICIPLMTSDIEHLFMCLLPFHVSSLXKCLFKSFAHFSVGLYFVVEF

SEQ ID NO: 7972 - protein, 34 aa, Homo sapiens
MSLFFFLFSLFILSFLHDICYFLIPVSLKHSGIK

SEQ ID NO: 7973 - protein, 45 aa, Homo sapiens
MLFSFLFTRATPATFLSLLVRLISALEHPCCCHHLKCFSSGILFW

SEQ ID NO: 7974 - protein, 104 aa, Homo sapiens
MLCPNHGLFPDPGFQCPPLFQEVQRDAPHRKGSATVLPRCPPWVPSLKHRTSHTSSPAVPLILVPRLPSLQLHSFIQHSLGDFYIDTPRTEAWGKDDQEHVPSR

SEQ ID NO: 7975 - protein, 75 aa, Homo sapiens
MARITGPPERDDPYPVLFRYLHSHHFLELVTLLLSIPVTSAHPGVLQATKDVLKFLAQSQKGLLFFMSEYEATIY

SEQ ID NO: 7976 - protein, 92 aa, Homo sapiens
MLRCAWALAPPVPPPLVTDLPFFFTLSPFLFALEPPLPDLTDSASMSVIVDRRSRGSDTNCWLLNRRSKHPGAPRMCTCKANSNKYTSSLTD

SEQ ID NO: 7977 - protein, 37 aa, Homo sapiens
MKQTRLNPPVVFILLQPLSRPRDGLSNSVLIILHSVP

SEQ ID NO: 7978 - protein, 54 aa, Homo sapiens
MLEWPISMYFVAFLHCFLCSGGNLGDSFQALPELCANCSSSPRVLCCVVMSPLP

SEQ ID NO: 7979 - protein, 176 aa, Homo sapiens
  SITE (137): Xaa equals any amino acid
MRGSHLRLLPYLVAANPVNYGRPYRLSCVEAFAATFCIVGFPDLAVILLRKFKWGKGFLDLNRQLLDKYAACGSPEEVLQAEQEFLANAKESPQEEEIDPFDVDSGREFGNPNRPVASTRLPSDTDDSDASEDPGPXAERGGASSSCCEEEQTQGRGAEARAPAEVWKGIKKRQRD

SEQ ID NO: 7980 - protein, 40 aa, Homo sapiens
MRANFRCWLHCTLYLLCSPPSNQGSCQCTPHVPWRSWCCE

SEQ ID NO: 7981 - protein, 46 aa, Homo sapiens
MCCRAISGCCGTCLACLCSTASGAPQPWPCSRQSTWRLIPRPSAPT

SEQ ID NO: 7982 - protein, 42 aa, Homo sapiens
MLINCIFSLLLLLSHADGMHLFISSGDRILFCLYFLHSRVCA

SEQ ID NO: 7983 - protein, 346 aa, Homo sapiens
  SITE (242): Xaa equals any amino acid
  SITE (246): Xaa equals any amino acid
MRRGAGAARGRASWCWALALLWLAVVPGWSRVSGIPSRRHWPVPYKRFDFRPKPDPYCQAKYTFCPTGSPIPVMEGDDDIEVFRLQAPVWEFKYGDLLGHLKIMHDAIGFRSTLTGKNYTMEWYELFQLGNCTFPHLRPEMDAPFWCNQGAACFFEGIDDVHWKENGTLVQVATISGNMFNQMAKWVKQDNETGIYYETWNVKASPEKGAETWFDSYDCSKFVLRTFNKLAEFGAEFKNIEXNYTXIFLYSGEPTYLGNETSVFGPTGNKTLGLAIKRFYYPFKPHLPTKEFLLSLLQIFDAVIVHKQFYLFYNFEYWFLPMKFPFIKITYEEIPLPIRNKTLSGL

SEQ ID NO: 7984 - protein, 49 aa, Homo sapiens [sequence omitted]

SEQ ID NO: 7985 - protein, 47 aa, Homo sapiens
MLIFSFLSFWFFQSCQGFIYFMSIFEEPVADFVHLYCVFYFQGCSYL

SEQ ID NO: 7986 - protein, 212 aa, Homo sapiens
  SITE (88): Xaa equals any amino acid
MLSFNFTWMVWVSLVLKSQRAKLALHSLHLHQEVRLRMSRRESPGRPLRCGVRGNMGARTPVPTADYPSPYRTLPRMAAPPPQKSSCXRLHRPHWWRPRTPSSEKTGGQSQSTLDRCAHLVHMLLRDQRATSQWKAGGRLCRALSKTPLQHQLHSTSYRKALPILRPSSRREAGPLHHIDLRRCFSRLGRGADFAVCAKEPVSDNPIFLLIT

SEQ ID NO: 7987 - protein, 41 aa, Homo sapiens
MPILLLNLAFTNSHLEAQQVHKPYFGYRGNHCHPSPMWCAQ

SEQ ID NO: 7988 - protein, 176 aa, Homo sapiens; identical to SEQ ID NO: 7232

SEQ ID NO: 7989 - protein, 67 aa, Homo sapiens
MVLGFVLLLFNMGGTFSDGRKERRRTTFLRCCDFIMKPSPALILVTSVGPVLLQNASWVSVCRTLLS

SEQ ID NO: 7990 - protein, 262 aa, Homo sapiens; identical to SEQ ID NO: 6503

SEQ ID NO: 7991 - protein, 31 aa, Homo sapiens
  SITE (11): Xaa equals any amino acid
MIHVLTFLLQXYILISKGKGDVSQFVKSREY

SEQ ID NO: 7992 - protein, 81 aa, Homo sapiens
  SITE (2): Xaa equals any amino acid
  SITE (74): Xaa equals any amino acid
MXEGGRCGYVLLPVSLLQCLAMGHKHYPAVGRLAKRSQLASPASSREWNHGSNTLLRKQKLYGHIFHLLSPRNXMYCDPAH

SEQ ID NO: 7993 - protein, 259 aa, Homo sapiens
MVSCSILALTHLLFEFKGLMGTSTVEQLLENVCLLLASRTRDVVKSALGFIKVAVTVMDVAHLAKHVQLVMEAIGKLSDDMRRHFRMKLRNLFTKFIRKFGFELVKRLLPEEYHRVLVNIRKAEARAKRHRALSQAAVEEEEEEEEEEEPAQGKGDSIEEILADSEDEEDNEEEERSRGKEQRKLARQRSRAWLKEGGGDEPLNFLDPKVAQRVLATQPGPAGQEEGPQLQGERRWPADHKGGGRRQQDGGRGRCQRRR

SEQ ID NO: 7994 - protein, 87 aa, Homo sapiens [sequence omitted]

SEQ ID NO: 7995 - protein, 66 aa, Homo sapiens
  SITE (23): Xaa equals any amino acid
  SITE (45): Xaa equals any amino acid
MAGFASYPWSDFPWCWVVCFSFXFFFLRQSESLSQKKRQVADELXFGQSKRDSDGGWMLRSSAGNS

SEQ ID NO: 7996 - protein, 40 aa, Homo sapiens
MSSNTYIVLVCQALLITAMNRGPPNKCNRVYLFLNLCHHY

SEQ ID NO: 7997 - protein, 42 aa, Homo sapiens
MLWLGTSLIFSSFSASFDGVPFLSSWLFWSSGSSPNSLIPPF

SEQ ID NO: 7998 - protein, 45 aa, Homo sapiens
MSMCIHAKKHLICICFRKGGNEATCLKILLYKAFQPFPLSFALIF

SEQ ID NO: 7999 - protein, 50 aa, Homo sapiens
MSGFKEFDFVVPWWSISFLLSFLLLLLSFWSLWVYTFHQIWNIFGYYFSK

SEQ ID NO: 8000 - protein, 293 aa, Homo sapiens
  SITE (36): Xaa equals any amino acid
MERPDWETAIQKPLCSLPAGSGNALAASLNHYAGYXQVTNEDLLTNCTLLLCRRLLSPMNLLSLHTASGLRLFSVLSLAWGFIADVDLESEKYRRLGEMRFTLGTFLRLAALRTYRGRLAYLPVGRVGSKTPASPVVVQQGPVDAHLVPLEEPVPSHWTVVPDEDFVLVLALLHSHLGSEMFAAPMGRCAAGVMHLFYVRAGVSRAMLLRLFLAMEKGRHMEYECPYLVYVPVVAFRLEPKDGKGVFAVDGELMVSEAVQGQVHPNYFWMVSGCVEPPPSWKPQQMPPPEEPL

SEQ ID NO: 8001 - protein, 191 aa, Homo sapiens
  SITE (47): Xaa equals any amino acid
MMAAMVLTSLSCSPVVQSPPGTEANFSASRAACDPWKESGDISDSGXSTTSGHWSGSSGVSTPSPPHPQASPKYLGDAFGSPQTDHGFETDPDPFLLDEPAPRKRKNSVKVMYKCLWPNCGKVLRSIVGIKRHVKALHLGDTVDSDQFKREEDFYYTEVQLKEESAAAAAAAAADPQSLGLPPPSQLPPPA

SEQ ID NO: 8002 - protein, 115 aa, Homo sapiens
MQLSVCVITTSLLFNSITLYFSKMPRSPGSYADLQRFYFLALESAEIRRHRAQRSSLGTRIAFALAGYVYTDEYKMFFSLGFLLLFSPPSHLPFSPTPPPKKATSSFRGTIIFFN

SEQ ID NO: 8003 - protein, 335 aa, Homo sapiens
  SITE (35): Xaa equals any amino acid
  SITE (297): Xaa equals any amino acid
MRGLGLWLLGAMMLPAIAPSRPWALMEQYEVVLPXRLPGPRVRRALPSHLGLHPERVSYVLGATGHNFTLHLRKNRDLLGSGYTETYTAANGSEVTEQPRGQDHCFYQGHVEGYPDSAASLSTCAGLRGFFQVGSDLHLIEPLDEGGEGGRHAVYQAEHLLQTAGTCGVSDDSLGSLLGPRTAAVFRPRPGDSLPSRETRYVELYVVVDNAEFQMLGSEAAVRHRVLEVVNHVDKLYQKLNFRVVLVGLEIWNSQDRFHVSPDPSVTLENLLTWQARQRTRRHLHDNVQLITGVDFXGTTVGFARVSTMCSHSSGAVNQDHSKNPVGVACTMAHE

SEQ ID NO: 8004 - protein, 23 aa, Homo sapiens
MSELSAFMFSTIIFLMAQPTSCF

SEQ ID NO: 8005 - protein, 127 aa, Homo sapiens
  SITE (4): Xaa equals any amino acid
  SITE (12): Xaa equals any amino acid
MAAXPPGCTPPXLLDISWLTESLGAGQPVPVECRHRLEVAGPRKGPLSPAWMPAYACQRPTPLTHHNTGLSELLEHGVCEEVERVRRSERYQTMKVRRAGLGPTPGMSCPGNDNTVHTMHGEANRGS

SEQ ID NO: 8006 - protein, 47 aa, Homo sapiens
MCETLFSSPVALGTNYLARLLVFVLFQAALSSGVTRCQSAEVRVKKT

SEQ ID NO: 8007 - protein, 173 aa, Homo sapiens
  SITE (150): Xaa equals any amino acid
  SITE (152): Xaa equals any amino acid
MGVPTAPEAGSWRWGSLLFALFLAASLDITAAALATGACIVESSASPSSCSWSTSKGRQPPTAVPRSWCGWTATFKGLKTPALKPHHLPRGYPRPKSGTPCPMWPSGSLLSLGGICFRSPAPPCLLQAPETSSSHPWTLSLTLQTLRSSXPXGGQWAVVAGSGAGAFEPGLAL

SEQ ID NO: 8008 - protein, 33 aa, Homo sapiens
MPLKAVTWPTLNSKLVAAVVNLKASQMPASSRV

SEQ ID NO: 8009 - protein, 356 aa, Homo sapiens
MDYRGGDGTSMDYRGREAPHMNYRDRDAHAVDFRGRDAPPSDFRGRGTYDLDFRGRDGSHADFRGRDLSDLDFRAREQSRSDFRNRDVSDLDFRDKDGTQVDFRGRGSGTTDLDFRDRDTPHSDFRGRHRSRTDQDFRGREMGSCMEFKDREMPPVDPNILDYIQPSTQDREHSGMNVNRREESTHDHTIERPAFGIQKGEFEHSETREGETQGVAFEHESPADFQNSQSPVQDQDKSQLSGREEQSSDAGLFKEEGGLDFLGRQDTDYRSMEYRDVDHRLPGSQMFGYGQSKSFPEGKTARDAQRDLQDQDYRTGPSEEKPSRLIRLSGVPEDATKEEILNAFRTPDGMPVKNCS

SEQ ID NO: 8010 - protein, 82 aa, Homo sapiens [sequence omitted]

SEQ ID NO: 8011 - protein, 75 aa, Homo sapiens
MNMCWQIPNFILIQVSSEYVHILIVIVTKTPGVQSGSCCSLHRKPMPETTSVAKEEGLIGCCSRGDGSSVSNPSL

SEQ ID NO: 8012 - protein, 18 aa, Homo sapiens
  SITE (4): Xaa equals any amino acid
  SITE (14): Xaa equals any amino acid
MVAXLLILLLDSGXLLAG

SEQ ID NO: 8013 - protein, 133 aa, Homo sapiens
MLLLWASSLPTRCDCSFPVTPLVPLVHVICVWVMFPSAATAACHPGAGAFFSQGPSPFSRTWPLLGHREIPAEGAGETVALGLQPKRHTLAVGVHGMLALSTVTVGGFGGFPWTSGPGCPPLSWTCFIFPILT

SEQ ID NO: 8014 - protein, 73 aa, Homo sapiens
MATPRGLGALLLLLLLPTSGQEKPTEGPRNTCLGSNNMYDIFNLNDKALCFTKCRQSGSDSCNVENLQRFRGR

SEQ ID NO: 8015 - protein, 185 aa, Homo sapiens
MAQANSTLGAGGWVGNGVYVSGVQREYDAFITNQLRAAQTQSSGLTARYEQMSKIDNMLSTSTSSLATQMQDFFTSLQTLVSNAEDPAARQALIGKSEGLVNQFKTTDQYLRDQDKQVNIAIGASVDQINNYAKQIASLNDQISRLTGVGAGASPNNLLDQRDQLGERIKPDCWCRSQRSGWRHL

SEQ ID NO: 8016 - protein, 125 aa, Homo sapiens
  SITE (55): Xaa equals any amino acid
MLSQPLVGAQRRRRAVGLAVVTLLNFLVCFGPYNVSHLVGYHQRKSPWWRSIAVXFSSLNASLDPLLFYFSSSVVRRAFGRGLQVLRNQGSSLLGRRGKDTAEGTNEDRGVGQGEGMPSSDFTTE

SEQ ID NO: 8017 - protein, 70 aa, Homo sapiens
  SITE (14): Xaa equals any amino acid
  SITE (21): Xaa equals any amino acid
MQPSYPLSWSGGVXLPCLASXLTLLFLLQPLMLPLGGSQTQLGNHSVVRLLLPVQRLGFAEVPPLEVAQS

SEQ ID NO: 8018 - protein, 83 aa, Homo sapiens
MSFFQLLMKRKELIPLVVFMTVAAGGASSFAVYSLWKTDVILDRKKNPEPWETVDPTVPQKLITINQQWKPIEELQNVQRVTK

SEQ ID NO: 8019 - protein, 325 aa, Homo sapiens
MSISLSSLILLPIWINMAQIQQGGPDEKEKTTALKDLLSRIDLDELMKKDEPPLDFPDTLEGFEYAFNEKGQLRHIKTGEPFVFNYREDLHRWNQKRYEALGEIITKYVYELLEKDCNLKKVSIPVDATESEPKSFIFMSEDALTNPQKLMVLIHGSGVVRAGQWARRLIINEDLDSGTQIPFIKRAVAEGYGVIVLNPNENYIEVEKPKIHVQSSSDSSDEPAEKRERKDKVSKETKKRRDFYEKYRNPQREKEMMQLYIRENGSPEEHAIYVWDHFIAQAAAENVFFVAHSYGGLAFVELQLMIKQANSDAGKCFRLAMWKNH

SEQ ID NO: 8020 - protein, 40 aa, Homo sapiens
MNMFQTILVCVLFVFVRWFFLLLQIESIQTKFHCISSQFW

SEQ ID NO: 8021 - protein, 141 aa, Homo sapiens [sequence omitted]

SEQ ID NO: 8022 - protein, 41 aa, Homo sapiens [sequence omitted]

SEQ ID NO: 8023 - protein, 46 aa, Homo sapiens
MMLGLFSPLCLVTGIAEGRAEDASLHDICTTQHTLTFTPSYPVGGS

SEQ ID NO: 8024 - protein, 59 aa, Homo sapiens
MELVWFRFLHLNLLPRGVCCGICVCVRRGMVLSEPTSCGQRALSCEGGCHSGRVQFRRP

SEQ ID NO: 8025 - protein, 272 aa, Homo sapiens
  SITE (120): Xaa equals any amino acid
  SITE (162): Xaa equals any amino acid
  SITE (175): Xaa equals any amino acid
  SITE (176): Xaa equals any amino acid
  SITE (180): Xaa equals any amino acid
MSALRRSGYGPSDGPSYGRYYGPGGGDVPVHPPPPLYPLRPEPPQPPISWRVRGGGPAETTWLGEGGGGDGYYPSGGAWPEPGRAGGSHQSLNSYTNGAYGPTYPPGPGANTAFILRGLXCTWLYSDQLLHRIPSTYRSSGNSPTPVSRWIYPQQDCQTEAXPLRGKVPGYPPSXXPGMXLPHYPYGDGNRSVPQSGPTVRPQEDAWASPGAYGMGGRYPWPSSAPSAPPGNLYMTEVLHHGLAVALPSHPLHPQSSSPRILHTPIANQIKA

SEQ ID NO: 8026 - protein, 79 aa, Homo sapiens
  SITE (36): Xaa equals any amino acid
MRVFALLPPFHKSTVLSFLLFFLSFFFFRQGLAVSXRLECSGAIIAHCSLDLLDSSNPPALTSQLLRRPRQEDHLSPGG

SEQ ID NO: 8027 - protein, 71 aa, Homo sapiens
MSPSHSPVSCFKLRVLVFPLPLFLGTALCSVWDPRARPLGLVAAARPLGPSTCPSPRFPASSAGTLKLRAR

SEQ ID NO: 8028 - protein, 58 aa, Homo sapiens [sequence omitted]

SEQ ID NO: 8029 - protein, 72 aa, Homo sapiens
MHIYMWVCGMCACVCMASYIICGTKGKMKLYGPRSKIRCGVLLSTVLCNCTGCMSMKPSCVCAHMCMNMYFI

SEQ ID NO: 8030 - protein, 15 aa, Homo sapiens
MSHCAWLHLQLFLSL

SEQ ID NO: 8031 - protein, 18 aa, Homo sapiens
MLTLVSFVFLLLLLESMI

SEQ ID NO: 8032 - protein, 43 aa, Homo sapiens
MILSFLMLFLIVKTIPLILAYCYNSISFFSNNLVLVKMGYNNK

SEQ ID NO: 8033 - protein, 92 aa, Homo sapiens
  SITE (86): Xaa equals any amino acid
MRMPSHTHARFVLFYLILRNRSGGVLPGCSDPEGSQESPGLQKSPPTGSEASLSWCIQTAHSRLWALTLQIPESPPGLPALGPVPXSSKGGR

SEQ ID NO: 8034 - protein, 25 aa, Homo sapiens
MQTIHFTPAVLHFLFLWSSTWSVSI

SEQ ID NO: 8035 - protein, 79 aa, Homo sapiens
  SITE (73): Xaa equals any amino acid
  SITE (75): Xaa equals any amino acid
MSTNYLTDVCSLFSYLNYLYFHHHLPVPEHLELCVLWLGPGLPSSYLVSALGLWGGSAGKWAGCLHEGIRCSXQXEPFC

SEQ ID NO: 8036 - protein, 87 aa, Homo sapiens
  SITE (24): Xaa equals any amino acid
  SITE (30): Xaa equals any amino acid
MSHSALPVLFILLLLFPLPLEPLXCESCTXCVSLSCPLYSHSSCSLIHLFIQHIYFERLAQCQALSLIVETHKLKRDSYPDLKLMTI

SEQ ID NO: 8037 - protein, 62 aa, Homo sapiens
MCALGVFLLVPWYEYYLVLLFFPCVAFSVVSGFFLCNDSKRTLHSCALCLCAGICFPYMFLF

SEQ ID NO: 8038 - protein, 56 aa, Homo sapiens
MSHCAWPPLLIFITRVQWATATKCQFTAKSGIGLTQGCSSVFVKLGLFLICPYDWE

SEQ ID NO: 8039 - protein, 46 aa, Homo sapiens
MMFCFLIWVVVTFTYSLNCTFVLHKFIIFPNFKKVKRRRKKLVMKV

SEQ ID NO: 8040 - protein, 25 aa, Homo sapiens
MILTFCVFLLFSFHNAIKSTPFLKF

SEQ ID NO: 8041 - protein, 72 aa, Homo sapiens
MSIYHVCLILLLYITSHSHQNMSSCLQVPLSLLSCPLKGEHLSQFAGDHSLPEVRDRNHHCILFKESHQKRK

SEQ ID NO: 8042 - protein, 25 aa, Homo sapiens
  SITE (21): Xaa equals any amino acid
MKLIYYCHLVDILLLQAIIKXNAGM

SEQ ID NO: 8043 - protein, 100 aa, Homo sapiens
  SITE (44): Xaa equals any amino acid
  SITE (46): Xaa equals any amino acid
  SITE (77): Xaa equals any amino acid
  SITE (78): Xaa equals any amino acid
MGFFFVLFFLYLALSRDWSINFLKDHRINFFVATSYFSVYVRGXPXVPADTPLGPLLSLWLHHNAFFSILPKFPENXXFLILKKLVVEMGWDLFISPENK

SEQ ID NO: 8044 - protein, 55 aa, Homo sapiens [sequence omitted]

SEQ ID NO: 8045 - protein, 132 aa, Homo sapiens
MIECPDWARTASLAKQRRKVFKQMLSSFLHFHFNSMMPLCPSDDISPGVWDSAGLPCLLRRLPGHHQAGKPQSPPSSTWDPWASSISLTRKPVLLLILGPHPRPIQRKTPGAALGSLCFHQICVKTQMNQPR

SEQ ID NO: 8046 - protein, 137 aa, Homo sapiens [sequence omitted]

SEQ ID NO: 8047 - protein, 71 aa, Homo sapiens [sequence omitted]

SEQ ID NO: 8048 - protein, 65 aa, Homo sapiens
MQRIPTSPRQAWWWTCWAMFQGPAAGSVGAERKGEGCLFFGQDESSRCGRSWPLADPWVYRVLRS

SEQ ID NO: 8049 - protein, 67 aa, Homo sapiens [sequence omitted]

SEQ ID NO: 8050 - protein, 75 aa, Homo sapiens
MFYVYDHSMYVDTHTHTHVPSLYTNGNILKILFCTFTVQVPYSPLSTWQRPKPVKGRVSTWPPSSMSSARSPQGP

SEQ ID NO: 8051 - protein, 104 aa, Homo sapiens
MWYCLLCGCSCHAKAVPSVLSRLSCNLPALLSHALPQPSPSVGAPPGSPRPVPPHPLSDPHSCLPTPAFRGLCSPPLCPLLPPRFSLKLPPLSLDPQLIPPATY

SEQ ID NO: 8052 - protein, 41 aa, Homo sapiens
MANTARIFLLLPIFIIEGNANMKIKMSLFPQSMQFPPKLYP

SEQ ID NO: 8053 - protein, 48 aa, Homo sapiens
MFLGSLCFSLLCHAGCQGSGGKPAVTGLTQLPHNPKGWFHSHHAPRPQ

SEQ ID NO: 8054 - protein, 58 aa, Homo sapiens
MSVCLPLHLPFLMLAKVATSFCRWQLTLFVSTFYKDALVHTVNDRNQEAELEALKKSC

SEQ ID NO: 8055 - protein, 41 aa, Homo sapiens
  SITE (9): Xaa equals any amino acid
MLLLMILEXFPCPQPGTNVIIISMCFFLSHSNAIYLQHYHF

SEQ ID NO: 8056 - protein, 55 aa, Homo sapiens [sequence omitted]

SEQ ID NO: 8057 - protein, 52 aa, Homo sapiens [sequence omitted]

SEQ ID NO: 8058 - protein, 31 aa, Homo sapiens
MALLVLTLYCILFLKIYMPVPSHCEQFKGRN

SEQ ID NO: 8059 - protein, 22 aa, Homo sapiens
  SITE (18): Xaa equals any amino acid
MLPKPQLSVLTLTVALSXIPGT

SEQ ID NO: 8060 - protein, 39 aa, Homo sapiens
MEMMMVVMGCVQGPGEGCSGKMGKKPRPWPLVSYSITHL

SEQ ID NO: 8061 - protein, 34 aa, Homo sapiens
MLLYQINIPFSFALSVLLSLCWPHQHYYPCYISF

SEQ ID NO: 8062 - protein, 33 aa, Homo sapiens
MCVCVFSFCLFCLFVFGMVLTVLLCHPGWSAVV

SEQ ID NO: 8063 - protein, 49 aa, Homo sapiens
  SITE (14): Xaa equals any amino acid
MLCHVYLLLVGHAXFSVGLMGQRKLRCSINSALRSAVSSAWNSSICFNS

SEQ ID NO: 8064 - protein, 82 aa, Homo sapiens
MAETRGLCSVCFCALCLYGSYAACPPCFSREPRQRRHHGNDWVRWKFRGPALVGREAWLTSQAQHVCGSLLCTVSSSPKWES

SEQ ID NO: 8065 - protein, 68 aa, Homo sapiens
MPPPECLSDCSKVALVMVLFLFLHSVFMLGGMKRETKTTFLARVLVPFCCSYLSSKGEHLRNLSPYSF

SEQ ID NO: 8066 - protein, 65 aa, Homo sapiens
  SITE (61): Xaa equals any amino acid
MNQPILRSQALLWPWRWVVKAKPCVCVSMDAWIPDRSQHCPSIPGQKKERAGSHGHQALAXLLFL

SEQ ID NO: 8067 - protein, 56 aa, Homo sapiens
  SITE (32): Xaa equals any amino acid
MGVEQYSYLFLTCVFMCVSLQWKSTQPWVGDXTCMRKGITGTEVHRTNALFTFWCS

SEQ ID NO: 8068 - protein, 54 aa, Homo sapiens [sequence omitted]

SEQ ID NO: 8069 - protein, 23 aa, Homo sapiens
MYGCVCVCIYLYTCIHGCPCVSM

SEQ ID NO: 8070 - protein, 96 aa, Homo sapiens
MELSFVRRLLLFTFFFSTFSPPPPTPCLEGLMSCLPSPLIKNHGGLPNQIPKGDRNGNIRHSRITFPCSSSTLQPESHLGFIRSKLHGLVRPGKRP

SEQ ID NO: 8071 - protein, 73 aa, Homo sapiens
  SITE (44): Xaa equals any amino acid
  SITE (69): Xaa equals any amino acid
MSFSLAHVKTGQGPRLTEALQYIASKIAVGVTSSQKSGEERAMXTQELLMDQAWDSVCHFHQHPTHQNXVTGP

SEQ ID NO: 8072 - protein, 50 aa, Homo sapiens
MLIFCGEYWYFCFNLLWVVVPYKFSFLSFGSVIQICPTSVPPIGQSGIWV

SEQ ID NO: 8073 - protein, 49 aa, Homo sapiens
MPSSECRSSALLLNVSLAESEAGRRPGKPGWAEEATGGRRASRKDGTQG

SEQ ID NO: 8074 - protein, 98 aa, Homo sapiens
MHLHVSVSLIWGLLSFLSLQVCVFVGSSQPLLLQCVSGPAPFLLSLGVRHQPFWDCPTGPSREETRLNPRALTRPRQTCWSFGWQVALRPSEKSPCFS

SEQ ID NO: 8075 - protein, 83 aa, Homo sapiens [sequence omitted]

SEQ ID NO: 8076 - protein, 46 aa, Homo sapiens
MKEKQVYHISKIKEEYSILICLLIVKMSFPQIAPIQFKRKHSTKIQ

SEQ ID NO: 8077 - protein, 79 aa, Homo sapiens
MVFFQIQSLLSFLASSLSIIFLLPRCLIPPANGTAGSSCSEFQTLHTFHPQASCAHAGPSNLYTFLRLFDLSAKVSPLM

SEQ ID NO: 8078 - protein, 54 aa, Homo sapiens
MKRLWCLSWVPGLQGSPSVLSSVFFSVFKPQLHWTCSQVSSHWHPPCLFILFSG

SEQ ID NO: 8079 - protein, 128 aa, Homo sapiens [sequence omitted]

SEQ ID NO: 8080 - protein, 42 aa, Homo sapiens
MALQSIPSFTLLISFFLSTQCLRCVYNYECILFMAFNCRMVF

SEQ ID NO: 8081 - protein, 48 aa, Homo sapiens
MWDQRPTKGTQDFQLLLLPGICSSFALLLNALPFPAPSPSIGTCLCAS

SEQ ID NO: 8082 - protein, 43 aa, Homo sapiens
MSVSSNLWQTLILLLSLWFCLFPECHIVGIIQLCRLFRLPSFT

SEQ ID NO: 8083 - protein, 35 aa, Homo sapiens [sequence omitted]

SEQ ID NO: 8084 - protein, 76 aa, Homo sapiens
  SITE (73): Xaa equals any amino acid
MQWVHIAETGNEKFSFFLFFFCGGWGQSLTLSPRQECSGAISAHCNLPPPHLQVQAILVPPPPEQLALQVHAXTLG

SEQ ID NO: 8085 - protein, 99 aa, Homo sapiens
MAVWGDTELAAGVFCFFLFFCFLYLSGTWNASKTELFTPLERELKPGHPSGMLSGSHPHGAQQAKSTGLKLSLPAQQSEVDLGCSSLVWGGASAITEAL

SEQ ID NO: 8086 - protein, 25 aa, Homo sapiens
MSPSIRILLVLQQLGSLMAPLPSAH

SEQ ID NO: 8087 - protein, 45 aa, Homo sapiens
MGSVWNCLLALLEKHLITLYKLIITVLLDLLSARHKCFTSVNSFN

SEQ ID NO: 8088 - protein, 35 aa, Homo sapiens
MVSKPWGVFISFSFISLSFYHAISISSVPSGRQVV

SEQ ID NO: 8089 - protein, 115 aa, Homo sapiens
MCMSVGAHICVCVCMCVLHVCGEVSSVRACDSWDLHSCVLPQRPQPGQALTFCAPCIEPVCCGCLWPPMGNSGELAGGCAQSPGCCYCHSAQLGQAVAPEGVRRELWEHLYSVLK

SEQ ID NO: 8090 - protein, 4 aa, Homo sapiens
MLKS

SEQ ID NO: 8091 - protein, 41 aa, Homo sapiens
  SITE (21): Xaa equals any amino acid
  SITE (38): Xaa equals any amino acid
MNSTCGFVTSINQIFLIILWXLYLPLLTTTLEIWELLXLLH

SEQ ID NO: 8092 - protein, 68 aa, Homo sapiens [sequence omitted]

SEQ ID NO: 8093 - protein, 91 aa, Homo sapiens
MQLIESRFHFRCVWILHLLALFSTWPPKDPEGSPPSATSSPLTPHLSLTLPFKQAPVSNVSSAIHVMLDKSVSLSEIQFSHMPNGKRASTL

SEQ ID NO: 8094 - protein, 34 aa, Homo sapiens
MFYDVQGPSHSSEMCFFVFFFVCLFLFLMNESKG

SEQ ID NO: 8095 - protein, 20 aa, Homo sapiens
MKLSVPLLIVPLLMWNSNWI

SEQ ID NO: 8096 - protein, 41 aa, Homo sapiens
MKRREMTQFLLSLVALNCCSISLGRLTYPGGFHLKLDPLEL

SEQ ID NO: 8097 - protein, 28 aa, Homo sapiens
MLSLDFPLILLGLNLHIALLSLLVPRLS

SEQ ID NO: 8098 - protein, 91 aa, Homo sapiens
MCPLHVPLPGHMGPFWPLPSLYSVRSSQSPCPLCFSLLPLQAHLSLLHTLFRSASQSPASGVFWGCLRERHEYMSPCLPHMYQKFDFFFFF

SEQ ID NO: 8099 - protein, 37 aa, Homo sapiens
  SITE (33): Xaa equals any amino acid
  SITE (34): Xaa equals any amino acid
  SITE (35): Xaa equals any amino acid
MRTPPSPGPRTHLVLVLLQPLSQRGQHDLGGRXXXVA

SEQ ID NO: 8100 - protein, 58 aa, Homo sapiens
MWGCSGLGHRTVSFLLLLPCSFPRPCGLFGLIPISRPCKVEAPRPLSPTTLMCQSPLL

SEQ ID NO: 8101 - protein, 72 aa, Homo sapiens
  SITE (41): Xaa equals any amino acid
MCGGHAINVGPFTVAGRGRNLQFLRVLLLRCPPVLGHSCSXPCPAWSHPPSANRSLGRVLWALIRPWQGRSS

SEQ ID NO: 8102 - protein, 44 aa, Homo sapiens
MFRSSISLMVFSLILLLTTERRILACPPIILNSSIFLSDLSVLP

SEQ ID NO: 8103 - protein, 92 aa, Homo sapiens
MELVFLIISLVCQHCSPDSAGDLCVQTPSVWPRTLMEIMLSSLGEFALSNNQRFVCFNNIHSSWAWWLTSVIPALWEADTGGLLEARSLRPA

SEQ ID NO: 8104 - protein, 110 aa, Homo sapiens
MAAPALGLVCGRCPELGLVLLLLLLSLLCGAAGSQEAGTGAGAGSLAGSCGCGTPQRPGAHGSSAAAHRYSREANAPGPVPGERQLAHSKVLHRFLRGGWGLLGSWTGLE

SEQ ID NO: 8105 - protein, 35 aa, Homo sapiens
MKLENYLFESLSLIIVVWSLSNSSEVCRKVKQIVG

SEQ ID NO: 8106 - protein, 74 aa, Homo sapiens
MLILFLSVCLFVFLLTVRALCCRSAGVWLRSTPDPVCLGFARGGCRIAMIAACFSSGSFVPEGHPPDASQSSPV

SEQ ID NO: 8107 - protein, 41 aa, Homo sapiens
MRLLSTLLSFYPFSNCFLLSFCDSHPPVWLRNSQVFPEEVV

SEQ ID NO: 8108 - protein, 47 aa, Homo sapiens
MGEFTSVVCYCFILSLIIGSVVRWQGCGAEWGFALGEHMWQRAQEDL

SEQ ID NO: 8109 - protein, 30 aa, Homo sapiens
MVLPRILVLMLFLALKNPVGEMRNLTHCRC

SEQ ID NO: 8110 - protein, 99 aa, Homo sapiens
  SITE (96): Xaa equals any amino acid
MFAFSPLSRLAMLGVCCGCCLGLFLESDTGINFLNFNYLASYSWSSRSSNFNNLGIFSFFFFETESRSVAQAGVQWHYLSSLQALPPGFTPFSCLXPTE

SEQ ID NO: 8111 - protein, 45 aa, Homo sapiens
MYLILSWLFLCKLVKCYFEILLFSTSPQLLQWTVIVTYCGPLLRF

SEQ ID NO: 8112 - protein, 46 aa, Homo sapiens
MASRGTAAPGRTFLAMMVTSFFFCMRWGSWAEQMPQRCLPCCMQEC

SEQ ID NO: 8113 - protein, 38 aa, Homo sapiens
  SITE (14): Xaa equals any amino acid
MLNVLSKVQQLVSXLGLVTFLLNHSAAGGSPQHRWLLL

SEQ ID NO: 8114 - protein, 72 aa, Homo sapiens
MDTRGVVLRSGEFNRQEGREKTEGRSSSIWRQREGGSKAKRGGPQVQWTPAKYICRGWKGRCLIYIGLRGLV

SEQ ID NO: 8115 - protein, 69 aa, Homo sapiens
MAGSYSSDILVLARSWTLLLLSVLRLQTVGSSVTLDSQVGIIWPAVFKIGNRVKKQNQIKEKRQQQNQN

SEQ ID NO: 8116 - protein, 23 aa, Homo sapiens
  SITE (21): Xaa equals any amino acid
  SITE (22): Xaa equals any amino acid
MAYSFHAFLFFFFFFWGGGKXXP

SEQ ID NO: 8117 - protein, 67 aa, Homo sapiens
MIFRNGVRLVFVFVLFYTSTQSLFNSLQTAEYVLFCQQRLSLYEPSHVLCLCMSPHRKHTRESDTSG

SEQ ID NO: 8118 - protein, 54 aa, Homo sapiens [sequence omitted]

SEQ ID NO: 8119 - protein, 37 aa, Homo sapiens
MGCFPLWLVTLAVGDALPPTACELWGVPAPPLHLAEE

SEQ ID NO: 8120 - protein, 41 aa, Homo sapiens
  SITE (2): Xaa equals any amino acid
MXFFAVLSSFPSRGKRAEAQQSLVCWRNRRVVGGLEARAVK

SEQ ID NO: 8121 - protein, 94 aa, Homo sapiens
  SITE (92): Xaa equals any amino acid
MTLLLVFIFLPVVGFHQFYTLQQNSAIHSQGLQIPSSISSLCFLRISWLSILSSPFCFKLNYPCFMCTYLFIMHNISIIFRELAWEGKMNMXSV

SEQ ID NO: 8122 - protein, 72 aa, Homo sapiens
MAIALGPLVLSWLCYLWLTLESLCTNKMASDEPVSHHCLPRLSEPPLTFCLEAGGLVEVGDLLKSRARPVIL

SEQ ID NO: 8123 - protein, 23 aa, Homo sapiens
MNFLLLIFPYFSSLLGEVEVVKC

SEQ ID NO: 8124 - protein, 25 aa, Homo sapiens
  SITE (11): Xaa equals any amino acid
  SITE (15): Xaa equals any amino acid
MTLLIIFLPFXFTTXTNSGGSFPVR

SEQ ID NO: 8125 - protein, 53 aa, Homo sapiens
MQPWAGLCPLLVLWISGHLHCISALLQERGVGVSLSSRSDACKAAHRIGTSSS

SEQ ID NO: 8126 - protein, 106 aa, Homo sapiens
MKAKRNKGRWVAAGPTAATAWIVLTVQAACPEGKCPLPGVCAPITWAPSYLTAGKAKLAGPRTYKPGPVLKAAHLPMGQHPHTTPWWQPLFIISVSRYPPRTPKQH

SEQ ID NO: 8127 - protein, 84 aa, Homo sapiens [sequence omitted]

SEQ ID NO: 8128 - protein, 57 aa, Homo sapiens
MGLLPGWLLLWARLKCFCAVGLGSLAAVYGRGPGLPQDQLDCVLWDCGTLGLYRGQF

SEQ ID NO: 8129 - protein, 48 aa, Homo sapiens
  SITE (31): Xaa equals any amino acid
MGETLVSVFLKPPALTWLLRAICLMVQTWAXGQRSWPQSLALPCYLNR

SEQ ID NO: 8130 - protein, 108 aa, Homo sapiens
MSLTPPTPVLFLFLSLLWARFFLSRLKCPGGCLCWPLLLSRGSSAAPWASVPMDGAAHAAISAPGLSVQLLPRQLASPSANTELRVLLLPARVRHYLPSSFHQVLGSS

SEQ ID NO: 8131 - protein, 122 aa, Homo sapiens [sequence omitted]

SEQ ID NO: 8132 - protein, 92 aa, Homo sapiens
  SITE (70): Xaa equals any amino acid
MWQYHRLSCTAWQPVILSFSLSVGHRILLALFFFILHLSILIATECRPWYSFHLVSLPSFLPQFLLCLAXICLFGFTTLLFSFCCQVHVLGH

SEQ ID NO: 8133 - protein, 114 aa, Homo sapiens
MSLYLCVSLLISLSLSLNVSVSVSLRLCLYFSPPLSDAISLCLSLSLSVSPFLSPSLALCFLCLCLFLAQSRALGMRTRVSQGWLQLDTSGIPASPGPSKGERYVYFRGGRGCG

SEQ ID NO: 8134 - protein, 114 aa, Homo sapiens
MASWPFLSPMGPIALALLTQALSSPVGLCLALTCSRRPSPDSVCASCRFPLVPLCCQPSLPALLRPVSHCRYPGTSLGIMLIVYCLFLPMRMSDCEGRDLCVIRCRDPSPWNDA

SEQ ID NO: 8135 - protein, 136 aa, Homo sapiens
  SITE (59): Xaa equals any amino acid
  SITE (111): Xaa equals any amino acid
MYQPHTQSWFPWCLILSSSQAGTRGLSWHLANAPVKPGMGLAFALIRLDSLLTCYLPCXHVRLVRAHTCTSPTRPLLSYQSVPAASMICPPCEIPHGEGSFEVAGRSTEMXHLPVEIPRLPGQCQQSQKTHPLAWS

SEQ ID NO: 8136 - protein, 45 aa, Homo sapiens [sequence omitted]

SEQ ID NO: 8137 - protein, 25 aa, Homo sapiens
MVGRCSILSSTPQRHPSLSWEGLGG

SEQ ID NO: 8138 - protein, 39 aa, Homo sapiens
GSRWAALQAGPLWPSIGFVVNMLCGVTTSNGGPNTYIHL

SEQ ID NO: 8139 - protein, 37 aa, Homo sapiens
MASEWVGLSSLITLLLLSCVLSCITLEEGEKELVFGP

SEQ ID NO: 8140 - protein, 44 aa, Homo sapiens
MQRTFKYLHFYIIRFVSTYAFIVFFPFSSSHVNGPCEKNIPLGK

SEQ ID NO: 8141 - protein, 39 aa, Homo sapiens
MYLLYLPSALLPPYPTCPYEHGSPWPHTPAKLLCCFAFL

SEQ ID NO: 8142 - protein, 36 aa, Homo sapiens
MARYFIFFILVFMKVSLNTTWPAPRPATLRTANKSK

SEQ ID NO: 8143 - protein, 84 aa, Homo sapiens
MSIQVLCPLFCFASFFILGSRGECAGFYTHVLQDPRAWASNDPATQVVNIVPNREFSTLALLLPPHFWNPWCPLFPCCAMCPQC

SEQ ID NO: 8144 - protein, 93 aa, Homo sapiens
MRSLSFLFTWENLYFSFTFEVYFYWMYYSRMKVFSFNTLNMLCHFLLACKVSLRSLLQDVWELICMLFVSFLLLPSFKILSLSLTFGSLIIKC

SEQ ID NO: 8145 - protein, 41 aa, Homo sapiens
MTGKLWLLLPRLGHAAAAPTTALSGSELEGTSISLLIALDR

SEQ ID NO: 8146 - protein, 40 aa, Homo sapiens
MWRGQSFLLLLLLLLLCFLRQCRSVAQAGVQWCDHSSLQP

SEQ ID NO: 8147 - protein, 56 aa, Homo sapiens
MVAVTLVLGAGDFALTLGGFTLGGIGTATFGAILLNALLSRKLVDVPPPEVVHQEP

SEQ ID NO: 8148 - protein, 88 aa, Homo sapiens [sequence omitted]

SEQ ID NO: 8149 - protein, 41 aa, Homo sapiens
FSTIRSGLTDRSVNFLFLFLDVPDCRLVNIELMANSTVTHA

SEQ ID NO: 8150 - protein, 160 aa, Homo sapiens
  SITE (55): Xaa equals any amino acid
MAPLIPAVARGSSFLLLHALTLWGAPFPTTWVSCQPRSVLRPSPVRPGVPPLAAXPLCSCVSLFFFRVVLHVSSICGVALGPFRTGAPAQLLGPPPVAQGRLFVPQPQAVSGENRCVVPELKFWEGQCPFLWGPGLVLHCFKRSCHSNRQPCNRRAACSP

SEQ ID NO: 8151 - protein, 7 aa, Homo sapiens
IFIYLLM

SEQ ID NO: 8152 - protein, 50 aa, Homo sapiens
MIFLFFILFEIIVTLWLTPTYPQAFSELTIQITAPFGSLPQQLYLHMSII

SEQ ID NO: 8153 - protein, 58 aa, Homo sapiens [sequence omitted]

SEQ ID NO: 8154 - protein, 54 aa, Homo sapiens
MPGPGALYSSFTSFYYTFSNHQLLLALLLLGFIASCSFFLSRVFLTFSTQLWKK

SEQ ID NO: 8155 - protein, 27 aa, Homo sapiens
  SITE (6): Xaa equals any amino acid
MPRCIXFMCVLLLPSGAGPPWGNCCPD

SEQ ID NO: 8156 - protein, 54 aa, Homo sapiens [sequence omitted]

SEQ ID NO: 8157 - protein, 66 aa, Homo sapiens
  SITE (8): Xaa equals any amino acid
MSILCCPXLCLFFSFCISSGSCPFSHVSQLSFIATFSQSSPVLLVPAYNTYLSFLAFLDCASLTST

SEQ ID NO: 8158 - protein, 131 aa, Homo sapiens [sequence omitted]

SEQ ID NO: 8159 - protein, 100 aa, Homo sapiens
MGSLSGHAYSCLLVFLLTVSPLCCQYTGVCWRFTPDPVCLGITSGGCRTAKIAASCFLWKLCPRGAPARCQPELSCRRCLSASTGRCLPVRIHRGQGPTR

SEQ ID NO: 8160 - protein, 42 aa, Homo sapiens [sequence omitted]

SEQ ID NO: 8161 - protein, 31 aa, Homo sapiens
MSRANKEIMLLLPADVPLVYSVVSVGRVTLR

SEQ ID NO: 8162 - protein, 46 aa, Homo sapiens
MSESHKIWWCYRHLAFPLLTLILYPATLGRSVFCHDCKFPEASPAM

SEQ ID NO: 8163 - protein, 72 aa, Homo sapiens
  SITE (35): Xaa equals any amino acid
MLTWVWYLIMTSVLQASVSSVVRGSILVGGSEDCXEGGSLIQVSLGYVLAAREDRQECGPDTVSCPPGMRLD

SEQ ID NO: 8164 - protein, 78 aa, Homo sapiens
  SITE (61): Xaa equals any amino acid
MQWPFLCVLPLLPQVWRAGSLLRALELYSVLLSHFLWEMWTMSLKEPELLLSTKSLTVWRXREPLSEIGGCRLNNEGT

SEQ ID NO: 8165 - protein, 46 aa, Homo sapiens
MWNFSCSTSICEYGFLKFLVLYLLSTSMSSPLIGPEPHSPTKCKIK

SEQ ID NO: 8166 - protein, 41 aa, Homo sapiens
MWLMLILSLTSGETEALRGCCSSSWTYGESAAGPADQAPCL

SEQ ID NO: 8167 - protein, 24 aa, Homo sapiens
  SITE (21): Xaa equals any amino acid
MLNRIMVASFGAVLVQVCRGXGQG

SEQ ID NO: 8168 - protein, 41 aa, Homo sapiens [sequence omitted]

SEQ ID NO: 8169 - protein, 53 aa, Homo sapiens
MQGVLFGFVWLFSFLWQENKSSASPSTLAKSGSPCPVSIPWMPGVLVRFFTLL

SEQ ID NO: 8170 - protein, 49 aa, Homo sapiens
MCHLCVHVGLLVSLFPSQAAGFVWMRMAPFLFTDRYSVPSTVPGTQEVL

SEQ ID NO: 8171 - protein, 44 aa, Homo sapiens
MLVFLPFTVLVLISYIFSSHSFNPLFTLCDFEQVLLHLKIFSHP

SEQ ID NO: 8172 - protein, 31 aa, Homo sapiens
MCCRAGGSQSPQVMVVLIIILGPWGGVRIDA

SEQ ID NO: 8173 - protein, 109 aa, Homo sapiens
MWAELKLLSWGRAAIAVWVCLRRVVRGGHSPPAGQGGQGVKVQWEGVQGSGSGQPEDMRWEKLHVRILMQGMHGAPQDDIRSVHGSTAFPDCLHLPCRPTCPGVSFGSG

SEQ ID NO: 8174 - protein, 158 aa, Homo sapiens [sequence omitted]

SEQ ID NO: 8175 - protein, 89 aa, Homo sapiens
MVVPADSGGLPRRTEKLLCVMLLLLERMALCPVLDVHTHLGCIICVACQPVRTVLSLLTASIQEGSRLSGHFQTLPHQTDTTFHKGSKL

SEQ ID NO: 8176 - protein, 66 aa, Homo sapiens
MHNLISSIISFLYNFCALPLASPQFTNEESSYTALRSCTRGGFESRSLGTQKSCTFQGKGDYHVTA

SEQ ID NO: 8177 - protein, 247 aa, Homo sapiens
MKALRLSASALFCLLLINGLGAAPPGRPEAQPPPLSSEHKEPVAGDAVPGPKDGSAPEVRGARNSEPQDEGELFQGVDPRALAAVLLQALDRPASPPAPSGSQQGPEEEAAEALLTETVRSQTHSLPAPESPEPAAPPRPQTPENGPEASDPSEELEALASLLQELRDFSPSSAKRQQETAAAETETRTHTLTRVNLGEPGAERVWRAPGESPGACPGGAPCARPSHSGAYAEGAFRTQSGGCFPKN

SEQ ID NO: 8178 - protein, 64 aa, Homo sapiens
  SITE (13): Xaa equals any amino acid
MTLITPARITLTXGNKSWSSTAVAAALELVDPPGCRNSARDRCMHTPLCVCMCVCVCVCRGILV

SEQ ID NO: 8179 - protein, 81 aa, Homo sapiens
MWPLLAVSPFGLVWASSQSGSLLLRASIPRQHSRRAWHFYSEVWQSHSVASVLLYLLVRAITKMCIGSKKRDITPTTRWKK

SEQ ID NO: 8180 - protein, 98 aa, Homo sapiens
MMNQHLLESFGSPSSLFIVFILLIWMLQRCKDFFLCCYRVVLTPSFWQKHQHPDPKIKHHLKLYSLKYSSSGQNNFRKDKHWLSGHTEEANLIKEEWK

SEQ ID NO: 8181 - protein, 70 aa, Homo sapiens
MTPQNLRFTLFQFCYSLYLELELGFRSLSQEVTREWCLSYFFLIKVCWQVPVSEFLLVKENPFLLLEKKL

SEQ ID NO: 8182 - protein, 85 aa, Homo sapiens
MSTCCTSALQYLLALFPLPAPNCVSYRSQGSSCYLLLQIQKPRLREEPEWPQPQSKSMRGSMKLGFFPHCTRLLPSWGGGGRCSG

SEQ ID NO: 8183 - protein, 42 aa, Homo sapiens
MALVISAPPPNSPCNCFFFIFLFILPLIFPLFKGLFATFVFF

SEQ ID NO: 8184 - protein, 165 aa, Homo sapiens
  SITE (100): Xaa equals any amino acid
MSKSEQCRAACPAALEQELSLGRGWWGWATEGIGSQIHPVSPPASPKQSPSLLQSMWDRCNSYTHGSLQWDRLRPPPVLPPSIYTIRTCSQRLFAAAQSXSYSHMNVRGPLIQPHNTQGPFLTPSLSSLLFHQSSPACTLSAWPLSRYAQPGSALLTTPPRLQRG

SEQ ID NO: 8185 - protein, 43 aa, Homo sapiens
  SITE (39): Xaa equals any amino acid
MDVPGMTSFLLLGGWRALVLGLSAEFQGSLTCPCPSFPXWAPS

SEQ ID NO: 8186 - protein, 113 aa, Homo sapiens
MGWKLLGLLSAAGRHSAGGDQAFPRPKGEAESASPEPDAGLGFTLHGPDVKSNGDMRFLMSLHLQMYTSAKLHHTNLTAGPGFPLSRFHQPPPSVLAACPSTNQLSPAPGDPR

SEQ ID NO: 8187 - protein, 63 aa, Homo sapiens
MLLVSCFMSIYFLSPLLLPLHGSPHPHSYLCFAVCRTSWSLSEKTCNFPNEMLQLPIFLKSIY

SEQ ID NO: 8188 - protein, 87 aa, Homo sapiens
MLSIIDLLFLLSPTFGLITELLFSPEVPKALSCPLKALGGGSHSHEPLGMFAPVPPGCESSTPFPKGLGASKILTLGAQAEFRRRSH

SEQ ID NO: 8189 - protein, 145 aa, Homo sapiens [sequence omitted]

SEQ ID NO: 8190 - protein, 61 aa, Homo sapiens
MEQGGGPRLLLLIPGLLHNTYLARPGDFPAQGTTENTECQGSPSPISHLGKVRSLDSNTQI

SEQ ID NO: 8191 - protein, 68 aa, Homo sapiens
MGTEQSLGYRVQGLLLVLSLHVSQRGLCGSLPPSMSSEERKQRPWSSQYGEHCVPDTPLRVKVRRHIL

SEQ ID NO: 8192 - protein, 67 aa, Homo sapiens
MQLLLLGLIRSQPSPPPSLCLMLCPCLPCLRYSPFVPQHPCPLPLDLCLAGCSSLSVQDKCSWPYPI

SEQ ID NO: 8193 - protein, 89 aa, Homo sapiens [sequence omitted]

SEQ ID NO: 8194 - protein, 76 aa, Homo sapiens
MFFLLILCWLLCLSLSGLYPRLLNPGGWLSLLSFQMDYGWILPWGACTVRHGKPGMGKRSGGSLPHLTALVLCLTS

SEQ ID NO: 8195 - protein, 60 aa, Homo sapiens
MLLSNLSLSLQPLLFLFSFFLFCKMGSRKGLRHKTQHFSSMTDQILKGSVRSPALGQLHD

SEQ ID NO: 8196 - protein, 55 aa, Homo sapiens
MKQRGEQVPLLLPPLLLSTRLWPCWGVPTESVGSGLARKSVGASQGHNYPMPHRV

SEQ ID NO: 8197 - protein, 88 aa, Homo sapiens [sequence omitted]

SEQ ID NO: 8198 - protein, 68 aa, Homo sapiens [sequence omitted]

SEQ ID NO: 8199 - protein, 116 aa, Homo sapiens [sequence omitted]

SEQ ID NO: 8200 - protein, 257 aa, Homo sapiens
MASKIGSRRWMLQLIMQLGSVLLTRCPFWGCFSQLMLYAERAEARRKPDIPVPYLYFDMGAAVLCASFMSFGVKRRWFALGAALQLAISTYAAYIGGYVHYGDWLKVRMYSRTVAIIGGFLVLASGAGELYRRKPRSRSLQSTGQVFLGIYLICVAYSLQHSKEDRLAYLNHLPGGELMIQLFFVLYGILALAFLSGYYVTLAAQILAVLLPPVMLLIDGNVAYWHNTRRVEFWNQMKLLGESVGIFGTAVILATDG

SEQ ID NO: 8201 - protein, 97 aa, Homo sapiens
MYHHDWLIFVFLVKTGFHHVGQAGLEFLTSSDPPAFGLPKCWDYKREPPRPARMLVFLLSCRNSFYIPDANSFSNICFANSSFQSIAGLCMVFFFFF

SEQ ID NO: 8202 - protein, 32 aa, Homo sapiens [sequence omitted]

SEQ ID NO: 8203 - protein, 51 aa, Homo sapiens
MPSHIRAHLFLLLFFLFIYQGISSISQASGLTLKTQNEKDIQVSILKEFVV

SEQ ID NO: 8204 - protein, 43 aa, Homo sapiens
  SITE (36): Xaa equals any amino acid
  SITE (37): Xaa equals any amino acid
MVSVVLIFSFLSLTISTTASAYNGNDTQGWNDKFHXXSVKTQT

SEQ ID NO: 8205 - protein, 116 aa, Homo sapiens [sequence omitted]

SEQ ID NO: 8206 - protein, 43 aa, Homo sapiens
MGKKSSTSFYLLLLCVLKTALLKCIHQPGQGGKTPSLQNIFKN

SEQ ID NO: 8207 - protein, 44 aa, Homo sapiens
MQLSLSLCAFVVCTNAVCTHAATNQARLVGFLKVLRPAHSPLCL

SEQ ID NO: 8208 - protein, 44 aa, Homo sapiens
MRPNVLQVAFPISTHRCVRPSCWLLFILFRLLPIMISQPGCNSC

SEQ ID NO: 8209 - protein, 18 aa, Homo sapiens
MVRTLSLAVLSWLPAAVC

SEQ ID NO: 8210 - protein, 134 aa, Homo sapiens
MFCFSSIFCSHEHTHLPGTFWLFLFLFLILPPSCPCFLPFSLAIETVRWPCWHHPTSFELCYPGTSIYYASRGGPVPNSPYSESYYNSLAVVLQRRDWENPGVTQLNRLAAHPPFASWRNSEEARTDRPSQQLR

SEQ ID NO: 8211 - protein, 135 aa, Homo sapiens
MGASSVQVRLASAVQTSSLLWCLFLALSTPGLVPRPDWIPSWGYLPPSNWADGEAQQRPQGLMWLPVTNVSAPRGCLPFLFCCPNSPLPQLRTILLPSKLGHRVQGPGHPWLTSCHCLVTTPAWARCLPSVLPCF

SEQ ID NO: 8212 - protein, 409 aa, Homo sapiens; identical to SEQ ID NO: 7233

SEQ ID NO: 8213 - protein, 79 aa, Homo sapiens
MSLWQSFFLGHWWPLALTLGQGRDGQWPSTCGSGVSWSGSGGGKWNFLPIWVAAVVQPSWPDWQRSGMGVYCARFLLLS

SEQ ID NO: 8214 - protein, 121 aa, Homo sapiens
  SITE (110): Xaa equals any amino acid
  SITE (112): Xaa equals any amino acid
  SITE (114): Xaa equals any amino acid
  SITE (116): Xaa equals any amino acid
MATLVWRLYLLQPELVLPSPPPPPRFPGPVQTPKIPGPARGPRTGFQPPAFSFPSPTPFFSAGTPVLSWKFAVLCPIAQELLPAEKGARNKCSGLSRSYIFAMLPEMGGXNXLXQXNEWHG

SEQ ID NO: 8215 - protein, 56 aa, Homo sapiens
MKIPLHVVFLLISLTFLFTTLPTAHSAPSSPASLHILRLRGHLMCVFPLKMMPTLI

SEQ ID NO: 8216 - protein, 50 aa, Homo sapiens
MHLCVNVCAFLCVCMLVCVHVCLCVVRTLESYSVSNAQYTVINSSHCAVR

SEQ ID NO: 8217 - protein, 87 aa, Homo sapiens
MFYLFLVLVVLPLLHKELCSIERPVYPCLFVISGKSSMSSFLCQFRWKFWGRREDGEKVQNKSMLGEISQCSAWDYYTCVAALKLGL

SEQ ID NO: 8218 - protein, 58 aa, Homo sapiens
MTLSVLQHFFICVLLILLLDTNLCRQISSHSFEFSGNQPLVFCCISSISAKLVLDQAG

SEQ ID NO: 8219 - protein, 72 aa, Homo sapiens
MGHYLLLLTLHPPATHPSLSRVLCVLWCLSLWTGQKITQDNAMPFTLDSVVFMFSQLECFSLMAATGSYIVL

SEQ ID NO: 8220 - protein, 91 aa, Homo sapiens [sequence omitted]

SEQ ID NO: 8221 - protein, 82 aa, Homo sapiens
MMKNPLSKFSGCTWVSSLLFLQAFSLLSGLEDSYDCVKSSSLHCCVAVLQCMSPPEVQRTPVKAKNFLLSVIISGAGKSLTP

SEQ ID NO: 8222 - protein, 118 aa, Homo sapiens
MPGPASPAGWFLLLLYPLPPAPCLVPWGSPPGTPARPPAAGHPHRLPAVHAPLVGDLAPPCPLTARLAPAPATVSDFAPWARSPDSCSAANSWGLLCHPGGTCQPLVPGPGSASLGDL

SEQ ID NO: 8223 - protein, 250 aa, Homo sapiens
MVYSAMWWMATCLLSHLPSDCWTDSLALSWCSPREAQSHSPRAQPSSPTASQAWSHEMLPSTWQNGPSRTRQPSLIGDLGAHGRTPRQAHPGAVTDMVPFPPARTVLELGSGASLTGLAICKMCRPRAYIFSDCHSRVLEQLRGNVLLNGLSLEADITANLDSPRVTVAQLDWDVATVHQLSAIQPDVVIAAGNAQPQESCAGGVLAALPSSGLWEKGTMDAVRHGHDGASRRVTLGLQADIKGQGCLLR

SEQ ID NO: 8224 - protein, 40 aa, Homo sapiens
MRLLKNVLTQMLIISFSTCSCLFSLFCAVITECLKLGNLY

SEQ ID NO: 8225 - protein, 109 aa, Homo sapiens
MVSCWDQNLILFLTCLLAVLIFCLVLAVYIVFFKFLKASLIYVPREWVTLTKANDVQKGHDLGLSYCRTQSTAWPPPCLGHHLHLESSLTLESFGLLTIPISDSVSLIT

SEQ ID NO: 8226 - protein, 89 aa, Homo sapiens
MKFLLAALVLSLILPRSSQYIKWIVSAGLAQVSEFSFVLGSRARRAGVISREVYLLILSVTTLSLLLAPVLWRAAITRCVPRPERRSSL

SEQ ID NO: 8227 - protein, 178 aa, Homo sapiens
MHRPEAMLLLLTLALLGGPTWAGKMYGPGGGKYFSTTEDYDHEITGLRVSVGLLLVKSVQVKLGDSWDVKLGALGGNTQEVTLQPGEYITKVFVAFQAFLRGMVMYTSKDRYFYFGKLDGQISSAYPSQEGQVLVGIYGQYQLLGIKSIGFEWNYPLEEPTTEPPVNLTYSANSPVGR

SEQ ID NO: 8228 - protein, 18 aa, Homo sapiens
MRFSEAWTSPWCMTLLTC

SEQ ID NO: 8229 - protein, 61 aa, Homo sapiens
MHVVHWSRLFLLKPPYSVHATFIPTGFLARFRTPGILDSCFFHSWPLLLSYFLSPQSPLLK

SEQ ID NO: 8230 - protein, 184 aa, Homo sapiens
MKILVAFLVVLTIFGIQSHGYEVFNIISPSNNGGNVQETVTIDNEKNTAIINIHAGSCSSTTIFDYKHGYIASRVLSRRACFILKMDHQNIPPLNNLQWYIYEKQALDNMFSSKYTWVKYNPLESLIKDVDWFLLGSPIEKLCKHIPLYKGEVVENTHNVGAGGCAKAGLLGILGISICADIHV

SEQ ID NO: 8231 - protein, 185 aa, Homo sapiens
MKFTIVFAGLLGVFLAPALANYNINVNDDNNNAGSGQQSVSVNNEHNVANVDNNNGWDSWNSIWDYGNGFAATRLFQKKTCIVHKMNKEVMPSIQSLDALVKEKKLQGKGPGGPPPKGLMYSVNPNKVDDLSKFGKNIANMCRGIPTYMAEEMQEASLFFYSGTCYTTSVLWIVDISFCGDTVEN

SEQ ID NO: 8232 - protein, 208 aa, Homo sapiens
MGLGARGAWAALLLGTLQVLALLGAAHESAAMAASANIENSGLPHNSSANSTETLQHVPSDHTNETSNSTVKPPTSVASDSSNTTVTTMKPTAASNTTTPGMVSTNMTSTTLKSTPKTTSVSQNTSQISTSTMTVTHNSSVTSAASSVTITTTMHSEAKKGSKFDTGSFVGGIVLTLGVLSILYIGCKMYYSRRGIRYRTIDEHDAII

SEQ ID NO: 8233 - protein, 73 aa, Homo sapiens
  SITE (21): Xaa equals any amino acid
MKGELLPFLFLTVWLWLYKLXFGESPRYPNVIGKTYFFFWTDQISRESRFLERLAFIVSENCLIFLIHAITGQ

SEQ ID NO: 8234 - protein, 185 aa, Homo sapiens
  SITE (163): Xaa equals any amino acid
MAWPNVFQRGSLLSQFSHHHVVVFLLTFFSYSLLHASRKTFSNVKVSISEQWTPSAFNTSVELPLEIWSSNHLFPSAEKATLFLGTLDTIFLFSYAVGLFISGIVGDRLNLRWVLSFGMCSSALVVFVFGALTEWLRFYNKWLYCCLWIVNGLLQSTGWPCVXAVMGNWFGKAGYATSFLSNFSV

SEQ ID NO: 8235 - protein, 508 aa, Homo sapiens
MAGRTTAAPRGPYGPWLCLLVALALDVVRVDCGQAPLDPVYLPAALELLDAPEHFRVQQVGHYPPANSSLSSRSETFLLLQPWPRAQPLLRASYPPFATQQVVPPRVTEPHQRPVPWDVRAVSVEAAVTPAEPYARVLFHLKGQDWPPGSGSLPCARLHATHPAGTAHQACRFQPSLGACVVELELPSHWFSQASTTRAELAYTLEPAAEGPGGCGSGEENDPGEQALPVGGVELRPADPPQYQEVPLDEAVTLRVPDMPVRPGQLFSATLLLRHNFTASLLTLRIKVKKGLHVTAARPAQPTLWTAKLDRFKGSRHHTTLITCHRAGLTEPDSSSPLELSEFLWVDFVVENSTGGGVAVTRPVTWQLEYPGQAPEAEKDKMVWEILVSERDIRALIPLAKVSEACDAVFVAGKESRGARGVRVDFWWRRLRASLRLTVWAPLLPLRIELTDTTLEQVRGWRVPGPAEGPAEPAAEASDEAERRARGCHLQYQRAGVRFLAPFAAHPL

SEQ ID NO: 8236 - protein, 58 aa, Homo sapiens
MRRMRMKSLSPRRSWWTLWLGQGVLGAALKANTLWIAMRRRMMMMGGPANMTSWPQRM

SEQ ID NO: 8237 - protein, 102 aa, Homo sapiens
MRVSCSRSCCSLPPISLSLRLVASCLPCCLCLSAAPRMQEEPGHLRPSRARPLEGPSWDSPSLAPPASAQRPLPPPVSRILPATSGRAGRWCGWAPCPKTAA

SEQ ID NO: 8238 - protein, 153 aa, Homo sapiens
MHTHTLSLVSLSLSHSFLLSSQVTCTLGFLVEAHLPPLRGVPDCIHHNPKTRVGGNWREQNTDLILVSLLETSSPKARSLKTNLLKTCLLKVNDLMTNLPKAQFLFWCVYIHLGVLFFFVMLWIFQGFISIHPRVLLSYYQQHKFIKFAALCK

SEQ ID NO: 8239 - protein, 121 aa, Homo sapiens
MPCGRQHLQNLDDAVNGSAWTILLLTENFLRDTWCNFQFYTSLMNSVNRQHKYNSVIPMRPLNNPLPRERTPFALQTINALEEESRGFPTQVERIFQESVYKTQQTIWKETRNMVQRQFIA

SEQ ID NO: 8240 - protein, 134 aa, Homo sapiens
MSALRPLLLLLLPLCPGPGPGPGSEAKVTRSCAETRQVLGARGYSLNLIPPALISGEHLRVCPQEYTCCSSETEQRLIRETEATFRGLVEDSGSFLVHTLAARHRKFDDNPDPGGCPSLCAGPGDWKKCGQRCA

SEQ ID NO: 8241 - protein, 116 aa, Homo sapiens
MKGLRSLAATTLALFLVFVFLGNSSCAPQRLLERRNWTPQAMLYLKGAQGRRFISDQSRRKDLSDRPLPERRSPNPQLLTIPEAATILLASLQKSPEDEEKNFDQTRFLEDSLLNW

SEQ ID NO: 8242 - protein, 203 aa, Homo sapiens
MARPRPREYKAGDLVFAKMKGYPHWPARIDELPEGAVKPPANKYPIFFFGTHETAFLGPKDLFPYKEYKDKFGKSNKRKGFNEGLWEIENNPGVKFTGYQAIQQQSSSETEGEGGNTADASSEEEGDRVEEDGKGKRKNEKAGSKRKKSYTSKKSSKQSRKSPGDEDDKDCKEEENKSSSEGGDAGNDTRNTTSDLQKTSEGT

SEQ ID NO: 8243 - protein, 566 aa, Homo sapiens
MQVVSHGDERPAWLMSETLRHLHTHFGADYDWFFIMQDDTYVQAPRLAALAGHLSINQDLYLGRAEEFIGAGEQARYCHGGFGYLLSRSLLLRLRPHLDGCRGDILSARPDEWLGRCLIDSLGVGCVSQHQAQIRNLTVLTPEGEAGLSWPVGLPAPFTPHSRFEVLGWDYFTEQHTFSCADGAPKCPLQGASRADVGDALETALEQLNRRYQPRLRFQKQRLLNGYRRFDPARGMEYTLDPGSTHASERGHRRALARRVSLLRPLSRVEILPMPYVTEATRVQLVLPLLVAEAAAAPAFLEAFAANVLEPREHALLTLLLVYGPREGGRGAPDPFLGVKAAAAELERRYPGTRLAWLAVRAEAPSQVRLMDVVSKKHPVDTLFFLTTVWTRPGPEVLNRCRMNAISGWQAFFPVHFQEFNPALSPQRSPPGPPGAGPDPPSPPGADPSRGAPIAGRFDRQASAEGCFYNADYLAARARLAGELAGQEEEEALEGLEVMDVFLRFSGLHLFRAVEPGLVQKFSLRDCSPRLSEELYHRCRLSNLEGLGGRAQLAMALFEQEQANST

SEQ ID NO: 8244 - protein, 509 aa, Homo sapiens
MEFSWLETRWARPFYLAFVFCLALGLLQAIKLYLRRQRLLRDLRPFPAPPTHWFLGHQKFIQDDNMEKLEEIIEKYPRAFPFWIGPFQAFFCIYDPDYAKTLLSRTDPKSQYLQKFSPPLLGKGLAALDGPKWFQHRRLLTPGFHFNILKAYIEVMAHSVKMMLDKWEKICSTQDTSVEVYEHINSMSLDIIMKCAFSKETNCQTNSTHDPYAKAIFELSKIIFHRLYSLLYHSDIIFKLSPQGYRFQKLSRVLNQYTDTIIQERKKSLQAGVKQDNTPKRKYQDFLDIVLSAKDESGSSFSDIDVHSEVSTFLLAGHDTLAASISWILYCLALNPEHQERCREEVRGILGDGSSITWDQLGEMSYTTMCIKETCRLIPAVPSISRDLSKPLTFPDGCTLPAGITVVLSIWGLHHNPAVWKNPKVFDPLRFSQENSDQRHPYAYLPFSAGSRNCIGQEFAMIELKVTIALILLHFRVTPDPTRPLTFPNHFILKPKNGMYLHLKKLSEC

SEQ ID NO: 8245 - protein, 215 aa, Homo sapiens
  SITE (7): Xaa equals any amino acid
MLPWTAXGLALSLRLALARSGAERGPPASAPRGDLMFLLDSSASVSHYEFSRVREFVGQLVAPLPLGTGALRASLVHVGSRPYTEFPFGQHSSGEAAQDAVRASAQRMGDTHTGLALVYAKEQLFAEASGARPGVPKVLVWVTDGGSSDPVGPPMQELKDLGVTVFIVSTGRGNFLELSAAASAPAEKHLHFVDVDDLHIIVQELRGSILDAMRP

SEQ ID NO: 8246 - protein, 109 aa, Homo sapiens
  SITE (40): Xaa equals any amino acid
MCSMFCERLLLLCHCQLSIAVFMYWVHVTHLSSVRRINYXFLIYKKGMQLPSWYPSSCPASRKNQVTGMNGRVVNVEDFIEQWKWLSVGWGARKGLEWEDDLYLEFGHP

SEQ ID NO: 8247 - protein, 209 aa, Homo sapiens
  SITE (3): Xaa equals any amino acid
  SITE (39): Xaa equals any amino acid
MAXSSRGNADSIVASLVLMVLYLIKKRLVACAAVFYGFXVHMKIYPVTYILPITLHLLPDRDNDKSLRQFRYTFQACLYELLKKLCNRAVLLFVAVAGLTFFALSFGFYYEYGWEFLEHTYFYHLTRRDIRHNFSPYFYMLYLTAESKWSFSLGIAAFLPQLILLSAVSFAYYRDLVFCCFLHTSIFVTFNKVCTSQYFLWVPLAYCLL

SEQ ID NO: 8248 - protein, 45 aa, Homo sapiens
MDMVCFCIYLGLLKFISAIFCSFSEEVLYISFVKCIPKYFVEMLL

SEQ ID NO: 8249 - protein, 40 aa, Homo sapiens
MKCSKVLTQLILFTPLGVCKMSLFYKHNHNSNKPQVVASV

SEQ ID NO: 8250 - protein, 709 aa, Homo sapiens
  SITE (216): Xaa equals any amino acid
MATAGGGSGADPGSRGLLRLLSFCVLLAGLCRGNSVERKIYIPLNKTAPCVRLLNATHQIGCQSSISGDTGVIHVVEKEEDLQWVLTDGPNPPYMVLLESKHFTRDLMEKLKGRTSRIAGLAVSLTKPSPASGFSPSVQCPNDGFGVYSNSYGPEFAHCREIQWNSLGNGLAYEDFSFPIFLLEDENETKVIKQCYQDHNLSQNGSAPSFPLCAMXLFSHMHAVISTATCMRRSSIQSTFSINPEIVCDPLSDYNVWSMLKPINTTGTLKPDDRVVVAATRLDSRSFFWNVAPGAESAVASFVTQLAAAEALQKAPDVTTLPRNVMFVFFQGETFDYIGSSRMVYDMEKGKFPVQLENVDSFVELGQVALRTSLELWMHTDPVSQKNESVRNQVEDLLATLEKSGAGVPAVILRRPNQSQPLPPSSLQRFLRARNISGVVLADHSGAFHNKYYQSIYDTAENINVSYPEWLSPEEDLNFVTDTAKALADVATVLGRALYELAGGTNFSDTVQADPQTVTRLLYGFLIKANNSWFQSILRQDLRSYLGDGPLQHYIAVSSPTNTTYVVQYALANLTGTVVNLTREQCQDPSKVPSENKDLYEYSWVQGPLHSNETDRLPRCVRSTARLARALSPAFELSQWSSTEYSTWTESRWKDIRARIFLIASKELELITLTVGFGILIFSLIVTYCINAKADVLFIAPREPGAVSY

SEQ ID NO: 8251 - protein, 137 aa, Homo sapiens
  SITE (132): Xaa equals any amino acid
MSAKQVTSQSSLSENDGFQAFVWWLLGIGALTFALLMSARMGIFQETLYKRFGKHSKEALFYNHALPLPGFVFLASDIYDHAVLFNKSELYEIPVIGVTLPIMWFYLLMNIITQYVCIRGVFILTTGMRLPXRHARS

SEQ ID NO: 8252 - protein, 412 aa, Homo sapiens
MGVWTGRLGGWAQVMFQFLSQGFYCGVGLFTRFLKLLGALLLLALALFLGFLQLGWRFLVGLGDRLGWRDKATWLFSWLDSPALQRCLTLLRDSRPWQRLVRIVQWGWLELPWVKQNINRQGNAPVASGRYCQPEEEVARLLTMAGVPEDELNPFHVLGVEATASDVELKKAYRQLAVMVHPDKNHHPRAEEAFKVLRAAWDIVSNAEKRKEYEMKRMAENELSRSVNEFLSKLQDDLKEAMNTMMCSRCQGKHRRFEMDREPKSARYCAECNRLHPAEEGDFWAESSMLGLKITYFALMDGKVYDITQWAGCQRVGISPDTHRVPYHISFGSRIPGTRGRQRATPDAPPADLQDFLSRIFQVPPGQMPNGNFFAAPQPAPGAAAASKPNSTVPKGEAKPKRRKKVRRPFQR

SEQ ID NO: 8253 - protein, 15 aa, Homo sapiens
MPPRAAWAWLLCGAS

SEQ ID NO: 8254 - protein, 104 aa, Homo sapiens [sequence omitted]

SEQ ID NO: 8255 - protein, 57 aa, Homo sapiens
MKQTYWQTHILLVLTLYFIVLAYSPFLRFLLRNIGTHPLLCAEGITSFFLSYKNMLY

SEQ ID NO: 8256 - protein, 51 aa, Homo sapiens [sequence omitted]

SEQ ID NO: 8257 - protein, 108 aa, Homo sapiens [sequence omitted]

SEQ ID NO: 8258 - protein, 233 aa, Homo sapiens
  SITE (168): Xaa equals any amino acid
MVSPRMSGLLSQTVILALIFLPQTRPAGVFELQIHSFGPGPGPGAPRSPCRLFFRVCLKPGLSEEAAESPCALGAALSARGPVYTEQPGAPAPDLPLPDGLLQVPFRDAWPGTFSFIIETWREELGDQIGGPAWSLLARVAGRRRLAAGGRGPGTFSAQAPGSCASRXARAASRLPSGPRARASAVRAAPPRGAVRDCAPAHRSRPNVRRRRCAEQAAALSMASVNSPVNADA

SEQ ID NO: 8259 - protein, 124 aa, Homo sapiens
  SITE (118): Xaa equals any amino acid
MIKSAPVGPVAGGIMGCIMVLVLAVYAYRHQIHRRSHQHMSPLAAQEMSVRMSNLENDRDERDDDSHEDRGIISNTRFIAAVIERHAHSPERRRRYWGRSGTESDHGYSTMSPQEDSXKSSMQQ

SEQ ID NO: 8260 - protein, 515 aa, Homo sapiens
MGSAPWAPVLLLALGLRGLQAGGEWRRPPAHSPVPAPPLRFASPHSPQAPDPGFQERFFQQRLDHFNFERFGNKTFPQRFLVSDRFWVRGEGPIFFYTGNEGDVWAFANNSGFVAELAAERGALLVFAEHRYYGKSLPFGAQSTQRGHTELLTVEQALADFAELLRALRRDLGAQDAPAIAFGGSYGGMLSAYLRMKYPHLVAGALAASAPVLAVAGLGDSNQFFRDVTADFEGQSPKCTQGVREAFRQIKDLFLQGAYDTVRWEFGTCQPLSDEKDLTQLFMFARNAFTVLAMMDYPYPTDFLGPLPANPVKVGCDRLLSEAQRITGLRALAGLVYNASGSEHCYDIYRLYHSCADPTGCGTGPDARAWDYQACTEINLTFASNNVTDMFPDLPFTDELRQRYCLDTWGVWPRPDWLLTSFWGGDLRAASNIIFSNGNLDPWAGGGIRRNLSASVIAVTIQGGAHHLDLRASHPEDPASVVEARKLEATIIGEWVKAARREQQPALRGGPRLSL

SEQ ID NO: 8261 - protein, 165 aa, Homo sapiens
MVNPGSSSQPPPVTAGSLSWKRCAGCGGKIADRFLLYAMDSYWHSRCLKCSCCQAQLGDIGTSCYTKSGMILCRNDYIRLFGNSGACSACGQSIPASELVMRAQGNVYHLKCFTCSTCRNRLVPGDRFHYINGSLFCEHDRPTALINGHLNSLQSNPLLPDQKVC

SEQ ID NO: 8262 - protein, 36 aa, Homo sapiens [sequence omitted]

SEQ ID NO: 8263 - protein, 89 aa, Homo sapiens
MIISLFIYIFLTCSNTSPSYQGTQLGLGLPSAQWWPLTGRRMQCCRLFCFLLQNCLFPFPLHLIQHDPCELVLTISWDWAEAGASLYSP

SEQ ID NO: 8264 - protein, 21 aa, Homo sapiens
MLFFFILHLLSIMSFLSPDIM

SEQ ID NO: 8265 - protein, 73 aa, Homo sapiens [sequence omitted]

SEQ ID NO: 8266 - protein, 490 aa, Homo sapiens
  SITE (134): Xaa equals any amino acid
  SITE (389): Xaa equals any amino acid
MLALTFMFMVLEVVVSRVTSSLAMLSDSFHMLSDVLALVVALVAERFARRTHATQKNTFGWIRAEVMGALVNAIFLTGLCFAILLEAIERFIEPHEMQQPLVVLGVGVAGLLVNVLGLCLFHHHSGFSQDSGHXHSHGGHGHGHGLPKGPRVKSTRPGSSDINVAPGEQGPDQEETNTLVANTSNSNGLKLDPADPENPRSGDTVEVQVNGNLVREPDHMELEEDRAGQLNMRGVFLHVLGDALGSVIVVVNALVFYFSWKGCSEGDFCVNPCFPDPCKPFVEIINSTHASVYEAGPCWVLYLDPTLCVVMVCILLYTTYPLLKESALILLQTVPKQIDIRNLIKELRNVEGVEEVHELHVWQLAGSRIIATAHIKCEDPTSYMEVAKXIKDVFHNHGIHATTIQPEFASVGSKSSVVPCELACRTQCALKQCCGTLPQAPSGKDAEKTPAVSISCLELSNNLEKKPRRTKAENIPAVVIEIKNMPKQTT

SEQ ID NO: 8267 - protein, 30 aa, Homo sapiens
MASHCWMGAVCVLFLGIIFLAALFPYISFY

SEQ ID NO: 8268 - protein, 41 aa, Homo sapiens
MACETHGVLVPAHLSGLITCLLAFWVPASCIQRCSGSPLPL

SEQ ID NO: 8269 - protein, 113 aa, Homo sapiens [sequence omitted]

SEQ ID NO: 8270 - protein, 295 aa, Homo sapiens
MSLLLLLSVLMSPGARPSDPVEVIASGPTVASSHNVQDCLHILNRYGLRAALPRSVKTVLSRADSDPHGPHTCGHVLNVIIGSNVLALAEAQRQAEALGYQAVVLSAAMQGDVKSMAQFYGLLAHVARTRLTPSMAGASVEEDAQLHELAAELQIPDLQLEEALETMAWGRGPVCLLAGGEPTVQLQGSGRGGRNQELALRVGAELRRWPLGPIDVLFLSGGTDGQDGPTEAAGAWVTPELASQAAAEGLDIATFLAHNDSHTFFCCLQGGAHLLHTGMTGTNVMDTHLLFLRPR

SEQ ID NO: 8271 - protein, 86 aa, Homo sapiens
  SITE (71): Xaa equals any amino acid
MLAAAPLHEQKQMIGTCYLVLKRWSDWMVLSFLPLLLSCDFEGSVSTPLSMMSTPSWLARSRACCWRLTTXSCCSCWSLQNPSMPR

SEQ ID NO: 8272 - protein, 44 aa, Homo sapiens [sequence omitted]

SEQ ID NO: 8273 - protein, 48 aa, Homo sapiens
MCIYQSEQMLALLLVLVFCISLLVLVCWGSHNKVPQKFIFSQFWGLED

SEQ ID NO: 8274 - protein, 173 aa, Homo sapiens
MHPAAFPLPVVVAAVLWGAAPTRGLIRATSDHNASMDFADLPALFGATLSQEGLQGFLVEAHPDNACSPIAPPPPAPVNGSVFIALLRRFDCNFDLKVLNAQKAGYGAAVVHNVNSNELLNMVWNSEEIQQQIWIPSVFIGERSSEYLRALFVYEKGARVLSWFQNNNLPLGL

SEQ ID NO: 8275 - protein, 41 aa, Homo sapiens
MGWEAALALLVSAVFFPWCTIQRPDVGTTSPGGLERRSKGF

SEQ ID NO: 8276 - protein, 55 aa, Homo sapiens
MAVRVLWGGLSLLRVLWCLLPQTGYVHPDEFFQSPEVMAGKTPHVWLRQAAAESA

SEQ ID NO: 8277 - protein, 30 aa, Homo sapiens
MSPGRVSVVSLQGSQLCLLVSIAIMGLLLF

SEQ ID NO: 8278 - protein, 67 aa, Homo sapiens [sequence omitted]

SEQ ID NO: 8279 - protein, 44 aa, Homo sapiens
MASTLETIRPLGFLLLYCFISLLYLPVLETSFSFLLVWRLEPIV

SEQ ID NO: 8280 - protein, 42 aa, Homo sapiens
MCILPLMLTYPILPKVVGNNILLGDSGLTSLVIPLSVVFNLK

SEQ ID NO: 8281 - protein, 174 aa, Homo sapiens
MSSAAADHWAWLLVLSFVFGCNVLRILLPSFSSFMSRVLQKDAEQESQMRAEIQDMKQELSTVNMMDEFARYARLERKINKMTDKLKTHVKARTAQLAKIKWVISVAFYVLQAALMISLIWKYYSVPVAVVPSKWITPLDRLVAFPTRVAGGVGITCWILVCNKVVAIVLHPFS

SEQ ID NO: 8282 - protein, 45 aa, Homo sapiens
MGKLINIVIRKPLLLLLVQCENCCRKNMLYNIFLNIHNIHKFSNH

SEQ ID NO: 8283 - protein, 65 aa, Homo sapiens [sequence omitted]

SEQ ID NO: 8284 - protein, 23 aa, Homo sapiens
MVASTLVTNLFGVAFATTAATRA

SEQ ID NO: 8285 - protein, 49 aa, Homo sapiens
MIVNHFSFLFCWIVFCFLLQHSCFCCAYFWSFDSLCHCFLSHTPLRFTQ

SEQ ID NO: 8286 - protein, 70 aa, Homo sapiens
  SITE (33): Xaa equals any amino acid
MLMAPVVCLSFSPCPADTSLTGDGLKAGLERGXALVTLFDSVTHFLAHTLFELLDFQLAFLRSGKQTAPH

SEQ ID NO: 8287 - protein, 10 aa, Homo sapiens
MAYAFHRTST

SEQ ID NO: 8288 - protein, 105 aa, Homo sapiens
MCLTTAGFCLLAIHSFALGVQSRQQHSVPIVFEVLPLRVPEPSRVTGCSSFFQTKVLCKQHLLGPRASVNIVLACLACCHRKGLCVHIPANLMSPSSAKLYHSLH

SEQ ID NO: 8289 - protein, 50 aa, Homo sapiens
MGWLCCEPSGLYNLEKQYFFFSSLQAGLPVIVSSGCTKIAYGFAVYSPSS

SEQ ID NO: 8290 - protein, 40 aa, Homo sapiens
MCFRFMMIIFLTNVISVSAVIFKLRERDSIRFFFFFIFLK

SEQ ID NO: 8291 - protein, 40 aa, Homo sapiens
MNNSIAAQASKFVILYLFILSFPKQCICHILVRWSGKSHF

SEQ ID NO: 8292 - protein, 283 aa, Homo sapiens
MKIVPLTAAVLALVLAPAAHAQPANKATTVSPTAAAFLAQFATEGNDSVSWAQFEAFRKQRYADTDRNQDGHVDEQEYVDEYLQRFDVRLADARAGHLRQTDTRFKALDRDGNGAISRAEYDAAGERTWAGYERSQNATQETAAASSRDPLKMPTSHTANGMLDLYDRNKDGAVDREEFDAVRAASFAATDTDGNGTLSLAEYTAEFEGRLDQQRQRVRADAERQARVRFASLDKDTDGRMTFAEYQLSGKRMFDRADSNGDGVVDARDPEPVAGAHSANGNR

SEQ ID NO: 8293 - protein, 55 aa, Homo sapiens
MMMSRVFFCCVGWLCFHLPWLHSQAGFCCVLIASGQRHHGSLSERKIDSFSPVIW

SEQ ID NO: 8294 - protein, 45 aa, Homo sapiens
MYLWFFCCLFFFFSSHAACAPAMLDSVLLCAVENSLAQTPHIWNS

SEQ ID NO: 8295 - protein, 74 aa, Homo sapiens
MFTGLLIYLLVSSILISLADRPFSSIRCLTFWVQFIRLCYIRNTSLLPMTCVAYIFFLFYFFTIQKFLVKIINF

SEQ ID NO: 8296 - protein, 29 aa, Homo sapiens [sequence omitted]

SEQ ID NO: 8297 - protein, 159 aa, Homo sapiens
MELPAVNLKVILLGHWLLTTWGCIVFSGSYAWANFTILALGVWAVAQRDSIDAISMFLGGLLATIFLDIVHISIFYPRVSLTDTGRFGVGMAILSLLLKPLSCCFVYHMYRERGGELLVHTGFLGSSQDRSAYQTIDSAEAPADPFAVPEGRSQDARGY

SEQ ID NO: 8298 - protein, 99 aa, Homo sapiens [sequence omitted]

SEQ ID NO: 8299 - protein, 121 aa, Homo sapiens
MPLFFTRFHPALGPLALSLLAGFAAGSLQAIGRTEEKGVRVLTSQAPPYRVMGQLHSSTKGFSFCQGVCPRALSLWVTTPLFLPPSPRLAMVPTVSCPGYCPSCFSVSCLCFTTGPSSNSA

SEQ ID NO: 8300 - protein, 26 aa, Homo sapiens
MVVMEVLMTMVAIIITAMGMMALMTE

SEQ ID NO: 8301 - protein, 32 aa, Homo sapiens
MRFLLTVWGSFPFMLIPVFLSIGTKEMKKAQR

SEQ ID NO: 8302 - protein, 38 aa, Homo sapiens [sequence omitted]

SEQ ID NO: 8303 - protein, 85 aa, Homo sapiens [sequence omitted]

SEQ ID NO: 8304 - protein, 188 aa, Homo sapiens; identical to SEQ ID NO: 7349

SEQ ID NO: 8305 - protein, 374 aa, Homo sapiens
  SITE (84): Xaa equals any amino acid
  SITE (112): Xaa equals any amino acid
MRPGTALQAVLLAVLLVGLRAATGRLLSGQPVCRGGTQRPCYKVIYFHDTSRRLNFEEAKEACRRDGGQLVSIESEDEQKLIEXFIENLLPSDGDFWIGLRRREEKQSNSTXCQDLYAWTDGSISQFRNWYVDEPSCGSEVCVVMYHQPSAPAGIGGPYMFQWNDDRCNMKNNFICKYSDEKPAVPSREAEGEETELTTPVLPEETQEEDAKKTFKESREAALNLAYILIPSIPLLLLLVVTTVVCWVWICRKRKREQPDPSTKKQHTIWPSPHQGNSPDLEVYNVIRKQSEADLAETRPDLKNISFRVCSGEATPDDMSCDYDNMAVNPSESGFVTLVSVESGFVTNDIYEFSPDQMGRSKESGWVENEIYGY

SEQ ID NO: 8306 - protein, 97 aa, Homo sapiens
MRPLLCALTGLALLRAAGSLAAAEPFSPPRGDSAQSTACDRHMAVQRRLDVMEEMVEKTVDHLGTEVKGLLGLLEELAWNLPPGPFSPAPDLLGDGF

SEQ ID NO: 8307 - protein, 180 aa, Homo sapiens
MVVLFRWVPVTDAYWQILFSVLKVTRNLKELDLSGNSLSHSAVKSLCKTLRRPRCLLETLRLAGCGLTAEDCKDLAFGLRANQTLTELDLSFNVLTDAGAKHLCQRLRQPSCKLQRLQLVSCGLTSDCCQDLASVLSASPSLKELDLQQNNLDDVGVRLLCEGLSILPANSYAWGWTRQL

SEQ ID NO: 8308 - protein, 41 aa, Homo sapiens
MRLVSPGFWWVLPLRLGEALPGRRRQQPPGAMKTLRLREVK

SEQ ID NO: 8309 - protein, 31 aa, Homo sapiens
MSVKVGSLLVLVYFTLGPVVAELEVTLPSHS

SEQ ID NO: 8310 - protein, 37 aa, Homo sapiens
MPDKREATAAAVALFIVPLGVWMRGSRGYSAAHEGSL

SEQ ID NO: 8311 - protein, 246 aa, Homo sapiens
MALFRCVWSVLSALGKSGSDLCAGCGSRLRSPFSFAYVPRCFSSTANSYPKKPLTSYVRFSKEQLPIFKAQNPDAKNSELIRKIAQLWRELPDSEKKIYEDAYRADWQAYKEEINRIQEQLTPSQIVSLEKEIQQKRLKKKALIKKRELTMLGKPKRPRSAYNIFIAERFQETKDGTSQVKLKTINENWKNLSSSQKQVYIQLANDDKIRYYNEMKSWEEQMMEVGRKDLLRRTVKHQRKVDPEEY

SEQ ID NO: 8312 - protein, 92 aa, Homo sapiens
MGPFAPTLLMLLPPLLMLVLYGCWQARGWAGHQYEHHRGPGEQSAAYFQAMRFNANMSFHAQMVINEGEAFREGQRTIPAVERPGNALRQRS

SEQ ID NO: 8313 - protein, 744 aa, Homo sapiens
MWWALLALPFLLPTALRLCLAGPPPERGPLFWLTRQDSRESGAANATVSPCEGLPSAGASTLTLANRSLERLPNCLPPALRSLDASHNLLRALSAPELGALPRLQALTLRHNRIAELRWGPGGPAALHTLDLSYNQLATLPPCAGPALPGLRSLALAGNPLQALQPGAFACLPALRLLNLSGTALGRDLGAGIADGAFAGAGGALEVLDLSGTFLERVRSGWIRDLPKLTSLHLRKMPRLRILEAAVFKMTPNLQQLDCQDSSALTSVHTQLFQDTPRLQVLLFQNCNLSSFPPWSLHSSQVLSISLFGNPLICSCELSWLLRDAKRTVLSRAADTVCVPASGSRDTFSAPLSLSQLPTVCHLDQSTTLHSSSPQAVPFTHQPSTQGLTTPWSTAPSTRPVEAEQSVTKPLSFPTDSATQTAWSHSGIKVGTARSTAIPTADSSTSSAPRRAANTAGAEHQEHAPMLVHAPHVSAASTPSASKHPGLFPTPWSQVRTPQPDYRAQATLQAPHPSPSEGAIPVLLLDESSEEEEEGQKEEVGAPPQDVPCDYHPCKHLQTPCAELQRRSRCRCPGLSGEDSLPDPPRLQAVTETTDTSALVRWCAPNSVVHGYQIHYSPEGWAENQSVTVVADIYATARQHPLYGLSPGTMYRVCVLAANRAGLSQPVQASGWTRACAAFTTKPSFVLVFAGLCAACGLLLVTTLLLAACLCRRSRTVRLQRYNTHLVAYKNPAFDYPLKLQTLS

SEQ ID NO: 8314 - protein, 112 aa, Homo sapiens
  SITE (17): Xaa equals any amino acid
  SITE (57): Xaa equals any amino acid
  SITE (90): Xaa equals any amino acid
  SITE (91): Xaa equals any amino acid
MAPWLPLLSLLGLLLGXAPAPPRRAADAQAREAAYPELLGPARFALEMYNRGRAAGXRATLGAVRGRVRRAGEGSLYSLRATLEEPPCNXXTVCQLPVSKRPCSAALKSWTS

SEQ ID NO: 8315 - protein, 281 aa, Homo sapiens
  SITE (216): Xaa equals any amino acid
  SITE (227): Xaa equals any amino acid
  SITE (268): Xaa equals any amino acid
MGFPQRQPGLSGLLLLVWALAWPLPCMSLELIPYTPQITAWDLEGKVTATTFSLEQPRCVLDGLAGVASTIWLVVAFSNASRDFQNPQTRAEIPAFPRLLTEGHYMTLPLSLDQLPCQDPAGGGRDVPLLRVGNDPGCLADLLQPPYCNSPLPSPGPYRVKFLLMDARGSPQAETRWSDPIALHQGKSPASIDTWPGRRSGGMIVITSILSSLASXLLLAFLAASTXRFSSLWWPEEAPEQLRIGSFMGKRYMTHHIPPSEAATLPVXCEPGLDPLPSLSP

SEQ ID NO: 8316 - protein, 61 aa, Homo sapiens
  SITE (17): Xaa equals any amino acid
MSSLLSAGLQASLCGKXLWASTWYLVCCLLPFFHQGCCDHKSKQQYIPNLKSYCGLSTIEI

SEQ ID NO: 8317 - protein, 65 aa, Homo sapiens
MASPSIILLLIFFFFFFFSVCSVSQYMFENECESMSRRRGRGLGRSRLKVEQGPDADLHPRTLGS

SEQ ID NO: 8318 - protein, 90 aa, Homo sapiens
MDYGGLQSLLWTLTLASSPVLFPMALGDPPGQKGSGVWHPLMPASSSAMCAASGTMWPRSYFRAQIWAPQKRQSGPGRKPASTAPCGRSM

SEQ ID NO: 8319 - protein, 117 aa, Homo sapiens
MQRIASLLTLLTQLTLAAGSTPAETISDSAEASLSATPSLVTWTQVSGLQPLVEPCLRQTLKLLSRPEMWRAVGPVPVACLLFLGAYYQAWSQQPSSCPEDWLQDMERLSESCCCHC

SEQ ID NO: 8320 - protein, 285 aa, Homo sapiens
MPLLFFSVSTLFSGSVTLQQRGMFLPWTGTGEQVLALLWPRFELILEMNVQSVRSTDPQRLGGLDTRPHYITRRYAEFSSALVSINQTIPNERTMQLLGQLQVEVENFVLRVAAEFSSRKEQLVFLINNYDMMLGVLMERAADDSKEVESFQQLLNARTQEFIEELLSPPFGGLVAFVKEAEALIERGQAERLRGEEARVTQLIRGFGSSWKSSVESLSQDVMRSFTNFRNGTSIIQGALTQLIQLYHRFHRVLSQPQLRALPARAELINIHHLMVELKKHKPNF

SEQ ID NO: 8321 - protein, 182 aa, Homo sapiens
MAKRSRGPGRRCLLALVLFCAWGTLAVVAQKPGAGCPSRCLCFRTTVRCMHLLLEAVPAVAPQTSILDLRFNRIREIQPGAFRRLRNLNTLLLNNNQIKRIPSGAFEDLENLKYLYLHFNQIETLDPDSFQHLPKLERLFLHNNRITHLVPGTFNHLESMKRLRLDSNTLHCDCEILWLRIC

SEQ ID NO: 8322 - protein, 794 aa, Homo sapiens
MLAGCFLLILGQIVLLPAEARERSRGRSISRGRHARTHPQTALLESSCENKRADLVFIIDSSRSVNTHDYAKVKEFIVDILQFLDIGPDVTRVGLLQYGSTVKNEFSLKTFKRKSEVERAVKRMRHLSTGTMTGLAIQYALNIAFSEAEGARPLRENVPRVIMIVTDGRPQDSVAEVAAKARDTGILIFAIGVGQVDFNTLKSIGSEPHEDHVFLVANFSQIETLTSVFQKKLCTAHMCSTLEHNCAHFCINIPGSYVCRCKQGYILNSDQTTCRIQDLCAMEDHNCEQLCVNVPGSFVCQCYSGYALAEDGKRCVAVDYCASENHGCEHECVNADGSYLCQCHEGFALNPDEKTCTKIDYCASSNHGCQHECVNTDDSYSCHCLKGFTLNPDKKTCRRINYCALNKPGCEHECVNMEESYYCRCHRGYTLDPNGKTCSRVDHCAQQDHGCEQLCLNTEDSFVCQCSEGFLINEDLKTCSRVDYCLLSDHGCEYSCVNMDRSFACQCPEGHVLRSDGKTCAKLDSCALGDHGCEHSCVSSEDSFVCQCFEGYILREDGKTCRRKDVCQAIDHGCEHICVNSDDSYTCECLEGFRLAEDGKRCRRKDVCKSTHHGCEHICVNNGNSYICKCSEGFVLAEDGRRCKKCTEGPIDLVFVIDGSKSLGEENFEVVKQFVTGIIDSLTISPKAARVGLLQYSTQVHTEFTLRNFNSAKDMKKAVAHMKYMGKGSMTGLALKHMFERSFTQGEGARPLSTRVPRAAIVFTDGRAQDDVSEWASKARPWYHYVCCWGRKSH

SEQ ID NO: 8323 - protein, 716 aa, Homo sapiens
MNNFRATILFWAAAAWAKSGKPSGEMDEVGVQKCKNALKLPVLEVLPGGGWDNLRNVDMGRVMELTYSNCRTTEDGQYIIPDEIFTIPQKQSNLEMNSEILESWANYQSSTSYSINTELSLFSKVNGKFSTEFQRMKTLQVKDQAITTRVQVRNLVYTVKINPTLELSSGFRKELLDISDRLENNQTRMATYLAELLVLNYGTHVTTSVDAGAALIQEDHLRASFLQDSQSSRSAVTASAGLAFQNTVNFKFEENYTSQNVLTKSYLSNRTNSRVQSIGGVPFYPGITLQAWQQGITNHLVAIDRSGLPLHFFINPNMLPDLPGPLVKKVSKTVETAVKRYYTFNTYPGCTDLNSPNFNFQANTDDGSCEGKMTNFSFGGVYQECTQLSGNRDVLLCQKLEQKNPLTGDFSCPSGYSPVHLLSQIHEEGYNHLECHRKCTLLVFCKTVCEDVFQVAKAEFRAFWCVASSQVPENSGLLFGGLFSSKSINPMTNAQSCPAGYFPLRLFENLKVCVSQDYELGSRFAVPFGGFFSCTVGNPLVDPAISRDLGAPSLKKCPGGFSQHPALISDGCQVSYCVKSGLFTGGSLPPARLPPFTRPPLMSQAATNTVIVTNSENARSWIKDSQTHQWRLGEPIELRRAMNVIHGDGGGLSGGAAAGVTVGVTTILAVVITLAIYGTRKFKKKAYQAIEERQSLVPGTAATGDTTYQEQGQSPA

SEQ ID NO: 8324 - protein, 39 aa, Homo sapiens
MHLLPWRAAAAPPLLIAVPPRPSRSPVQPPSLGAANPSA

SEQ ID NO: 8325 - protein, 85 aa, Homo sapiens
MAHGPQSLWSLGFTVTLTFELPVGCVLGRICHPIQACNTGLMTPTPQGPCRTEMMSNDKPWLPANAPAHISLPGARLTSTCAPGL

SEQ ID NO: 8326 - protein, 1189 aa, Homo sapiens
MDLPRGLVVAWALSLWPGFTDTFNMDTRKPRVIPGSRTAFFGYTVQQHDISGNKWLVVGAPLETNGYQKTGDVYKCPVIHGNCTKLNLGRVTLSNVSERKDNMRLGLSLATNPKDNSFLACSPLWSHECGSSYYTTGMCSRVNSNFRFSKTVAPALQRCQTYMDIVIVLDGSNSIYPWVEVQHFLINILKKFYIGPGQIQVGVVQYGEDVVHEFHLNDYRSVKDVVEAASHIEQRGGTETRTAFGIEFARSEAFQKGGRKGAKKVMIVITDGESHDSPDLEKVIQQSERDNVTRYAVAVLGYYNRRGINPETFLNEIKYIASDPDDKHFFNVTDEAALKDIVDALGDRIFSLEGTNKNETSFGLEMSQTGFSSHVVEDGVLLGAVGAYDWNGAVLKETSAGKVIPLRESYLKEFPEELKNHGAYLGYTVTSVVSSRQGRVYVAGAPRFNHTGKVILFTMHNNRSLTIHQAMRGQQIGSYFGSEITSVDIDGDGVTDVLLVGAPMYFNEGRERGKVYVYELRQNRFVYNGTLKDSHSYQNARFGSSIASVRDLNQDSYNDVVVGAPLEDNHAGAIYIFHGFRGSILKTPKQRITASELATGLQYFGCSIHGQLDLNEDGLIDLAVGALGNAVILWSRPVVQINASLHFEPSKINIFHRDCKRSGRDATCLAAFLCFTPIFLAPHFQTTTVGIRYNATMDERRYTPRAHLDEGGDRFTNRAVLLSSGQELCERINFHVLDTADYVKPVTFSVEYSLEDPDHGPMLDDGWPTTLRVSVPFWNGCNEDEHCVPDLVLDARSDLPTAMEYCQRVLRKPAQDCSAYTLSFDTTVFIIESTRQRVAVEATLENRGENAYSTVLNISQSANLQFASLIQKEDSDGSIECVNEERRLQKQVCNVSYPFFRAKAKVAFRLDFEFSKSIFLHHLEIELAAGSDSNERDSTKEDNVAPLRFHLKYEADVLFTRSSSLSHYEVKLNSSLERYDGIGPPFSCIFRIQNLGLFPIHGIMMKITIPIATRSGNRLLKLRDFLTDEVANTSCNIWGNSTEYRPTPVEEDLRRAPQLNHSNSDVVSINCNIRLVPNQEINFHLLGNLWLRSLKALKYKSMKIMVNAALQRQFHSPFIFREEDPSRQIVFEISKQEDWQVPIWIIVGSTLGGLLLLALLVLALWKLGFFRSARRRREPGLDPTPKVLE

SEQ ID NO: 8327 - protein, 47 aa, Homo sapiens
MQCFLFSIFLITGLAEEFCEQLSISLAEEEIQLSSTVEHFCMTAFSW

SEQ ID NO: 8328 - protein, 52 aa, Homo sapiens
MGPNFVVLCLNLLQDTLAYATALLNEKEQSGSSNGSESSPANENGDRHLQQV

SEQ ID NO: 8329 - protein, 80 aa, Homo sapiens
  SITE (25): Xaa equals any amino acid
MGTSTAWRVPWRRWARVRCWWLWPXTGTAEPPGTAGWQGLAGGRCREAWGSLLMGMFGLCFLPVHSQSCLSSSSSPTPRP

SEQ ID NO: 8330 - protein, 102 aa, Homo sapiens [sequence omitted]

SEQ ID NO: 8331 - protein, 780 aa, Homo sapiens
MLSSLGCLLLCGSITLALGNAQKLPKGKRPNLKVHINTTSDSILLKFLRPSPNVKLEGLLLGYGSNVSPNQYFPLPAEGKFTEAIVDAEPKYLIVVRPAPPPSQKKSCSGKTRSRKPLQLVVGTLTPSSVFLSWGFLINPHHDWTLPSHCPNDRFYTIRYREKDKEKKWIFQICPATETIVENLKPNTVYEFGVKDNVEGGIWSKIFNHKTVVGSKKVNGKIQSTYDQDHTVPAYVPRKLIPITIIKQVIQNVTHKDSAKSPEKAPLGGVILVHLIIPGLNETTVKLPASLMFEISDALKTQLAKNETLALPAESKTPEVEKISARPTTVTPETVPRSTKPTTSSALDVSETTLVLSKRTPETLQTILIPQFELPLSTLAPKSLPEFPEAKTPFPFEKPRGTLASSEKPWIVPTAKISEDSKVLQPQTATYDVFSSPTTSDEPEISDSYTATSDRILDSIPPKTSRTLEQPRATLAPSETPFVPQKLEIFTSPEMQPTTPAPQQTTSIPSTPKRRPRPKPPRTKPERTTSAGTITPKISKSPEPTWTTPAPGKTQFISLKPKIPLSPEVTHTKPAPKQTPRAPPKPKTSPRPRIPQTQPVPKVPQRVTAKPKTSPSPEVSYTTPAPKDVLLPHKPYPEVSQSEPAPLETRGIPFIPMISPSPSQEELQTTLEETDQSTQEPFTTKIPRTTELAKTTQAPHRFYTTVRPRTSDKPHIRPVLNRTTTRPTRPKPSGMPSGNGVGTGVKQAPRPSGADRNVSVDSTHPTKKPGTRRPPLPPSR

SEQ ID NO: 8332 - protein, 211 aa, Homo sapiens
MRLFLWNAVLTLFVTSLIGALIPEPEVKIEVLQKPFICHRKTKGGDLMLVHYEGYLEKDGSLFHSTHKHNNGQPIWFTLGILEALKGWDQGLKGMCVGEKRKLIIPPALGYGKEGKGKIPPESTLIFNIDLLEIRNGPRSHESFQEMDLNDDWKLSKDEVKAYLKKEFEKHGAVVNESHHDALVEDIFDKEDEDKDGFISAREFTYKHDEL

SEQ ID NO: 8333 - protein, 34 aa, Homo sapiens
MSGLESARVLLCALGSFLLNSLLSTFRLNSSAPS

SEQ ID NO: 8334 - protein, 219 aa, Homo sapiens [sequence omitted]

SEQ ID NO: 8335 - protein, 54 aa, Homo sapiens
MFRALRDLLTHYPQQILLQVLVVMYQVLQVWELPWPELIHLQGIVPTDQLHLKQ

SEQ ID NO: 8336 - protein, 32 aa, Homo sapiens
MRNKESLCKVVLKALYANLLICVSASAILVQC

SEQ ID NO: 8337 - protein, 28 aa, Homo sapiens
MHSIIVKELIVTFFLGITVLLLLMQRSL

SEQ ID NO: 8338 - protein, 50 aa, Homo sapiens [sequence omitted]

SEQ ID NO: 8339 - protein, 92 aa, Homo sapiens
MLLYLYSLGISVLIISFPTNSSIHVRKNMANQYLKGAIFQSSGFQSVAGQHWQHLNLLGTLLKMQILSPTLVLLNWETGVGPSSLCFNMFSK

SEQ ID NO: 8340 - protein, 59 aa, Homo sapiens
MSYPLFLFMSCMVISLSPNAGSQTSTVRCLSDLVTFTLIKGSPVHQTPYLESSINCITF

SEQ ID NO: 8341 - protein, 54 aa, Homo sapiens
MRRCVRHVLGIGLIVLKNLYFHKNSMYPSPKLSSFQEAFLFFFLILKNPLTLCS

SEQ ID NO: 8342 - protein, 178 aa, Homo sapiens [sequence omitted]

SEQ ID NO: 8343 - protein, 289 aa, Homo sapiens
MSGFSTEERAAPFSLEYRVFLKNEKGQYISPFHDIPIYADKDVFHMVVEVPRWSNAKMEIATKDPLNPIKQDVKKGKLRYVANLFPYKGYIWNYGAIPQTWEDPGHNDKHTGCCGDNDPIDVCEIGSKVCARGEIIGVKVLGILAMIDEGETDWKVIAINVDDPDAANYNDINDVKRLKPGYLEATVDWFRRYKVPDGKPENEFAFNAEFKDKDFAIDIIKSTHDHWKALVTKKTNGKGISCMNTTLSESPFKCDPDAARAIVDALPPPCESACTVPTDVDKWFHHQKN

SEQ ID NO: 8344 - protein, 61 aa, Homo sapiens [sequence omitted]

SEQ ID NO: 8345 - protein, 223 aa, Homo sapiens
  SITE (203): Xaa equals any amino acid
  SITE (221): Xaa equals any amino acid
  SITE (223): Xaa equals any amino acid
MLTRKETEHVSALILRAFLLTIPENAEGHIILGKSLIVPLKGQRVIDSTVLPGILIEMSEVQLMRLLPIKKSTALKVALFCTTLSGDTSDTGEGTVVVSYGVSLENAVLDQLLNLGRQLISDHVDLVLCQKVIHPSLKQFLNMHRIIAIDRIGVTLMEPLTKMTGTQPIGSLGSICPNSYGSVKDVCTAKFGSKHFFHLIPNXATICSLLLCNRNEGVSRXLX

SEQ ID NO: 8346 - protein, 46 aa, Homo sapiens
MKFIVWRRFKWVIIGLLFLLILLLFVAVLLYSLPNYLSMKIVKPNV

SEQ ID NO: 8347 - protein, 338 aa, Homo sapiens [sequence omitted]

SEQ ID NO: 8348 - protein, 48 aa, Homo sapiens [sequence omitted]

SEQ ID NO: 8349 - protein, 39 aa, Homo sapiens [sequence omitted]

SEQ ID NO: 8350 - protein, 19 aa, Homo sapiens
MVSILYLGLFFLNSSVLYA

SEQ ID NO: 8351 - protein, 123 aa, Homo sapiens [sequence omitted]

SEQ ID NO: 8352 - protein, 112 aa, Homo sapiens
MAYLTLFQMGSWMSFSLSLCSLLFILTGHCLSENFYVRGDGTRAYFFTKGEVHSMFCKASLDEKQNLVDRRLQVNRKKQVKMHRVWIQGKFQKPLHQTQNSSNMVSTLLSQD

SEQ ID NO: 8353 - protein, 49 aa, Homo sapiens
IHPSRSTLSSQLVTLPLFELVFPIPSSQSPFSLNYLSEFPLPEHEPCLE

SEQ ID NO: 8354 - protein, 50 aa, Homo sapiens
MISDAGAGFGVFLLVPRAGHCWGAGKPLPSCPSVASIPSWVLPSFLERGR

SEQ ID NO: 8355 - protein, 46 aa, Homo sapiens
MRYWTDMRRNYRVTYQVVLLFLCFSLLTECKTFEPRSERSLFSYPL

SEQ ID NO: 8356 - protein, 64 aa, Homo sapiens
MTGTCHHSLFSFLIFSFFLAIGSPFVAQVGLELLGSNDPLASASQSVRITGMSYCAWPKSYSYH

SEQ ID NO: 8357 - protein, 36 aa, Homo sapiens
MLDPAASGTFRALLLLSHPFLDWSLSDPHCESLNQK

SEQ ID NO: 8358 - protein, 442 aa, Homo sapiens
MASVVLPSGSQCAAAAAAAAPPGLRLRLLLLLFSAAALIPTGDGQNLFTKDVTVIEGEVATISCQVNKSDDSVIQLLNPNRQTIYFRDFRPLKDSRFQLLNFSSSELKVSLTNVSISDEGRYFCQLYTDPPQESYTTITVLVPPRNLMIDIQKDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLTREGDALELTCEAIGKPQPVMVTWVRVDDEMPQHAVLSGPNLFINNLNKTDNGTYRCEASNIVGKAHSDYMLYVYDPPTTIPPPTTTTTTTTTTTTTILTIITDSRAGEEGSIRAVDHAVIGGVVAVVVFAMLCLLIILGRYFARHKGTYFTHEAKGADDAADADTAIINAEGGQNNSEEKKEYFI

SEQ ID NO: 8359 - protein, 42 aa, Homo sapiens
MVQTIQDFLSLFSTPIFLLLLMFETLSLAPAWLKPLRVTSHS

SEQ ID NO: 8360 - protein, 587 aa, Homo sapiens; identical to SEQ ID NO: 7145

SEQ ID NO: 8361 - protein, 62 aa, Homo sapiens
MGKLTLTLLLCLLQLLPPEVYYSRWGANMMAQTPLNSMRSPWPMEILLFFPLFSSSVFIGSA

SEQ ID NO: 8362 - protein, 385 aa, Homo sapiens
MWGFRLLRSPPLLLLLPQLGIGNASSCSQARTMNPGGSGGARCSLSAEVRRRQCLQLSTVPGADPQRSNELLLLAAAGEGLERQDLPGDPAKEEPQPPPQHHVLYFPGDVQNYHEIMTRHPENYQWENWSLENVATILAHRFPNSYIWVIKCSRMHLHKFSCYDNFVKSNMFGAPEHNTDFGAFKHLYMLLVNAFNLSQNSLSKKSLNVWNKDSIASNCRSSPSHTTNGCQGEKVRTCEKSDESAMSFYPPSLNDASFTLIGFSKGCVVLNQLLFELKEAKKDKNIDAFIKSIRTMYWLDGGHSGGSNTWVTYPEVLKEFAQTGIIVHTHVTPYQVRDPMRSWIGKEHKKFVQILGDLGMQVTSQIHFTKEAPSIENHFRVHEVF

SEQ ID NO: 8363 - protein, 360 aa, Homo sapiens
MVPAAGRRPPRVMRLLGWWQVLLWVLGLPVRGVEVAEESGRLWSEEQPAHPLQVGAVYLGEEELLHDPMGQDRAAEEANAVLGLDTQGDHMVMLSVIPGEAEDKVSSEPSGVTCGAGGAEDSRCNVRESLFSLDGAGAHFPDREEEYYTEPEVAESDAAPTEDSNNTESLKSPKVNCEERNITGLENFTLKILNMSQDLMDFLNPNGSDCTLVLFYTPWCRFSASLAPHFNSLPRAFPALHFLALDASQHSSLSTRFGTVAVPNILLFQGAKPMARFNHTDRTLETLKIFIFNQTGIEAKKNVVVTQADQIGPLPSTLIKSVDWLLVFSLFFLISFIMYATIRTESIRWLIPGQEQEHVE

SEQ ID NO: 8364 - protein, 43 aa, Homo sapiens
MCRTQFHLFWFIVTELSPVIWAKANQKLSCLSQQTLVLVYFCR

SEQ ID NO: 8365 - protein, 70 aa, Homo sapiens
MRLASSLSVFPLLPLTCGHSLALLPSSIGQHSETFTRCRPLTFPVFRTINQVNPYKSPSLWYSVIATQTD

SEQ ID NO: 8366 - protein, 50 aa, Homo sapiens [sequence omitted]

SEQ ID NO: 8367 - protein, 61 aa, Homo sapiens
MASLLDNFILNIIVIFCIVIDSYLCGFMYFFVIDSPVPACSPLQLSQTLILQLQPTARYFH

SEQ ID NO: 8368 - protein, 205 aa, Homo sapiens [sequence omitted]

SEQ ID NO: 8369 - protein, 410 aa, Homo sapiens
  SITE (78): Xaa equals any amino acid
  SITE (168): Xaa equals any amino acid
MNPAVRQRCLLFCFQQKLILSHFFLLQVPQWCAEYCLSIHYQHGGVICTQVHKQTVVQLALRVADEMDVNIGHEVGYXIPFENCCTNETILRYCTDDMLQREMMSNPFLGSYGVIILDDIHERSIATDVLLGLLKDVLLARPELKLIINSSPHLISKLNSYYGNVPVXEVKNKHPVEVVYLSEAQKDSFESILRLIFEIHHSGEKGDIVVFLACEQDIEKVCETVYQGSNLNPDLGELVVVPLYPKEKCSLFKPLDETEKRCQVYQRRVVLTTSSGEFLIWSNSVRFVIDVGVERRKVYNPRIRANSLVMQPISQSQAEIRKQILGSSSSGKFFCLYTEEFASKDMTPLKPAEMQEANLTSMVLFMKRIDIAGLGHCDFMNRPGSLMLPCQPGIRLRFTFSCPFSVLSSH

SEQ ID NO: 8370 - protein, 99 aa, Homo sapiens [sequence omitted]

SEQ ID NO: 8371 - protein, 84 aa, Homo sapiens
MGHGRRLGRHLLALPVTLSERCLGSPVENETHSRDGTELPDGSREPSSPRRVSESRVTPARTEEPPAEPSLTPDLRLDNSRGSL

SEQ ID NO: 8372 - protein, 167 aa, Homo sapiens
MIGPHGYISASDWPLMIFYMVMCIVYILYGILWLTWSACYWKDILRIQFWIAAVIFLGMLEKAVFYSEYQNISNTGLSTQGLLIFAELISAIKRTLARLLVIIVSLGYGIVKPRLGTVMHRVIGLGLLYLIFAAVEGVMRVIGGSNHLAVVLDDIILAVIDSIFVWF

SEQ ID NO: 8373 - protein, 265 aa, Homo sapiens
MFLLFLLTCELAAEVAAEVEKSSDGPGAAQEPTWLTDVPAAMEFIAATEVAVIGFFQDLEIPAVPILHSMVQKFPGVSFGISTDSEVLTHYNITGNTICLFRLVDNEQLNLEDEDIESIDATKLSRFIEINSLHMVTEYNPVTVIGLFNSVIQIHLLLIMNKASPEYEENMHRYQKAAKLFQGKILFILVDSGMKENGKVISFFKLKESQLPALAIYQTLDDEWDTLPTAEVSVEHVQNFCDGFLSGKLLKENRESEGKTPKVEL

SEQ ID NO: 8374 - protein, 62 aa, Homo sapiens
MLGLQPQGLGWPALLLLILKTFKVGGWQGMCLINQFQASKKKKKKKKKKKKKKKKKKKKKKK

SEQ ID NO: 8375 - protein, 320 aa, Homo sapiens
  SITE (120): Xaa equals any amino acid
  SITE (292): Xaa equals any amino acid
MPSEYTYVKLRSDCSRPSLQWYTRAQSKMRRPSLLLKDILKCTLLVFGVWILYILKLNYTTEECDMKKMHYVDPDHVKRAQKYAQQVLQKECRPKFAKTSMALLFEHRYSVDLLPFVQKXPKDSEAESKYDPPFGFRKFSSKVQTLLELLPEHDLPEHLKAKTCRRCVVIGSGGILHGLELGHTLNQFDVVIRLNSAPVEGYSEHVGNKTTIRMTYPEGAPLSDLEYYSNDLFVAVLFKSVDFNWLQAMVKKETLPFWVRLFFWKQVAEKIPLQPKHFRILNPVIIKETAFXHPSVLRASVKVLGAEIRTSPQSVSLPLS

SEQ ID NO: 8376 - protein, 95 aa, Homo sapiens
  SITE (49): Xaa equals any amino acid
  SITE (69): Xaa equals any amino acid
MRRNLIDAGWTYHNRLWTYLPPACAFSVFLLLFDTVLYETLLSFDLVFXFCFFRGEGGFPLLCPDFSLXTNALALWLEHPLPTSVSPHLSYALTC

SEQ ID NO: 8377 - protein, 41 aa, Homo sapiens
  SITE (12): Xaa equals any amino acid
MALAFLHLNISXSQALTLCKELEKPKLEKNKGGPALEKLVV

SEQ ID NO: 8378 - protein, 52 aa, Homo sapiens
MSGTTWTAIHLTSNLFGILALPGNQSSGSNIEQLCTSSREATNRLPCVDVGS

SEQ ID NO: 8379 - protein, 37 aa, Homo sapiens
MFGQGLLVLLGFWVEGARRGWSPPIFLFPVHVTLFYR

SEQ ID NO: 8380 - protein, 38 aa, Homo sapiens
  SITE (33): Xaa equals any amino acid
MPSFFLSLIQTNTLGSASFLLFLTLHIHLSPNXVHSAS

SEQ ID NO: 8381 - protein, 41 aa, Homo sapiens
MEDHFLIGHFPFFFLFSFPCFCTKPLCREYFLICSIQDESK

SEQ ID NO: 8382 - protein, 152 aa, Homo sapiens [sequence omitted]

SEQ ID NO: 8383 - protein, 29 aa, Homo sapiens [sequence omitted]

SEQ ID NO: 8384 - protein, 36 aa, Homo sapiens
MRALPSGCLPTLCSCGLSLVHGHGGEIVQTLWCLFL

SEQ ID NO: 8385 - protein, 97 aa, Homo sapiens
MSIMLLTFTLHFPSTLLSYLPENYVIPSLFSNLQHWICCVHSQLVTCFVFQRDNVSTEKRTLAHSNTSSATSHHLSPCTTGDGLPSSWGGQTHPLLH

SEQ ID NO: 8386 - protein, 40 aa, Homo sapiens
MCIFECMCHFFIDISNHYYVVRFYPEDSLPKTFIYDPFKA

SEQ ID NO: 8387 - protein, 83 aa, Homo sapiens
MWYFMSLISMVLLLSPSCSDLLVISVLNLEQRRQSKVGFEPFTSPLCGDGTICHLTGYHKTEHFKNYCCAPKIIFSKCHFTPS

SEQ ID NO: 8388 - protein, 15 aa, Homo sapiens
MSLALCLVPLVREGH

SEQ ID NO: 8389 - protein, 50 aa, Homo sapiens
MSITSNTYFFLLGAFKILSSSYWKIHTKLLLTIVPLQCCGMPQLIPPLQL

SEQ ID NO: 8390 - protein, 45 aa, Homo sapiens
MQLAPFISIPVLSGTTPWTAVFRASSICTPLLTLSAAGMLVESSL

SEQ ID NO: 8391 - protein, 28 aa, Homo sapiens
MPPLSDILLTVAVVAFEMTGHIYIWPHT

SEQ ID NO: 8392 - protein, 28 aa, Homo sapiens
MFFIFFMLSIQALFHGQQVIFHNVDFPK

SEQ ID NO: 8393 - protein, 74 aa, Homo sapiens [sequence omitted]

SEQ ID NO: 8394 - protein, 41 aa, Homo sapiens
MRGKFPHDLLCFLIKLLCPTIAGSAYGCCNVGSAVSCSYHF

SEQ ID NO: 8395 - protein, 8 aa, Homo sapiens
LLLFCILG

SEQ ID NO: 8396 - protein, 47 aa, Homo sapiens
MFMYVWCPLVLFFFLLVFELVLNRILSGFLKYFHFHHGYNKFAACPN

SEQ ID NO: 8397 - protein, 50 aa, Homo sapiens
  SITE (12): Xaa equals any amino acid
  SITE (15): Xaa equals any amino acid
  SITE (16): Xaa equals any amino acid
  SITE (19): Xaa equals any amino acid
MGVLFVPQETSXKVXXDIXGLSQFVMGEKRTTSIRGIQARYQVDRGLEYC

SEQ ID NO: 8398 - protein, 47 aa, Homo sapiens
MGNCHDHRGLEFCFFFFFFFFGGLGDSSQDHILASFSPTPFRKISNR

SEQ ID NO: 8399 - protein, 24 aa, Homo sapiens
MPWRRAGLMMLPIITGCCPCSASI

SEQ ID NO: 8400 - protein, 501 aa, Homo sapiens
MWKLWRAEEGAAALGGALFLLLFALGVRQLLKQRRPMGFPPGPPGLPFIGNIYSLAASSELPHVYMRKQSQVYGEIFSLDLGGISTVVLNGYDVVKECLVHQSEIFADRPCLPLFMKMTKMGGLLNSRYGRGWVDHRRLAVNSFRYFGYGQKSFESKILEETKFFNDAIETYKGRPFDFKQLITNAVSNITNLIIFGERFTYEDTDFQHMIELFSENVELAASASVFLYNAFPWIGILPFGKHQQLFRNAAVVYDFLSRLIEKASVNRKPQLPQHFVDAYLDEMDQGKNDPSSTFSKENLIFSVGELIIAGTETTTNVLRWAILFMALYPNIQGQVQKEIDLIMGPNGKPSWDDKCKMPYTEAVLHEVLRFCNIVPLGIFHATSEDAVVRGYSIPKGTTVITNLYSVHFDEKYWRDPEVFHPERFLDSSGYFAKKEALVPFSLGRRHCLGEHLARMEMFLFFTALLQRFHLHFPHELVPDLKPRLGMTLQPQPYLICAERR

SEQ ID NO: 8401 - protein, 305 aa, Homo sapiens
  SITE (180): Xaa equals any amino acid
  SITE (197): Xaa equals any amino acid
MSEDRPMLQFLLHTSFLSPLFILWLWTKPIARDFLHQPPFGETRFSLLSDSAFDSGRLWLLVVLCLLRLAVTRPHLQAYLCLAKARVEQLRREAGRIEAREIQQRVVRVYCYVTVVSLQYLTPLILTLNCTLLLKTLGGYSWGLGPAPLLSPRPILSQRCPHRLWGGRSPADCSADCRGXGWPAYSPLPPWRPGLPXLVDGCLPAARQPFRPLLPPALGRLLAACRPSWGPEVCSWGSGTLACPLCLRPRVPSCKVGPDSPAFPSPQCLTRGPPWTPSFCLRTVSPGPSSMRVPRPLSPKRMCQV

SEQ ID NO: 8402 - protein, 95 aa, Homo sapiens
MKAPHTGVLHLGSVWVFLGPFLLGVGYTLTFNPLSGCMSTVRWLNSNITANRTLSRSVCHVTPLHRSLSPHDGEYLRQMLLNSSSRAGEAGSWGY

SEQ ID NO: 8403 - protein, 709 aa, Homo sapiens
  SITE (189): Xaa equals any amino acid
  SITE (275): Xaa equals any amino acid
  SITE (414): Xaa equals any amino acid
  SITE (438): Xaa equals any amino acid
  SITE (641): Xaa equals any amino acid
  SITE (643): Xaa equals any amino acid
  SITE (696): Xaa equals any amino acid
  SITE (697): Xaa equals any amino acid
MAGLNCGVSIALLGVLLLGAARLPRGAEAFEIALPRESNITVLIKLGTPTLLAKPCYIVISKRHITMLSIKSGERIVFTFSCQSPENHFVIEIQKNIDCMSGPCPFGEVQLQPSTSLLPTLNRTFIWDVKAHKSIGLELQFSIPRLRQIGPGESCPDGVTHSISGRIDATVVRIGTFCSNGTVSRIKMXEGVKMALHLPWFHPRNVSGFSIANRSSIKRLCIIESVFEGEGSATLMSANYPEGFPEDELMTWQFVVPAHLRASVSFLNFNLSNCXRKEERVEYYIPGSTTNPEVFKLEDKQPGNMAGNFNLSLQGCDQDAQSPGILRLQFQVLVQHPQNESNKIYVVDLSNERAMSLTIEPRPVKQSRKFVPGCFVCLESRTCSSNLTLTSGSKHKISFLCDDLTRLWMNVEKXISCTDHRYCQRKSYSLQVPSDILXLPVELHDFSWKLLVPKDRLSLVLVPAQKLQQHTHEKPCNTSFSYLVASAIPSQDLYFGSFCPGGSIKQIQVKQNISVTLRTFAPSFRQEASRQGLTVSFIPYFKEEGVFTVTPDTKSKVYLRTPNWDRGLPSLTSVSWNISVPRDQVACLTFFKERSGVVCQTGRAFMIIQEQRTRAEEIFSLDEDVLPKPSFHHHSFWVNIXNXSPTSGKQLDLLFSVTLTPRTVDLTVILIAAVGGGVLLLSALGLIICCVKKKKXXTRGPAVGIYNGN

SEQ ID NO: 8404 - protein, 50 aa, Homo sapiens [sequence omitted]

SEQ ID NO: 8405 - protein, 60 aa, Homo sapiens
MNESFYCSAFLPAFIVCWILAILIVLTCGFRMTDYIEHLHEILCHLYIFFGKASISGLST

SEQ ID NO: 8406 - protein, 139 aa, Homo sapiens
MALRMLWAGQAKGILGGWGIICLVMSLLLQHPGVYSKCYFQAQAPCHYEGKYFTLGESWLRKDCFHCTCLHPVGVGCCDTSQHPIDFPAGCEVRQEAGTCQFSLVQKSDPRLPCKGGGPDPEWGSANTPVPGAPAPHSS

SEQ ID NO: 8407 - protein, 96 aa, Homo sapiens
MRACVCVYACAHMCVCLAFSYLIGCIKCRPKDEGEDLHPKPGCDSFCPEKLCLGSELLTTFMQYICKQGAESFITGATQQKGKTVMWRAGDLTREA

SEQ ID NO: 8408 - protein, 56 aa, Homo sapiens
MRWLFVLMLSLPLPPTPRQGPACDVPLPVSHVFSLFNSHLGARTCGVWFSLPVSVC

SEQ ID NO: 8409 - protein, 133 aa, Homo sapiens
MWHTKPLGSGSCVPLLPLLLLLLLLFPLLPWPPPLPPPPPSSLHPFAPAFPATGSLSSNNSQLLAPLRLQNALHLFKCFPVLFPLHKIISFHPEYPWQAPIFQYFYLSIPSSSLHPEHLGHSFVSTLHSPTRQ

SEQ ID NO: 8410 - protein, 33 aa, Homo sapiens
MAAAWFILLFKHCVHSSSIVDLSFKESSPWDIK

SEQ ID NO: 8411 - protein, 240 aa, Homo sapiens; identical to SEQ ID NO: 7697

SEQ ID NO: 8412 - protein, 80 aa, Homo sapiens
MGWIDLLLPELGALRVFLHLFLVALRTKRWIFRTLGQLTCVNILGDSRKKRECRLNKRQLQFGEKTLQVPERLVVRHSPF

SEQ ID NO: 8413 - protein, 136 aa, Homo sapiens
EFGTRKEEERVAMVPRLAFILFVLARDYNVTSLGQDLNWKYEAKDYRKTGELKNIGECGRSYKFLSRNQDWNTRYSHPNRPAKYSGIDEMCKAQESGLSPSKQLNRLSTLTALKVSQPVKLALFSRSPRREIRVGR

SEQ ID NO: 8414 - protein, 111 aa, Homo sapiens
MHHHAHLSCYDFLMLLFLLLHPLLPPPPTASLPPSPLICLFLHTVPWNLSLASSHSTHSLRALPFTSAIVYTFTLDHSSEISQLLHPDGCSAPPPGCPTGTLNPTSPKLNS

SEQ ID NO: 8415 - protein, 94 aa, Homo sapiens [sequence omitted]

SEQ ID NO: 8416 - protein, 116 aa, Homo sapiens
  SITE (95): Xaa equals any amino acid
  SITE (112): Xaa equals any amino acid
MLVAWCLAPGDLLLLVIITLPRKEVTGSMSTVCQCEAQPAMLPKGHFTHHSPKAARKAQEGTRKARWVALEDSAPFHPSPGWGLILQLHPQPMNXSQSAWKHCCWKNCEEPXEGKK

SEQ ID NO: 8417 - protein, 127 aa, Homo sapiens
  SITE (85): Xaa equals any amino acid
  SITE (88): Xaa equals any amino acid
  SITE (95): Xaa equals any amino acid
  SITE (107): Xaa equals any amino acid
  SITE (123): Xaa equals any amino acid
MKREGRCVLHMHPSSPPSRLSFFLFLRQSLALLPRLECSGVILAQRNLRLLGSRDSPASASCCPPSSLSRRWRWREVPEGLWGLXWVXLCSLSAXWTALKGSSPPFXAKQLGHHRNGINLAEXSLPK

SEQ ID NO: 8418 - protein, 141 aa, Homo sapiens [sequence omitted]

SEQ ID NO: 8419 - protein, 93 aa, Homo sapiens
MIVNISHEIWWFYKGKVPLHMLTCLLPCKTCLAPPSPSSVTVRPPQPCETVSPLKLFFFINYPVLHMSLLTVRKWTNTLGHEGGALINGISAL

SEQ ID NO: 8420 - protein, 100 aa, Homo sapiens
  SITE (62): Xaa equals any amino acid
  SITE (85): Xaa equals any amino acid
  SITE (88): Xaa equals any amino acid
  SITE (95): Xaa equals any amino acid
  SITE (99): Xaa equals any amino acid
MLLQRTRFLLLFFSFVSSFFLSLPSFSLFFLFLSLSLFCIHVAAKDMISSFFSLPFSFLSFXLSFLLPSFSFFYFFFFWLSFFFXSKXLALVPKXGMQXV

SEQ ID NO: 8421 - protein, 462 aa, Homo sapiens
MAKFRRRTCIILALFILFIFSLMMGLKMLRPNTATFGAPFGLDLLPELHQRTIHLGKNFDFQKSDRINSETNTKNLKSVEITMKPSKASELNLDELPPLNNYLHVFYYSWYGNPQFDGKYIHWNHPVLEHWDPRIAKNYPQGRHNPPDDIGSSFYPELGSYSSRDPSVIETHMRQMRSASIGVLALSWYPPDVNDENGEPTDNLVPTILDKAHKYNLKVTFHIEPYSNRDDQNMYKNVKYIIDKYGNHPAFYRYKTKTGNALPMFYVYDSYITKPEKWANLLTTSGSRSIRNSPYDGLFIALLVEEKHKYDILQSGFDGIYTYFATNGFTYGSSHQNWASLKLFCDKYNLIFIPSVGPGYIDTSIRPWNTQNTRNRINGKYYEIGLSAALQTRPSLISITSFNEWHEGTQIEKAVPKRTSNTVYLDYRPHKPGLYLELTRKWSEKYSKERATYALDRQLPVS

SEQ ID NO: 8422 - protein, 42 aa, Homo sapiens
MRVAFILFFFFKLTPSFTPSSISGYRIRDAAVTNGILTCKIV

SEQ ID NO: 8423 - protein, 41 aa, Homo sapiens
MYMKQVVACRDQLILVLWLIELLCIQGFCKSKSDFSSRIYS

SEQ ID NO: 8424 - protein, 86 aa, Homo sapiens
MVLFCFVLFCFVFEMDSSSVTQAGVQWCDLGSLQAPPPGFSPFSCLSLPSSWDYRRPPPRPANFLYFLVETGFHHVSQDGLDLLTS

SEQ ID NO: 8425 - protein, 121 aa, Homo sapiens
MRIMLLFTAILAFSLAQSFGAVCKEPQEEVVPGGGRSKRDPDLYQLLQRLFKSHSSLEGLLKALSQASTDPKESTSPEKRDMHDFFVGLMGKRSVQPDSPTDVNQENVPSFGILKYPPRAE

SEQ ID NO: 8426 - protein, 5 aa, Homo sapiens
MGYLN

SEQ ID NO: 8427 - protein, 31 aa, Homo sapiens
MTLDVQTVVVFAVIVVLLLVNVILMFFLGTR

SEQ ID NO: 8428 - protein, 125 aa, Homo sapiens
MKALMLLTLSVLLCWVSADIRCHSCYKVPVLGCVDRQSCRLEPGQQCLTTHAYLGKMWVFSNLRCGTPEEPCQEAFNQTNRKLGLTYNTTCCNKDNCNSAGPRPTPALGLVFLTSLAGLGLWLLH

SEQ ID NO: 8429 - protein, 62 aa, Homo sapiens [sequence omitted]

SEQ ID NO: 8430 - protein, 262 aa, Homo sapiens
MALGLKCFRMVHPTFRNYLAASIRPVSEVTLKTVHERQHGHRQYMAYSAVPVRHFATKKAKAKGKGQSQTRVNINAALVEDIINLEEVNEEMKSVIEALKDNFNKTLNIRTSPGSLDKIAVVTADGKLALNQISQISMKSPQLILVNMASFPECTAAAIKAIRESGMNLNPEVEGTLIRVPIPQVTREHREMLVKLAKQNTNKAKDSLRKVRTNSMNKLKKSKDTVSEDTIRLIEKQISQMADDTVAELDRHLAVKTKELLG

SEQ ID NO: 8431 - protein, 98 aa, Homo sapiens
  SITE (82): Xaa equals any amino acid
MFGLLVESQTLLEENAVQGTERTLGLNIAPFINQFQVPIRVFLDLSSLPCIPLSKPVELLRLDLMTPYLNTSNREVKVYVCXIWEDLTAIPFWVSYVP

SEQ ID NO: 8432 - protein, 93 aa, Homo sapiens [sequence omitted]

SEQ ID NO: 8433 - protein, 453 aa, Homo sapiens
MRKKWKMGGMKYIFSLLFFLLLEGGKTEQVKHSETYCMFQDKKYRVGERWHPYLEPYGLVYCVNCICSENGNVLCSRVRCPNVHCLSPVHIPHLCCPRCPEDSLPPVNNKVTSKSCEYNGTTYQHGELFVAEGLFQNRQPNQCTQCSCSEGNVYCGLKTCPKLTCAFPVSVPDSCCRVCRGDGELSWEHSDGDIFRQPANREARHSYHRSHYDPPPSRQAGGLSRFPGARSHRGALMDSQQASGTIVQIVINNKHKHGQVCVSNGKTYSHGESWHPNLRAFGIVECVLCTCNVTKQECKKIHCPNRYPCKYPQKIDGKCCKVCPEELPGQSFDNKGYFCGEETMPVYESVFMEDGETTRKIALETERPPQVEVHVWTIRKGILQHFHIEKISKRMFEELPHFKLVTRTTLSQWKIFTEGEAQISQMCSSRVCRTELEDLVKVLYLERSEKGHC

SEQ ID NO: 8434 - protein, 85 aa, Homo sapiens [sequence omitted]

SEQ ID NO: 8435 - protein, 49 aa, Homo sapiens
MGFSIIFRPEAARPEVRLHLSALFVLLLATLGFLLGTMCGCGMCEQKGG

SEQ ID NO: 8436 - protein, 75 aa, Homo sapiens
MAGQEDPVQREIHQDWANREYIEIITSSIKKIADFLNSFDMSCRSRLATLNEKLTALERRIEYIEARVTKGETLT

SEQ ID NO: 8437 - protein, 60 aa, Homo sapiens
MILMPGLGTSRQRSVPFVPTLNASTPGAMTGPTATLTSCQWTTACRVSWANGWTSLRTFR

SEQ ID NO: 8438 - protein, 30 aa, Homo sapiens
MKWCHFLLIVFLSPFIFCLFQGCFFFPISK

SEQ ID NO: 8439 - protein, 42 aa, Homo sapiens
MFYTTLCKMFQYLHILSLSFCFALIWWSESFLWLSNLVRLRH

SEQ ID NO: 8440 - protein, 53 aa, Homo sapiens
MFCFNWLLCFLFPRFPILVCRKHQFCVYLLLVLKLRTLYAELIDLHLCASILG

SEQ ID NO: 8441 - protein, 52 aa, Homo sapiens [sequence omitted]

SEQ ID NO: 8442 - protein, 232 aa, Homo sapiens
MAALAAAAKKVWSARRLLVLLFTPLALLPVVFALPPKEGRCLFVILLMAVYWCTEALPLSVTALLPIVLFPFMGILPSNKVCPQYFLDTNFLFLSGLIMASAIEEWNLHRRIALKILMLVGVQPARLILGMMVTTSFLSMWLSNTASTAMMLPIANAILKSLFGQKEVRKDPSQESEENTGIEPNTFLSEERLKLQAPLVIRLGQITESGQWNMSGNDVCNFRVLSFLPGGM

SEQ ID NO: 8443 - protein, 35 aa, Homo sapiens
MSHHAQPRFLLITMLLQEAKPVSNIPHLLESWYFG

SEQ ID NO: 8444 - protein, 75 aa, Homo sapiens [sequence omitted]

SEQ ID NO: 8445 - protein, 234 aa, Homo sapiens; identical to SEQ ID NO: 7861

SEQ ID NO: 8446 - protein, 275 aa, Homo sapiens
  SITE (131): Xaa equals any amino acid
MANTGVFGFSFLLLTVALLASYSVHLLLSMCIQTAVTSYEDLGLFAFGLPGKLVVAGTIIIQNIGAMSSYLLIIKTELPAAIAEFLTGDYSRYWYLDGQTLLIIICVGIVFPLALLPKIGFLGYTSSLSFXFMMFFALVVIIKKWSIPCPLTLNYVEKGFQISNVTDDCKPKLFHFSKESAYALPTMAFSFLCHTSILPIYCELQSPSKKRMQNVTNTAIALSFLIYFISALFGYLTFYGSHSVAQVGVQWCDLSSLQPLPPGLKQSSHLSLQSS

SEQ ID NO: 8447 - protein, 154 aa, Homo sapiens
  SITE (100): Xaa equals any amino acid
  SITE (126): Xaa equals any amino acid
  SITE (151): Xaa equals any amino acid
  SITE (153): Xaa equals any amino acid
MRSCPEEQYWAALLGTCMFCKAICNHQSQRTCAASCGEFWDLSPGDSVITPNACPQSTLWPHSQVAEERMAGGDVQCGTSYPSTFLLWPHCLLSVSNMPXSSLPRVLCTCCSRCLECMLSIIFLSXLLPNFQVSAQTSGVSSDHTVVLGPXLXC

SEQ ID NO: 8448 - protein, 106 aa, Homo sapiens
  SITE (59): Xaa equals any amino acid
  SITE (63): Xaa equals any amino acid
  SITE (65): Xaa equals any amino acid
  SITE (77): Xaa equals any amino acid
  SITE (88): Xaa equals any amino acid
  SITE (105): Xaa equals any amino acid
MGAALAAWICIVRYHQLRDWGVRRWPNQLILWTGLLCALGTSVVGNLPGETQSAPRVCXRPAXGXTTPSMPRGHRLXVSGAGSRPPFXGLVFFSGHWPGPAGSFXL

SEQ ID NO: 8449 - protein, 47 aa, Homo sapiens
MSHGSQPFLLLLSLHILILAGSFLLFSPYTAKPSFSSSFIVFPRAEM

SEQ ID NO: 8450 - protein, 143 aa, Homo sapiens [sequence omitted]

SEQ ID NO: 8451 - protein, 35 aa, Homo sapiens
MLNDGKVWVSCFCVVLTSLDFCSFCSLWASVLSLI

SEQ ID NO: 8452 - protein, 29 aa, Homo sapiens [sequence omitted]

SEQ ID NO: 8453 - protein, 43 aa, Homo sapiens
  SITE (6): Xaa equals any amino acid
MGRLGXQCLLFLAFKAISGVFFLFWRPADSTERNTQSWDFPPL

SEQ ID NO: 8454 - protein, 26 aa, Homo sapiens
MHNAFNLNVLTLFLSVLCCTFSDSEL

SEQ ID NO: 8455 - protein, 210 aa, Homo sapiens
  SITE (5): Xaa equals any amino acid
MSRSXDVTNTTFLLMAASIYLHDQNPDAALRALHQGDSLECTAMTVQILLKLDRLDLARKELKRMQDLDEDATLTQLATAWVSLATGGEKLQDAYYIFQEMADKCSPTLLLLNGQAACHMAQGRWEAAEGLLQEALDKDSGYPETLVNLIVLSQHLGKPPEVTNRYLSQLKDAHRSHPFIKEYQAKENDFDRLVLQYAPSAEAGPELSGP

SEQ ID NO: 8456 - protein, 82 aa, Homo sapiens
  SITE (15): Xaa equals any amino acid
MGGSLLPQVSAAVLXLDGLLLPGLKGCGPLRVSFPQAKFKAAALCEALLALGWRENFKLFCSQGRGMGPGCRCPHSANESFV

SEQ ID NO: 8457 - protein, 83 aa, Homo sapiens
  SITE (35): Xaa equals any amino acid
  SITE (44): Xaa equals any amino acid
MRVPPVLRGRILPLVLQCTLLEFCLCATTVLPTVXCWKPRLPVXASGLYVDRMSLWKYGCSGWNESARPRRAGGTMRPPRSGR

SEQ ID NO: 8458 - protein, 191 aa, Homo sapiens
  SITE (34): Xaa equals any amino acid
  SITE (48): Xaa equals any amino acid
MTVSGTVVLVAGTLCFAWWSEGDATAQPGQLAPXTEYPVPEGPSPLLXSVSFVCCGAGGLLLLIGLLWSVKASIPGPPRWDPYHLSRDLYYLTVESSEKESCRTPKVVDIPTYEEAVSFPVAEGPPTPPAYPTEEALEPSGSRDALLSTQPAWPPPSYESISLALDAVSAETTPSATRSCSGLVQTARGGS

SEQ ID NO: 8459 - protein, 18 aa, Homo sapiens
LVLQLLLLQQAAQANRLL

SEQ ID NO: 8460 - protein, 153 aa, Homo sapiens
MCESNSTMPGPSLESPVSTPAGKIGLAVCYDMRFPELSLALAQAGAEILTYPSAFGSITGPAHWEVLLRARAIETQCYVVAAAQCGRHHEKRASYGHSMVVDPWGTVVARCSEGPGLCLARIDLNYLRQLRRHLPVFQHRRPDLYGNLGHPLS

SEQ ID NO: 8461 - protein, 92 aa, Homo sapiens
MKQRLRGQQGFQLDVCVACTLLFLLLTVNSGVTSREQLGCSRPSLAQGEGRGTCSSEQPEGGGRSEVVEVVCVSYWSEGTKCVCCLFCILFF

SEQ ID NO: 8462 - protein, 80 aa, Homo sapiens [sequence omitted]

SEQ ID NO: 8463 - protein, 547 aa, Homo sapiens
MEDSEALGFEHMGLDPRLLQAVTDLGWSRPTLIQEKAIPLALEGKDLLARARTGSGKTAAYAIPMLQLLLHRKATGPVVEQAVRGLVLVPTKELARQAQSMIQQLATYCARDVRVANVSAAEDSVSQRAVLMEKPDVVVGTPSRILSHLQQDSLKLRDSLELLVVDEADLLFSFGFEEELKSLLCHLPRIYQAFLMSATFNEDVQALKELILHNPVTLKLQESQLPGPDQLQQFQVVCETEEDKFLLLYALLKLSLIRGKSLLFVNTLERSYRLRLFLEQFSIPTCVLNGELPLRSRCHIISQFNQGFYDCVIATDAEVLGAPVKGKRRGRGPKGDKASDPEAGVARGIDFHHVSAVLNFDLPPTPEAYIHRAGRTARANNPGIVLTFVLPTEQFHLGKIEELLSGENRGPILLPYQFRMEEIEGFRYRCRDAMRSVTKQAIREARLKEIKEELLHSEKLKTYFEDNPRDLQLLRHDLPLHPAVVKPHLGHVPDYLVPPALRGLVRPHKKRKKLSSSCRKAKRAKSQNPLRSFKHKGKKFRPTAKPS

SEQ ID NO: 8464 - protein, 299 aa, Homo sapiens
MTTVPPSPRPMSRPSERNMRRPRGPSPLPASPRNSTPDEPDVHFSKKFLNVFMSGRSRSSSAESFGLFSCIINGEEQEQTHRAIFRFVPRHEDELELEVDDPLLVELQAEDYWYEAYNMRTGARGVFPAYYAIEVTKEPEHMAALAKNSDWVDQFRVKFLGSVQVPYHKGNDVLCAAMQKIATTRRLTVHFNPPSSCVLEISVRGVKIGVKADDSQEAKGNKCSHFFQLKNISFCGYHPKNNKYFGFITKHPADHRFACHVFVSEDSTKALAESVGRAFQQFYKQFVEYTCPTEDIYLE

SEQ ID NO: 8465 - protein, 82 aa, Homo sapiens
MEDTDDSLVLVFLSAVNVQQFAQELGDHICLSGQGSEVHWNLLRNLFVKTIVNNYCIFLQKYILENCILSIKVFLCKKKKKK

SEQ ID NO: 8466 - protein, 40 aa, Homo sapiens
  SITE (15): Xaa equals any amino acid
MAYSPLLISLVLAFXPASTYGRASIDFTCFPNHYGISNQY

SEQ ID NO: 8467 - protein, 537 aa, Homo sapiens [sequence omitted]

SEQ ID NO: 8468 - protein, 25 aa, Homo sapiens
  SITE (17): Xaa equals any amino acid
MAGIHRAFLVFCLWGLXLCVVGGPW

SEQ ID NO: 8469 - protein, 66 aa, Homo sapiens
MSSSSLKHLLCMALSWFSSFISGETSFSLLNSFFLPYPSSRCCCFSVQCSILDPFSCNSMRFPWEN

SEQ ID NO: 8470 - protein, 44 aa, Homo sapiens
MFVWHLKVMVMFIILYFAYCESNFHSVLSVSKPLLKILFLPRNL

SEQ ID NO: 8471 - protein, 33 aa, Homo sapiens
MSHNIQPLFSFLTLLSYFLFHFLSLPSSFFPNY

SEQ ID NO: 8472 - protein, 72 aa, Homo sapiens [sequence omitted]

SEQ ID NO: 8473 - protein, 43 aa, Homo sapiens
MRSDGFIRTFCFGIFLIFLLLSLCKKCLLPPAMILRPPSHVEL

SEQ ID NO: 8474 - protein, 444 aa, Homo sapiens
  SITE (92): Xaa equals any amino acid
  SITE (95): Xaa equals any amino acid
  SITE (97): Xaa equals any amino acid
  SITE (98): Xaa equals any amino acid
  SITE (101): Xaa equals any amino acid
MLQRIGLIFLHNIVVVSNCFYFQAFLDEFTNWSRINPNKARIPMAGDTQGVVGTVSKPCFTAYEMKIGAITFQVATGDIATEQVDVIVNSTXRTXNXXSGXSRAILEGAGQAVESECAVLAAQPHRDFIITPGGCLKCKIIIHVPGGKDVRKTVTSVLEECEQRKYTSVSLPAIGTGNAGKNPITVADNIIDAIVDFSSQHSTPSLKTVKVVIFQPELLNIFYDSMKKRDLSASLNFQSTFSMTTCNLPEHWTDMNHQLFCMVQLEPGQSEYNTIKDKFTRTCSSYAIEKIERIQNAFLWQSYQVKKRQMDIKNDHKNNERLLFHGTDADSVPYVNQHGFNRSCAGKNAVSYGKGTYFAVDASYSAKDTYSKPDSNGRKHMYVVRVLTGVFTKGRAGLVTPPPKNPHNPTDLFDSVTNNTRSPKLFVVFFDNQAYPEYLITFTA

SEQ ID NO: 8475 - protein, 617 aa, Homo sapiens
MFRTAVMMAASLALTGAVVAHAYYLKHQFYPTVVYLTKSSPSMAVLYIQAFVLVFLLGKVMGKVFFGQLRAAEMEHLLERSWYAVTETCLAFTVFRDDFSPRFVALFTLLLFLKCFHWLAEDRVDFMERSPNISWLFHCRIVSLMFLLGILDFLFVSHAYHSILTRGASVQLVFGFEYAILMTMVLTIFIKYVLHSVDLQSENPWDNKAVYMLYTELFTGFIKVLLYMAFMTIMIKVHTFPLFAIRPMYLAMRQFKKAVTDAIMSRRAIRNMNTLYPDATPEELQAMDNVCIICREEMVTGAKRLPCNHIFHTSCLRSWFQRQQTCPTCRMDVLRASLPAQSPPPPEPADQGPPPAPHPPPLLPQPPNFPQGLLPPFPPGMFPLWPPMGPFPPVPPPPSSGEAVAPPSTSAAALSRPSGAATTTAAGTSATAASATASGPGSGSAPEAGPAPGFPFPPPWMGMPLPPPFAFPPMPVPPAGFAGLTPEELRALEGHERQHLEARLQSLRNIHTLLDAAMLQINQYLTVLASLGPPRPATSVNSTEETATTVVAAASSTSIPSSEATTPTPGASPPAPEMERPPAPESVGTEEMPEDGEPDAAELRRRRLQKLESPVAH

SEQ ID NO: 8476 - protein, 117 aa, Homo sapiens
MDTFCVLILCVYTCAAHMSIHRCVCILCVYFVHLWMCVCTIESISRRERECVCVCVHVWMCGYSMSVFRVQVYGCSCAVCVCAHTHSASLCVCMCIPCVPMYRGCVYPACLCMGEHM

SEQ ID NO: 8477 - protein, 270 aa, Homo sapiens
  SITE (27): Xaa equals any amino acid
MHYYRYSNAKVSCWYKYLLFSYNIIFXLAGVVFLGVGLWAWSEKGVLSDLTKVTRMHGIDPVVLVLMVGVVMFTLGFAGCVGALRENICLLNFFCGTIVLIFFLELAVAVLAFLFQDWVRDRFREFFESNIKSYRDDIDLQNLIDSLQKANQCCGAYGPEDWDLNVYFNCSGASYSREKCGVPFSCCVPDPAQKVVNTQCGYDVRIQLKSKWDESIFTKGCIQALESWLPRNIYIVAGVFIAISLLQIFGIFLARTLISDIEAVKAGHHF

SEQ ID NO: 8478 - protein, 49 aa, Homo sapiens
MQVSSWVVFQLVWNSLVLTQTGIKHYFRFSLCQFLSSYNHVNQDVRTSI

SEQ ID NO: 8479 - protein, 47 aa, Homo sapiens
MFGSRGLLCMCVFFFNILASQCKVISSGGMLCCRTPTLLDYLRQHFL

SEQ ID NO: 8480 - protein, 33 aa, Homo sapiens
MISCLCNFIAHCVALVMRTCMLVVSSNFAPSFL

SEQ ID NO: 8481 - protein, 79 aa, Homo sapiens [sequence omitted]

SEQ ID NO: 8482 - protein, 186 aa, Homo sapiens
MLPLVSGCPGFSLGCFFFLTALHIYANYRAVRALVMETLNEGRLRLVLKHYLQRGEVLDPTAANRMEPLWTGFWPAPSLSLGVPLHRLVSSVFELQQLVEGHQESYLLCWDQSQNQVQVVLNQKAGPKTILRAATHGLMLGALQGDGPLPAELEELRNRVRAGPRKRAGSSSRRHTKCWTCCSQSS

SEQ ID NO: 8483 - protein, 44 aa, Homo sapiens
MTQEILVVFSIQVLSSLRLLGLWFFMENRLCSGIVEQRRLLHLN

SEQ ID NO: 8484 - protein, 24 aa, Homo sapiens
MHLFLLVKFWNLWTGQLLLITKLF

SEQ ID NO: 8485 - protein, 82 aa, Homo sapiens
  SITE (43): Xaa equals any amino acid
MHMNLQLFSYPQMRYGAAQHSLQIPSFYNCQLYILMFRILQVXAWIFGKLDKIRQPTPPLSRASSISIHHDQFFPPQKHYHL

SEQ ID NO: 8486 - protein, 92 aa, Homo sapiens
  SITE (59): Xaa equals any amino acid
MAIRCCSSTSNALILILFTWTVLLHHPRSSSFLPSFKKPSWTSPLGYAIIATPCNSLSXHLSCYIELSVSLTECEPALKLEVRLQAGGIVLG

SEQ ID NO: 8487 - protein, 41 aa, Homo sapiens
MPSLPIRVTKFSEIGNWQLKAVSTTRFLLPLKKKSFLRLLF

SEQ ID NO: 8488 - protein, 47 aa, Homo sapiens
MTFGLGQGLCFLFCYQVLVAFRLTNQIPALGYISHLSSHIPYLALFG

SEQ ID NO: 8489 - protein, 57 aa, Homo sapiens
MLLKSTGSFLEFGLQESCAEFWTSADDSSASDEIRLELCFLSPSTSYLVVSFLMVRS

SEQ ID NO: 8490 - protein, 56 aa, Homo sapiens
MCQTLPARLRAQCISSLLFLLMGLLAMTGERNQGTHYYEFSGFIFKSQMMWSIKPN

SEQ ID NO: 8491 - protein, 213 aa, Homo sapiens
MQIQVAGLLQFAVPLFSTAEEDLLAIQLLLNSSESSLHQLTAMVDCRGLHKDYLDALAGICYDGLQGLLYLGLFSFLAALAFSTMICAGPRAWKHFTTRNRDYDDIDDDDPFNPQAWRMAAHSPPRGQLHSFCSYSSGLGSQTSLQPPAQTISNAPVSEYMNQAMLFGRNPRYENVPLIGRASPPPTYSPSMRATYLSVADEHLRHYGNQFPA

SEQ ID NO: 8492 - protein, 73 aa, Homo sapiens [sequence omitted]

SEQ ID NO: 8493 - protein, 45 aa, Homo sapiens
MLSSLYLLLMPPYKFTGELHPPVAATCLLTVLLGCLIGVSSDGWI

SEQ ID NO: 8494 - protein, 201 aa, Homo sapiens [sequence omitted]

SEQ ID NO: 8495 - protein, 30 aa, Homo sapiens
  SITE (4): Xaa equals any amino acid
  SITE (7): Xaa equals any amino acid
  SITE (20): Xaa equals any amino acid
  SITE (25): Xaa equals any amino acid
  SITE (28): Xaa equals any amino acid
TLLXFLXLLTTEGGRENIFXGRILXLQXSP

SEQ ID NO: 8496 - protein, 122 aa, Homo sapiens
MVSISVVLRVSLPTLEPVPVAGRSIWISTTSPSMISVSSLMRTPMDRRKACVSASVLLISREKISLPAMAVNGVSGPRACAMPMAMAVFPVPGWPAIRTARPAIFPSRIISSTTPAARRAAS

SEQ ID NO: 8497 - protein, 39 aa, Homo sapiens
  SITE (8): Xaa equals any amino acid
LLYLLKVXVIFVFSSSKGVTLVSMNLTSFFVSSVLACFS

SEQ ID NO: 8498 - protein, 74 aa, Homo sapiens
MVVITVLLSVAHVPAGAGLHHCPGTGLPQVRRSARSSSFSRKPRAPSSSPAHLLPGPRPVAPLVPSLLLCPPLP

SEQ ID NO: 8499 - protein, 53 aa, Homo sapiens
MLHLKLWSFPVISVFGVVLFFFLQELLQEERTMSSTLEGAMGTKQNSEAPSTI

SEQ ID NO: 8500 - protein, 86 aa, Homo sapiens
MFLVAVWWRFGILSICMLCVGLVLGFLISSVTFFTPLGNLKIFHDDGVFWVTFSCIAILIPVVFMGCLRILNILTCGSHWAPIRWF

SEQ ID NO: 8501 - protein, 55 aa, Homo sapiens
MQHLPGLSLHLVLVFLESLGSCATPHPRAAPAAKKKKKKKEFETSLDNIVEPCLY

SEQ ID NO: 8502 - protein, 49 aa, Homo sapiens
MHHHTLLIFVFLVETAFHHLGQTGLKLLASSDSSASASQKKKKKKKKNS

SEQ ID NO: 8503 - protein, 46 aa, Homo sapiens
  SITE (44): Xaa equals any amino acid
MHQHAQLSILFLVEIRSCCVAQASLKFLASSNPSALASQIVGFXRH

SEQ ID NO: 8504 - protein, 91 aa, Homo sapiens
  SITE (52): Xaa equals any amino acid
  SITE (68): Xaa equals any amino acid
MPVSWGCPSKTPQTRGLHKVRVFPHGPRGWSRRSQCQQGWLPRSPSLACGRXQLPASHVVVLLCWFPXRLLKREPNQCRIKGPPKNLIERN

SEQ ID NO: 8505 - protein, 52 aa, Homo sapiens
MSFLVFSFFCFGFSNSRFSRDYQHYLSLLSSPHAQKRNKIIRESSISALLTS

SEQ ID NO: 8506 - protein, 115 aa, Homo sapiens
MINVYFSGPGVLTPLDDQGSPCPPAPFAALHPCPHPAGSGVLCCCPLRLCRPCRILFTGPLLLTLHHLLCETSPSGIGVGNIVPGARPLGVNPVFPISSCDLGQVAEPLLVTISS

SEQ ID NO: 8507 - protein, 23 aa, Homo sapiens
  SITE (19): Xaa equals any amino acid
MSWLFLLFALLCKFQHKLXFHNI

SEQ ID NO: 8508 - protein, 66 aa, Homo sapiens
  SITE (32): Xaa equals any amino acid
MNILVCVFWLWGGVAGSWGRHIFIFTSVKNVXGGQPLCLAQMTSSQGDTYCVYQSGSNQETNHTVI

SEQ ID NO: 8509 - protein, 60 aa, Homo sapiens
MSRFSQNFRGKEDHIVFLFCFNEIFFLLLMLLVFPWLLSKAVSGFAERLEMTTIFRVSRS

SEQ ID NO: 8510 - protein, 72 aa, Homo sapiens [sequence omitted]

SEQ ID NO: 8511 - protein, 27 aa, Homo sapiens
HQCGLVGLKLLRGGWEQSDRGGSLGLT

SEQ ID NO: 8512 - protein, 30 aa, Homo sapiens
MDHSPFAGINNTAVLVLTLHFHHATLSVTE

SEQ ID NO: 8513 - protein, 7 aa, Homo sapiens
MQHQQMQ

SEQ ID NO: 8514 - protein, 34 aa, Homo sapiens
MTALFCSLLHSLVSLLLPTKWGQGKAFLTGPLFS

SEQ ID NO: 8515 - protein, 206 aa, Homo sapiens
MGAEWELGAEAGGSLLLCAALLAAGCALGLRLGRGQGAADRGALIWLCYDALVHFALEGPFVYLSLVGNVANSDGLIASLWKEYGKADARWVYFDPTIVSVEILTVALDGSLALFLIYAIVKEKYYRHFLQITLCVCELYGCWMTFLPEWLTRSPNLNTSNWLYCWLYLFFFNGVWVLIPGLLLWQSWLELKKMHQKETSSVKKFQ

SEQ ID NO: 8516 - protein, 576 aa, Homo sapiens
MIVFGWAVFLASRSLGQGLLLTLEEHIAHFLGTGGAATTMGNSCICRDDSGTDDSVDTQQQQAENSAVPTADTRSQPRDPVRPPRRGRGPHEPRRKKQNVDGLVLDTLAVIRTLVDNDQEPPYSMITLHEMAETDEGWLDVVQSLIRVIPLEDPLGPAVITLLLDECPLPTKDALQKLTEILNLNGEVACQDSSHPAKHRNTSAVLGCLAEKLAGPASIGLLSPGILEYLLQCLKLQSHPTVMLFALIALEKFAQTSENKLTISESSISDRLVTLESWANDPDYLKRQVGFCAQWSLDNLFLKEGRQLTYEKVNLSSIRAMLNSNDVSEYLKISPHGLEARCDASSFESVRCTFCVDAGVWYYEVTVVTSGVMQIGWATRDSKFLNHEGYGIGDDEYSCAYDGCRQLIWYNARSKPHIHPCWKEGDTVGFLLDLNEKQMIFFLNGNQLPPEKQVFSSTVSGFFAAASFMSYQQCEFNFGAKPFKYPPSMKFSTFNDYAFLTAEEKIILPRHRRLALLKQVSIRENCCSLCCDEVADTQLKPCGHSDLCMDCALQLETCPLCRKEIVSRIRQISHIS

SEQ ID NO: 8517 - protein, 576 aa, Homo sapiens; identical to SEQ ID NO: 8516

SEQ ID NO: 8518 - protein, 61 aa, Homo sapiens [sequence omitted]

SEQ ID NO: 8519 - protein, 21 aa, Homo sapiens
MLLFLTVINFMALAKMNFCGD

SEQ ID NO: 8520 - protein, 73 aa, Homo sapiens [sequence omitted]

SEQ ID NO: 8521 - protein, 67 aa, Homo sapiens
MLFLIYVSLLMLLFSLCLSLPHLQPPSLREILIPVHSLRFSLVSPLHGSLASSLLLQHCGTLRQVFF

SEQ ID NO: 8522 - protein, 44 aa, Homo sapiens
MYVKASAVTVSRDEALTPCLPDPHWNAPFARHLLQPSCSFLEFP

SEQ ID NO: 8523 - protein, 38 aa, Homo sapiens
MEVVLVLLASACHLLLGGHTTVEGHAAWRWPGWPCCPG

SEQ ID NO: 8524 - protein, 95 aa, Homo sapiens [sequence omitted]

SEQ ID NO: 8525 - protein, 72 aa, Homo sapiens
  SITE (26): Xaa equals any amino acid
  SITE (68): Xaa equals any amino acid
  SITE (69): Xaa equals any amino acid
  SITE (70): Xaa equals any amino acid
MLPLLFCAFCLHKLGPLLFLYDVLMXHEAVMRTHQIQLPDPEFPSQQNQVLNKTLFNKLKKKKKKKKXXXKK

SEQ ID NO: 8526 - protein, 649 aa, Homo sapiens
  SITE (555): Xaa equals any amino acid
  SITE (557): Xaa equals any amino acid
  SITE (558): Xaa equals any amino acid
MSASQDLEPKPLFPKPAFGQKPPLSTENSHEDESPMKNVSSSKGSPAPLGVRSKSGPLKPAREDSENKDHAGEISSLPFPGVVLKPAASRGGPGLSKNGEEKKEDRKIDAAKNTFQSKINQEELASGTPPARFPKAPSKLTVGGPWGQSQEKEKGDKNSATPKQKPLPPLFTLGPPPPKPNRPPNVDLTKFHKTSSGNSTSKGQTSYSTTSLPPPPPSHPASQPPLPASHPSQPPVPSLPPRNIKPPFDLKSPVNEDNQDGVTHSDGAGNLDEEQDSEGETYEDIEASKEREKKREKEEKKRLELEKKEQKEKEKKEQEIKKKFKLTGPIQVIHLAKACCDVKGGKNELSFKQGEQIEIIRITDNPEGKWLGRTARGSYGYIKTTAVEIDYDSLKLKKDSLGAPSRPIEDDQEVYDDVAEQDDISSHSQSGSGGIFPPPPDDDIYDGIEEEDADDGSTLQVQEKSNTWSWGILKMLKGKDDRKKSIREKPKVSDSDNNEGSSFPAPPKQLDMGDEVYDDVDTSDFPVSSAEMSQGTNVGKAKTEEKDLKKLKKQXKXXKDFRKKFKYDGEIRVLYSTKVTTSITSKKWGTRDLQVKPGESLEVIQTTDDTKVLCRNEEGKYGYVLRSYLADNDGEIYDDIADGCIYDND

SEQ ID NO: 8527 - protein, 55 aa, Homo sapiens
MAWPSRSKMFTLLPVLCYLWSLWLPQFSWIQELKAVLRDDGLISAVAWNAEFQTC

SEQ ID NO: 8528 - protein, 54 aa, Homo sapiens
  SITE (3): Xaa equals any amino acid
  SITE (12): Xaa equals any amino acid
  SITE (13): Xaa equals any amino acid
  SITE (24): Xaa equals any amino acid
  SITE (32): Xaa equals any amino acid
  SITE (34): Xaa equals any amino acid
MVXNLQVISIWXXSTTCFYACIWXQGCLMLRXFXTLNNVTRLPSSQKPIKCYLL

SEQ ID NO: 8529 - protein, 37 aa, Homo sapiens
  SITE (31): Xaa equals any amino acid
MHSSAETLLCWPLFVGVAVGGQGASSKSSSXWTLSRA

SEQ ID NO: 8530 - protein, 44 aa, Homo sapiens
MQIPFLLEVFVIHTGVLGSKLLKSGGLFDLTSFSPMIICFSNKS

SEQ ID NO: 8531 - protein, 594 aa, Homo sapiens
  SITE (99): Xaa equals any amino acid
MPASSLESRSFLLAKKSGENVAKFIINSYPKYFQKDIAEPHIPCLMPEYFEPQIKDISEAALKERIELRKVKASVDMFDQLLQAGTTVSLETTNSLLDXLCYYGDQEPSTDYHFQQTGQSEALEEENDETSRRKAGHQFGVTWRAKNNAERIFSLMPEKNEHSYCTMIRGMVKHRAYEQALNLYTELLNNRLHADVYTFNALIEATVCAINEKFEEKWSKILELLRHMVAQKVKPNLQTFNTILKCLRRFHVFARSPALQVLREMKAIGIEPSLATYHHIIRLFDQPGDPLKRSSFIIYDIMNELMGKRFSPKDPDDDKFFQSAMSICSSLRDLELAYQVHGLLKTGDNWKFIGPDQHRNFYYSKFFDLICLMEQIDVTLKWYEDLIPSAYFPHSQTMIHLLQALDVANRLEVIPKIWKDSKEYGHTFRSDLREEILMLMARDKHPPELQVAFADCAADIKSAYESQPIRQTAQDWPATSLNCIAILFLRAGRTQEAWKMLGLFRKHNKIPRSELLNELMDSAKVSNSPSQAIEVVELASAFSLPICEGLTQRVMSDFAINQEQKEALSNLTALTSDSDTDSSSDSDSDTSEGK

SEQ ID NO: 8532 - protein, 49 aa, Homo sapiens
MSFQSIKNLLTCRARWLTPVIPALWGARAGGSSEEFETSLTNMVKPHLY

SEQ ID NO: 8533 - protein, 45 aa, Homo sapiens
MLHLFCSQPLGLLFLLIFLGLDSLPRCLTATRLQSPINYIFNFVL

SEQ ID NO: 8534 - protein, 44 aa, Homo sapiens
MTPGCSVPFLLCWLFALMMQEKWGGVKSLVSYHYSRQWHQTVVV

SEQ ID NO: 8535 - protein, 51 aa, Homo sapiens
MLSTILSFVCNCACRLNRILIVLITCLILVSPVRQACFLEAGTECHSHLCS

SEQ ID NO: 8536 - protein, 47 aa, Homo sapiens
MAFRVLYYSVWFIFLHVSFATPKVTGLIASTYHFLYVFMFLLMILSA

SEQ ID NO: 8537 - protein, 70 aa, Homo sapiens [sequence omitted]

SEQ ID NO: 8538 - protein, 60 aa, Homo sapiens
MTPGVGAEPRGEGCKGKAVRGLGGERVSPVLLVLHLRSPSPVEGEQSQRQWGVQFWNLEE

SEQ ID NO: 8539 - protein, 44 aa, Homo sapiens
MPTWPLLQLLSCSFPSLLCETFTFCSKDEVSRWKAGCFVPLPAS

SEQ ID NO: 8540 - protein, 57 aa, Homo sapiens
MCMTVFIVFYYSFMRLLFRCSHNRRHWRGSGKNTVYHTGPRDEACCAMPCWATWGRR

SEQ ID NO: 8541 - protein, 59 aa, Homo sapiens [sequence omitted]

SEQ ID NO: 8542 - protein, 108 aa, Homo sapiens
MSSVSLSASSSSSSKVPRVRIKSEGCSTGDKLSLAVPASKATEPISFRRRSSCSLCCWLSALASDFFRRSYSGRYSLSYSSAALVTCTKSSSNPVPRTAETPTTLSEL

SEQ ID NO: 8543 - protein, 39 aa, Homo sapiens
  SITE (15): Xaa equals any amino acid
  SITE (36): Xaa equals any amino acid
ILGFSFAVGEGKWGXFCLLVPGIMLHIIHLLSHLIXPNP

SEQ ID NO: 8544 - protein, 36 aa, Homo sapiens
MSLPASFFFKIALVFLHVFSVNFRISLSVSTSPLGF

SEQ ID NO: 8545 - protein, 26 aa, Homo sapiens
MVFILEQIKNQVFFLFLLLKLTCVSH

SEQ ID NO: 8546 - protein, 32 aa, Homo sapiens
MSHFTFPLFLWGQLLFNTPCGLPSWRLCHHYQ

SEQ ID NO: 8547 - protein, 45 aa, Homo sapiens
MPFFLLTFPLVLYPHLSRGSDPVLPCVMGIHVFGLSHHSRKVAPP

SEQ ID NO: 8548 - protein, 43 aa, Homo sapiens
MCLAILLFLILSVLDENVYFTELCQRVSTFFCLIIGEKGLSYF

SEQ ID NO: 8549 - protein, 46 aa, Homo sapiens
  SITE (34): Xaa equals any amino acid
MHHPNLCLHFHAAFSLCVHGCLCVQFFPFYKDTXHIGLEPTLMTSS

SEQ ID NO: 8550 - protein, 183 aa, Homo sapiens [sequence omitted]

SEQ ID NO: 8551 - protein, 65 aa, Homo sapiens [sequence omitted]

SEQ ID NO: 8552 - protein, 75 aa, Homo sapiens
MFTTRFPKLLIFPKIVTENCCLLFCSFWGWWCWLGHACEVMCVSDLTDSLFSLLIERALFTLFICFDTSAFSVLS

SEQ ID NO: 8553 - protein, 56 aa, Homo sapiens
MLIFLKCLTVSYAKYSSKIYTAVSNTFSTASDSWLCVKTPRGYHWFMSLETPDIEQ

SEQ ID NO: 8554 - protein, 48 aa, Homo sapiens [sequence omitted]

SEQ ID NO: 8555 - protein, 38 aa, Homo sapiens
MLFIYLFVFPIRIGSEKAKTVSVLLIIVSLTARPLAGF

SEQ ID NO: 8556 - protein, 217 aa, Homo sapiens
MDSQQASGTIVQIVINNKHKHGQVCVSNGKTYSHGESWHPNLRAFGIVECVLCTCNVTKQECKKIHCPNRYPCKYPQKIDGKCCKVCPEELPGQSFDNKGYFCGEETMPVYESVFMEDGETTRKIALETERPPQVEVHVWTIRKGILQHFHIEKISKRMFEELPHFKLVTRTTLSQWKIFTEGEAQISQMCSSRVCRTELEDLVKVLYLERSEKGHC

SEQ ID NO: 8557 - protein, 60 aa, Homo sapiens
MTYHPNQVVEGCCSYMAVTFNGLTPNQMHVMMYGVYRLRAFGHIFNDALVFLPPNGSDND

SEQ ID NO: 8558 - protein, 29 aa, Homo sapiens
MSITLIQLMFYFNTPELPHKTSFHVKGSR

SEQ ID NO: 8559 - protein, 152 aa, Homo sapiens
MLFMGFVPWATSSIAVMFVLLFLCGWFQGMGWPPCGRTMVHWWSQKERGGIVSVWNCAHNVGGGIPPLLFLLGMAWFNDWHAALYMPAFCAILVALFAFAMMRDTPQSCGLPPIEEYKNDYPDDYNEKAEQELTAKQPGGRRLWLHPAYTAA

SEQ ID NO: 8560 - protein, 70 aa, Homo sapiens
MLFWKFGSFLFFCLPLTLFCILNERGIMHLEGGTLLNSLSHVRHYLRLRLSCFEKIPLHRSIFIFLLLLL

SEQ ID NO: 8561 - protein, 130 aa, Homo sapiens
MKLNLCIPNWARCPLLLLFPQLLPFQGEDDDPLKAKAANLVEAVPWGIKAPSFQVTCLVRVQLQSCTPSRPSTLLATSQSPGRISCYSPLSHLPPVTTSIQPSPVMVPFQYQAFLLQVKEPAAQTLLGQQ

SEQ ID NO: 8562 - protein, 42 aa, Homo sapiens [sequence omitted]

SEQ ID NO: 8563 - protein, 20 aa, Homo sapiens
  SITE (14): Xaa equals any amino acid
  SITE (19): Xaa equals any amino acid
MRYHAQLIFCIFCXFVFVXK

SEQ ID NO: 8564 - protein, 44 aa, Homo sapiens
MTSHPSWRLILVTSLVLGVEPEEAPGEAGEGSGGQRTMDPEQKW

SEQ ID NO: 8565 - protein, 52 aa, Homo sapiens
MPLDLLFLITYFLLSVILKVLYIDAPGHLGMPISLCSSAVVWVKVDLVSEKG

SEQ ID NO: 8566 - protein, 52 aa, Homo sapiens
MNCGGSTLCVLSFCSVVCSVEASCQSTVQWGGAAARVGVPFDWSRNEQGKGH

SEQ ID NO: 8567 - protein, 44 aa, Homo sapiens
MGTIFGYLHCVKCYVLYFIFILITAVYHSFYYPHYRGKALISGT

SEQ ID NO: 8568 - protein, 40 aa, Homo sapiens
MNIVPQFSVLPHFAYFSFIILYWAVLFSQTICSMSVFKVK

SEQ ID NO: 8569 - protein, 91 aa, Homo sapiens
  SITE (35): Xaa equals any amino acid
  SITE (36): Xaa equals any amino acid
MGLPSSIPRLVLLELIMAQCSSLWKCPRQPRHSLXXLSNTTLQAAVTNHQSSAEASSLCHPCNDSLRPCPKHSGLSNTQNCNVIFCSNLNF

SEQ ID NO: 8570 - protein, 319 aa, Homo sapiens
MSSNKEQRSAVFVILFALITILILYSSNSANEVFHYGSLRGRSRRPVNLKKWSITDGYVPILGNKTLPSRCHQCVIVSSSSHLLGTKLGPEIERAECTIRMNDAPTTGYSADVGNKTTYRVVAHSSVFRVLRRPQEFVNRTPETVFIFWGPPSKMQKPQGSLVRVIQRAGLVFPNMEAYAVSPGRMRQFDDLFRGETGKDREKSHSWLSTGWFTMVIAVELCDHVHVYGMVPPNYCSQRPRLQRMPYHYYEPKGPDECVTYIQNEHSRKGNHHRFIREKGLLIVGPAVWHHLLPPLLDLGHPACGTSGGSEEKQPPPSR

SEQ ID NO: 8571 - protein, 73 aa, Homo sapiens
  SITE (71): Xaa equals any amino acid
MLSVGIALAALGSLLLLGLLLYQVGVSGHCPSICMATPSTHSGHGGHGSIFSISGQLSAGRRHETTSSIAXLI

SEQ ID NO: 8572 - protein, 62 aa, Homo sapiens
  SITE (57): Xaa equals any amino acid
MPTLRVPVLSVWLLRWWRVLGAGRVLPDSLSLSPPPPTGCQTKPERGWGSQPPSVLXPQAPV

SEQ ID NO: 8573 - protein, 217 aa, Homo sapiens
MASKMKDTGFIVFAVLLLVSCLILIFVIAPRYGQRNILIYIIICSVIGAFSVAAVKGLGITIKNFFQGLPVVRHPLPYILSLILALSLSTQVNFLNRALDIFNTSLVFPIYYVFFTTVVVTSSIILFKEWYSMSAVDIAGTLSGFVTIILGVFMLHAFKDLDISCASLPHMHKNPPPSPAPEPTVIRLEDKNVLVDNIELASTSSPEEKPKVFIIHS

SEQ ID NO: 8574 - protein, 49 aa, Homo sapiens
MICKFLIIICITLLLFAICQLCKRQGLVQKISFYQKETLSSTVGTTFLS

SEQ ID NO: 8575 - protein, 104 aa, Homo sapiens
MERDTREKCLWSLPYPKLLCNLLASHFLSILSFFIYSIGFLDLVVSNTLPVFQFDVTFYPVTKFIFQKHSMLCHTANLVNVPDMVWLCPHPNLILNCSSHNPHM

SEQ ID NO: 8576 - protein, 39 aa, Homo sapiens [sequence omitted]

SEQ ID NO: 8577 - protein, 42 aa, Homo sapiens
MHALSYTHLSLLSLFLFLPPSFLYYNLVILFFEAFQNISHLS

SEQ ID NO: 8578 - protein, 22 aa, Homo sapiens
MSLLLFLKVHLFSPSTIFKRNN

SEQ ID NO: 8579 - protein, 51 aa, Homo sapiens
MKLNVHFLWCTFIFQTSGSHIELLISGQVSSYIPSLDFCTHKVVSREKFEE

SEQ ID NO: 8580 - protein, 24 aa, Homo sapiens
MHTCVYCSIIHNSKDLGTNPNVQQ

SEQ ID NO: 8581 - protein, 32 aa, Homo sapiens
MVQGSGGTCLMMTDLLFAVMLAVMIESCKRLY

SEQ ID NO: 8582 - protein, 68 aa, Homo sapiens
MPLALKRGQLFLIPWLFPQGVCPLEGEQLGSGKEGLLQFAIASCPRVYPEHSPPWKETQSATGYRKSD

SEQ ID NO: 8583 - protein, 24 aa, Homo sapiens
MIYFLLLLPEAQGEFSSIFTVRTW

SEQ ID NO: 8584 - protein, 70 aa, Homo sapiens
MYLWFSFSTVGLCGCCLLYRACGFIWYLLLLGHSSTNSLQDGGAERPEHPWAHVRYSCRRELSFWFYVFN

SEQ ID NO: 8585 - protein, 194 aa, Homo sapiens
  SITE (177): Xaa equals any amino acid
MRACLTTRSLPMPACLLTRHPLLCPRRTMPVTSGCRMPSTSASEGLGGRGHAPMQKAQKLPLRQALRLRSLRLPPYRLTSQEGQACIPQRRNCQTLSPVLGWLALGRASRVQPLLMALGLQFFHMCAPPAWPTLSLAVGPEASSLPLGVSGIGMSAWLPSPPHLLLLSAAAGSGASXLRALGSSALEGLQDPSQ

SEQ ID NO: 8586 - protein, 58 aa, Homo sapiens
MTWPPSCLVALLLSTVTQKMTPLNLMRTTGPINSFCLLPTFFFFPSYLPSLMPTPTDP

SEQ ID NO: 8587 - protein, 62 aa, Homo sapiens
MELMALFFRTTTVAAMASRGALALFLRKILSEAKFKLSLTPQPPQPFYIYMAYYSENFFLKF

SEQ ID NO: 8588 - protein, 53 aa, Homo sapiens
MFTAPLFFFFFFEIINSMRNLGLNICLLCLLIEHHSRPSVCLPFTPKILTKKF

SEQ ID NO: 8589 - protein, 136 aa, Homo sapiens
MLMLLTLLVLGMVWVASAIVDKNKANRESLYDFWEYYLPYLYSCISFLGVLLLLGECTGSGREWAGSLDQSNQARRKGNGGHVREGVESRVWQVTGSCPYSVYSTGSRPHVLRHWEAASQAPAAGRPGGAAVLLSL

SEQ ID NO: 8590 - protein, 291 aa, Homo sapiens
MSQEGVELEKSVRRLREKFHGKVSSKKAGALMRKFGSDHTGVGRSIVYGVKQKDGQELSNDLDAQDPPEDMKQDRDIQAVATSLLPLTEANLRMFQRAQDDLIPAVDRQFACSSCDHVWWRRVPQRKEVSRCRKCRKRYEPVPADKMWGLAEFHCPKCRHNFRGWAQMGSPSPCYGCGFPVYPTRILPPRWDRDPDRRSTHTHSCSAADCYNRREPHVPGTSCAHPKSRKQNHLPKVLHPSNPHISSGSTVATCLSQGGLLEDLDNLILEDLKEEEEEEEEVEDEEGGPRE

SEQ ID NO: 8591 - protein, 256 aa, Homo sapiens [sequence omitted]

SEQ ID NO: 8592 - protein, 131 aa, Homo sapiens
  SITE (6): Xaa equals any amino acid
MENISXDVIVGRCLAILKGIFGSSAVPQPKETVVSRWRADPYVAAGSSGNDYDLMAQPITPGPSIPGAPQPIPRLFFAGEHTIRNYPATVHGALLSGLREAGRIADQFLGAMYTLPRQATPGVPAQQSPSM

SEQ ID NO: 8593 - protein, 121 aa, Homo sapiens
ARAAVVNAFYSPNRNQIVFPAGILQPPFFSKEQPQALNFGGIGMVIGHEITHGFDDNGRNFDKNGNMMDWWSNFSTQHFREQSECMIYQYGNYSWDLADEQNVSAATSTQAAGVPEPQPWP

SEQ ID NO: 8594 - protein, 74 aa, Homo sapiens
MGHLFVVCLLSSWWTFRPFALAVTVNHVAVNIVCVSAWTCVSCSLGRSCGLEGSFLFPLETLWFPHMVVLCLTF

SEQ ID NO: 8595 - protein, 281 aa, Homo sapiens
MASRGRRPEHGGPPELFYDETEARKYVRNSRMIDIQTRMAGRALELLYLPENKPCYLLDIGCGTGLSGSYLSDEGHYWVGLDISPAMLDEAVDREIEGDLLLGDMGQGIPFKPGTFDGCISISAVQWLCNANKKSENPAKRLYCFFASLFSVLVRGSRAVLQLYPENSEQLELITTQATKAGFSGGMVVDYPNSAKAKKFYLCLFSGPSTFIPEGLSENQDEVEPRESVFTNERFPLRMSRRGMVRKSRAWVLEKKERHRRQGREVRPDTQYTGRKRKPRF

SEQ ID NO: 8596 - protein, 74 aa, Homo sapiens
MHWTFSSSLGCLYHFSLSFSGLHTVLKSSPSSRFLLPCSSQVTQPSPVGQPRLVVQLPPVKVIGHRTGQCRGPG

SEQ ID NO: 8597 - protein, 86 aa, Homo sapiens
MLFIFLLLILSITASYSLTCILSGAGEPSSVSASVVSGPGFCLAALLLMRTGGFAATLLPVAPTERFFSCCTVLSAQRNVSRTRSP

SEQ ID NO: 8598 - protein, 73 aa, Homo sapiens
MSSCFQLLLTYRAWFSTSSLAEQMCRTGLKSRHSPTSEQTERCARSWCLVHHCFPSQTFLFHACLTDKPLARP

SEQ ID NO: 8599 - protein, 75 aa, Homo sapiens [sequence omitted]

SEQ ID NO: 8600 - protein, 46 aa, Homo sapiens
MQNSHKNLSLFLSLIICLIHPKKKKGRAPIHLHSRGSITFKKYLLK

SEQ ID NO: 8601 - protein, 60 aa, Homo sapiens
  SITE (59): Xaa equals any amino acid
MVSFACFCFHCLFLVSYPRNHCQIQCRDAFSRSFLLGVFQVLYLGFINYITFYVEEKTXE

SEQ ID NO: 8602 - protein, 228 aa, Homo sapiens
MSMAVETFGFFMATVGLLMLGVTLPNSYWRVSTVHGNVITTNTIFENLWFSCATDSLGVYNCWEFPSMLALSGYIQACRALMITAILLGFLGLLLGIAGLRCTNIGGLELSRKAKLAATAGALHILAGICGMVAISWYAFNITRDFFDPLYPGTKYELGPALYLGWSASLISILGGLCLCSACCCGSDEDPAASARRPYQAPVSVMPVATSDQEGDSSFGKYGRNAYV

SEQ ID NO: 8603 - protein, 47 aa, Homo sapiens
MLRFSSSLLECLLSPLCLTDATGHHLDHPILVPVQVQKRNNVLKFTS

SEQ ID NO: 8604 - protein, 613 aa, Homo sapiens
MFRCGGLAAGALKQKLVPLVRTVCVRSPRQRNRLPGNLFQRWHVPLELQMTRQMASSGASGGKIDNSVLVLIVGLSTVGAGAYAYKTMKEDEKRYNERISGLGLTPEQKQKKAALSASEGEEVPQDKAPSHVPFLLIGGGTAAFAAARSIRARDPGARVLIVSEDPELPYMRPPLSKELWFSDDPNVTKTLRFKQWNGKERSIYFQPPSFYVSAQDLPHIENGGVAVLTGKKVVQLDVRDNMVKLNDGSQITYEKCLIATGGTPRSLSAIDRAGAEVKSRTTLFRKIGDFRSLEKISREVKSITIIGGGFLGSELACALGRKARALGTEVIQLFPEKGNMGKILPEYLSNWTMEKVRREGVKVMPNAIVQSVGVSSGKLLIKLKDGRKVETDHIVAAVGLEPNVELAKTGGLEIDSDFGGFRVNAELQARSNIWVAGDAACFYDIKLGRRRVEHHDHAVVSGRLAGENMTGAAKPYWHQSMFWSDLGPDVGYEAIGLVDSSLPTVGVFAKATAQDNPKSATEQSGTGIRSESETESEASEITIPPSTPAVPQAPVQGEDYGKGVIFYLRDKVVVGIVLWNIFNRMPIARKIIKDGEQHEDLNEVAKLFNIHED

SEQ ID NO: 8605 - protein, 914 aa, Homo sapiens [sequence omitted]

SEQ ID NO: 8606 - protein, 63 aa, Homo sapiens
MSLDSLVLVKALFCFTFVVQITLSNISSTNVSILVFVHTAITSPLQTFQFWHYEEVAVNLKYL

SEQ ID NO: 8607 - protein, 414 aa, Homo sapiens [sequence omitted]

SEQ ID NO: 8608 - protein, 103 aa, Homo sapiens
MAHIGACVSFVFFLLQGAVSVWTFCFRELERRVSAEGGEQGQRPHWPPPASQSETLCLVTKVPPKCSSFWVIQAKYLGFPLSSFPSKPQLSFKIGDISHPLPL

SEQ ID NO: 8609 - protein, 81 aa, Homo sapiens [sequence omitted]

SEQ ID NO: 8610 - protein, 305 aa, Homo sapiens [sequence omitted]

SEQ ID NO: 8611 - protein, 286 aa, Homo sapiens
MAMEGYWRFLALLGSALLVGFLSVIFALVWVLHYREGLGWDGSALEFNWHPVLMVTGFVFIQGIAIIVYRLPWTWKCSKLLMKSIHAGLNAVAAILAIISVVAVFENHNVNNIANMYSLHSWVGLIAVICYLLQLLSGFSVFLLPWAPLSLRAFLMPIHVYSGIVIFGTVIATALMGLTEKLIFSLRDPAYSTFPPEGVFVNTLGLLILVFGALIFWIVTRPQWKRPKEPNSTILHPNGGTEQGARGSMPAYSGNNMDKSDSELNSEVAARKRNLALDEAGQRSTM

SEQ ID NO: 8612 - protein, 335 aa, Homo sapiens [sequence omitted]

SEQ ID NO: 8613 - protein, 64 aa, Homo sapiens
MFVLCTRAVRTRLFSLCCCCCSSQPPTKSPAGTPKAPAPSKPGESQESQGTPGELPSTWSFCPF

SEQ ID NO: 8614 - protein, 266 aa, Homo sapiens
MVKVTFNSALAQKEAKKDEPKSGEEALIIPPDAVAVDCKDPDDVVPVGQRRAWCWCMCFGLAFMLAGVILGGAYLYKYFALQPDDVYYCGIKYIKDDVILNEPSADAPAALYQTIEENIKIFEEEEVEFISVPVPEFADSDPANIVHDFNKKLTAYLDLNLDKCYVIPLNTSIVMPPRNLLELLINIKAGTYLPQSYLIHEHMVITDRIENIDHLGFFIYRLCHDKETYKLQRRETIKGIQKREASNCFAIRHFENKFAVETLICS

SEQ ID NO: 8615 - protein, 33 aa, Homo sapiens
IEWSGYNKPERKGPLALFLVFLFLDTPPLQGDL

SEQ ID NO: 8616 - protein, 31 aa, Homo sapiens
YEGSRSSTHTCRQTLALYSFSTPFMILIILT

SEQ ID NO: 8617 - protein, 52 aa, Homo sapiens
MNFIWILSRLILEASCYDFLFLFLGSTTLYSQLTAAFRPGLQLLSSRKCVPV

SEQ ID NO: 8618 - protein, 45 aa, Homo sapiens
MLRKYMPETSVHCLALTVLVETHSQTKPTAAFLWSQFMFLILSFQ

SEQ ID NO: 8619 - protein, 78 aa, Homo sapiens [sequence omitted]

SEQ ID NO: 8620 - protein, 195 aa, Homo sapiens
MRSRIREFDSSTLNESVRNTIMRDLKAVGKKFMHVLYPRKSNTLLRDWDLWGPLILCVTLALMLQRDSADSEKDGGPQFAEVFVIVWFGAVTITLNSKLLGGNISFFQSLCVLGYCILPLTVAMLICRLVLLADPGPVNFMVRLFVVIVMFAWSIVASTAFLADSQPPNRRALAVYPVFLFYFVISWMILTFTPQ

SEQ ID NO: 8621 - protein, 86 aa, Homo sapiens
MLKTWFFVMAVIGVIIPTVFDQSSRLCLKETGFVQNVDQSNVLEDSPLDRDHPWKVMKMWKTVWEVRMMKLMAMKKKVKVRRKSMR

SEQ ID NO: 8622 - protein, 105 aa, Homo sapiens
  SITE (89): Xaa equals any amino acid
MGPALMVASLCLGGPAPAVGAITPSPFITSLRWAPSPAGCLPSGNSRTLRDTRAAWPRGATARPPGGQPWRELRPTYSGVWEPCLYLGXSPSQLPPCVFPPAKVG

SEQ ID NO: 8623 - protein, 109 aa, Homo sapiens [sequence omitted]

SEQ ID NO: 8624 - protein, 28 aa, Homo sapiens
  SITE (7): Xaa equals any amino acid
MSILLLXFPSAPAPVVSGGLQPWLHSCI

SEQ ID NO: 8625 - protein, 52 aa, Homo sapiens
  SITE (51): Xaa equals any amino acid
MDICSPVALYFLLTAAHITAVSKPTVMLRERPCSGPSRSAPQSRLIGPWDXC

SEQ ID NO: 8626 - protein, 64 aa, Homo sapiens
MVLLLWRLFFPVGLMRIAQPLGHLIKHRETYSLRHWCLHTQVMLGHGDETAPLLIFLKKPSCHI

SEQ ID NO: 8627 - protein, 21 aa, Homo sapiens
MGTSLNLQIMALFSGQAMAPR

SEQ ID NO: 8628 - protein, 51 aa, Homo sapiens
MRKSGAMKKGGIFSAEFLKVFIPSLFLSHVLALGLGIYIGKRLSTPSASTY

SEQ ID NO: 8629 - protein, 119 aa, Homo sapiens [sequence omitted]

SEQ ID NO: 8630 - protein, 405 aa, Homo sapiens
  SITE (273): Xaa equals any amino acid
MLLLWVSVVAALALAVLAPGAGEQRRRAAKAPNVVLVVSDSYDGRLTFHPGSQVVKLPFINFMKTRGTSFLNAYTNSPICCPSRAAMWSGLFTHLTESWNNFKGLDPNYTTWMDVMERHGYRTQKFGKLDYTSGHHSISNRVEAWTRDVAFLLRQEGRPMVNLIRNRTKVRVMERDWQNTDKAVNWLRKEAINYTEPFVIYLGLNLPHPYPSPSSGENFGSSTFHTSLYWLEKVSHDAIKIPKWSPLSEMHPVDYYSSYTKNCTGRFTKKEIXNIRAFYYAMCAETDAMLGEIILALHQLDLLQKTIVIYSSDHGELAMEHRQFYKMSMYEASAHVPLLMMGPGIKAGLQVSNVVSLVDIYPTMLDIAGIPLPQNLSGYSSLPLSSETFKNEHKVKNLHPPWITE

SEQ ID NO: 8631 - protein, 234 aa, Homo sapiens
MAALLLLPLLLLLPLLLLKLHLWPQLRWLPADLAFAVRALCCKRALRARALAAAAADPEGPEGGCSLAWRLAELAQQRAAHTFLIHGSRRFSYSEAERESNRAARAFLRALGWDWGPDGGDSGEGSAGEGERAAPGAGDAAAGSGAEFAGGDGAARGGGAAAPLSPGATVALLLPAGPEFLWLWFGLAKAGCALPLCPPPCAGAPCCTASAAAARARWCWRQSFWSPWSRTCPP

SEQ ID NO: 8632 - protein, 486 aa, Homo sapiens
MGPLSPARTLRLWGPRSLGVALGVFMTIGFALQLLGGPFQRRLPGLQLRQPSAPSLRPALPSCPPRQRLVFLKTHKSGSSSVLSLLHRYGDQHGLRFALPARYQFGYPKLFQASRVKGYRPQGGGTQLPFHILCHHMRFNLKEVLQVMPSDSFFFSIVRDPAALARSAFSYYKSTSSAFRKSPSLAAFLANPRGFYRPGARGDHYARNLLWFDFGLPFPPEKRAKRGNIHPPRDPNPPQLQVLPSGAGPRAQTLNPNALIHPVSTVTDHRSQISSPASFDLGSSSFIQWGLAWLDSVFDLVMVAEYFDESLVLLADALCWGLDDVVGFMHNAQAGHKQGLSTVSNSGLTAEDRQLTARARAWNNLDWALYVHFNRSLWARIEKYGQGRLQTAVAELRARREALAKHCLVGGEASDPKYITDRRFRPFQFGSAKVLGYILRSGLSPQDQEECERLATPELQYKDKLDAKQFPPTVSLPLKTSRPLSP

SEQ ID NO: 8633 - protein, 950 aa, Homo sapiens; identical to SEQ ID NO: 6194

SEQ ID NO: 8634 - protein, 628 aa, Homo sapiens
MGSCARLLLLWGCTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPYDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTCKCNGHADTCHFDVNVWEASGNRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSGKCECKEQTLGNAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 8635 - protein, 60 aa, Homo sapiens
MLGSIPKLWSVLSFSINFCFCCFILSLLCLSVLSNYLFKTPRTWTPSTGNTLTIMQLCSA

SEQ ID NO: 8636 - protein, 41 aa, Homo sapiens
  SITE (40): Xaa equals any amino acid
MQLIQLITLTITQVLFLDTIMSTYVADTDYVVLPVSSHKXF

SEQ ID NO: 8637 - protein, 643 aa, Homo sapiens
MGEPNRHPSMFLLLLVLERLYASPMDGTSSALSMGPFVPFIMRCGHSPVYHSREMAARALVPFVMIDHIPNTIRTLLSTLPSCTDQCFRQNHIHGTLLQVFHLLQAYSDSKHGTNSDFQHELTDITVCTKAKLWLAKRQNPCLVTRAVYIDILFLLTCCLNRSAKDNQPVLESLGFWEEVRGIISGSELITGFPWAFKVPGLPQYLQSLTRLAIAAVWAAAAKSGERETNVPISFSQLLESAFPEVRSLTLEALLEKFLAAASGLGEKGVPPLLCNMGEKFLLLAMKENHPECFCKILKILHCMDPGEWLPQTEHCVHLTPKEFLIWTMDIASNERSEIQSVALRLASKVISHHMQTCVENRELIAAELKQWVQLVILSCEDHLPTESRLAVVEVLTSTTPLFLTNPHPILELQDTLALWKCVLTLLQSEEQAVRDAATETVTTAMSQENTCQSTEFAFCQVDASIALALALAVLCDLLQQWDQLAPGLPILLGWLLGESDDLVACVESMHQVEEDYLFEKAEVNFWAETLIFVKYLCKHLFCLLSKSGWRPPSPEMLCHLQRMVSEQCHLLSQFFRELPPAAEFVKTVEFTRLRIQEERTLACLRLLAFLEGKEGEDTLVLSVWDSYAESRQLTLPRTEAAC

SEQ ID NO: 8638 - protein, 43 aa, Homo sapiens
MYFFFFLTFLALWVMGTTAMASPFFMGYQLQYGPQCCSGHFND

SEQ ID NO: 8639 - protein, 142 aa, Homo sapiens
  SITE (90): Xaa equals any amino acid
MSIPMVSVLLCQAPLLIQVALPRTVAIRKKRLCLVDSILQTWHLFNFFLVGFIFQSIFRFTAKLSESTEISHLFFAPTQAKPHLLPISPXQRGTFVIINKPTMTHCYHPKSIVYIRVHSLFVLYILWVLTNVITCIYNYRNM

SEQ ID NO: 8640 - protein, 48 aa, Homo sapiens
MCGIFSILCIKIFFLILQLFFYFPLYNCIFNTSISILNRVLVKKRSTF

SEQ ID NO: 8641 - protein, 86 aa, Homo sapiens
MSFRSELAMWFQAALVSSLVLPTPPGSGGTSRRKKWIKSWRDFKQYLTHSSRHDSHQLRSSNAFLFDAQEGPSAVDIAKDEIQRQR

SEQ ID NO: 8642 - protein, 43 aa, Homo sapiens
MLSALSALYLIITIFLKGSCCSCHHCFTNGKLWLRKFISGSQP

SEQ ID NO: 8643 - protein, 102 aa, Homo sapiens
MSNTTVPNAPQANSDSMVGYVLGPFFLITLVGVVVAVVMYVQKKKRVDRLRHHLLPMYSYDPAEELHEAEQELLSDMGDPKVVHGWQSGYQHKRMPLLDVKT

SEQ ID NO: 8644 - protein, 44 aa, Homo sapiens
MRFFFQAYSQICVQNFLTFLLCIIIEFIAADFYNDSCCHVSLNN

SEQ ID NO: 8645 - protein, 59 aa, Homo sapiens
MENQMLTCVAIFVLFCFVLFLRQGLALSPRLECSGMIRAYCSLTLDFLGSSNPPTSAPK

SEQ ID NO: 8646 - protein, 253 aa, Homo sapiens
MDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIATGILHLLAGLCTLGSVSCYVAGIELLHQKLELPDNVSGEFGWSFCLACVSAPLQFMASALFIWAAHTNRKEYTLMKAYRVA

SEQ ID NO: 8647 - protein, 720 aa, Homo sapiens
MELGCWTQLGLTFLQLLLISSLPREYTVINEACPGAEWNIMCRECCEYDQIECVCPGKREVVGYTIPCCRNEENECDSCLIHPGCTIFENCKSCRNGSWGGTLDDSYVKGFYCAECRAGWYGGDCMRCGQVLRAPKGQILLESYPLNAHCEWTIHAKPGFVIQLRFGMLSLEFDYMCQYDYVEVRDGDNRDGQIIKRVCGNERPAPIQSIGSSLHVLFHSDGSKNFDGFHAIYEEITACSSSPCFHDGTCVLDKAGSYKCACLAGYTGQRCENLLEERNCSDPGGPVNGYQKITGGPGLINGRHAKIGTVVSFFCNNSYGLSGNEKRTCQQNGEWSGKQPICIKACREPKISDLVRRRVLPMQVQSRETPLHQLYSAAFSKQKLQSAPTKKPALPFGDLPMGYQHLHTQLQYECISPFYRRLGSSRRTCLRTGKWSGRAPSCIPICGKIENITAPKTQGLRWPWQAAIYRRTSGVHDGSLHKGAWFLVCSGALVNERTVVVAAHCVTDLGKVTMIKTADLKVVLGKFYRDDDRDEKTIQSLQISAIILHPNYDPILLDADIAILKLLDKARISTRVQPICLAASRDLSTSFQESHITVAGWNVLADVRSPGFKNDTLRSGVVSVVDSLLCEEQHEDHGIPVSVTDNMFCASWEPTAPSDICTAETGGIAAVSFPGRASPEPRWHLMGLVSWSYDKTCSHRLSTAFTKVLPFKDWIERNMK

SEQ ID NO: 8648 - protein, 392 aa, Homo sapiens
MLILGSMFSLVEPVLTIAAALSVQSPFTRSAQSSPECAAARRPLESDQGDPFTLFNVFNAWVQVKSERSRNSRKWCRRRGIEEHRLYEMANLRRQFKELLEDHGLLAGAQAAQVGDSYSRLQQRRERRALHQLKRQHEEGAGCRRKVLRLQEEQDGGSSDEDRAGPAPPGASDGVDIQDVKFKLRHDLAQLQAAASSAQDLSREQLALLKLVLGRGLYPQLAVPDAFNSSRKDSDQIFHTQAKQGAVLHPTCVFAGSPEVLHAQELEASNCDGSRDDKDKMSSKHQLLSFVSLLETNKPYLVNCVRIPALQSLLLFSRSLDTNGDCSRLVADGWLELQLADSESAIRLLAASLAASVPAGKVPWTGSWRTRPSSSWRRRRRIRQSAPRRWPP

SEQ ID NO: 8649 - protein, 200 aa, Homo sapiens
MASSLTCTGVIWALLSFLCAATSCVGFFMPYWLWGSQLGKPVSFGTFRRCSYPVHDESRQMMVMVEECGRYASFQGIPSAEWRICTIVTGLGCGLLLLVALTALMGCCVSDLISRTVGRVAGGIQFLGGLLIGAGCALYPLGWDSEEVRQTCGYTSGQFDLGKCEIGWAYYCTGAGATAAMLLCTWLACFSGKKQKHYPY

SEQ ID NO: 8650 - protein, 226 aa, Homo sapiens
MAAMRWRWWQRLLPWRLLQARGFPQNSAPSLGLGARTYSQGDCSYSRTALYDLLGVPSTATQAQIKAAYYRQCFLYHPDRNSGSAEAAERFTRISQAYVVLGSATLRRKYDRGLLSDEDLRGPGVRPSRTPAPDPGSPRTPPPTSRTHDGSRASPGANRTMFNFDAFYQAHYGEQLERERRLRARREALRKRQEYRSMKGLRWEDTRDTAAIFLIFSIFIIIGFYI

SEQ ID NO: 8651 - protein, 44 aa, Homo sapiens
MTYLFCSSISLLLLKVHSSGHQDIRKAKSKVPRLLIIQCPQQRE

SEQ ID NO: 8652 - protein, 126 aa, Homo sapiens
MPIIVLILVSLLSQLMVSNPPYSLYPRSGTGQTIKMQTENLGVVYYVNKDFKNEYKGMLLQKVEKSVEEDYVTNIRNNCWKERQQKTDMQYAAKVYRDDRLRRKADALSMDNCKELERLTSLYKGG

SEQ ID NO: 8653 - protein, 40 aa, Homo sapiens
MWVQLIFFFVQYGDSLTSAFFPFSSNFSLQNSGFSMHKLK

SEQ ID NO: 8654 - protein, 253 aa, Homo sapiens
MVFLWDLLRCESLLGLDPATCSRVLNKNYTLLVSMAPLTNEIRPVSSCTPQHIGPAIPEVSSVWFKLYIYHVTGQGPPSLLLSKGTRLRKLPDIFQSYDRLLITSWGHDPGVVPTSNVLTMLNDALTHSAVLIQGHGLHGIGETVHVPFPFDETELQGEFTRVNMGVHKALQILRNRVDLQHLCGYVTMLNASSQLADRKLSDASDERGEPDLASGSDVNGSTESFEMVIEEATIDSATKQTSGATTEADWVP

SEQ ID NO: 8655 - protein, 31 aa, Homo sapiens
MFIFCVSLAFLPRFISPQSCEWAGLSLVWHH

SEQ ID NO: 8656 - protein, 35 aa, Homo sapiens
MGGQMMNQLITVAFVRWRFLICFLSLMKAILKKPT

SEQ ID NO: 8657 - protein, 76 aa, Homo sapiens
MFCIQQKWLFSFLFYEVGLMGIDSLRKKYNCKSVEVFPSQDVKCQRSDSCGRMGSKLYKSLEMNEVRQLSLRQKTM

SEQ ID NO: 8658 - protein, 60 aa, Homo sapiens
  SITE (14): Xaa equals any amino acid
MFITRGCYCFVFFXLAHNCKAARTTRNGFPTVPGRRQRTLRRLFLCGFPLLCSQGDLSAA

SEQ ID NO: 8659 - protein, 31 aa, Homo sapiens
MVSLIAFSSLGLCLGESPSKIPFTAFFHREG

SEQ ID NO: 8660 - protein, 53 aa, Homo sapiens [sequence omitted]

SEQ ID NO: 8661 - protein, 36 aa, Homo sapiens
MNGLVRPVELNSLLLPVVRYQVAQPQKLLNVFVGGL

SEQ ID NO: 8662 - protein, 159 aa, Homo sapiens
  SITE (109): Xaa equals any amino acid
  SITE (118): Xaa equals any amino acid
  SITE (122): Xaa equals any amino acid
  SITE (127): Xaa equals any amino acid
MTGTYSGQFVMEGFLNLKWSRFARVVLTRSIAIIPTLLVAVFQDVEHLTGMNDFLNVLQSLQLPFALIPILTFTSLRPVMSDFANGLGWRIAGGIWSYHLFHHMYFVVXYVRDLRHVXLYVXAAVVXRGLSGLCVLLGLAMFDCTGHVLPGLWAYGKHL

SEQ ID NO: 8663 - protein, 32 aa, Homo sapiens
MGPKSQTERTSSLMPHQVRERRAHIPQMPMNT

SEQ ID NO: 8664 - protein, 84 aa, Homo sapiens
  SITE (77): Xaa equals any amino acid
MVWFLFLVFIFLKVKGDFFPPFLICNLFCIWMITGVSHRLQPQILFSRHKHNQEIILQMVSFSCCVFFPMIREVKSXLGCIKMS

SEQ ID NO: 8665 - protein, 248 aa, Homo sapiens
  SITE (185): Xaa equals any amino acid
MTSQPVPNETIIVLPSNVINFSQAEKPEPTNQGQDSLKKHLHAEIKVIGTIQILCGMMVLSLGIILASASFSPNFTQVTSTLLNSAYPFIGPFFFIISGSLSIATEKRLTKLLVHSSLVGSILSALSALVGFIILSVKQATLNPASLQCELDKNNIPTRSYVSYFYHDSLYTTDCYTAKASLAGXLSLMLICTLLEFCLAVLTAVLRWKQAYSDFPGSVLFLPHSYIGNSGMSSKMTHDCGYEELLTS

SEQ ID NO: 8666 - protein, 57 aa, Homo sapiens [sequence omitted]

SEQ ID NO: 8667 - protein, 46 aa, Homo sapiens
MSYFSLTYTYTVVYILKSLCISSLHNIYLLIFIFLFSSVHTTEYVL

SEQ ID NO: 8668 - protein, 47 aa, Homo sapiens
MTPQKPALAVLLLEVPLLLTLSVLKKRCLVTCEPTSRFVSCDLPLSV

SEQ ID NO: 8669 - protein, 94 aa, Homo sapiens [sequence omitted]

SEQ ID NO: 8670 - protein, 35 aa, Homo sapiens [sequence omitted]

SEQ ID NO: 8671 - protein, 83 aa, Homo sapiens
MYGVCLCVIVCVSGVSLCLYVWGVSVCDCVSVFMCVCLCVIFCVYGKPRTEHYHSPHLAKQKAFREMCGRHDVSAAGIFQSYV

SEQ ID NO: 8672 - protein, 110 aa, Homo sapiens
MLTFLMLVRLSTLCPSAVLQRLDRLVEPLRATCTTKVKANSVKQEFEKQDELKRSAMRAVAALLTIPEAEKSPLMSEFQSQISSNPELAAIFESIQKDSSSTNLESMDTS

SEQ ID NO: 8673 - protein, 60 aa, Homo sapiens
MHVLLFSFLIPFLLLSPVGVTCNSHMLERQVSWLKKRSTQASQQFNKFLRGISNVGRIVI

SEQ ID NO: 8674 - protein, 25 aa, Homo sapiens
MFLRIIIQVGFPSSIPGQLIKFFCQ

SEQ ID NO: 8675 - protein, 215 aa, Homo sapiens
MVADWLQQSYQAVKEKSSEALEFMKRDLTEFTQVVQHDTACTIAATASVVKEKLAIAACSRGACFLCPFSIQTEGSSGATEKMKKGLSDFLGVISDTFAPSPDKTIDCDVITLMGTPSGTAEPYDGTKARLYSLQSDPATYCNEPDGPPELFDAWLSQFCLEEKKGEISELLVGSPSIRALYTKMVPAAVSHSEFWHRYFYKVHQLEQEQARRTP

SEQ ID NO: 8676 - protein, 52 aa, Homo sapiens
MGRYHFVFLTFFFSTYSSCFYPVVSQVLYLVCSCTADRPLMAPVGSCLGGRN

SEQ ID NO: 8677 - protein, 45 aa, Homo sapiens
MTAFITYPLLFICLPSVSHFLPVPTCLFPCEGLNCEPLRFNVRSP

SEQ ID NO: 8678 - protein, 218 aa, Homo sapiens
MHFLFRFIVFFYLWGLFTAQRQKKEESTEEVKIEVLHRPENCSKTSKKGDLLNAHYDGYLAKDGSKFYCSRTQNEGHPKWFVLGVGQVIKGLDIAMTDMCPGEKRKVVIPPSFAYGKEGYAEGKIPPDATLIFEIELYAVTKGPRSIETFKQIDMDNDRQLSKAEINLYLQREFEKDEKPRDKSYQDAVLEDIFKKNDHDGDGFISPKEYNVYQHDEL

SEQ ID NO: 8679 - protein, 106 aa, Homo sapiens
MALHGFHFDLFHFHLLLFQLLLLTPQCSLLQPALFLRIFLIHDSLLLCSFFLLPPRLCCFLSLHMCQFQEVLFYSGTVLICFLFAFSVESELFGFINRINHHVHQG

SEQ ID NO: 8680 - protein, 85 aa, Homo sapiens
MLHNAFLFVLFALVSGYGNYAATAHDWLYENGQLSRKEADAVLYRALRAEGVARWRAWLMYAGVRLGGAKQYKTPTSSGFSSSGD

SEQ ID NO: 8681 - protein, 97 aa, Homo sapiens
MRDPLNRVLANLFLLISSILGSRTAGPHTQFVQWFMEECVDCLEQGGRGSVLQFMPFTTVSELVKVSAMSSPKVVLAITDLSLPLGRQVAAKAIAAL

SEQ ID NO: 8682 - protein, 21 aa, Homo sapiens
  SITE (17): Xaa equals any amino acid
MITLLIWMLAGFIARIXVALQ

SEQ ID NO: 8683 - protein, 116 aa, Homo sapiens [sequence omitted]

SEQ ID NO: 8684 - protein, 122 aa, Homo sapiens
  SITE (96): Xaa equals any amino acid
MAGAFVAVFLLAMFYEGLKIARESLLRKSQVSIRYNSMPVPGPNGTILMETHKTVGQQMLSFPHLLQTVLHIIQVVISYFLMLIFMTYNGYLCIAXAAGAGTGYFLFSWKKAVVVDITEHCH

SEQ ID NO: 8685 - protein, 24 aa, Homo sapiens
MQGSPLVTAIYKIFLLSLLVRGIC

SEQ ID NO: 8686 - protein, 295 aa, Homo sapiens
MLCCWFPWRILAAGQVPYSPHSPQVAGCDLTRCESGGARALSIQRAALVVLENYYKDFTIYNPNLLTASKFRAAKHMAGLKVYNVDGPSNNATGQSRAMIAAAARRRDSSHNELYYEEAEHERRVKKRKARLVVAVEEAFIHIQRLQAEEQQKAPGEVMDPREAAQAIFPSMARALQKYLRITRQQNYHSMESILQHLAFCITNGMTPKAFLERYLSAGPTLQYDKDRWLSTQWRLVSDEAVTNGLRDGIVFVLKCLDFSLVVNVKKIPFIILSEEFIDPKSHKFVLRLQSETSV

SEQ ID NO: 8687 - protein, 35 aa, Homo sapiens
MGLFNQCDYSDPSLQLVFFLMALFHILFSLTTLIM

SEQ ID NO: 8688 - protein, 69 aa, Homo sapiens
MALFRPILLPAPGAWWWPCHHALCPSGCGFPEQPHSRCSSLELQSASRQCWLQWLGDIRPLLLQGREVT

SEQ ID NO: 8689 - protein, 13 aa, Homo sapiens
MRDHEIWEGPGAE

SEQ ID NO: 8690 - protein, 22 aa, Homo sapiens
MTLMTSIYFFLAIFMSTRSERL

SEQ ID NO: 8691 - protein, 276 aa, Homo sapiens
MESRMWPALLLSHLLPLWPLLLLPLPPPAQGSSSSPRTPPAPARPPCARGGPSAPRHVCVWERAPPPSRSPRVPRSRRQVLPGTAPPATPSGFEEGPPSSQYPWAIVWGPTVSREDGGDPNSANPGFLDYGFAAPHGLATPHPNSDSMRGDGDGLILGEAPATLRPFLFGGRGEGVDPQLYVTITISIIIVLVATGIIFKFCWDRSQKRRRPSGQQGALRQEESQQPLTDLSPAGVTVLGAFGDSPTPTPDHEEPRGGPRPGMPHPKGAPAFQLNR

SEQ ID NO: 8692 - protein, 43 aa, Homo sapiens
VGASTAHGLLLPLLHIHGGSANSSAPHHPNPWPQADRAWSHYL

SEQ ID NO: 8693 - protein, 281 aa, Homo sapiens
MGSRGQGLLLAYCLLLAFASGLVLSRVPHVQGEQQEWEGTEELPSPPDHAERAEEQHEKYRPSQDQGLPASRCLRCCDPGTSMYPATAVPQINITILKGEKGDRGDRGLQGKYGKTGSAGARGHTGPKGQKGSMGAPGERCKSHYAAFSVGRKKPMHSNHYYQTVIFDTEFVNLYDHFNMFTGKFYCYVPGLYFFSLNVHTWNQKETYLHIMKNEEEVVILFAQVGDRSIMQSQSLMLELREQDQVWVRLYKGERENAIFSEELDTYITFSGYLVKHATEP

SEQ ID NO: 8694 - protein, 61 aa, Homo sapiens
MSNLQFHLLPHSSPILPLFTLALLKMQIPGLRLSHCLLTYNSYTRTPFLLPSSESYLVFEI

SEQ ID NO: 8695 - protein, 69 aa, Homo sapiens
MVTIFNIITTTTILPTQTAAAPPSWTPAVCSLSSWPGSPRSWAGPVLRDSARRCAWNSWTTRADPSSAM

SEQ ID NO: 8696 - protein, 33 aa, Homo sapiens
MRLLLPSLLGGLSVLTTSLGSVAGLRNSRAAWW

SEQ ID NO: 8697 - protein, 63 aa, Homo sapiens
MFVTLSILNITIEKDKSTNRFRDVFLQHILVILMPSLTYCLIGQHLCSFTRYVSLCYSRCHSW

SEQ ID NO: 8698 - protein, 273 aa, Homo sapiens
MLFFCGDLLSRSQIFYYSTGMTVGIVASLLIIIFILSKFMPKKSPIYVILVGGWSFSLYLIQLVFKNLQEIWRCYWQYLLSYVLTVGFMSFAVCYKYGPLENERSINLLTWTLQLMGLCFMYSGIQIPHIALAIIIIALCTKNLEHPIQWLYITCRKVCKGAEKPVPPRLLTEEEYRIQGEVETRKALEELREFCNSPDCSAWKTVSRIQSPKRFADFVEGSSHLTPNEVSVHEQEYGLGSIIAQDEIYEEASSEEEDSYSRCPAITQNNFLT

SEQ ID NO: 8699 - protein, 565 aa, Homo sapiens
MRFPSRSQSDTPLGDAVEKWLNDLLCLDCLNITRIVSGCPLPEACELHYVNRDTLFCYHKASEVFLQRLMALYVASHYKNSPNDLQMLSDAPAHHLFCLLPPVPPTQNALPEVLAVIQVCLEGEISRQSILNSLSRGKKASGDLIPWTVSEQFQDPDFGGLSGGRVVRIAVHPDYQGMGYGSRALQLLQMYYEGRFPCLEEKVLETPQEIHTVSSEAVSLLEEVITPRKDLPPLLLKLNERPAERLDYLGVSYGLTPRLLKFWKRAGFVPVYLRQTPNDLTGEHSCIMLKTLTDEDEADQGGWLAAFWKDFRRRFLALLSYQFSTFSPSLALNIIQNRNMGKPAQPALSREELEALFLPYDLKRLEMYSRNMVDYHLIMDMIPAISRIYFLNQLGDLALSAAQSALLLGIGLQHKSVDQLEKEIELPSGQLMGLFNRIIRKVVKLFNEVQEKAIEEQMVAAKDVVMEPTMKTLSDDLDEAAKEFQEKHKKEVGKLKSMDLSEYIIRGDDEEWNEVLNKAGPNASIISLKSDKKRKLEAKQEPKQSKKLKNRETKNKKDMKLKRKK

SEQ ID NO: 8700 - protein, 209 aa, Homo sapiens
  SITE (135): Xaa equals any amino acid
  SITE (143): Xaa equals any amino acid
  SITE (179): Xaa equals any amino acid
  SITE (182): Xaa equals any amino acid
MRSTILLFCLLGSTRSLPQLKPALGLPPTKLAPDQGTLPNQQQSNQVFPSLSLIPLTQMLTLGPDLHLLNPAAGMTPGTQTHPLTLGGLNVQQQLHPHVLPIFVTQLGAQGTILSSEELPQIFTSLIIHSLFPGXILPTSQAXANPDVQDGSLPAGGAGVNPATQGTPAGRLPTPSGTXDDXAVTTPAGIQRSTHAIEEATTESANGIQ

SEQ ID NO: 8701 - protein, 86 aa, Homo sapiens
  SITE (84): Xaa equals any amino acid
MTCCCLLCKLQGIFFFSFNSSVLKSILGTTRTLSAPWIGVSVKGTQWALGSARPGCGSQLTSSLGGLRQVICQPHLQKHDAKLXSV

SEQ ID NO: 8702 - protein, 216 aa, Homo sapiens; identical to SEQ ID NO: 6769

SEQ ID NO: 8703 - protein, 51 aa, Homo sapiens
  SITE (12): Xaa equals any amino acid
MAGVSEISVCFXLLSLFSLFCSFYFPKQATPKRDLFVQESGKGKRNTESWE

SEQ ID NO: 8704 - protein, 378 aa, Homo sapiens; identical to SEQ ID NO: 7067

SEQ ID NO: 8705 - protein, 70 aa, Homo sapiens
MAFCFFIFYLYSFPSISHGDLHKFGVFSWCTHVRRFKVLYASVLLKSTEILLAIQEPFSGSWSYFLLNLS

SEQ ID NO: 8706 - protein, 98 aa, Homo sapiens
  SITE (53): Xaa equals any amino acid
  SITE (56): Xaa equals any amino acid
MLPLYFLQPYLSLVIFIMLRDNWHLLALTCSYSIIWRLSPDTNPSPIAPSRHXQLXVVAIAPLEPSPHSHMQSIPKNLAQFSSSQMFSLTLQLVYISS

SEQ ID NO: 8707 - protein, 45 aa, Homo sapiens
MFKDFIFLTFLPKLSQFVKGSLISGLSECDNTSLKAILGFSNYSQ

SEQ ID NO: 8708 - protein, 88 aa, Homo sapiens
MLFLSASICTSALFLCLSRLTISAPHPAWWGRMPTHTSPGHLLELQPRGMTESILFSISALVSNSWGKMTQLTSGSHSWSSGLQNFQA

SEQ ID NO: 8709 - protein, 31 aa, Homo sapiens
MYILSLSCSIFFSFFFFLFPFFRGLRKGQAK

SEQ ID NO: 8710 - protein, 26 aa, Homo sapiens
MLAVLFFSSYSLGELAHSLGLNCTFI

SEQ ID NO: 8711 - protein, 35 aa, Homo sapiens
MCLSLLLLSLSCLAVPWWPHSVTALQLSPESDHHS

SEQ ID NO: 8712 - protein, 99 aa, Homo sapiens
MTSALTQGLERIPDQLGYLVLSEGAVLASSGDLENDEQAASAISELVSTACGFRLHRGMNVPFKRLSVVFGEHTLLVTVSGQRVFVVKRQNRGREPIDV

SEQ ID NO: 8713 - protein, 57 aa, Homo sapiens
  SITE (51): Xaa equals any amino acid
MKALVGNSPPVGDSGTQPPSALRLCLLKVLRVLSMYLANGERVWRTHKRVXHHVLRG

SEQ ID NO: 8714 - protein, 365 aa, Homo sapiens
MAKVAKDLNPGVKKMSLGQLQSARGVACLGCKGTCSGFEPHSWRKICKSCKCSQEDHCLTSDLEDDRKIGRLLMDSKYSTLTARVKGGDGIRIYKRNRMIMTNPIATGKDPTFDTITYEWAPPGVTQKLGLQYMELIPKEKQPVTGTEGAFYRRRQLMHQLPIYDQDPSRCRGLLENELKLMEEFVKQYKSEALGVGEVALPGQGGLPKEEGKQQEKPEGAETTAATTNGSLSDPSKEVEYVCELCKGAAPPDSPVVYSDRAGYNKQWHPTCFVCAKCSEPLVDLIYFWKDGAPWCGRHYCESLRPRCSGCDEIIFAEDYQRVEDLAWHRKHFVCEGCEQLLSGRAYIVTKGQLLCPTCSKSKRS

SEQ ID NO: 8715 - protein, 145 aa, Homo sapiens
MHYQMSVTLKYEIKKLIYVHLVIWLLLVAKMSVGHLRLLSHDQVAMPYQWEYPYLLSILPSLLGLLSFPRNNISYLVLSMISMGLFSIAPLIYGSMEMFPAAQPSTAMARPTVSSLVFLPFPSCTWCWCWQCKCMPGSCTTARSS

SEQ ID NO: 8716 - protein, 83 aa, Homo sapiens
MASCGLTGASLPPCCCSSFLAALKSMFWGLGSLLWSLVGILSPISSCFCVYTCLTPGSSSLFPRAVTQKLEQSVPTKALWGWM

SEQ ID NO: 8717 - protein, 36 aa, Homo sapiens
MLFLCLLPSLFPPGLPTTHYITSICNQSCYHHCARA

SEQ ID NO: 8718 - protein, 43 aa, Homo sapiens
MLFLHTRLHFPRYTLLICKVLLVVAASVHRPWLRSITGCFFTK

SEQ ID NO: 8719 - protein, 32 aa, Homo sapiens
MLGFFSPIFPHLHLFFPTAYSWRERSRQEFAI

SEQ ID NO: 8720 - protein, 24 aa, Homo sapiens
MLFLFQISSLVGLFSATLLGVFGN

SEQ ID NO: 8721 - protein, 155 aa, Homo sapiens
MFEHFSLFFVCVFQINVFFYTIPLAIKLKEHPIFFMFIQIAVIAIFKSYPTVGDVALYMAFFPVWNHLYRFLRNIFVLTCIIIVCSLLFPVLWHLWIYAGSANSNFFYAITLTFNVGQILLISDYFYAFLRREYYLTHGLYLTAKDGTEAMLVLK

SEQ ID NO: 8722 - protein, 77 aa, Homo sapiens
MFALSILISHCLLIYHMVNVKTPHLSASGKMHGHTSSLPPSLLSSLPSGLLALFVFPFLILLLHAEDLPYYYFGNIE

SEQ ID NO: 8723 - protein, 58 aa, Homo sapiens
MAWRVWCLWGIPPLFCSPGTLSCVCVSFLSPGNGMASEHHPRSIFPLQNDVSSHVCFC

SEQ ID NO: 8724 - protein, 61 aa, Homo sapiens
MSVCVFLDFRLIFWSFCPCSASPSRHFASSSRGGGGGSRNWVGAGASLAASLALYALSPRR

SEQ ID NO: 8725 - protein, 49 aa, Homo sapiens
  SITE (41): Xaa equals any amino acid
  SITE (48): Xaa equals any amino acid
MWVIRVFQKTFLFFVLFWSVHCISDKFGCLWHVCMKREGDXNCLSFSXL

SEQ ID NO: 8726 - protein, 38 aa, Homo sapiens
MVCELAHLDHCILPLSFLVSHCHCMASCHCESWPSLSL

SEQ ID NO: 8727 - protein, 121 aa, Homo sapiens
  SITE (7): Xaa equals any amino acid
  SITE (20): Xaa equals any amino acid
MPSQTEXFAACGGHSLLLVXLPLGLPFCPRAALCDLPFSLPSFPGQARRGGAEKQGAEGRGLQVKPRGQRTFQVSRTAPAAPRSRQPRPPAALPALGFGGRGVAKGRFLCFWCLYMLRIDQ

SEQ ID NO: 8728 - protein, 51 aa, Homo sapiens
MSLEPSTSSFNILLFPAFLRVFGWALGWMPWEYLYLSSKVTNGETGTQRGT

SEQ ID NO: 8729 - protein, 176 aa, Homo sapiens [sequence omitted]

SEQ ID NO: 8730 - protein, 218 aa, Homo sapiens; identical to SEQ ID NO: 5630

SEQ ID NO: 8731 - protein, 464 aa, Homo sapiens
  SITE (35): Xaa equals any amino acid
  SITE (332): Xaa equals any amino acid
  SITE (405): Xaa equals any amino acid
MLALGNNHFIGFVNDSVTKSIVALRLTLVVKVSTXPGESHANDLECSGKGKCTTKPSEATFSCTCEEQYVGTFCEEYDACQRKPCQNNASCIDANEKQDGSNFTCVCLPGYTGELCQSKIDYCILDPCRNGATCISSLSGFTCQCPEGYFGSACEEKVDPCASSPCQNNGTCYVDGVHFTCNCSPGFTGPTCAQLIDFCALSPCAHGTCRSVGTSYKCLCDPGYHGLYCEEEYNECLSAPCLNAATCRDLVNGYECVCLAEYKGTHCELYKDPCANVSCLNGATCDSDGLNGTCICAPGFTGEECDIDINECDSNPCHHGGSCLDQPNGYNXHCPHGWVGANCEIHLQWKSGHMAESLTNMPRHSLYIIIGALCVAFILMLIILIVGICRISRIEYQGSSRPAYXEFYNCRSIDSEFSNAIASIRHARFGKKSRPAMYDVSPIAYEDYSPDDKPLVTLIKTKDL

SEQ ID NO: 8732 - protein, 65 aa, Homo sapiens
MFHCWSLFLYYFSLSLSSYHRKCILLRMKIKEQSRDVPCQGAQQSHPKFHLDHHLPDYPHTNLLP

SEQ ID NO: 8733 - protein, 47 aa, Homo sapiens
MGSCAAFLLAALSLLGVLGGYPGRRAFILPNRRSLRQWLEVSLGPVS

SEQ ID NO: 8734 - protein, 52 aa, Homo sapiens
MQAQISSPRWTSWFSLTAVTLAFPSLIPYPSCGIPVLTQDAKWPSDYTSPDS

SEQ ID NO: 8735 - protein, 199 aa, Homo sapiens
  SITE (4): Xaa equals any amino acid
  SITE (193): Xaa equals any amino acid
MVLXVVTLGLALFTLCGKFKRWKLNGAFLLITAFLSVLIWVAWMTMYLFGNVKLQQGDAWNDPTLAITLAASAGSSSSSTPSLRSTAPFCQPCRRTRPTTSTRRSPGCGRRPSRRTCSCRGPIWRTRPSPWMNTMQLSEQQDFPTAAWEKDPVAAWGKDPALRLEATCISQLRWPSCSTVGPSQLLRQVTQEXTFGERL

SEQ ID NO: 8736 - protein, 220 aa, Homo sapiens
  SITE (170): Xaa equals any amino acid
MATVRASLRGALLLLLAVAGVAEVAGGLAPGSAGALCCNHSKDNQMCRDVCEQIFSSKSESRLKHLLQRAPDYCPETMVEIWNCMNSSLPGVFKKSDGWVGLGCCELAIALECRQACKQASSKNDISKVCRKEYENALFSCISRNEMGSVCCSYAGHHTNCREYCQAIFXTDSSPGPSQIKAVENYCASISPQLIHCVNNYTQSYPMRNPTDSRSVLSDI

SEQ ID NO: 8737 - protein, 547 aa, Homo sapiens
MAMGLFRVCLVVVTAIINHPLLFPRENATVPENEEEIIRKMQAHQEKLQLEQLRLEEEVARLAAEKEALEQVAEEGRQQNETRVAWDLWSTLCMILFLMIEVWRQDHQEGPSPECLGGEEDELPGLGGAPLQGLTLPNKATLGHFYERCIRGATADAARTREFLEGFVDDLLEALRSLCNRDTDMEVEDFIGVDSMYENWQVDRPLLCHLFVPFTPPEPYRFHPELWCSGRSVPLDRQGYGQIKVVRADGDTLSCICGKTKLGEDMLCLLHGRNSMAPPCGDMENLLCATDSLYLDTMQVMKWFQTALTRAWKGIAHKYEFDLAFGQLDSPGSLKIKFRSGKFMPFNLIPVIQCDDSDLYFVSHLPREPSEGTPASSTDWLLSFAVYERHFLRTTLKALPEGACHLSCLQIASFLLSKQSRLTGPSGLSSYHLKTALLHLLLLRQAADWKAGQLDARLHELLCFLEKSLLQKKLHHFFIGNRKVPEAMGLPEAVLRAEPLNLFRPFVLQRSLYRKTLDSFYEMLKNAPALISEYSLHVPSDQPTPKS

SEQ ID NO: 8738 - protein, 121 aa, Homo sapiens
MRAARAAPLLQLLLLLGPWLEAAGVAESPLPAVVLAILARNAEHSLPHYLGALERLDYPRARMALWCATDHNVDNTTEMLQEWLAAVGDDYAAVVWRPEGEPSSTQMKRVPSTGPKKGTSF

SEQ ID NO: 8739 - protein, 401 aa, Homo sapiens
  SITE (307): Xaa equals any amino acid
MMGLGNGRRSMKSPPLVLAALVACIIVLGFNYWIASSRSVDLQTRIMELEGRVRRRAAERGAVELKKNEFQGELEKQREQLDKIQSSHNFQLESVNKLYQDEKAVLVNNITTGERLIRVLQDQLKTLQRNYGRLQQDVLQFQKNQTNLERKFSYDLSQCINQMKEVKEQCEERIEEVTKKGNEAVASRDLSENNDQRQQLQALSEPQPRLQAAGLPHTEVPQGKGNVLGNSKSQTPAPSSEVVLDSKRQVEKEETNEIQVVNEEPQRDRLPQEPGREQVVEDRPVGGRGFGGAGELGQTPQVQAALXVSQENPEMEGPERDQLVIPDGQEEEQEAAGEGRNQQKLRGEDDYNMDENEAESETDKQAALAGNDRNIDVFNVEDQKRDTINLLDQREKRNHTL

SEQ ID NO: 8740 - protein, 47 aa, Homo sapiens
MGIMLLSYSNGTVLFIFVPQITSSVLSVFCIVFVQDSLGFISVISAF

SEQ ID NO: 8741 - protein, 65 aa, Homo sapiens
  SITE (27): Xaa equals any amino acid
MGKGHQRPWWKVLPLSCFLVALIIWCXLREESEADQWLRQVWGEVPEPSDRSEEPETPAAYRART

SEQ ID NO: 8742 - protein, 54 aa, Homo sapiens [sequence omitted]

SEQ ID NO: 8743 - protein, 385 aa, Homo sapiens
MLDKIISIFIIFLLVIGTLLLALLLTAKVHQESVHMIEVTSNLINETLANHPEWANWLPEAQVVQRALNSAANNVYQYGREWITHKLHKILGDKVNNTAVIEKQVLELWDRLYHSWFVKNVTHSGRHKGQKLHVSRQNSWLGDILDWQDIVSFVHENIETFLSILESLWIVMSRNVSLLFTTVTTLLTILFYSGTALLNFVLSLIIFLTTLFYLLSSSDEYYKPVKWVISLTPLSQPGPSSNIIGQSVEEAIRGVFDASLKMAGFYGLYTWLTHTMFGINIVFIPSALAAILGAVPFLGTYWAAVPAVLDLWLTQGLGCKAILLMIFHLLPTYFVDTAIYSDISGGGHPYLTGLAVAGGSILPRPGRSNHRSYSSLHTCGCFQYL

SEQ ID NO: 8744 - protein, 88 aa, Homo sapiens
  SITE (18): Xaa equals any amino acid
  SITE (63): Xaa equals any amino acid
MSTYLKMFAASLLAMCAXAEVVHRYYRPDLMRNRLRRVKLISQSHIALVRRFEDLKPKLSVCXTGITSLSVGELEVWAESSRGDLMTA

SEQ ID NO: 8745 - protein, 335 aa, Homo sapiens
MAGSPTCLTLIYILWQLTGSAASGPVKELVGSVGGAVTFPLKSKVKQVDSIVWTFNTTPLVTIQPEGGTIIVTQNRNRERVDFPDGGYSLKLSKLKKNDSGIYYVGIYSSSLQQPSTQEYVLHVYEHLSKPKVTMGLQSNKNGTCVTNLTCCMEHGEEDVIYTWKALGQAANESHNGSILPISWRWGESDMTFICVARNPVSRNFSSPILARKLCEGAADDPDSSMVLLCLLLVPLLLSLFVLGLFLWFLKRERQEEYIEEKKRVDICRETPNICPHSGENTEYDTIPHTNRTILKEDPANTVYSTVEIPKKMENPHSLLTMPDTPRLFAYENVI

SEQ ID NO: 8746 - protein, 199 aa, Homo sapiens
MKSGLWYFFLFCLRIKVLTGEINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLKFWLPIGCAAFVVVCILGCILICWLTKKKYSSSVHDPNGEYMFMRAVNTAKKSRLTDVTL

SEQ ID NO: 8747 - protein, 187 aa, Homo sapiens
MVLLWVVTCPATMLTEPQNPHLIGFVAYSGPSHTTQPHKYWLLLDGQADPAAAEGPVKRKAASVVWWPQALRHLSLLVHCWEESYEMNIGCQSLWAGGLASSGNGWDLGVAFRRDTCMSSSSLHWKEFKYAPGSLHYFALSFVLILTEICLVSSGMGFPQEGKHFSVLGSPDCSLWGRDEHVPREFA

SEQ ID NO: 8748 - protein, 288 aa, Homo sapiens
  SITE (63): Xaa equals any amino acid
  SITE (256): Xaa equals any amino acid
MPAHRFVLAVGSAVFNAMFNGGMATTSTEIELPDVEPAAFLALLKFLYSDEVQIGPETVMTTXYTAKKYAVPALEAHCVEFLKKNLRADNAFMLLTQARLFDEPQLASLCLENIDKNTADAITAEGFTDIDLDTLVAVLERDTLGIREVRLFNAVVRWSEAECQRQQLQVTPENRRKVLGKALGLIRFPLMTIEEFAAGPAQSGILVDREVVSLFCTSPSTPSHEWSSLTGPAAACVGRSAASTASSRWRVAGATXGPVTASGSQSTSASSWWDLGCMDPSTGPPTTK

SEQ ID NO: 8749 - protein, 55 aa, Homo sapiens
MVAVCWCLALTAKVSASCSYMKLRPWPADPWQCWAWTWLPQPCCPATTQTLAWCS

SEQ ID NO: 8750 - protein, 156 aa, Homo sapiens
MQASLWEPPRSGLPLWAEGLTFFYCYMLLLVLPCVALSEVSMQGEHIAPQKMMLYPVLSLATVNVVAVLARAANMALFRDSRVSAIFVGKNVVALATKACTFLEYRRQVRDFPPPALSLELQPPPPQRNSVPPPPPLHGPPGRPHMSSPTRDPLDT

SEQ ID NO: 8751 - protein, 306 aa, Homo sapiens
MAVARLAAVAAWVPCRSWGWAAVPFGPHRGLSVLLARIPQRAPRWLPACRQKTSLSFLNRPDLPNLAYKKLKGKSPGIIFIPGYLSYMNGTKALAIEEFCKSLGHACIRFDYSGVGSSDGNSEESTLGKWRKDVLSIIDDLADGPQILVGSSLGGWLMLHAAIARPEKVVALIGVATAADTLVTKFNQLPVELKKEVEMKGVWSMPSKYSEEGVYNVQYSFIKEAEHHCLLHSPIPVNCPIRLLHGMKDDIVPWHTSMQVADRVLSTDVDVILRKHSDHRMREKADIQLLVYTIDDLIDKLSTIVN

SEQ ID NO: 8752 - protein, 311 aa, Homo sapiens
MNSVVSLLLILEPDKQEALIESLCEKLVKFREGERPSLRLQLLSNLFHGMDKNTPVRYTVYCSLIKVAASCGAIQYIPTELDQVRKWISDWNLTTEKKHTLLRLLYEALVDCKKSDAASKVMVELLGSYTEDNASQARVDAHRCIVRALKDPNAFLFDHLLTLKPVKFLEGELIHDLLTIFVSAKLASYVKFYQNNKDFIDSLGLLHEQNMAKMRLLTFMGMAVENKEISFDTMQQELQIGADDVEAFVIDAVRTKMVYCKIDQTQRKVVVSHSTHRTFGKQQWQQLYDTLNAWKQNLNKVKNSLLSLSDT

SEQ ID NO: 8753 - protein, 43 aa, Homo sapiens
MYKITYRVCFLCQPLMVGLGCIGSIAIVLLLLLLVPHVCPKIL

SEQ ID NO: 8754 - protein, 63 aa, Homo sapiens
MKHVLNLYLLGVVLTLLSIFVRVMESLEGLLESPSPGTSWTTRSQLANTEPTKGLPDHPSRSM

SEQ ID NO: 8755 - protein, 176 aa, Homo sapiens [sequence omitted]

SEQ ID NO: 8756 - protein, 84 aa, Homo sapiens
MGLRLPPPLCWFLCLTSTGQVPMAQARAGVQGPMDGRMPSNGCLPVSPRTPYGMPYLGALWPCWPCSWQGRSTSRHPCQQDLSG

SEQ ID NO: 8757 - protein, 65 aa, Homo sapiens
MWVLLSCPLPPLCLPASAVPGQCLGGQWSGHQLRLRGRGWHCRCHCRAWAADMGRGLHSCQLLSR

SEQ ID NO: 8758 - protein, 46 aa, Homo sapiens
MSGGEGAALPILLLLLALRGTFHGARPGGGASGIWCLLLPEQEPPV

SEQ ID NO: 8759 - protein, 183 aa, Homo sapiens
MICSGFFGWWWWWCFLMGLSGFHQTHFPAAVWSGPENTKPPDPRPTPTHHPASAALSQDSHGNEGIHLLPDTHWALRPSQGPHNGPQRRGPTTCWIFPGKGVRGWRGRAVRLFPAPSPICTLVARVSQRGHPCPRTLSPSSAPCFLILKLQGGWEDSNGNGSKDTLRNCGLPDKESKRLGLQA

SEQ ID NO: 8760 - protein, 47 aa, Homo sapiens [sequence omitted]

SEQ ID NO: 8761 - protein, 210 aa, Homo sapiens
MAVMCVAGLFFIPVAGLTGFHVVLVARGRTTNEQVTGKFRGGVNPFTNGCCNNVSRVLCSSPAPRYLGRPKKEKTIVIRPPFLRPEVSDGQITVKIMDNGIQGELRRTKSKGSLEITESQSADAEPPPPPKPDLSRYTGLRTHLGLATNEDSSLLAKDSPPTPTMYKYRPGYSSSSTSAAMPHSSSAKVLSTLRGGVITCQLARHSGSFL

SEQ ID NO: 8762 - protein, 967 aa, Homo sapiens
MAARGRGLLLLTLSVLLAAGPSAAAAKLNIPKVLLPFTRATRVNFTLEASEGCYRWLSTRPEVASIEPLGLDEQQCSQKAVVQARLTQPARLTSIIFAEDITTGQVLRCDAIVDLIHDIQIVSTTRELYLEDSPLELKIQALDSEGNTFSTLAGLVFEWTIVKDSEADRFSDSHNALRILTFLESTYIPPSYISEMEKAAKQGDTILVSGMKTGSSKLKARIQEAVYKNVRPAEVRLLILENILLNPAYDVYLMVGTSIHYKVQKIRQGKITELSMPSDQYELQLQNSIPGPEGDPTRPVAVLAQDTSMVTALQLGQSSLVLGHRSIRMQGASRLPNSTIYVVEPGYLGFTVHPGDRWVLETGRLYEITIEVFDKFSNKVYVSDNIRIETVLPAEFFEVLSSSQNGSYHRIRALKRGQTAIDAALTSVVDQDGGVHILQVPVWNQQEVEIHIPITLYPSILTFPWQPKTGAYQYTIRAHGGSGNFSWSSSSHLVATVTVKGVMTTGSDIGFSVIQAHDVQNPLHFGEMKVYVIEPHSMEFAPCQVEARVGQALELPLRISGLMPGGASEVVTLSDCSHFDLAVEVENQGVFQPLPGRLPPGSEHCSGVRVKAEAQGSTTLLVSYRHGHVHLSAKITIAAYLPLKAVDPSSVALVTLGSSKEMLFEGGPRPWILEPSKFFQNVTAEDTDSIGLALFAPHSSRNYQQHWILVTCQALGEQVIALSVGNKPSLTNPFPAVEPAVVKFVCAPPSRLTLVPVYTSPQLDMSCPLLQQNKQVVPVSSHRNPLLDLAAYDQEGRRFDNFSSLSIQWESTRPVLASIEPELPMQLVSQDDESGQKKLHGLQAILVHEASGTTAITATATGYQESHLSSARTKQPHDPLVPLSASIELILVEDVRVSPEEVTIYNHPGIQAELRIREGSGYFFLNTSTADVVKVAYQEARGVAMVSLGHRSPLLVFIPYLGCCVVN

SEQ ID NO: 8763 - protein, 42 aa, Homo sapiens
MSSPCLFLSLTENIFMSFLIAGFGLFIIMFINTFDSTVRNVG

SEQ ID NO: 8764 - protein, 40 aa, Homo sapiens
MKNNTQKRLFLWGELLLQDLALILYLSIFLKSTLTNLNLF

SEQ ID NO: 8765 - protein, 761 aa, Homo sapiens
  SITE (376): Xaa equals any amino acid
  SITE (380): Xaa equals any amino acid
  SITE (381): Xaa equals any amino acid
  SITE (384): Xaa equals any amino acid
  SITE (463): Xaa equals any amino acid
  SITE (483): Xaa equals any amino acid
  SITE (486): Xaa equals any amino acid
  SITE (490): Xaa equals any amino acid
MALPALGLDPWSLLGLFLFQLLQLLLPTTTAGGGGQGPMPRVRYYAGDERRALSFFHQKGLQDFDTLLLSGDGNTLYVGAREAILALDIQDPGVPRLKNMIPWPASDRKKSECAFKKKSNETQCFNFIRVLVSYNVTHLYTCGTFAFSPACTFIELQDSYLLPISEDKVMEGKGQSPFDPAHKHTAVLVDGMLYSGTMNNFLGSEPILMRTLGSQPVLKTDNFLRWLHHDASFVAAIPSTQVVYFFFEETASEFDFFERLHTSRVARVCKNDVGGEKLLQKKWTTFLKAQLLCTQPGQLPFNVIRHAVLLPADSPTAPHIYAVFTSQWQVGGTRSSAVCAFSLLDIERVFKGKYKELNKETSRWTTYRGPETNPRXGSCXXGPXSDKALTFMKDHFLMDEQVVGTPLLVKSGVEYTRLAVETAQGLDGHSHLVMYLGTTTGSLHKAVVSGDSSAHLVEEIQLXPDPEPVRNLQLAPTQGAVFXGFXGGVXRVPRANCSVYESCVDCVLARDPHCAWDPESRTCCLLSAPNLNSWKQDMERGNPEWACASGPMSRSLRPQSRPQIIKEVLAVPNSILELPCPHLSALASYYWSHGPAAVPEASSTVYNGSLLLIVQDGVGGLYQCWATENGFSYPVISYWVDSQDQTLALDPELAGIPREHVKVPLTRVSGGAALAAQQSYWPHFVTVTVLFALVLSGALIILVASPLRALRARGKVQGCETLRPGEKAPLSREQHLQSPKECRTSASDVDADNNCLGTEVA

SEQ ID NO: 8766 - protein, 109 aa, Homo sapiens
MIKKDKYHKKVFLFGWFFCLFVFFLRLSLSLLPKLECNLGSLQPPPPRFQRFSCLSLLNSWDYRRPPPHLANFCVVSRGGVSSCWPGWSRTPDLMIRLPRPPRVLGLQA

SEQ ID NO: 8767 - protein, 122 aa, Homo sapiens
MYASQWFLTLFTAKFPLCMVFHIIDLLLCEGLNIIFHVALALLKTSKEDLLQADFEGALKFFRVQLPKRYRAEENARRLMEQACNIKVPTKKLKKYEKEYQTMRESQLQQEDPMDRYKFVYL

SEQ ID NO: 8768 - protein, 55 aa, Homo sapiens
MVNEKEARTGSPKSWLLCLALLLIKYVTFCKPYLTKPYFLHLSVLDQLSPGTPLD

SEQ ID NO: 8769 - protein, 74 aa, Homo sapiens
  SITE (7): Xaa equals any amino acid
  SITE (71): Xaa equals any amino acid
MAELLLXVLSVQSAVHEVEANEGGKQSHTPAHRGWNRRAAEVRKARLPLGVTVGPRCRHAVHPSKGGISAXAVL

SEQ ID NO: 8770 - protein, 51 aa, Homo sapiens
MIICLIMFYFIALAGAHKRVVIQLREQLSLESRDKCYLIQKLTEAQRDMRN

SEQ ID NO: 8771 - protein, 37 aa, Homo sapiens
MQEARQQITTVVLPTLAVVVLLIVVFVYVATRPTITE

SEQ ID NO: 8772 - protein, 115 aa, Homo sapiens
MFSIRILSSSAFCSCSFLACSSALSFLIFSSSARRAAVSSSSLSSSKSSSSSSVRGSSASRLAAGIWSNRGFFDTEEEVVCSRVGRSLFFSLAAALSLSSNSLLKSRLRTSSGAS

SEQ ID NO: 8773 - protein, 122 aa, Homo sapiens [sequence omitted]

SEQ ID NO: 8774 - protein, 37 aa, Homo sapiens
MPLDAAKSMVVFNFAILLFFLPDPGMSLDIAKIYFCS

SEQ ID NO: 8775 - protein, 338 aa, Homo sapiens [sequence omitted]

SEQ ID NO: 8776 - protein, 62 aa, Homo sapiens [sequence omitted]

SEQ ID NO: 8777 - protein, 77 aa, Homo sapiens
MSLYKIHLLLYVAVLSSVASSYPEAQHMSPGQVPKFQAVLSVKAGVCMCYQHMIRGRPTQGAVSVAQQSTTFTVAYF

SEQ ID NO: 8778 - protein, 194 aa, Homo sapiens [sequence omitted]

SEQ ID NO: 8779 - protein, 133 aa, Homo sapiens
MGSSGLLSLLVLFVLLANVQGPGLTDWLFPRRCPKIREECEFQERDVCTKDRQCQDNKKCCVFSCGKKCLDLKQDVCEMPKETGPCLAYFLHWWYDKKDNTCSMFVYGGCQGNNNNFQSKANCLNTCKNKRFP

SEQ ID NO: 8780 - protein, 162 aa, Homo sapiens
MKMVAPWTRFYSNSCCLCCHVRTGTILLGVWYLIINAVVLLILLSALADPDQYNFSSSELGGDFEFMDDANMCIAIAISLLMILICAMATYGAYKQRAAGIIPFFCYQIFDFALNMLVAITVLIYPNSIQEYIRQLPPNFPYRDDVMCSESYLFGPYYSSVY

SEQ ID NO: 8781 - protein, 46 aa, Homo sapiens
  SITE (46): Xaa equals any amino acid
MEVVLTVAHPLRERRKRSSVICVYCCLLFCLFYYVVFIDFVKKVNX

SEQ ID NO: 8782 - protein, 65 aa, Homo sapiens
MFLGNSLETLTNRILVSLASVFLLPPRKGAGLCSRQDRRAPHAYTSLPELSPRASGPCLETGLAL

SEQ ID NO: 8783 - protein, 37 aa, Homo sapiens
MNEAPPLSSSSICFILFYFFPLLPPLSSTCFSKGNRH

SEQ ID NO: 8784 - protein, 161 aa, Homo sapiens
MAEASCGVFWLLSLLCCIKEQQFEQVVALLLQSIRLCQDRALLVNNAYQGLASLVKVSELAAFKVVVQEEGGSGLSLIKETYQLHRDDPEVVENVGMLLVHLASYEEILPELVSSSMKALLQEIKERFTSSLELVSCVEKVLLRLEAATSPSPLGGEAAQP

SEQ ID NO: 8785 - protein, 132 aa, Homo sapiens
MRALHFSSRHNKDIALVNLANVLHRAHFSADAAVVVHAALDDSDFFTSYYTLGNIYAMLGEYNHSVLCYDHALQARPGFEQAIKRKHAVLCQQKLEQKLEAQHRSLQRTLNELKEYQKQHDHYLRPGNPRKT

SEQ ID NO: 8786 - protein, 152 aa, Homo sapiens [sequence omitted]

SEQ ID NO: 8787 - protein, 112 aa, Homo sapiens
MMTSSLGLSFLLNLILGMKFTYLIPQNKYIQLFTTILSFFSGVLSLLECKLSTSSCTCLNIHKSDNECKESENSIEDISLPERTAMPRSIVRAHTVNSLNKKVQTRHVTWAL

SEQ ID NO: 8788 - protein, 23 aa, Homo sapiens
MLLHHQLLIVTLHLVLLLATLLV

SEQ ID NO: 8789 - protein, 187 aa, Homo sapiens
  SITE (73): Xaa equals any amino acid
  SITE (92): Xaa equals any amino acid
  SITE (94): Xaa equals any amino acid
  SITE (126): Xaa equals any amino acid
MGTASTGPWAIPTWSPCWGRAGRSSSSKNAYCRPQMTFWLLALRSTSSETSSMLLQCGGTGREGWLSVQPAEXVSTTRVPRDHIVQFLRLLXSXFIRNRADFFRHFIDEEMDIKDFCTHEVEPMAXECDHIQITALSQALSIALQVEYVDEMDTALNHHVFPEAATPSVYLLYKTSHYNILYAADKH

SEQ ID NO: 8790 - protein, 280 aa, Homo sapiens
  SITE (94): Xaa equals any amino acid
  SITE (95): Xaa equals any amino acid
MHSQCQGFFSSLTMLNPLRQLFKLMASLFLSVFTLGLPFALFQYYAYTQFCLPGSARPIPEPLVQLAVDKGYRIAEGNEPPWCFWDVPLIYSYXXDVYWNVGFLKYYELKQVPNFLLAAPVAILVAWATWTYVTTHPWLCLTLGLQRSKNNKTLEKPDLGFLSPQVFVYVVHAAVLLLFGGLCMHVQVLTRFLGSSTPIMYWFPAHLLQDQEPLLRSLKTVPWKPLAEDSPPGQKVPRNPIMGLLYHWKTCSPVTRYILGYFLTYWLLGLLLHCNFLPWT

SEQ ID NO: 8791 - protein, 25 aa, Homo sapiens
MIQVSVPLLTIMIFLLYLQIGPGKL

SEQ ID NO: 8792 - protein, 45 aa, Homo sapiens
MKKIIETVAEGGGELGVHMYLLIFLKFVQAVIPTIEYDYTRHFTM

SEQ ID NO: 8793 - protein, 55 aa, Homo sapiens
MQTCQAIKGSCLSVSLILLCAASTEGFRAPDLFCVLRKSKCLARTQPFFLHPETS

SEQ ID NO: 8794 - protein, 209 aa, Homo sapiens
MCPLWRLLIFLGLLALPLAPHKQPWPGLAQAHRDNKSTLARIIAQGLIKHNAESRIQNIHFGDRLNASAQVAPGLVGWLISGRKHQQQQESSINITNIQLDCGGIQISFHKEWFSANISLEFDLELRPSFDNNIIKMCAHMSIVVEFWLEKDEFGRRDLVIGKCDAEPSSVHVAILTEAIPPKMNQFLYNLKENLQKVLPHMVESQPLA

SEQ ID NO: 8795 - protein, 185 aa, Homo sapiens
  SITE (114): Xaa equals any amino acid
MTLLNLLLQTIFYGVTCLDDVLKRTKGGKDIKFLTAFRDLLFTTLAFPVSTFVFLAFWILFLYNRDLIYPKVLDTVIPVWLNHAMHTFIFPITLAEVVLRPHSYPSKKTGLTLXAAASIAYISRILWLYFETGTWVYPVFAKLSLLGLAAFFSLSYVFIASIYLLGEKLNHWKWGDMRQPRKKRK

SEQ ID NO: 8796 - protein, 41 aa, Homo sapiens
MRLWLQECLCFLLLSSHQGFFHLNLVFICLFLLHPCLLLCK

SEQ ID NO: 8797 - protein, 134 aa, Homo sapiens
MSYKPALFGFLFLLLLLSNWLVKYEHKLTLPEPQQEEEKPKTSENDSKNSKAVNTKEVNRTHACFALQDEILQRLLFSEMKMKVLENQMFIIWNKMNHHGRSSRHRNFPMKKHRMRRHESICPTLSDCTSSSPS

SEQ ID NO: 8798 - protein, 146 aa, Homo sapiens
MKASVVLSLLGYLVVPSGAYILGRCTVAKKLHDGGLDYFEGYSLENWVCLAYFESKFNPMAIYENTREGYTGFGLFQMRGSDWCGDHGRNRCHMSCSALLNPNLEKTIKCAKTIVKGKEGMGAWPTWSRYCQYSDTLARWLDGCKL

SEQ ID NO: 8799 - protein, 353 aa, Homo sapiens
MRLRFWLLIWLLLGFISHQPTPVSFLKTIFWSRNGHDGSMDVQQRAWRSNRSRQKGLRSICMHTKKRVSSFRGNKIGLKDVITLRRHVETKVRAKIRKRKVTTKINRHDKINGKRKTARKQKMFQRAQELRRRAEDYHKCKIPPSARKPLCNWVRMAAAEHRHSSGLPYWLYLTAETLKNRMGRQPPPPTQQHSITDNSLSLKTPPECLLTPLPPSVDDNIKECPLAPLPPSPLPPSVDDNLKECLFVPLPPSPLPPSVDDNLKECLFVPLPPSPLPPSVDDNLKTPPLATQEAEVEKPPKPKRWRVDEVEQSPKPKRQREAEAQQLPKPKRRRLSKLRTRHCTQAWAIRINP

SEQ ID NO: 8800 - protein, 76 aa, Homo sapiens
MFIAIYFKAFHGSFQLCTWLVIMIVILGQSFSALALLTFWLILCCRGCPVHCRVFSSIPDLYLLNARSNTVPPAQL

SEQ ID NO: 8801 - protein, 50 aa, Homo sapiens
MPNVMLTLFVMTLSSASNLGLYFFKFNFECSCMFGTSLLTAKDKLFICIT

SEQ ID NO: 8802 - protein, 213 aa, Homo sapiens
MKGFSWAIVPALTSLGYLIILVVSIFPFWVRLTNEESHEVFFSGLFENCFNAKCWKPRPLSIYIILGRVFLLSAVFLAFVTTFIMMPFASEFFPRTWKQNFVLACISFFTGACAFLALVLHALEIKALRMKLGPLQFSVLWPYYVLGFGIFLFIVAGTICLIQEMVCPCWHLLSTSQSMEEDHGSLYLDNLESLGGEPSSVQKETQVTAETVI

SEQ ID NO: 8803 - protein, 117 aa, Homo sapiens [sequence omitted]

SEQ ID NO: 8804 - protein, 148 aa, Homo sapiens
MTKALLIYLVSSFLALNQASLISRCDLAQVLQLEDLDGFEGYSLSDWLCLAFVESKFNISKINENADGSFDYGLFQINSHYWCNDYKSYSENLCHVDCQDLLNPNLLAGIHCAKRIVSGARGMNNWVEWRLHCSGRPLFYWLTGCRLR

SEQ ID NO: 8805 - protein, 99 aa, Homo sapiens
MSETFLESVNLLLVIPVATTLISWMAPRKKESFQELSRQVVPCQMMLLSTVLPCLTHPRIKKGVLRFPGVTLWLYLRPFQFYQFIPMDHRSLDSQFRMR

SEQ ID NO: 8806 - protein, 59 aa, Homo sapiens
MTSFCEMLKGSAAGCLVLLAFAFYLACSFSHKTKSHSHYALFILQDYLLGNFYYIPLSP

SEQ ID NO: 8807 - protein, 56 aa, Homo sapiens
MWRCIFSMMCFAVLLEGSFSEISLSISSSSLFRGWPRDSVLSDTRLARTLSTDSTF

SEQ ID NO: 8808 - protein, 81 aa, Homo sapiens
MGKPSLLFFGLMASWRTRSQARRTWSTSSRMPGRNVLLRSRKRRSQISSSISWSIALGPVMPWPGLILFLKISRSSTPTRL

SEQ ID NO: 8809 - protein, 212 aa, Homo sapiens
  SITE (54): Xaa equals any amino acid
  SITE (74): Xaa equals any amino acid
  SITE (81): Xaa equals any amino acid
  SITE (101): Xaa equals any amino acid
  SITE (122): Xaa equals any amino acid
MRLRFWLLIWLLLGFISHQPTPVINSLAVYRHRETDFGVGVRDHPGQHGKTPSXQKLDNLIIIIIGFLRRYTFXILFCTSXLCVSFLKTIFWSRNGHDGSXDVQQRAWRSNRSRQKGLRSIXMHTKKRVSSFRGNKIGLKDVITLRRHVETKVRAKIRKRKVTTKINRHNKINGKRKTARKQKMFQRAQELRRRAEDYHKCKVRSFLPAVAG

SEQ ID NO: 8810 - protein, 183 aa, Homo sapiens
MEPEEGTPLWRLQKLPAELGPQLLHKIIDGICGRAYPVYQDYHTVWESEEWMHVLEDIAKFFKAIVGKNLPDEEIFQQLNQLNSLHQETIMKCVKSRKDEIKQALSREIVAISSAQLQDFDWQVKLALSSDKIAALRMPLLSLHLDVKENGEVKPYSIEMSREELQNLIQSLEAANKVVLQLK

SEQ ID NO: 8811 - protein, 384 aa, Homo sapiens
MARALVQLWAICMLRVALATVYFQEEFLDGEHWRNRWLQSTNDSRFGHFRLSSGKFYGHKEKDKGLQTTQNGRFYAISARFKPFSNKGKTLVIQYTVKHEQKMDCGGGYIKVFPADIDQKNLNGKSQYYIMFGPDICGFDIKKVHVILHFKNKYHENKKLIRCKVDGFTHLYTLILRPDLSYDVKIDGQSIESGSIEYDWNLTSLKKETSPAESKDWEQTKDNKAQDWEKHFLDASTSKQSDWNGDLDGDWPAPMLQKPPYQDGLKPEGIHKDVWLHRKMKNTDYLTQYDLSEFENIGAIGLELWQVRSGTIFDNFLITDDEEYADNFGKATWGETKGPEREMDAIQAKEEMKKAREEEEEELLSGKINRHEHYFNQFHRRNEL

SEQ ID NO: 8812 - protein, 90 aa, Homo sapiens
MAVTWRQALLRALCISGVCSQGKWKRFFQSSTAHPSMRWRGRPLARTLSVWTKDAKLCCGHSTDGALRAGRTPVPSSEEAHGLLQPCPGR

SEQ ID NO: 8813 - protein, 92 aa, Homo sapiens
MTSLLEGRMVLCVSCLLLPLLLLLKHFNGLMTPYLAHNVYCPIEYISFFPFHEKNIEYISIWFIFDSFKFIYSRLLCISQIYVLYRAYTLPH

SEQ ID NO: 8814 - protein, 327 aa, Homo sapiens
MLHVTRGVWGSRVRVWPLLPALLGPPRALSSLAAKMGEYRKMWNPREPRDWAQQYRERFIPFSKEQLLRLLIQALYDPINPDRETLDQPSLTDPQRLSNEQEVLRALEPLLAQANFSPLSEDTLAYALVVHHPQDEVQVTVNLDQYVYIHFWALGQRVGQMPLKSSVGSRRVFFTKLPPAERRYFKRVVLAARTKRGHLVLKSFKDTPLEGLEQLLPELKVRTPTLQRALLNLMLVVSGVAIFVNVGMVVLTDLKVATSLLLLLFAIFMGLRASKCRAALNSCTGCSPSKDSWPRGQVEADTQLVLRLPKCVSCLEAESAQRGAAFY

SEQ ID NO: 8815 - protein, 211 aa, Homo sapiens
  SITE (21): Xaa equals any amino acid
  SITE (104): Xaa equals any amino acid
MSGMTLSSTDMYTVSLLLCLXFKKSDPDPGPFQNNLFHNHGTQSQSCMGSKVGDVIPGAARLISETAQRVHTIGQKQKNDQHLRRVQALLSGRQAKGLTSGRWXLRQGWLLVVPPHGEPRPRMFFLFTDVLLMAKPRPPLHLLRSGTFACKALYPMAQCHLSRVFGHSGGPCGGLLSLSFPREKLLLMSTDQEELSRWYHSLTWAISSQKN

SEQ ID NO: 8816 - protein, 71 aa, Homo sapiens
MKSQKSSVAQAGVQWHDFGSLQPPPPGFRRFSHVSLPSGRDCRHTPPCLANFLYFWWRWGFTMLARLVSNS

SEQ ID NO: 8817 - protein, 52 aa, Homo sapiens
MCQNRESVLVLLIESNMFSFYLLFSFYIVFSFFIVLRPLPRNESIKKIGVIF

SEQ ID NO: 8818 - protein, 42 aa, Homo sapiens
MFFLSMFLHIVLLHCGNSFYKICHSWDYAALQESTRFYSNSY

SEQ ID NO: 8819 - protein, 33 aa, Homo sapiens
MIQTFPAYLCLPLFYVLDLALASAPVLSHSALL

SEQ ID NO: 8820 - protein, 78 aa, Homo sapiens
MQQRGAAGSRGCALFPLLGVLFFQVSAPAGYAPLPAGGLGKMVAFPVPGRGVSRKPPHSSGKEGGRERDVGTMSSPPR

SEQ ID NO: 8821 - protein, 50 aa, Homo sapiens
MLNFLLSNSLLLTIVSIVLLFLVLVTCGTVQEDERERERDHSCNFYYSIL

SEQ ID NO: 8822 - protein, 287 aa, Homo sapiens
MSPHPTALLGLVLCLAQTIHTQEEDLPRPSISAEPGTVIPLGSHVTFVCRGPVGVQTFRLERESRSTYNDTEDVSQASPSESEARFRIDSVSEGNAGPYRCIYYKPPKWSEQSDYLELLVKETSGGPDSPDTEPGSSAGPTQRPSDNSHNEHAPASQGLKAEHLYILIGVSVVFLFCLLLLVLFCLHRQNQIKQGPPRSKDEEQKPQQRPDLAVDVLERTADKATVNGLPEKDRETDTSALAAGSSQEVTYAQLDHWALTQRTARAVSPQSTKPMAESITYAAVARH

SEQ ID NO: 8823 - protein, 28 aa, Homo sapiens
MLLDPFILLFCLFSTAAQSCLEFIYIQF

SEQ ID NO: 8824 - protein, 37 aa, Homo sapiens
MLLKSNILMLNLFAANVGANFALTVEKIGMILLNVSG

SEQ ID NO: 8825 - protein, 30 aa, Homo sapiens
MRASQYILFFLQFLGFKLQFQGISSQQQVE

SEQ ID NO: 8826 - protein, 70 aa, Homo sapiens; identical to SEQ ID NO: 7063

SEQ ID NO: 8827 - protein, 66 aa, Homo sapiens
MSNFISITCLVFTILGHLVSLQVAHSSVFEFKTLYVLKTNRYSQSLFRHFCHLSFIRTRKIFLKNN

SEQ ID NO: 8828 - protein, 123 aa, Homo sapiens
  SITE (3): Xaa equals any amino acid
  SITE (65): Xaa equals any amino acid
  SITE (88): Xaa equals any amino acid
  SITE (99): Xaa equals any amino acid
  SITE (100): Xaa equals any amino acid
  SITE (101): Xaa equals any amino acid
MAXHFLLVALQSVPHCPHLLEEEHKLCKVSHFSGVTLVTSRQDSSSYVPVQTLFIHLGPWAWDLXPCTAEDPEAERSLRLCHSHLARXNVSPSQAAEGXXXRGCQHRGSRELTFLSAENEAGI

SEQ ID NO: 8829 - protein, 43 aa, Homo sapiens
MYLSHFHLGIVIMAVAALMEKPVLASFSGIRISCHRTIGKVQV

SEQ ID NO: 8830 - protein, 304 aa, Homo sapiens
MPCLEAVALILLILLVPDPPRGAAETQGEGAVGGFRSSWCEDVRYLGKNWSFVWSTLGVTAMAFVTGALGFWAPKFLLEARVVHGLQPPCFQEPCSNPDSLIFGALTIMTGVIGVILGAEAARRYKKVIPGAEPLICASSLLATAPCLYLALVLAPTTLLASYVFLGLGELLLSCNWAVVADILLSVVVPRCRGTAEALQITVGHILGDAGSPYLTGLISSVLRARRPDSYLQRFRSLQQSFLCCAFVIALGGGCFLLTALYLERDETRAWQPVTGTPDSNDVDSNDLERQGLLSGAGASTEEP

SEQ ID NO: 8831 - protein, 43 aa, Homo sapiens
MIVIAVSLSLFCDVVSSECMSCFTPKFADIVANAYQNESYIFI

SEQ ID NO: 8832 - protein, 24 aa, Homo sapiens
MHIFTILYPISEGFFKIFNFIVFF

SEQ ID NO: 8833 - protein, 91 aa, Homo sapiens
MPALRHPAWPCIFSLLMGISNGYFGSVPMILAAGKVSPKQRELAGNTMTVSYMSGLTLGSAVAYCTYSLTRDAHGSCLHASTANGSILAGL

SEQ ID NO: 8834 - protein, 41 aa, Homo sapiens
MKQFGFGHPIKLLKTKLCRIVFYLVFFVWPQSSVIREATQT

SEQ ID NO: 8835 - protein, 157 aa, Homo sapiens
MSPWLLLLLVVGSWLLARILAWTYAFYNNCRRLQCFPQPPKRNWFWGHLGLITPTEEGLKDSTQMSATYSQGFTVWLGPIIPFIVLCHPDTIRSITNASAAIAPKDNLFIRFLKPWLGEYLQVKGVGDNLAGRVGEVLLLPIVLGCPTRRRDTAEWR

SEQ ID NO: 8836 - protein, 71 aa, Homo sapiens
MLQAASLSLVTWVVCTVWLETTVPPSLPEPPMWPLSSDSSWSLWISTGMAPAPSSSTRSFSVLPEICFCLW

SEQ ID NO: 8837 - protein, 78 aa, Homo sapiens
  SITE (40): Xaa equals any amino acid
MSPPPTALLHQGSKASGNASWPWPWQAPLTRLWAWSKALXLYCRGSMELSSGQKCLSAGTCPCSYSGLRPLTLQCCLP

SEQ ID NO: 8838 - protein, 221 aa, Homo sapiens
  SITE (139): Xaa equals any amino acid
  SITE (140): Xaa equals any amino acid
  SITE (160): Xaa equals any amino acid
  SITE (164): Xaa equals any amino acid
MSLLVLVLSWGSMGLEAATAVGLSDFCSNPDPYVLNLTQEETGLSSDILSYYLLCNRAVSNPFQQRLTLSQRALANIHSQLLGLEREAVPQFPSAQKPLLSLEETLNVTEGNFHQLVALLHCRSLHKDYGAALRGLCEXXLEGLLFLLLFSLLSAGALAXALCXLPRAWALFPPRNPSALCSGSRLSEPLLPAGLEPGSPLRSFPGCRRDPTNPACLGSDH

SEQ ID NO: 8839 - protein, 219 aa, Homo sapiens
  SITE (68): Xaa equals any amino acid
  SITE (87): Xaa equals any amino acid
  SITE (98): Xaa equals any amino acid
MAEIHTPYSSLKKLLSLLNGFVAVSGIILVGLGIGGKCGGASLTNVLGLSSAYLLHVGNLCLVMGCIXVLLGCAGWYGATKESRGTXLFVGDVALEHXFVTLRKNYRGYNEPDDYSTQWNLVMEKLKCCGVNNYTDFSGSSFEMTTGHTYPRSCCKSIGSVSCDGRDVSPNVIHQKGCFHKLLKITKTQSFTLSGSSLGAAVIQLPGILATLLLFIKLG

SEQ ID NO: 8840 - protein, 157 aa, Homo sapiens
  SITE (108): Xaa equals any amino acid
  SITE (156): Xaa equals any amino acid
MSWVGLGRRGHLLLLINPRALAGIRLPSPTGAPAPGPCPPLCTPHCSREHPAGGTGHPAGVWWRRGCYGGSCPMGPVRGILGGLPCREEALRRHHSKPCWRPGGQARXLGSWPLTAGREPPRTASTAPHTSEPTSSFPRFPRSQAWEDLPDAAHHXS

SEQ ID NO: 8841 - protein, 163 aa, Homo sapiens
  SITE (51): Xaa equals any amino acid
  SITE (82): Xaa equals any amino acid
  SITE (89): Xaa equals any amino acid
  SITE (90): Xaa equals any amino acid
  SITE (91): Xaa equals any amino acid
  SITE (163): Xaa equals any amino acid
MSRPTHTPLSPATISPTITVAVFFAVFVAAAAATAVVAVAAATTSSGRRTXDKSPIATQSSVTHIAAKRCHNYTECLSLIRXTRIPTWXXXTTCPSRIPSTHVAAGAGFIRERACLQCGAVGPPGCILASLPPPSLYLSPELRCMPKRVEARSELRLCPPGVX

SEQ ID NO: 8842 - protein, 57 aa, Homo sapiens
  SITE (2): Xaa equals any amino acid
  SITE (39): Xaa equals any amino acid
MXGQSQPWHKHLCIKVLLLCNNSPQTEGWKPPCHRTATXRIQRHLPGLMSVQAGLMP

SEQ ID NO: 8843 - protein, 25 aa, Homo sapiens
MTVLAKRLVLFLGHIFLLLCVRILD

SEQ ID NO: 8844 - protein, 80 aa, Homo sapiens; identical to SEQ ID NO: 6586

SEQ ID NO: 8845 - protein, 50 aa, Homo sapiens
MPGCWVLELVDHWLASLWLVVAVTECAARPEWLFWLCPPSCSMPGGGGDT

SEQ ID NO: 8846 - protein, 68 aa, Homo sapiens [sequence omitted]

SEQ ID NO: 8847 - protein, 148 aa, Homo sapiens
  SITE (61): Xaa equals any amino acid
  SITE (142): Xaa equals any amino acid
MRKIAQCAPGVVELVLIPLRQRLEERQRRRKQGAGSLQELAPQDGSGYMDVGVSQKARGEXVPDPQGGGQLSWDRPPAPRPPAYNRALQGDPSFVLQIAEKEQELLASQETVQVLQMKVRRLEHLLQLKNVRIENLSRRLQXAERKQR

SEQ ID NO: 8848 - protein, 72 aa, Homo sapiens
MQRWVCILEFKENLFQIPSSLVALLNTLFLDILHPQNSLSPHGSFSLSSLSFPPLPVSSLQPFLFLRSLLCR

SEQ ID NO: 8849 - protein, 80 aa, Homo sapiens
  SITE (35): Xaa equals any amino acid
  SITE (52): Xaa equals any amino acid
  SITE (74): Xaa equals any amino acid
MSKGRPKLGSSKGLAGQLWLLTLRLLLGALLVWTXAYVYVVNPTPFEGLVPXLLSRATVWKLRALLDPFLRLKXDGFLPF

SEQ ID NO: 8850 - protein, 180 aa, Homo sapiens
  SITE (24): Xaa equals any amino acid
  SITE (55): Xaa equals any amino acid
  SITE (73): Xaa equals any amino acid
  SITE (177): Xaa equals any amino acid
MWNSPGCRQHAGHLCGLGGGSRAXMSLTTYSTWGRTPVMVLQPCSRLLHHPGSPXPSGQASPRPWKTRKGIQXQTAGELFFVVGGIQRGRCRAVLVRCARSAPQLPELEGVRRLGAQRIPVICKGCRWIPLQCPPVLCGPQQTHGLCDLAGREGSREGRVQSFWGSEAALLLVCPGXGAF

SEQ ID NO: 8851 - protein, 273 aa, Homo sapiens
MVSALCGLCLLGSNDSPASASQVAGTTGLSKSLGLIEGYGGRGKGGLPATLSPAEEEKAKGPHEKYGYNSYLSEKISLDRSIPDYRPTKCKELKYSKDLPQISIIFIFVNEALSVILRSVHSAVNHTPTHLLKEIILVDDNSDEEELKVPLEEYVHKRYPGLVKVVRNQKREGLIRARIEGWKVATGQVTGFFDAHVEFTAGWAEPVLSRIQENRKRVILPSIDNIKQDNFEVQRYENSAHGYSWELWCMYISPPKDWWDAGDPSLPISDRFS

SEQ ID NO: 8852 - protein, 45 aa, Homo sapiens
  SITE (45): Xaa equals any amino acid
MALLLLAVPPVKSFLTKKKKKKNSRGARYPIRPIVSRITIHWPSX

SEQ ID NO: 8853 - protein, 227 aa, Homo sapiens
HELKVGLAQIAAMDISRGNHRDNKAVIRYLPWLYHPPSAMQQGPKEFIECVSHIRLLSWLLLGSLTHNAVCPNASSPCLPIPLDAGSHVADHLIVILIGFPEQSKTSVLHMCSLFHAFIFAQLWTVYCEQSAVATNLQNQNEFSFTAILTALEFWSRVTPSILQLMAHNKVMVEMVCLHVISLMEALQECNSTIFVKLIPMWLPMIQSNIKHLSAGLQFASRLFRTT

SEQ ID NO: 8854 - protein, 205 aa, Homo sapiens
MKTGLVLVVLGHVSFITAALFHGTVLRYVGTPQDAVALQYCVVNILSVTSAIVVITSGIAAIVLSRYLPSTPLRWTVFSSSVACALLSLTCALGLLASIAMTFATQGKALLAACTFGSSELLALAPDCPFDPTRIYSSSLCLWGIALVLCVAENVFAVRCAQLTHQLLELRPWWGKSSHHMMRENPELVEGRDLLSCTSSEPLTL

SEQ ID NO: 8855 - protein, 64 aa, Homo sapiens
MMSFFCFVMGVTVAATFTAIVPRWRLSQKEIGSVLSVWLSRWRENSLRSLVSQSVARSGKVVIR

SEQ ID NO: 8856 - protein, 121 aa, Homo sapiens
SRSSKELPRNERPTDGANKPPGLLEPTSTLVRVKKSAATLGIAIEGGANTRQPLPRIVTIQRGGSAHNCGQLKVGHVILEVNGLTLRGKEHREAARIIAEAFKTKDRDYIDFLVTEFNVML

SEQ ID NO: 8857 - protein, 148 aa, Homo sapiens
METGALRRPQLLPLLLLLCGGCPRAGGCNETGMLERLPLCGKAFADMMGKVDVWKWCNLSEFIVYYESFTNCTEMEANVVGCYWPNPLAQGFITGIHRQFFSNCTVDRVHLEDPPDEVLIPLIVIPVVLTVAMAGLVVWRSKRTDTLL

SEQ ID NO: 8858 - protein, 207 aa, Homo sapiens [sequence omitted]

SEQ ID NO: 8859 - protein, 314 aa, Homo sapiens
  SITE (303): Xaa equals any amino acid
MVKLLVAKILCMVGVFFFMLLGSLLPVKIIETDFEKAHRSKKILSLCNTFGGGVFLATCFNALLPAVREKLQKVLSLGHISTDYPLAETILLLGFFMTVFLEQLILTFRKEKPSFIDLETFNAGSDVGSDSEYESPFMGGARGHALYVEPHGHGPSLSVQGLSRASPVRLLSLAFALSAHSVFEGLALGLQEEGEKVVSLFVGVAVHETLVAVALGISMARSAMPLRDAAKLAVTVSAMIPLGIGLGLGIESAQGVPGSVASVLLQGLAGGTFLFITFLEILAKELEEKSDRLLKVLFLVLGXTVLAGMVFLKW

SEQ ID NO: 8860 - protein, 271 aa, Homo sapiens [sequence omitted]

SEQ ID NO: 8861 - protein, 302 aa, Homo sapiens
MIGISASFSALLEQILCASGHSSGFSGLCGALFITFGILGALALGPYVDRTKHFTEATKIGLCLFSLACVPFALVSQLQGQTLALAATCSLLGLFGFSVGPVAMELAVECSFPVGEGAATGMIFVLGQAEGILIMLAMTALTVRRSEPSLSTCQQGEDPLDWTVSLLLMAGLCTFFSCILAVFFHTPYRRLQAESGEPPSTRNAVGGADSGPGVDRGGAGRAGVLGPSTATPECTARGASLEDPRGPGSPHPACHRATPRAQGPAATDAPSRPGRLAGRVQASRFIDPAGSHSSFSSPWVIT

SEQ ID NO: 8862 - protein, 43 aa, Homo sapiens
MPYPLWQWSVWMLTCAICPPVCARRHLSSLLLSCPKGLGRAST

SEQ ID NO: 8863 - protein, 242 aa, Homo sapiens
MAPGQTPSLCSWLLPLPSTWATTGHVCFSDILQTPDGGQLLLDWAKQPDSSQDPDPTTQPIVLLLPGITGSSQETYVLHLVNQALRDGYQAVVFNNRGCRGEELRTHRAFCASNTEDLETVVNHIKHRYPQAPLLAVGISFGGILVLNHLAQARQAAGLVAALTLSACWDSFETTRSLETPLNSLLFNQPLTAGLCQLVERLSYGKTCRPVQSASLMSATHLWPLDIKTVLPTTKQQALEPR

SEQ ID NO: 8864 - protein, 341 aa, Homo sapiens
MVPAAGALLWVLLLNLGPRAAGAQGLTQTPTEMQRVSLRFGGPMTRSYRSTARTGLPRKTRIILEDENDAMADADRLAGPAAAELLAATVSTGFSRSSAINEEDGSSEEGVVINAGKDSTSRELPSATPNTAGSSSTRFIANSQEPEIRLTSSLPRSPGRSTEDLPGSQATLSQWSTPGSTPSRWPSPSPTAMPSPEDLRLVLMPWGPWHCHCKSGTMSRSRSGKLHGLSGRLRVGALSQLRTEHKPCTYQQCPCNRLREECPLDTSLCTDTNCASQSTTSTRTTTTPFPTIHLRSSPSLPPASPCPALAFWKRVRIGLEDIWNSLSSVFTEMQPIDRNQR

SEQ ID NO: 8865 - protein, 91 aa, Homo sapiens
MGPVSELSIFILLFVFCFVFSLMPDIRRTLHFWLHSLLYPHETDQCLQSSAIPFQVFYVQQKKRASLSSSSHIIKGIAPLLNQSVNHSGPI

SEQ ID NO: 8866 - protein, 86 aa, Homo sapiens [sequence omitted]

SEQ ID NO: 8867 - protein, 152 aa, Homo sapiens
  SITE (37): Xaa equals any amino acid
  SITE (65): Xaa equals any amino acid
  SITE (71): Xaa equals any amino acid
  SITE (74): Xaa equals any amino acid
  SITE (84): Xaa equals any amino acid
MSKSFCHGDIGKALLDIEEGLLCQGTGVVTSKLLLQXVLGHIKHNIRKQFIDIQAGIPQLDAADXSQQKSXGGXCHPHDSGVWXQQAQAGNLAMGELYVYLNKAHASSCVCVCVCVCVCVCSRLEGRAVVLIWFTAALTSWAQAILLPQPPK

SEQ ID NO: 8868 - protein, 179 aa, Homo sapiens
  SITE (143): Xaa equals any amino acid
MAQVLASELSLVAFILLLVMAFSKKWLDLSRSLFYQRWPVDVSNRIHTSAHVMSMGLLHFCKSRSCSDLENGKVTFIFSTLMLFPINIWIFELERNVSIPIGWSYFIGWLVLILYFTCAILCYFNHKSFWSLILSHPSGAVSXSSSFGSVEESPRAQTITDTPITQEGVLDPEQKDTHV

SEQ ID NO: 8869 - protein, 133 aa, Homo sapiens
MFLELSQALLLLGLPRAPTLFPALPEGPTSLGEQWPPQLPPHLGAPPAAEGAVAMVGCGEGRGGKPLCCSPAQSPAQRVRSGGDKEPITTTEVSLILLHSRCFNLTKLKKTAFAMKKKKKKKKKKKKKKKKKK

SEQ ID NO: 8870 - protein, 359 aa, Homo sapiens [sequence omitted]

SEQ ID NO: 8871 - protein, 70 aa, Homo sapiens
  SITE (58): Xaa equals any amino acid
MCSVHVLGSQLLPQVGILIWLRTDPLPCYLHLWVFVVAVRKFVAGENSTPLAGALVSXHVLGCFPPSFLI

SEQ ID NO: 8872 - protein, 35 aa, Homo sapiens
MHITSLVGAGTLMVLLLLILLLECFFVAEALVMRS

SEQ ID NO: 8873 - protein, 92 aa, Homo sapiens
  SITE (18): Xaa equals any amino acid
MAGCLGSYLLVMILILCXAHFFICGNEDNRVLRYNLEQCPSHSKHVINGSSYCYYYYYYYLEDRGSVLFIIPSPALSTVPGTIQTCIWMNDK

SEQ ID NO: 8874 - protein, 48 aa, Homo sapiens
  SITE (44): Xaa equals any amino acid
MKFLSILLDDNNFPLMLMSAPFGCLAFERSMKMRNGALGLEEVXISSV

SEQ ID NO: 8875 - protein, 57 aa, Homo sapiens
MSEWCQPDQILLQFPVLATMSVAFLIQRCFCFWWFVLNAFSIPSGTEKKRIVFKKWL

SEQ ID NO: 8876 - protein, 123 aa, Homo sapiens
  SITE (43): Xaa equals any amino acid
  SITE (73): Xaa equals any amino acid
  SITE (107): Xaa equals any amino acid
FGTRFLANLLLEEDNKFCADCQSKGPRWASWNIGVFICIRCAXIHRNLGVHISRVKSVNLDQWTQVQIQCMQXMGNGKANRLYEAYLPETFRRPQIDPAVEGFIRDXYEKKKYMDRSLGHQCL

SEQ ID NO: 8877 - protein, 42 aa, Homo sapiens
MLLQFTLWVFGAIHFPKCLGIKEELLKCCLQLPPSSTYEKVV

SEQ ID NO: 8878 - protein, 42 aa, Homo sapiens
MYNKLLLTVVTLFCYQIVDFIYSNYIFISINHPPHPPNILVF

SEQ ID NO: 8879 - protein, 69 aa, Homo sapiens [sequence omitted]

SEQ ID NO: 8880 - protein, 60 aa, Homo sapiens [sequence omitted]

SEQ ID NO: 8881 - protein, 47 aa, Homo sapiens
MRLCQRPGLVLALPPQLSFSTARGGDSRMLGLPLGRGTLEGQGDPQL

SEQ ID NO: 8882 - protein, 323 aa, Homo sapiens
MLLLLLLLGSGQGPQQVGAGQTFEYLKREHSLSKPYQGVGTGSSSLWNLMGNAMVMTQYIRLTPDMQSKQGALWNRVPCFLRDWELQVHFKIHGQGKKNLHGDGLAIWYTRNRMQPGPVFGNMDKFVGLGVFVDTYPNEEKQQERVFPYISAMVNNGSLSYDHERDGRPTELGGCTAIVRNLHYDTFLVIRYVKRHLTIMMDIDGKHEWRDCIEVPGVRLPRGYYFGTSSITGDLSDNHDVISLKLFELTVERTPEEEKLHRDVFLPSVDNMKLPEMTAPLPPLSGLALFLIVFFSLVFSVFAIVIGIILYNKWQEQSRKRFY

SEQ ID NO: 8883 - protein, 38 aa, Homo sapiens
MLVVAFGLLVLYILLASSWKRPEPGILTDRQPLLHDGE

SEQ ID NO: 8884 - protein, 278 aa, Homo sapiens [sequence omitted]

SEQ ID NO: 8885 - protein, 60 aa, Homo sapiens
MKWKWIIMKVFIPVFTLSRLSCCLRGGRGGRGGGSGWGGGRGGGSGWEGGRGRHTWCNFC

SEQ ID NO: 8886 - protein, 98 aa, Homo sapiens
MCSVVLLKDCPLFSFSVINGHTLCLRLLLEIADNPEAVDVKDAKGQTPLMLAVAYGHIDAVSLLLEKEANVDTVDILGCTALHRGVCTSFSALVKQFF

SEQ ID NO: 8887 - protein, 51 aa, Homo sapiens
  SITE (34): Xaa equals any amino acid
MGLIAADVNLDLLVQVVPASCLHCGVTIFPFPHXIHQKPVTKRGQTPGQGN

SEQ ID NO: 8888 - protein, 41 aa, Homo sapiens [sequence omitted]

SEQ ID NO: 8889 - protein, 86 aa, Homo sapiens
MVMVFFLTFSGSHGCVPTSQPWKDAEDQVGCVHAVAWVNSALYTVLCPFLGKPKCSFSFDRNESEDLNKQEVKCRAVPVSVSSSML

SEQ ID NO: 8890 - protein, 61 aa, Homo sapiens
MDRVRFRSWLLYPCCVALGQELGLSAPQWLITENGMPALALVGCFEPTAGSGSSWHDVFLP

SEQ ID NO: 8891 - protein, 121 aa, Homo sapiens
MTCFPTRLGLSCPKPAFLLVPLALAQCVVPAGFLGKCCLLGRLMCAECIGTYSWDQPRRREEMEARLDSGRSWASVLYGHRPQLHGEPCTAVACRRVPCCSEGAGPFSSLTDQQLNAVYPG

SEQ ID NO: 8892 - protein, 495 aa, Homo sapiens
MKHLWFFLLLVAAPRWVLSQVELQESGPGLVKPSQTLSLTCSVSGVSMSRGDWSWSWVRQVPGKGLEWIGHIDYTGKTDYKSSLKNQVSISQDTAKNQFFLRVESVTAADTAVYFCARLFESSGYGAWLDPWGPGILVTVSSASPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCPVPSTPPTPSPSTPPTPSPSCCHPRLSLHRPALEDLLLGSEANLTCTLTGLRDASGVTFTWTPSSGKSAVQGPPDRDLCGCYSVSSVLPGCAEPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGKPTHVNVSVVMAEVDGTCY

SEQ ID NO: 8893 - protein, 42 aa, Homo sapiens
MVAPLHLFIPFSWLVRTIGQLLSPVGKALSHRSNQMMPRSWG

SEQ ID NO: 8894 - protein, 143 aa, Homo sapiens
MPDVQGPWHPAHPPIPSAALCLLWPHCLAAPKYARPRCLLVFVLCDRSAWNILLYSVGSKVSGLCSNCSLVPGVVAHTCNPKVPLGLQGCELPCPAEHLIFSKCLSSCATWAHCFLGLSCCWCLHPHPHPSWPAPFLSRWAHV

SEQ ID NO: 8895 - protein, 58 aa, Homo sapiens
MPNQFWKLHILLFLLFFLFPLVQLCIFILISNKEKKNVCTLRKTYIVRHFLWLRSFQV

SEQ ID NO: 8896 - protein, 43 aa, Homo sapiens [sequence omitted]

SEQ ID NO: 8897 - protein, 54 aa, Homo sapiens
MTSPLARLLLPFWCHTLGTMALGTPNPGAMAWGAVGEPNPGAWTVPLGAFLAGR

SEQ ID NO: 8898 - protein, 48 aa, Homo sapiens
MLQYTWLILVFLSSCLSATWFCKVVVAAIGSTVGSSRLHFKRSGQCLR

SEQ ID NO: 8899 - protein, 279 aa, Homo sapiens
MSFNLQSSKKLFIFLGKSLFSLLEAMIFALLPKPRKNVAGEIVLITGAGSGLGRLLALQFARLGSVLVLWDINKEGNEETCKMAREAGATRVHAYTCDCSQKEGVYRVADQVKKEVGDVSILINNAGIVTGKKFLDCPDELMEKSFDVNFKAHLWTYKAFLPAMIANDHGHLVCISSSAGLSGVNGLADYCASKFAAFGFAESVFVETFVQKQKGIKTTIVCPFFIKTGMFEGCTTGCPSLLPILEPKYAVEKIVEAILQEKMYLYMPKLLYFMMFLKR

SEQ ID NO: 8900 - protein, 191 aa, Homo sapiens
MGDHLDLLLGVVLMAGPVFGIPSCSFDGRIAFYRFCNLTQVPQVLNTTERLLLSFNYIRTVTASSFPFLEQLQLLELGSQYTPLTIDKEAFRNLPNLRILDLGSSKIYFLHPDAFQGLFHLFELRLYFCGLSDAVLKDGYFRNLKALTRLDLSKNQIRSLYLHPSFGKLNSLKSIDFSSNQIFLVCEHELE

SEQ ID NO: 8901 - protein, 144 aa, Homo sapiens
  SITE (63): Xaa equals any amino acid
MKLQFPLTFSGTVRPICLPFFDEELTPATPLWIIGWGFTKQNGGKMSDILLQASVQVIDSTRXNADDAYQGEVTEKMMCAGIPEGGVDTCQGDSGGPLMYQSDQWHVVGIVSWGYGCGGPSTPGVYTKVSAYLNWIYNVWKAEL

SEQ ID NO: 8902 - protein, 856 aa, Homo sapiens
  SITE (52): Xaa equals any amino acid
  SITE (190): Xaa equals any amino acid
  SITE (233): Xaa equals any amino acid
  SITE (595): Xaa equals any amino acid
  SITE (683): Xaa equals any amino acid
MDISKGLPGMQGGLHIWISENRKMVPVPEGAYGNFFEEHCYVILHVPQSPKXTQGASSDLHYWVGKQAGAEAQGAAEAFQQRLQDELGGQTVLHREAQGHESDCFCSYFRPGIIYRKGGLASDLKHVETNLFNIQRLLHIKGRKHVSATEVELSWNSFNKGDIFLLDLGKMMIQWNGPKTSISEKARGLXLTYSLRDRERGGGRAQIGVVDDEAKAPDLMQIMEAVLGRRVGXLRAATPSKDINQLQKANVRLYHVYEKGKDLVVLELATPPLTQDLLQEEDFYILDQGGFKIYVWQGRMSSLQERKAAFSRAVGFIQAKGYPTYTNVEVVNDGAESAAFKQLFRTWSEKRRRNQKLGGRDKSIHVKLDVGKLHTQPKLAAQLRMVDDGSGKVEVWCIQDLHRQPVDPKRHGQLCAGNCYLVLYTYQRLGRVQYILYLWQGHQATADEIEALNSNAEELDVMYGGVLVQEHVTMGSEPPHFLAIFQGQLVIFQERAGHHGKGQSASTTRLFQVQGTDSHNTRTMEVPARASSLNSSDIFLLVTASVCYLWFGKGCNGDQREMARVVVTVISRKNEETVLEGQEPPHFWEALGGRXPYPSNKRLPEEVPSFQPRLFECSSHMGCLVLAEVGFFSQEDLDKYDIMLLDTWQEIFLWLGEAASEWKEAVAWGQEYLKTHPAGRSPXTPIVLVKQGHEPPTFIGWFFTWDPYKWTSHPSHKEVVDGSPAAASTISEITAEVNNFRLSRWPGNGRAGAVALQALKGSQDSSENDLVRSPKSAGSRTSSSVSSTSATINGGLRREQLMHQAVEDLPEGVDPARREFYLSDSDFQDIFGKSKEEFYSMATWRQRQEKKQLGFF

SEQ ID NO: 8903 - protein, 70 aa, Homo sapiens
  SITE (35): Xaa equals any amino acid
SDPLASASQNAGIVSVGLCTRPGPQFKNAQPPFPXQKAPRCLWENQPPPWRKAWDLPSHLGRRGICGKSF

SEQ ID NO: 8904 - protein, 529 aa, Homo sapiens
MAALTTVVVAAAATAVAGAVAGAGAATGTGVGATPAPQQSDGCFSTSGGIRPFHLQNWKQKVNQTKKAEFVRTAEKFKNQVINMEKDKHSHFYNQKSDFRIEHSMLEELENKLIHSRKTERAKIQQQLAKIHNNVKKLQHQLKDVKPTPDFVEKLREMMEEIENAINTFKEEQRLIYEELIKEEKTTNNELSAISRKIDTWALGNSETEKAFRAISSKVPVDKVTPSTLPEEVLDFEKFLQQTGGRQGAWDDYDHQNFVKVRNKHKGKPTFMEEVLEHLPGKTQDEVQQHEKWYQKFLALEERKKESIQIWKTKKQQKREEIFKLKEKADNTPVLFHNKQEDNQKQKEEQRKKQKLAVEAWKKQKSIEMSMKCASQLKEEEEKEKKHQKERQRQFKLKLLLESYTQQKKEQEEFLRLEKEIREKAEKAEKRKNAADEISRFQERDLHKLELKILDRQAKEDEKSQKQRRLAKLKEKVENNVSRDPSRLYKPTKGWEERTKKIGPTGSGPLLHIPHRAIPTWRQGIQRRV

SEQ ID NO: 8905 - protein, 60 aa, Homo sapiens
  SITE (10): Xaa equals any amino acid
  SITE (48): Xaa equals any amino acid
MFFPCLPTLXLRILHSGWVGLFLLISSRAPSSSLAWKHGPGELWWPRXPLRSCTGLASCG

SEQ ID NO: 8906 - protein, 74 aa, Homo sapiens [sequence omitted]

SEQ ID NO: 8907 - protein, 31 aa, Homo sapiens
MNCVLATYGSIALIVLYFKLRSKKTPAVKAT

SEQ ID NO: 8908 - protein, 261 aa, Homo sapiens
MAVTACQGLGFVVSLIGIAGIIAATCMDQWSTQDLYNNPVTAVFNYQGLWRSCVRESSGFTECRGYFTLLGLPAMLQAVRALMIVGIVLGAIGLLVSIFALKCIRIGSMEDSAKANMTLTSGIMFIVSGLCAIAGVSVFANMLVTNFWMSTANMYTGMGGMVQTVQTRYTFGAALFVGWVAGGLTLIGGVMMCIACRGLAPEETNYKAVSYHASGHSVAYKPGGFKASTGFGSNTKNKKRYDGGARTEDEVQSYPSKHDYV

SEQ ID NO: 8909 - protein, 125 aa, Homo sapiens
MVPIFLLKCLLLHVPLCMSSNLSFHSSHHLHIFLPSFSSHLPRPLYIPPLSPFYIFSISPHIFPLCPHLCIPPNFPSIYLFYSPFPPCILCVPPILLYIILPKIFTSPILISPSPLSPNIFISVP

SEQ ID NO: 8910 - protein, 447 aa, Homo sapiens
MTSVSQASLDVSMIIIISLGAICAVLLVIMVLFATRCNREKKDTRSYNCRVAESTYQHHPKRPSRQIHKGDITLVPTINGTLPIRSHHRSSPSSSPTLERRQMGSRQSHNSHQSLNSLVTISSNHVPENFSLELTHATPAVEVSQLLSMLHQGQYQPRPSFRGNKYSRSYRYALQDMDKFSLKDSGRGDSEAGDSDYDLGRDSPIDRLLGEGFSDLFLTDGRIPAAMRLCTEECRVLGHSDQCWMPPLPSPSSDYRSNMFIPGEEFPTQPQQQHPHQSLEDDAQPADSGEKKKSFSTFGKDSPNDEDTGDTSTSSLLSEMSSVFQRLLPPSLDTYSECSEVDRSNSLERRKGPLPAKTVGYPQGVAAWAASTHFQNPTTNCGPPLGTHSSVQPSSKWLPAMEEIPENYEEDDFDNVLNHLNDGKHELMDASELVAEINKLLQDVRQS

SEQ ID NO: 8911 - protein, 43 aa, Homo sapiens
MSMAMGSSTLLLGWGPGPGWDCGVMRVVLCWLPGGNCQGESST

SEQ ID NO: 8912 - protein, 113 aa, Homo sapiens [sequence omitted]

SEQ ID NO: 8913 - protein, 234 aa, Homo sapiens
MRVPAQLLGLLLLWLSGAKCDTQMTQSPSSLSASVGDTVTITCQASDDISKDLNWFQQKPGPAPKLLIFDASNLETGVPSRFSGSGSGTDFTFTISSLQPEDFATYYCQQYDNPPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKLYACEVTHQGLSSPVTKSFNRGEC

SEQ ID NO: 8914 - protein, 129 aa, Homo sapiens [sequence omitted]

SEQ ID NO: 8915 - protein, 64 aa, Homo sapiens
MTKEDKASSESLRLILVVFLGGCTFSEISALRFLGREKGYRFIFLTTAVTNSARLMEAMSEVKA

SEQ ID NO: 8916 - protein, 227 aa, Homo sapiens
MADLLGSILSSMEKPPSLGDQETRRKAREQAARLKKLQEQEKQQKVEFRKRMEKEVSDFIQDSGQIKKKFQPMNKIERSILHDVVEVAGLTSFSFGEDDDCRYVMIFKKEFAPSDEELDSYRRGEEWDPQKAEEKRKLKELAQRQEEEAAQQGPVVVSPASDYKDKYSHLIGKGAAKDAAHMLQANKTYGCVPVANKRDTRSIEEAMNEIRAKKRLRQSGEELPPTS

SEQ ID NO: 8917 - protein, 74 aa, Homo sapiens
  SITE (59): Xaa equals any amino acid
MLSSPNLAASLLCLWHSGSATNWAPPCAGMWASRCGWKVSPHPEAGPCSSALWVSCCVXAEQPQPGGREPRHRG

SEQ ID NO: 8918 - protein, 89 aa, Homo sapiens
  SITE (50): Xaa equals any amino acid
  SITE (53): Xaa equals any amino acid
  SITE (59): Xaa equals any amino acid
  SITE (60): Xaa equals any amino acid
  SITE (61): Xaa equals any amino acid
  SITE (64): Xaa equals any amino acid
  SITE (65): Xaa equals any amino acid
MWDWDWSAPWSWPLWLSLALVCLSAGAKGHRASEAGHARALTCEMGSEFXTAXGLVLGXXXWTXXNGSAGPERRGWRPAAFLAVFLLGD

SEQ ID NO: 8919 - protein, 62 aa, Homo sapiens
MFCRNWRCEFMMLSHNTAVMICSFSQNDFHAALCCSSVSELPYLFLVCSTYKCSCHAVLFFC

SEQ ID NO: 8920 - protein, 113 aa, Homo sapiens
MHPQLIPSVIAVVFILLLGVCFIASCLVTHHNFSRCKRGTGVHKLEHHAKLKCIKEKSELKSAEGSTWNCCPIDWRAFQSNCYFPLTDNKTWAESERNCSGMGGPSDDHQHGS

SEQ ID NO: 8921 - protein, 401 aa, Homo sapiens
MSLYDDLGVETSDSKTEGWSKNFKLLQSQLQVKKAALTQAKSQRTKQSTVLAPVIDLKRGGSSDDRQIVDTPPHVAAGLKDPVPSGFSAGEVLIPLADEYDPMFPNDYEKVVKRQREERQRQRELERQKEIEEREKRRKDRHEASGFARRPDPDSDEDEDYERERRKRSMGGAAIAPPTSLVEKDKELPRDFPYEEDSRPRSQSSKAAIPPPVYEEQDRPRSPTGPSNSFLANMGGTVAHKIMQKYGFREGQGLGKHEQGLSTALSVEKTSKRGGKIIVGDATEKDASKKSDSNPLTEILKCPTKVVLLRNMVGAGEVDEDLEVETKEECEKYGKVGKCVIFEIPGAPDDEAVRIFLEFERVESAIKAVVDLNGRYFGGRVVKACFYNLDKFRVLDLAEQV

SEQ ID NO: 8922 - protein, 70 aa, Homo sapiens
MSNACKELAIFLTTGIVVSAFGLPIVFARAHLIEWGACALVLTGNTVIFATILGFFLVFGSNDDFSWQQW

SEQ ID NO: 8923 - protein, 125 aa, Homo sapiens
MQILGVVLTLLGWVNGLVSCALPMWKVTAFIGNSIVVAQVVWEGLWMSCVVQSTGQMQCKVYDSLLALPQDLQAARALCVIALLVALFGLLVYLAGAKCTTCFYIRIPRPAWCSPLGLSLSSQGS

SEQ ID NO: 8924 - protein, 50 aa, Homo sapiens
MALMWSLWYFNSVFIISCVSGKIVLTFPLYTTVCSYGALNCLTEEPSSVF

SEQ ID NO: 8925 - protein, 45 aa, Homo sapiens
MGCWVLFILLYLALHICVQNYIYSYKIICLQSFHYIVRKIQIFVS

SEQ ID NO: 8926 - protein, 60 aa, Homo sapiens
  SITE (37): Xaa equals any amino acid
MLLYYSVMTLSSLGQDPSLPTFADRHSGMWRQQCVPXTFLYPPAVGSTQWKGDMTLILLF

SEQ ID NO: 8927 - protein, 104 aa, Homo sapiens
MAAPVDLELKKAFTELQAKVIDTQQKVKLADIQIEQLNRTKKHAHLTDTEIMTLVDETNMYEGVGRMFILQSKEAIHSQLLEKQKIAEEKIKELEQKKSYLERR

SEQ ID NO: 8928 - protein, 366 aa, Homo sapiens
MACLKTQRAPKAFLLLPLLLYFAGLSKLTQLQVCSGTDEDPDDKNAPFRQRPFCKYKGHTADLLDLSWSKNYFLLSSSMDKTVRLWHISRRECLCCFQHIDFVTAIAFHPRDDRYFLSGSLDGKLRLWNIPDKKVALWNEVDGQTKLITAANFCQNGKYAVIGTYDGRCIFYDTEHLKYHTQIHVRSTRGRNKVGRKITGIEPLPGENKILVTSNDSRIRLYDLRDLSLSMKYKGYVNSSSQIKASFSHDFTYLVSGSEDKYVYIWSTYHDLSKFTSVRRDRNDFWEGIKAHNAVVTSAIFAPNPSLMLSLDVQSEKSEGNEKSEDAEVLDATPSGIMKTDNTEVLLSADFTGAIKVFVNKRKNVS

SEQ ID NO: 8929 - protein, 197 aa, Homo sapiens
MGVPLGLGAAWLLAWPGLALPLVAMAAGGRWVRQQGPRVRRGISRLWLRVLLRLSPMAFRALQGCGAVGDRGLFALYPKTNKDGFRSRLPVPGPRRRNPRTTQHPLALLARVWVLCKGWNWRLARASQGLASHLPPWAIHTLASWGLLRGERPTRIPRLLPRSQRQLGPPASRQPLPGTLAGRRSRTRQSRALPPWR

SEQ ID NO: 8930 - protein, 31 aa, Homo sapiens
MSKRFTLDYLFLSEIVLCLFYYLLLIRALAL

SEQ ID NO: 8931 - protein, 94 aa, Homo sapiens
MLLGFLVLIPWGSLILGSSDLDPSSLPLGTRGHGWRWPPLSPVQILYPLAGDPHAAVSCSCCGETELRALLTGSLPMEAFSGLHSIEYSSRTAC

SEQ ID NO: 8932 - protein, 89 aa, Homo sapiens
MNHRAWPFLPFFFFFLRRSLALSPRLECSGAVSAHCGLRLPGSRHSPASASRVAGTAGARYHARLVFFVFLVETGFHRVGQDGLDLLTS

SEQ ID NO: 8933 - protein, 168 aa, Homo sapiens [sequence omitted]

SEQ ID NO: 8934 - protein, 48 aa, Homo sapiens
  SITE (41): Xaa equals any amino acid
MFGPTFHSLVLVPPWPNLSLLHFTSPVGQHSSFLPTSLRLXKKKKKKK

SEQ ID NO: 8935 - protein, 71 aa, Homo sapiens
MYQETRSSPTNTLRPWPRGTSRCLRCSFCRLSFAHSQGIQQLSCSLSRTDSRSFTISKTLWAHNRRHSFQG

SEQ ID NO: 8936 - protein, 55 aa, Homo sapiens
MCSKNGFLLAWSWNSPWLPQASLAHGCWGRWMSDLVGCSRENKCALRDHSERVQG

SEQ ID NO: 8937 - protein, 53 aa, Homo sapiens
MLLQIHPLLPSPTIPHILLLFLYPTFSILEHSCSYCIEYLWVCLLFCLSLWFL

SEQ ID NO: 8938 - protein, 21 aa, Homo sapiens
MNGLLFLVMIAKNLLPSGNKQ

SEQ ID NO: 8939 - protein, 29 aa, Homo sapiens
MCLWCCGDVCSGLSSLLSLCVCCVVLAVC

SEQ ID NO: 8940 - protein, 39 aa, Homo sapiens
  SITE (14): Xaa equals any amino acid
MEYIYVFFRDTFFXLLLEIFQFGSRTCMMFSSFAEMLKI

SEQ ID NO: 8941 - protein, 167 aa, Homo sapiens
MATLWGGLLRLGSLLSLSCLALSVLLLAHCQTPPSDCLHVVEPMPVRGPDVEAYCLRCECKYEERSSVTIKVTIIIYLSILGLLLLYMVYLTLVEPILKRRLFGHAQLIQSDDDIGDHQPFANAHDVLARSRSRANVLNKVEYAQQRWKLQVQEQRKSVFDRHVVLS

SEQ ID NO: 8942 - protein, 121 aa, Homo sapiens
MLWVKTRREELRPFGEPRPGSSLRQGCDSLFGPLKFLESQASSRHHVSWWQLWKLLLVCLVQLQPCREPAPMQTPCAGCPAAAAGVPHCVQWLDPMLTCSHTPHCSTPGLPLAVMGSRLVA

SEQ ID NO: 8943 - protein, 25 aa, Homo sapiens
MLPSFPSLRVFVIFFCLLVYCLFAP

SEQ ID NO: 8944 - protein, 27 aa, Homo sapiens
MSHFVLFLILLILSLSKDTNLWIQVKG

SEQ ID NO: 8945 - protein, 21 aa, Homo sapiens
MQIIFLAVTCSFTTAESAVAR

SEQ ID NO: 8946 - protein, 122 aa, Homo sapiens [sequence omitted]

SEQ ID NO: 8947 - protein, 43 aa, Homo sapiens
  SITE (40): Xaa equals any amino acid
MLLRIIHLVIFFINFSTSVVIVHYNVLNYRCLLKCRCRVXKYS

SEQ ID NO: 8948 - protein, 91 aa, Homo sapiens
  SITE (56): Xaa equals any amino acid
MASQVPSSPFQSFFVFVFVFLRPSHSVAQAGVPLHFYFFIQQVLIKCALYQVLSSXLGYNGDQGDCRFWQGKLTSNTATRHSETLSLLEEL

SEQ ID NO: 8949 - protein, 49 aa, Homo sapiens
MKSLFCIYFLRWPMGLSWGETFILLRDSLAINFQSFSKAASGDIFGCHD

SEQ ID NO: 8950 - protein, 55 aa, Homo sapiens
  SITE (40): Xaa equals any amino acid
MGRNILIITVVTCVDLRPSSMSSLSATCHSTWTRSSGCFXSAALPATSSPWRKQR

SEQ ID NO: 8951 - protein, 37 aa, Homo sapiens
MRKRRPYNRWTGCWLRLAVSCRWAVAISASPWLRLTS

SEQ ID NO: 8952 - protein, 50 aa, Homo sapiens
MASPVFKTFWRLELSVPLSLLFILQIVTSLSSDEICYSTRKVFIIRRQLY

SEQ ID NO: 8953 - protein, 107 aa, Homo sapiens
MDKMPPGLMEVLRPFLGSSWVVYGTNYRKAISIFISNTGGEQINQVALEAWRSRRDREEILLQELEPVISRAVLDNPHRESGSAAPSRAASPHTQGPGSPGVSCFAH

SEQ ID NO: 8954 - protein, 356 aa, Homo sapiens
MLARAARGTGALLLRGSLLASGRAPRRASSGLPRNTVVLFVPQQEAWVVERMGRFHRILEPGLNILIPVLDRIRYVQSLKEIVINVPEQSAVTLDNVTLQIDGVLYLRIMDPYKASYGVEDPEYAVTQLAQTTMRSELGKLSLDKVFRERESLNASIVDAINQAADCWGIRCLRYEIKDIHVPPRVKESMQMQVEAERRKRATVLESEGTRESAINVAEGKKQAQILASEAEKAEQINQAAGEASAVLAKAKAKAEAIRILAAALTQHNGDAAASLTVAEQYVSAFSKLAKDSNTILLPSNPGDVTSMVAQAMGVYGALTKAPVPGTPDSLSSGSSRDVQGTDASLDEELDRVKMS

SEQ ID NO: 8955 - protein, 48 aa, Homo sapiens
MGFSHRSPPVAHPRARNRRSQEVVTELGPCLLLCTLLVQTGVVGSQAL

SEQ ID NO: 8956 - protein, 35 aa, Homo sapiens [sequence omitted]

SEQ ID NO: 8957 - protein, 47 aa, Homo sapiens
MQWAVKCWLFQLCMDSSLASLGWAEKRELLFPKRPSQLCSTTLCSPG

SEQ ID NO: 8958 - protein, 59 aa, Homo sapiens
MQNCLGSLIPGVLFSLLLLPSMFNIILTQSKYGENSYPACFYSSSNFPVSAITFLVGVV

SEQ ID NO: 8959 - protein, 63 aa, Homo sapiens
  SITE (6): Xaa equals any amino acid
MSCGLXFGPWFVPMLLMSHSLLPSWSGLWVTTWNGSSGERTPSPWRRKRASQSAGRIASWMSF

SEQ ID NO: 8960 - protein, 96 aa, Homo sapiens
MARACVFQLSLWRKLPVGINLSPAILSLSLGCLGLGFLLLLERMTTDSGIRQRSRHDLLGFCGCQHCRSFWRLREALEGIGTSCCRPPGRAGLFIF

SEQ ID NO: 8961 - protein, 61 aa, Homo sapiens
MVGSAMMGGILLALIEGVGILLTRYTAQQFRNAPPFLEDPSQLPPKDGTPAPGYPSYQQYH

SEQ ID NO: 8962 - protein, 161 aa, Homo sapiens [sequence omitted]

SEQ ID NO: 8963 - protein, 69 aa, Homo sapiens
  SITE (20): Xaa equals any amino acid
MLLKLHTLWPLWPGLWATTXSDSLGERTHSLCRRKKASLSTGWMSWMSCRARATHTQVVSLKDKVEFAP

SEQ ID NO: 8964 - protein, 54 aa, Homo sapiens
MPHISFCLGTPYVVAVYLPAWIVMLLLPGVRPYSSLQALKHPSCSSSSVCAPYM

SEQ ID NO: 8965 - protein, 49 aa, Homo sapiens [sequence omitted]

SEQ ID NO: 8966 - protein, 342 aa, Homo sapiens
MARALLDHFLGFSQPDSSVTPCVPAVSMNRDEQDVLLVHHPDMPENSRVLRVVLLGAPNAGKSTLSNQLLGRKVFPVSRKVHTTRCQALGVITEKETQVILLDTPGIISPGKQKRHHLELSLLEDPWKSMESADLVVVLVDVSDKWTRNQLSPQLLRCLTKYSQIPSVLVMNKVDCLKQKSVLLELTAALTEGVVNGKKLKMRQAFHSHPGTHCPSPAVKDPNTQSVGNPQRIGWPHFKEIFMLSALSQEDVKTLKQYLLTQAQPGPWEYHSAVLTSQTPEEICANIIREKLLEHLPQEVPYNVQQKTAVWEEGPGGELVIQQKLLVPKESYVKLLIGPKAT

SEQ ID NO: 8967 - protein, 57 aa, Homo sapiens
MGLNISPWCFLAILTCAISAAFISVGVVCWLLFLISHRSSKNLRKSRVRGVWENEEI

SEQ ID NO: 8968 - protein, 491 aa, Homo sapiens
MENEESDVKPPDWPNPMNATSQFPQPQHFDSFGLRLPRDITELPEWSEGYPFYMAMGFPGYDLSADDIAGKFQFSRGMRRSYDAGFKLMVVEYAESTNNCQAAKQFGVLEKNVRDWRKVKPQLQNAHAMRRAFRGPKNGRFALVDQRVAEYVRYMQAKGDPITREAMQLKALEIAQEMNIPEKGFKASLGWCRRMMRRYDLSLRHKVPVPQHLPEDLTEKLVTYQRSVLALRRAHDYEVAQMGNADETPICLEVPSRVTVDNQGEKPVLVKTPGREKLKITAMLGVLADGRKLPPYIILRGTYIPPGKFPSGMEIRCHRYGWMTEDLMQDWLEVVWRRRTGAVPKQRGMLILNGFRGHATDSVKNSMESMNTDMVIIPGGLTSQLQVLDVVVYKPLNDSVRAQYSNWLLAGNLALSPTGNAKKPPLGLFLEWVMVAWNSISSESIVQGFKNCHISSNLEEEDDVLWEIESELPGGGEPPKDCDTESMAESN

SEQ ID NO: 8969 - protein, 59 aa, Homo sapiens
MLHLTLYLHFILFVFPITSNFSSLHPFLFISSQFTSCCQINFPNAQALSYHEFLIATYD

SEQ ID NO: 8970 - protein, 25 aa, Homo sapiens
EGLRLLLSLPAALPRSCCHPRWLPV

SEQ ID NO: 8971 - protein, 59 aa, Homo sapiens
MGPFLLVFLFPILRVCGIIREPTQDWSVLLERARLTAPGQPPALFPLESGPMATAQNTS

SEQ ID NO: 8972 - protein, 99 aa, Homo sapiens
MPCIRGVFHCFILIILILLASHAFSGSGNQRLKEALTLIVSVNCGYCQTQGPSWSVYMLRRATLSPQNSTPVLRLHAAEIAGWREILSQGLPMPLQPQG

SEQ ID NO: 8973 - protein, 233 aa, Homo sapiens
MEEAILVPCVLGLLLLPILAMLMALCVHCHRLPGSYDSTSSDSLYPRGIQFKRPHTVAPWPPAYPPVTSYPPLSQPDLLPIPRSPQPLGGSHRTPSSRRDSDGANSVASYENEEPACEDADEDEDDYHNPGYLVVLPDSTPATSTAAPSAPALSTPGIRDSAFSMESIDDYVNVPESGESAEASLDGSREYVNVSQELHPGAAKTEPAALSSQEAEEVEEEGAPDYENLQELN

SEQ ID NO: 8974 - protein, 52 aa, Homo sapiens [sequence omitted]

SEQ ID NO: 8975 - protein, 68 aa, Homo sapiens [sequence omitted]

SEQ ID NO: 8976 - protein, 61 aa, Homo sapiens
MCLLLLWLTTFQRTSGALRRGGLSSPAWAMRSPSVYSTQTPSPMMSTGTLRGLSGAMCNLS

SEQ ID NO: 8977 - protein, 71 aa, Homo sapiens
  SITE (25): Xaa equals any amino acid
MTEGHVFCFALCCVLVFLSMTLLVXSLEKTNAGGVIAWGCISVSVQTQTFSSPTSYQTLFIACKLWNPRKL

SEQ ID NO: 8978 - protein, 48 aa, Homo sapiens [sequence omitted]

SEQ ID NO: 8979 - protein, 40 aa, Homo sapiens
MRTSLFFFFFKNILVLCGTLLISRSSHSQSAPRGCWWPHK

SEQ ID NO: 8980 - protein, 222 aa, Homo sapiens
MKHADPRIQGYPLMGSPLLMTSILLTYVYFVLSLGPRIMANRKPFQLRGFMIVYNFSLVALSLYIVYEVIFILRKKDGQVTFLHVFHHSVLPWSWWWGVKIAPGGMGSFHAMINSSVHVIMYLYYGLSAFGPVAQPYLWWKKHMTAIQLIQFVLVSLHISQYYFMSSCNYQYPVIIHLIWMYGTIFFMLFSNFWYHSYTKGKRLPRALQQNGAPGIAKVKAN

SEQ ID NO: 8981 - protein, 153 aa, Homo sapiens
MHWLCVSCIFTCLPGWRPAAPDQGPAAISLCSLPSSSQGHREPLALGLPSALPPAHRQRLRGSATCQAQGKQRRVGGRTRLLGRQEWGVASHPTGGDGGGMPGAMPEQGRGLVQPVAVSSRWDRGHSKAKGVGRAGGVSLVLAELPVPTTSVC

SEQ ID NO: 8982 - protein, 153 aa, Homo sapiens
MSPSGRLCLLTIVGLILPTRGQTLKDTTSSSSADSTIMDIQVPTRAPDAVYTELQPTSPTPTWPADETPQPQTQTQQLEGTDGPLVTDPETHKSTKAAHPTDDTTTLSERPSPSTDVQTDPQTLKPSGFHEDDPFFYGGKCRQLSRLCRNHCR

SEQ ID NO: 8983 - protein, 93 aa, Homo sapiens [sequence omitted]

SEQ ID NO: 8984 - protein, 458 aa, Homo sapiens
  SITE (69): Xaa equals any amino acid
MKVWGLAAACFLLQHHGMPAQFTLPPAPRDETSPADAVCPGLGRDLCGSSRCCLRPPSQPDWKEPSGAXCGPDRLRVAGEVHRFRTSDVSQATLASVAPVFTVTKFDKQGNVTSFERKKTELYQELGLQARDLRFQHVMSITVRNNRIIMRMEYLKAVITPECLLILDYRNLNLEQWLFRELPSQLSGEGQLVTYPLPFEFRAIEALLQYWINTLQGKLSILQPLILETLDALVDPKHSSVDRSKLHILLQNGKSLSELETDIKIFKESILEILDEEELLEELCVSKWSDPQVFEKSSAGIDHAEEMELLLENYYRLADDLSNAARELRVLIDDSQSIIFINLDSHRNVMMRLNLQLTMGTFSLSLFGLMGVAFGMNLESSLEEDHRIFWLITGIMFMGSGLIWRRLLSFLGRQLEAPLPPMMASLPKKTLLADRSMELKNSLRLDGLGSGRSILTNR

SEQ ID NO: 8985 - protein, 56 aa, Homo sapiens; identical to SEQ ID NO: 6901

SEQ ID NO: 8986 - protein, 91 aa, Homo sapiens
MPLAPLLLVLSPFSFDQVVQARLEVPVFKQRDLCNYVLILVGAQLKPLAMLVKNIRDYRLEPPCPACIDTFYPTFKTGMFSLCFKMPLKYF

SEQ ID NO: 8987 - protein, 249 aa, Homo sapiens
MIGMSTKAVLWRCFSTVVIFLFLLDEQTSLLVLVPAGVGAAIELWKVKKALKMTIFWRGLMPEFQFGTYSESERKTEEYDTQAMKYLSYLLYPLCVGGAVYSLLNIKYKSWYSWLINSFVNGVYAFGFLFMLPQLFVNYKVRRCVLPAARPPSPVLPTADLGLSLLFQLKSVAHLPWKAFTYKAFNTFIDDVFAFIITMPTSHRLACFRDDVVFLVYLYQRWLYPVDKRRVNEFGESYEEKATRAPHTD

SEQ ID NO: 8988 - protein, 92 aa, Homo sapiens
MEDRLLLILVFPLLWFPVAVFQLVLLLPFLLIHSLNCLEWRHLFSAYRVHILAWLAYPCFCVSLRVRHCIELFIQIVLSLPQCCGIGGVPIL

SEQ ID NO: 8989 - protein, 23 aa, Homo sapiens
MSACTATSSWPGPSPPSSARCSS

SEQ ID NO: 8990 - protein, 331 aa, Homo sapiens
MWLWEDQGGLLGPFSFLLLVLLLVTRSPVNACLLTGSLFVLLRVFSFEPVPSCRALQVLKPRDRISAIAHRGGSHDAPENTLAAIRQAAKNGATGVELDIEFTSDGIPVLMHDNTVDRTTDGTGRLCDLTFEQIRKLNPAANHRLRNDFPDEKIPTLREAVAECLNHNLTIFFDVKGHAHKATEALKKMYMEFPQLYNNSVVCSFLPEVIYKMRQTDRDVITALTHRPWSLSHTGDGKPRYDTFWKHFIFVMMDILLDWSMHNILWYLCGISAFLMQKDFVSPAYLKKWSAKGIQVVGWTVNTFDEKSYYESHLGSSYITDSMVEDCEPHF

SEQ ID NO: 8991 - protein, 78 aa, Homo sapiens
MSLYGTRWRISWPHWRRVVLVSLLSSSGGQISPSLSHHLPCSDFFELETSLALFWLTTLVPSITNITRVFTTLLRTLM

SEQ ID NO: 8992 - protein, 267 aa, Homo sapiens
MLIAVGIHLLLLMFEVLVCDRVERGTHFWLLVFMPLFFVSPVSVAACVWGFRHDRSLELEILCSVNILQFIFIALKLDRIIHWPWLVVFVPLWILMSFLCLVVLYYIVWSLLFLRSLDVVAEQRRTHVTMAISWITIVVPLLTFEVLLVHRLDGHNTFSYVSIFVPLWLSLLTLMATTFRRKGGNHWWFGIRRDFCQFLLEIFPFLREYGNISYDLHHEDSEDAEETSVPEAPKIAPIFGKKARVVITQSPGKYVPPPPKLNIDMPD

SEQ ID NO: 8993 - protein, 44 aa, Homo sapiens
MHKNNLFLCVLFRLLFRCSCFNLLNFPQTYAVGKGQAGKDQCSS

SEQ ID NO: 8994 - protein, 510 aa, Homo sapiens
MRPGLSFLLALLFFLGQAAGDLGDVGPPIPSPGFSSFPGVDSSSSFSSSSRSGSSSSRSLGSGGSVSQLFSNFTGSVDDRGTCQCSVSLPDTTFPVDRVERLEFTAHVLSQKFEKELSKVREYVQLISVYEKKLLNLTVRIDIMEKDTISYTELDFELIKVEVKEMEKLVIQLKESFGGSSEIVDQLEVEIRNMTLLVEKLETLDKNNVLAIRREIVALKTKLKECEASKDQNTPVVHPPPTPGSCGHGGVVNISKPSVVQLNWRGFSYLYGAWGRDYSPQHPNKGLYWVAPLNTDGRLLEYYRLYNTLDDLLLYINARELRITYGQGSGTAVYNNNMYVNMYNTGNIARVNLTTNTIAVTQTLPNAAYNNRFSYANVAWQDIDFAVDENGLWVIYSTEASTGNMVISKLNDTTLQVLNTWYTKQYKPSASNAFMVCGVLYATRTMNTRTEEIFYYYDTNTGKEGKLDIVMHKMQEKVQSINYNPFDQKLYVYNDGYLLNYDLSVLQKPQ

SEQ ID NO: 8995 - protein, 39 aa, Homo sapiens
  SITE (10): Xaa equals any amino acid
  SITE (17): Xaa equals any amino acid
  SITE (24): Xaa equals any amino acid
  SITE (26): Xaa equals any amino acid
  SITE (31): Xaa equals any amino acid
  SITE (35): Xaa equals any amino acid
MYILLFWGGXFHRCLSXLFDPELXSXPGISXFTVXLQMT

SEQ ID NO: 8996 - protein, 76 aa, Homo sapiens
MKNATLLRMVLFVINLQNLKSCPVLHIHQDVQQQKRMGHGGSSTRVTVTSLIRHCTVFQRPKNCVQNMITLQLSFP

SEQ ID NO: 8997 - protein, 103 aa, Homo sapiens
MNLSSILAVIFVLTGIMENVLASQKRRLRKWMCTSVMIVNGHKRAAVRNCTVSAEHLMMSHNFILAVIGVRIGTMGAALASCKVRQSSLMSMSVHSASQQRMP

SEQ ID NO: 8998 - protein, 144 aa, Homo sapiens
MSAVSAPALWQTWCVPAARAWTSSTLRHDAVARPNPSTSLTPGLLTSSDSPRWPGLQEAPGRPCIRLGRSELCMYIYTYIDTFIIYTHSLYIYIHCFLAPELIWVQAHFKTLPGGGCFFSGFLAREEGEGTGWVFSLKRESRRF

SEQ ID NO: 8999 - protein, 41 aa, Homo sapiens
MLWKYFLSLFLPWYLYCFFNNNIMFYSLHSVPMFIQPFLLW

SEQ ID NO: 9000 - protein, 38 aa, Homo sapiens
MYKIHSENCLVILHLFIQKTVISGEPNMLVNIFNFFPH

SEQ ID NO: 9001 - protein, 421 aa, Homo sapiens
MGGPRAWALLCLGLLLPGGGAAWSIGAAPFSGRRNWCSYVVTRTISCHVQNGTYLQRVLQNCPWPMSCPGSSYRTVVRPTYKVMYKIVTAREWRCCPGHSGVSCEEVAASSASLEPMWSGSTMRRMALRPTAFSGCLNCSKVSELTERLKVLEAKMTMLTVIEQPVPPTPATPEDPAPLWGPPPAQGSPGDGGLQDQVGAWGLPGPTGPKGDAGSRGPMGMRGPPGPQGPPGSPGRAGAVGTPGERGPPGPPGPPGPPGPPAPVGPPHARISQHGDPLLSNTFTETNNHWPQGPTGPPGPPGPMGPPGPPGPTGVPGSPGHIGPPGPTGPKGISGHPGEKGERGLRGEPGPQGSAGQRGEPGPKGDPGEKSHWNQSWGLGRALPAQAPPASFGARGADMQPTTGSWPPGAGTREAEGGGGP

SEQ ID NO: 9002 - protein, 197 aa, Homo sapiens
MWGLLLALAAFAPAVGPALGAPRNSVLGLAQPGTTKVPGSTPALHSSPAQPPAETANGTSEQHVRIRVIKKKKVIMKKRKKLTLTRPTPLVTAGPLVTPTPAGTLDPAEKQETGCPPLGLESLRVSDSRLEASSSQSFGLGPHRGRLNIQSGLEDGDLYDGAWCAEEQDADPWFQVDAGHPTRFSGVITQGRNSVWR

SEQ ID NO: 9003 - protein, 104 aa, Homo sapiens [sequence omitted]

SEQ ID NO: 9004 - protein, 46 aa, Homo sapiens
MKLCKLTQCSFLLKSLILLLEQLNVSMGFVAAFDVLVGCSICFEKH

SEQ ID NO: 9005 - protein, 52 aa, Homo sapiens
MLLPVNTLLYILLTPLCFFYGTSRPPYLELVTLLKKKKQSVGFSVCILEAGR

SEQ ID NO: 9006 - protein, 58 aa, Homo sapiens
  SITE (11): Xaa equals any amino acid
MLCLLVLTGLXVLIVGIHILELLIDEAAMPRGMQGTSLGQVSFSKLGSFASSASLSAR

SEQ ID NO: 9007 - protein, 72 aa, Homo sapiens
MGTLMVLTRLAVLLATSLADCTNWRLAVGLVVRAEARRQLLHSAEVCLATMVAAESTWAWVQPGSPKLWQAI

SEQ ID NO: 9008 - protein, 63 aa, Homo sapiens
  SITE (14): Xaa equals any amino acid
MCHHAWLIFKFFVXMGSHYVAQAGFRFLCSRDSANLAPQSAGITNVSHCIWPIFFFKKKMQRC

SEQ ID NO: 9009 - protein, 33 aa, Homo sapiens
MFFVLLCFWLFPFSKNSPLWGMLRSSFFISINL

SEQ ID NO: 9010 - protein, 9 aa, Homo sapiens
MVLSPLFSA

SEQ ID NO: 9011 - protein, 54 aa, Homo sapiens [sequence omitted]

SEQ ID NO: 9012 - protein, 25 aa, Homo sapiens
MSKTFLSAFLFLTVLSLTVLSICSN

SEQ ID NO: 9013 - protein, 34 aa, Homo sapiens
MAHRSWILSSSLLPIPIFFLLPPSSAATLATPGS

SEQ ID NO: 9014 - protein, 87 aa, Homo sapiens
MPTRQLHFKQLQLQGLLIVIAVTDNCLSFSVKGNLGTCPVRILVASFCVHVCVHVRVYFIQISLCLKSGRKYFKFLLLNCANVEISS

SEQ ID NO: 9015 - protein, 78 aa, Homo sapiens [sequence omitted]

SEQ ID NO: 9016 - protein, 73 aa, Homo sapiens
MGIAVSMLTYPFLLVGDLMAVNNCGLQAGLPPYSPVFKSWIHCWKYLSVQGQLFRGSSLLFRRVSSGSCFALE

SEQ ID NO: 9017 - protein, 383 aa, Homo sapiens
MAGIPGLLFLLFFLLCAVGQVSPYSAPWKPTWPAYRLPVVLPQSTLNLAKPDFGAEAKLEVSSSCGPQCHKGTPLPTYEEAKQYLSYETLYANGSRTETQVGIYILSSSGDGAQHRDSGSSGKSRRKRQIYGYDSRFSIFGKDFLLNYPFSTSVKLSTGCTGTLVAEKHVLTAAHCIHDGKTYVKGTQKLRVGFLKPKFKDGGRGANDSTSAMPEQMKFQWIRVKRTHVPKGWIKGNANDIGMDYDYALLELKKPHKRKFMKIGVSPPAKQLPGGRIHFSGYDNDRPGNLVYRFCDVKDETYDLLYQQCDAQPGASGSGVYVRMWKRQQQKWERKIIGIFSGHQWVDMNGSPQDFNVAVRITPLKYAQICYWIKGNYLDCREG

SEQ ID NO: 9018 - protein, 77 aa, Homo sapiens
MRLVFFFGVSIILVLGSTFVAYLPDYRCTGCPRAWDGMKEWSRREAERLVKYREANGLPIMESNCFDPSKIQLPEDE

SEQ ID NO: 9019 - protein, 316 aa, Homo sapiens
MALYELFSHPVERSYRAGLCSKAALFLLLAAALTYIPPLLVAFRSHGFWLKRSSYEEQPTVRFQHQVLLVALLGPESDGFLAWSTFPAFNRLQGDRLRVPLVSTREEDRNQDGKTDMLHFKLELPLQSTEHVLGVQLILTFSYRLHRMATLVMQSMAFLQSSFPVPGSQLYVNGDLRLQQKQPLSCGGLDARYNISVINGTSPFAYDYDLTHIVAAYQERNVTTVLNDPNPIWLVGRAADAPFVINAIIRYPVEVISYQPGFWEMVKFAWVQYVSILLIFLWVFERIKIFVFQNQVVTTIPVTVTPRGDLCKEHLS

SEQ ID NO: 9020 - protein, 41 aa, Homo sapiens
MGGIALPSLSLCLLSAGSHCISPADQETGPKVTAPQGNFLP

SEQ ID NO: 9021 - protein, 54 aa, Homo sapiens
MVVIVLTSNVCICGYVVHSALIPRRQGLFLFLFLVMFYFSIAFNRITKGTLSSQ

SEQ ID NO: 9022 - protein, 54 aa, Homo sapiens
MLLLCILLIFCVVGLSVVGRRVLKSTTIIVYLSITPFSSFSSISHIFQLLIGAH

SEQ ID NO: 9023 - protein, 22 aa, Homo sapiens
MIFLFLFCTLLDDCEAMSIGLG

SEQ ID NO: 9024 - protein, 106 aa, Homo sapiens
MLATMVVQILRLRPHTQKWSHVLTLLGLSLVLGLPWALIFFSFASGTFQLVVLYLFSIITSFQGFLIFIWYWSMRLQARGGPSPLKSNSDSARLPISSGSTSSSRI

SEQ ID NO: 9025 - protein, 479 aa, Homo sapiens
MAVLGVQLVVTLLTATLMHRLAPHCSFARWLLCNGSLFRYKHPSEEELRALAGKPRPRGRKERWANGLSEEKPLSVPRDAPFQLETCPLTTVDALVLRFFLEYQWFVDFAVYSGGVYLFTEAYYYMLGPAKETNIAVFWCLLTVTFSIKMFLTVTRLYFSAEEGGERSVCLTFAFLFLLLAMLVQVVREETLELGLEPGLASMTQNLEPLLKKQGWDWALPVAKLAIRVGLAVVGSVLGAFLTFPGLRLAQTHRDALTMSEDRPMLQFLLHTSFLSPLFILWLWTKPIARDFLHQPPFGETRFSLLSDSAFDSGRLWLLVVLCLLRLAVTRPHLQAYLCLAKARVEQLRREAGRIEAREIQQRVVRVYCYVTVVSLQYLTPLILTLNCTLLLKTLGGYSWGLGPAPLLSPDPSSASAAPIGSGEDEVQQTAARIAGALGGLLTPLFLRGVLAYLIWWTAACQLLASLFGLYFHQHLAGS

SEQ ID NO: 9026 - protein, 46 aa, Homo sapiens
MKFILWRRFRWAIILFIILFILLLFLAIFIYAFPNYAAMKLVKPFS

SEQ ID NO: 9027 - protein, 13 aa, Homo sapiens
MKSLHGRLLWQSA

SEQ ID NO: 9028 - protein, 336 aa, Homo sapiens
MAAAVAAALARLLAAFLLLAAQVACEYGMVHVVSQAGGPEGKDYCILYNPQWAHLPHDLSKASFLQLRNWTASLLCSAADLPARGFSNQIPLVARGNCTFYEKVRLAQGSGARGLLIVSRERLVPPGGNKTQYDEIGIPVALLSYKDMLDIFTRFGRTVRAALYAPKEPVLDYNMVIIFIMAVGTVAIGGYWAGSRDVKKRYMKHKRDDGPEKQEDEAVDVTPVMTCVFVVMCCSMLVLLYYFYDLLVCVVIGIFCLASATGLYSCLAPCVRRLPFGKCRIPNNSLPYFHKRPQARMLLLALFCVAVSVVWGVFRNEDSGPGSSRMPWASPSASTC

SEQ ID NO: 9029 - protein, 54 aa, Homo sapiens
MHSGFYTSAFRGLWQHGMGQEVLLLHLPLMSVTHPFCTAGVVNAFVSSSSHADC

SEQ ID NO: 9030 - protein, 467 aa, Homo sapiens
MLSRPQPPPDPLLLQRLPRPSSLSDKTQLHSRWLDSSRCLMQQGIKAGDALWLRFKYYSFFDLDPKTDPVRLTQLYEQARWDLLLEEIDCTEEEMMVFAALQYHINKLSQSGEVGEPAGTDPGLDDLDVALSNLEVKLEGSAPTDVLDSLTTIPELKDHLRIFRPRKLTLKGYRQHWVVFKETTLSYYKSQDEAPGDPIQQLNLKGCEVVPDVNVSGQKFCIKLLVPSPEGMSEIYLRCQDEQQYARWMAGCRLASKGRTMADSSYTSEVQAILAFLSLQRTGSGGPGNHPHGPDASAEGLNPYGLVAPRFQRKFKAKQLTPRILEAHQNVAQLSLAEAQLRFIQAWQSLPDFGISYVMVRFKGSRKDEILGIANNRLIRIDLAVGDVVKTWRFSNMRQWNVNWDIRQVAIEFDEHINVAFSCVSASCRIVHEYIGGYIFLSTRERARGEELDEDLFLQLTGGHEAF

SEQ ID NO: 9031 - protein, 46 aa, Homo sapiens
MHTAKMSLLNSVCLLVLSIWYVVKFPMMRDSTINVPYLLRLKAITT

SEQ ID NO: 9032 - protein, 83 aa, Homo sapiens
MLPLLLFTYLNSFLHQRIPQSVRILGSLVAILLVFLITAILVKVQLDALPFFVITMIKIVLINSFGAILQGSLFGLAGLLPAS

SEQ ID NO: 9033 - protein, 82 aa, Homo sapiens
MGLQSRLSQPCHCRHLGLGNSVVGTVLFLVGCLVASLPPPTRCQGHCSPQPPAPVVTIVSKHCQMVQGKGKIAPVEKSTAVK

SEQ ID NO: 9034 - protein, 115 aa, Homo sapiens [sequence omitted]

SEQ ID NO: 9035 - protein, 39 aa, Homo sapiens [sequence omitted]

SEQ ID NO: 9036 - protein, 146 aa, Homo sapiens
MQQSRLLLPFLFFLLEGCAPSSLGPGAAPGSGHSLGPPGSPGAPGPQPAVGPSSPCQPGPSPSSPAAAAASSQSSVASWPCTLRCAAPSPDASALRPAASPAATPAWSPGSGTIRVLRPPAPAAAPATAITNRGPPRRRRRNARTA

SEQ ID NO: 9037 - protein, 19 aa, Homo sapiens
MMTMLMILIVPAIAQRKVR

SEQ ID NO: 9038 - protein, 289 aa, Homo sapiens
  SITE (60): Xaa equals any amino acid
MSVPGRWPPARWRLSILAVSIMPCVCLASLLQILWTRSSSPAHHLASPFLCVQIWQCGGXLETHPCSHVGHVFPKQAPYSRNKALANSVRAAEVWMDEFKELYYHRNPRARLEPFGDVTERKQLRDKLQCKDFKWFLETVYPELHVPEDRPGFFGMLQNKGLTDYCFDYNPPDENQIVGHQVILYLCHGMGQNQFFEYTSQKEIRYNTHQPEGCIAVEAGMDTLIMHLCEETAPENQKFILQEDGSLFHEQSKKCVQAARKESSDSFVPLLRDCTNSDHQKWFFKERML

SEQ ID NO: 9039 - protein, 540 aa, Homo sapiens
MALARPVRLFSLVTRLLLAPRRGLTVRSPDEPLPVVRIPVALQRQLEQRQSRRRNLPRPVLVRPGPLLVSARRPELNQPARLTLGRWERAPLASQGWKSRRARRDHFSIERAQQEAPAVRKLSSKGSFADLGLEPRVLHALQEAAPEVVQPTTVQSSTIPSLLRGRHVVCAAETGSGKTLSYLLPLLQRLLGQPSLDSLPIPAPRGLVLVPSRELAQQVRAVAQPLGRSLGLLVRDLEGGHGMRRIRLQLSRQPSADVLVATPGALWKALKSRLISLEQLSFLVLDEADTLLDESFLELVDYILEKSHIAEGPADLEDPFNPKAQLVLVGATFPEGVGQLLNKVASPDAVTTITSSKLHCIMPHVKQTFLRLKGADKVAELVHILKHRDRAERTGPSGTVLVFCNSSSTVNWLGYILDDHKIQHLRLQGQMPALMRVGIFQSFQKSSRDILLCTDIASRGLDSTGVELVVNYDFPPTLQDYIHRAGRVGRVGSEVPGTVISFVTHPWDVSLVQKIELAARRRRSLPGLASSVKEPLPQAT

SEQ ID NO: 9040 - protein, 115 aa, Homo sapiens
MRSRKIPQQSRFFTPLFFLNLPILVVPLPSTDTSCSDFQYQVFKTSYPPSSVPPSLQSHKHWCSQIKISPKQCQRDPLSSFQARDMFSFQVLEKTGSMFTWNFSRGGAISFCIKL

SEQ ID NO: 9041 - protein, 182 aa, Homo sapiens
MEPQLGPEAAALRPGWLALLLWVSALSCSFSLPASSLSSLVPQVRTSYNFGRTFLGLDKCNACIGTSICKKFFKEEIRSDNWLASHLGLPPDSLLSYPANYSDDSKIWRPVEIFRLVSKYQNEISDRRICASASAPKTCSIERVLRKTERFQKWLQAKRLTPDLVQDCHQGQRELKFLCMLR

SEQ ID NO: 9042 - protein, 182 aa, Homo sapiens; identical to SEQ ID NO: 9041

SEQ ID NO: 9043 - protein, 363 aa, Homo sapiens
MERRRLLGGMALLLLQALPSPLSARAEPPQDKEACVGTNNQSYICDTGHCCGQSQCCNYYYELWWFWLVWTIIIILSCCCVCHHRRAKHRLQAQQRQHEINLIAYREAHNYSALPFYFRFLPNYLLPPYEEVVNRPPTPPPPYSAFQLQQQQLLPPQCGPAGGSPPGIDPTRGSQGAQSSPLSEPSRSSTRPPSIADPDPSDLPVDRAATKAPGMEPSGSVAGLGELDPGAFLDKDAECREELLKDDSSEHGAPDSKEKTPGRHRRFTGDSGIEVCVCNRGHHDDDLKEVNTLIDDALDGPLDFCDSCHVRPPGDEEEGLCQPSEEQAREPGHPHLPRPPACLLLNTINEQDSPNSQSNSSPS

SEQ ID NO: 9044 - protein, 47 aa, Homo sapiens
MLSRRLHCLVLYFLLLLLSFIHTLSVSHICSSFIWLFPKNIESEATM

SEQ ID NO: 9045 - protein, 123 aa, Homo sapiens [sequence omitted]

SEQ ID NO: 9046 - protein, 320 aa, Homo sapiens
  SITE (168): Xaa equals any amino acid
MNLSTALLFLNLLFLLDGWITSFNVDGLCIAVAVLLHFFLLATFTWMGLEAIHMYIALVKVFNTYIRRYILKFCIIGWGLPALVVSVVLASRNNNEVYGKESYGKEKGDEFCWIQDPVIFYVTCAGYFGVMFFLNIAMFIVVMVQICGRNGKRSNRTLREEVLRNLRXVVSLTFLLGMTWGFAFFAWGPLNIPFMYLFSIFNSLQGLFIFIFHCAMKENVQKQWRRHLCCGRFRLADNSDWSKTATNIIKKSSDNLGKSLSSSSIGSNSTYLTSKSKSSSTTYFKRNSHTDNVSYEHSFNKSGSLRQCFHGQVLVKTGPC

SEQ ID NO: 9047 - protein, 408 aa, Homo sapiens
MAVRALKLLTTLLAVVAAASQAEVESEAGWGMVTPDLLFAEGTAAYARGDWPGVVLSMERALRSRAALRALRLRCRTQCAADFPWELDPDWSPSPAQASGAAALRDLSFFGGLLRRAACLRRCLGPPAAHSLSEEMELEFRKRSPYNYLQVAYFKINKLEKAVAAAHTFFVGNPEHMEMQQNLDYYQTMSGVKEADFKDLETQPHMQEFRLGVRLYSEEQPQEAVPHLEAALQEYFVAYEECRALCEGPYDYDGYNYLEYNADLFQAITDHYIQVLNCKQNCVTELASHPSREKPFEDFLPSHYNYLQFAYYNIGNYTQAVECAKTYLLFFPNDEVMNQNLAYYAAMLGEEHTRSIGPRESAKEYRQRSLLEKELLFFAYDVFGIPFVDPDSWTPEEVIPKRLQEKQK

SEQ ID NO: 9048 - protein, 497 aa, Homo sapiens
MFLDRPQQWLQLVLLPPALFIPSTENEEQRLASARAVPRNVQPYVVYEEVTNVWINVHDIFYPFPQSEGEDELCFLRANECKTGFCHLYKVTAVLKSQGYDWSEPFSPGEDEFKCPIKEEIALTSGEWEVLARHGSKIWVNEETKLVYFQGTKDTPLEHHLYVVSYEAAGEIVRLTTPGFSHSCSMSQNFDMFVSHYSSVSTPPCVHVYKLSGPDDDPLHKQPRFWASMMEAASCPPDYVPPEIFHFHTRSDVRLYGMIYKPHALQPGKKHPTVLFVYGGPQVQLVNNSFKGIKYLRLNTLASLGYAVVVIDGRGSCQRGLRFEGALKNQMGQVEIEDQVEGLQFVAEKYGFIDLSRVAIHGWSYGGFLSLMGLIHKPQVFKVAIAGAPVTVWMAYDTGYTERYMDVPENNQHGYEAGSVALHVEKLPNEPNRLLILHGFLDENVHFFHTNFLVSQLIRAGKPYQLQIYPNERHSIRCPESGEHYEVTLLHFLQEYL

SEQ ID NO: 9049 - protein, 82 aa, Homo sapiens
  SITE (4): Xaa equals any amino acid
MCVXLSFCPFLSSALPASHTQFYMPRGAKFGTFTLQASVSPLEEKTHSFTHPGIGGKLLGHQDPGAPGPSWNIRSTWSTRSL

SEQ ID NO: 9050 - protein, 186 aa, Homo sapiens
MRTLVELGPWAGDFGPDLLLTLLFLLFLAHGVTLDGASANPTVSLQEFLMAEQSLPGTLLKLAAQGLGMQAACTLMRLCWAWELSDLHLLQSLMAQSCSSALRTSVPHGALLEAACTFCFHLTLLHLRHSPPAYSGPAVALLVTVTAYTAGPFTSAFFNPALAASVTFACSDTPYWSTCRCTGWAL

SEQ ID NO: 9051 - protein, 95 aa, Homo sapiens
MAWAPACVQAQGLSCLCLFPDPSSCREWCCPLGMYLQVETRTSSRLHLKRAPGIRSWSLLVGKALHVPPQNPRTGSLTFKKDENETKYFLFFLLP

SEQ ID NO: 9052 - protein, 66 aa, Homo sapiens
  SITE (55): Xaa equals any amino acid
MPFLSVWFFNLGLIFGVESFVLRAVLFIAGCSATSQMEAASPYPAVTKRKKNVSXHCQISSGGAPG

SEQ ID NO: 9053 - protein, 82 aa, Homo sapiens; identical to SEQ ID NO: 9033

SEQ ID NO: 9054 - protein, 83 aa, Homo sapiens
METAELTSPGLFAQKRGLLLLSLCFFPWPLCVLSSSPAHDQLPSAEGKLLKVEILSSPPLFSRKLSLELCPVRHRTLARGLND

SEQ ID NO: 9055 - protein, 50 aa, Homo sapiens [sequence omitted]

SEQ ID NO: 9056 - protein, 193 aa, Homo sapiens
MQLGTLLTFFHELVQTALPSGSCVDTLLKDLCKMYTTLTALVRYYLQVCQSSGGIPKNMEKLVKLSGSHLTPLCYSFISYVQNKSKSLNYTGEKKEKPAAVATAMARVLRETKPIPNLIFAIEQYEKFLIHLSKKSKVNLMQHMKLSTSRDFKIKGNILDMVLREDGEDENEEGTASEHGGQNKEPAKKKRKK

SEQ ID NO: 9057 - protein, 271 aa, Homo sapiens
MLSEKHLISVCADNNHVRTWSVTRFRGMISTQPGSTPLASFKILALESADGHGGCSAGNDIGPYGERDDQQVFIQKVVPSASQLFVRLSSTGQRVCSVRSVDGSPTTAFTVLECEGSRRLGSRPRRYLLTGQANGSLAMWDLTTAMDGLGQAPAGGLTEQELMEQLEHCELAPPAPSAPSWGCLPSPSPRISLTSLHSASSNTSLSGHRGSPSPPQAEARRRGGGSFVERCQELVRSGPDLRRPPTPAPWPSSGLGTPLTPPKMKLNETSF

SEQ ID NO: 9058 - protein, 266 aa, Homo sapiens
MELLTALLRLFLSRPAECQDMLGRLLYYCIEEEKDMAVRDRGLFYYRLLLVGIDEVKRILCSPKSDPTLGLLEDPAERPVNSWASDFNTLVPVYGKAHWATISKCQGAERCDPELPKTSSFAASGPLIPEENKERVQELPDSGALMLVPNRQLTADYFEKTWLSLKVAHQQVLPWRGEFHPDTLQMALQVVNIQTIAMSRAGSRPWKAYLSAQDDTGCLFLTELLLEPGNSEMQISVKQNEARTETLNSFISVLETVIGTIEEIKS

SEQ ID NO: 9059 - protein, 48 aa, Homo sapiens
MLLKRNLLILILFLVTCFNFVSFFFFPWKLLGSPFYPCSLRSDNDGCV

SEQ ID NO: 9060 - protein, 130 aa, Homo sapiens [sequence omitted]

SEQ ID NO: 9061 - protein, 17 aa, Homo sapiens
MRVVSGTLFIHFLVLIF

SEQ ID NO: 9062 - protein, 81 aa, Homo sapiens [sequence omitted]

SEQ ID NO: 9063 - protein, 331 aa, Homo sapiens
  SITE (176): Xaa equals any amino acid
MALSGGLRCCRRVLSWVPVLVIVLVVLWSYYAYVFELCLVTVLSPAEKVIYLILYHAIFVFFTWTYWKSIFTLPQQPNQKFHLSYTDKERYENEERPEVQKQMLVDMAKKLPVYTRTGSGAVRFCDRCHLIKPDRCHHCSVCAMCVLKMDHHCPWVNNCIGFSNYKFFLQFLAYSXLYCLYIATTVFSYFIKYWRGELPSVRSKFHVLFLLFVACMFFVSLVILFGYHCWLVSRNKTTLEAFCTPVFTSGPEKNGFNLGFIKNIQQVFGDKKKFWLIPIGSSPGDGHSFPMRSMNESQNPLLANEETWEDNEDDNQDYPEGSSSLAVETET

SEQ ID NO: 9064 - protein, 41 aa, Homo sapiens
MAFPRVGAFLFLASLSSLLHCRLLAEAVSGRSVSLAPSIIR

SEQ ID NO: 9065 - protein, 120 aa, Homo sapiens
EVLFSNDSVLGHFPHQSPNERARLYFLLAWFHAIIQERLRYAPLGWSKKYEFGESDLRSACDTVDTWLDDTAKASVGHARTDSGRVSGKDAAGRGAERPDSAWKSELTPRDRQSLAGHGE

SEQ ID NO: 9066 - protein, 130 aa, Homo sapiens
MAFFFTFMAQLVISIIQAVGIPGWGVCGWIATISFFGTNIGSAVVMLIPTVMFTVMAVFSFIALSMVHKFYRGSGGSFSKAQEEWTTGAWKNPHVQQAAQNAAMGAAQGAMNQPQTQYSATPNYTYSNEM

SEQ ID NO: 9067 - protein, 56 aa, Homo sapiens
MAKTDFSIILLKLHCLFFFSVISVHCAQSFISVTQTEPSPAVCIFPAVGSGLGPCD

SEQ ID NO: 9068 - protein, 408 aa, Homo sapiens
  SITE (223): Xaa equals any amino acid
MRSSCVLLTALVALAAYYVYIPLPGSVSDPWKLMLLDATFRGAQQVSNLIHYLGLSHHLLALNFIIVSFGQKSAWSSAQVKVTDTDFDGVEVRVFEGPPKPEEPLKRSVVYIHGGGWALASAKISYYDELCTAMAEELNAVIVSIEYRLVPKVYFPEQIHDVVRATKYFLKPEVLQKYMVDPGRICISGDSAGGNLAAALGQQFTQDASLKNKLKLQALIYPXLQALDFNTPSYQQNVNTPILPRYVMVKYWVDYFKGNYDFVQAMIVNNHTSLDVEEAAAVRARLNWTSLLPASFTKNYKPVVQTTGNARIVQELPQLLDARSAPLIADQAVLQLLPKTYILTCEHDVLRDDGIMYAKRLESAGVEVTLDHFEDGFHGCMIFTSWPTNFSVGIRTRNSYIKWLDQNL

SEQ ID NO: 9069 - protein, 73 aa, Homo sapiens
MWLPAWAAIETFSTCSSLSLSFQPRWALASEGCAGSYVTTHRALGAHLWPLWSDQFLGKGLGLRIPFITHAHQ

SEQ ID NO: 9070 - protein, 36 aa, Homo sapiens
  SITE (17): Xaa equals any amino acid
MAGEEMAWGARLWIMCXLLFLAASEGIMPRLRASAW

SEQ ID NO: 9071 - protein, 48 aa, Homo sapiens
MLICRLVLLADPGPVNFMVRLFVVIVMFAWSIVGKYVLISTITEQTKT

SEQ ID NO: 9072 - protein, 309 aa, Homo sapiens
MITFLPIIFSILVVVTFVIGNFANGFIALVNSTEWVKRQKISFADQIVTALAVSRVGLLWVLLLNWYSTVLNPAFCSVELRTTAYNIWAVTGHFSNWPATSLSIFYLLKIANFSNLIFLRLKRRVKSVILVMLLGPLLFLACYLFVVNMNQIVWTKEYEGNMTWKIKLRRAVYLSDTTVTMLANLVPFTVTLLSFLLLVCSLCKHLKKMHLHGKGSQDPSTKVHIKVLQTVISFLLLCAIYFVSVIISVWSFKNLENKPVFMFCQAIGFSYPSIHPFILIWGNKKLKQTFLSVLRQVRYWVKGEKPSSP

SEQ ID NO: 9073 - protein, 55 aa, Homo sapiens
MAVIHYQQFLWFLELVLQCSWGQTLIGCFFVVLRGHLCSIVRTGKRMFLEHCDLE

SEQ ID NO: 9074 - protein, 195 aa, Homo sapiens
MYCYPGSHLARALTRALALALVLALLVGPFLSGLAGAIPAPGGRWARDGPVPPASRSRSVLLDVSAGQLLMVDGRHPDAVAWANLTNAIRETGWAFLELGTSGQYNDSLQDPEPAGGQRSHVGPGAPVPVEHLALQRPAAHGPARPLEVRACQGFMGLKFCPCSAAFAPADPRQGHPRPKATGLLTPAPPGGFVL

SEQ ID NO: 9075 - protein, 40 aa, Homo sapiens
MILYICLLLKIWGCSLPCNFSFPLDLRKVMDFQFVQHFFL

SEQ ID NO: 9076 - protein, 54 aa, Homo sapiens [sequence omitted]

SEQ ID NO: 9077 - protein, 41 aa, Homo sapiens
  SITE (3): Xaa equals any amino acid
MAXLDNCLMLLITSGTWLGSVARKTWQAICDSGSSGCALIR

SEQ ID NO: 9078 - protein, 151 aa, Homo sapiens
MNGLLLFPHTFILSMVFPTSLAIQLLFLLPKMSEHSLSVQLSPHLTSSLRMFFCCYHSFSSYEFLCYIASPSLRLAFLHSLFQLTHFLSPNLVSSSRTLILYFCFLFKQCLAKRQEWQSMNTQIDMRICLGPCIFMYILSSSILLNEFILH

SEQ ID NO: 9079 - protein, 96 aa, Homo sapiens
MTLPTSQCLICLLQALCGIGHGALAWGSNQVLFPGGQQEDGGCQRIPDPSFLSTPCGKQGGHAEQELQQCWGAFCQLPGCVLHFHPGVLHKAHSEW

SEQ ID NO: 9080 - protein, 290 aa, Homo sapiens
  SITE (166): Xaa equals any amino acid
  SITE (268): Xaa equals any amino acid
  SITE (272): Xaa equals any amino acid
MPLLTLYLLLFWLSGYSIATQITGPTTVNGLERGSLTVQCVYRSGWETYLKWWCRGAIWRDCKILVKTSGSEQEVKRDRVSIKDNQKNRTFTVTMEDLMKTDADTYWCGIEKTGNDLGVTVQVTIDPAPVTQEETSSSPTLTGHHLDNRHKLLKLSVLLPLIFTIXLLLLVAASLLAWRMMKYQQKAAGMSPEQVLQPLEGDLCYADLTLQLAGTSPRKATTKLSSAQVDQVEVEYVTMASLPKEDISYASLTLGAEDQEPTYCNMGXLSSXLPGRGPEEPTEYSTISRP

SEQ ID NO: 9081 - protein, 53 aa, Homo sapiens [sequence omitted]

SEQ ID NO: 9082 - protein, 189 aa, Homo sapiens
  SITE (40): Xaa equals any amino acid
MQLLLCDALLAILPCHPLSGLHLPWGMDGFRVGGPVGALXQSHPSSSEWAGLEEQPGSPEWPRSPPTHRCIGLPSGDPVHIAGTTLVGPLVGARDRLGPLWGRHFGFLFHAVLFGWEPHRGRSWNHPTPTPGRSLWWGHTQVEVVVGAGVCRGVGGAGVWLSWPRTQAGEAQVRHFTQTDAQSSHFTLF

SEQ ID NO: 9083 - protein, 231 aa, Homo sapiens
  SITE (92): Xaa equals any amino acid
  SITE (113): Xaa equals any amino acid
  SITE (116): Xaa equals any amino acid
MQAGKGLAQVWGVATFVQLCAHTVFLSMYLCMHICFAAISSKVRVRVNAPFCVSVPLKVHAPLSLGIKVGLQGQKHGRATGEAGMPQGEMLXKQEPQTSSSPKPTRRREVSRXELXPVIPSAATLIIVVCVGFLVLMVVLGLVRIHSLHRRVSGAGGPPGASSDPKDPDLFWDDSALTIIVNPMESYQNRQSCVTGAVGGQQEDEDSSDSEVADSPSSDERRIIETPPHRY

SEQ ID NO: 9084 - protein, 531 aa, Homo sapiens
MLCALLLLPSLLGATRASPTSGPQECAKGSTVWCQDLQTAARCGAVGYCQGAVWNKPTAKSLPCDVCQDIAAAAGNGLNPDATESDILALVMKTCEWLPSQESSAGCKWMVDAHSSAILSMLRGAPDSAPAQVCTALSLCEPLQRHLATLRPLSKEDTFEAVAPFMANGPLTFHPRQAPEGALCQDCVRQVSRLQEAVRSNLTLADLNIQEQCESLGPGLAVLCKNYLFQFFVPADQALRLLPPQELCRKGGFCEELGAPARLTQVVAMDGVPSLELGLPRKQSEMQMKAGVTCEVCMNVVQKLDHWLMSNSSELMITHALERVCSVMPASITKECIILVDTYSPSLVQLVAKITPEKVCKFIRLCGNRRRARAVHDAYAIVPSPEWDAENQGSFCNGCKRLLTVSSHNLESKSTKRDILVAFKGGCSILPLPYMIQCKHFVTQYEPVLIESLKDMMDPVAVCKKVGACHGPRTPLLGTDQCALGPSFWCRSQEAASCATLCNTARSMYGKRCTSTLGNTRDRGCQRPRAC

SEQ ID NO: 9085 - protein, 293 aa, Homo sapiens
MTGLYELVWRVLHALLCLHRTLTSWLRVRFGTWNWIWRRCCRAASAAVLAPLGFTLRKPPAVGRNRRHHRHPRGGSCLAAAHHRMRWRADGRSLEKLPVHMGLVITEVEQEPSFSDIASLVVWCMAVGISYISVYDHQGIFKRNNSRLMDEILKQQQELLGLDCSKYSPEFANSNDKDDQVLNCHLAVKVLSPEDGKADIVRAAQDFCQLVAQKQKRPTDLDVDTLASLLSSNGCPDPDLVLKFGPVDSTLGFLPWHIRLTEIVSLPSHLNISYEDFFSALRQYAACEQRLGK

SEQ ID NO: 9086 - protein, 211 aa, Homo sapiens
MISLPGPLVTNLLRFLFLGLSALDVIRGSLSLTNLSSSMAGVYVCKAHNEVGTAQCNVTLEVSTGPGAAVVAGAVVGTLVGLGLLAGLVLLYHRRGKALEEPANDIKEDAIAPRTLPWPKSSDTISKNGTLSSVTSARALRPPHGPPRPGALTPTPSLSSQALPSPRLPTTDGAHPQPISPIPGGVSSSGLSRMGAVPVMVPAQSQAGSLV

SEQ ID NO: 9087 - protein, 17 aa, Homo sapiens
MLSGSLGSAVCMSSQPR

SEQ ID NO: 9088 - protein, 290 aa, Homo sapiens
MRRPAAVPLLLLLCFGSQRAKAATACGRPRMLNRMVGGQDTQEGEWPWQVSIQRNGSHFCGGSLIAEQWVLTAAHCFRNTSETSLYQVLLGARQLVQPGPHAMYARVRQVESNPLYQGTASSADVALVELEAPVPFTNYILPVCLPDPSVIFETGMNCWVTGWGSPSEEDLLPEPRILQKLAVPIIDTPKCNLLYSKDTEFGYQPKTIKNDMLCAGFEEGKKDACKGDSGGPLVCLVGQSWLQAGVISWGEGCARQNRPGVYIRVTAHHNWIHRIIPKLQFQPARLGGQK

SEQ ID NO: 9089 - protein, 69 aa, Homo sapiens
MHGMHAAGTGTELTLSGCQPLSTLLLLLLYYCPSFVHSINMCKAAALSLPWAAGQHRGGLSGGAGERMA

SEQ ID NO: 9090 - protein, 340 aa, Homo sapiens; identical to SEQ ID NO: 5999

SEQ ID NO: 9091 - protein, 489 aa, Homo sapiens
MTGQIPRLSKVNLFTLLSLWMELFPAEAQRQKSQKNEEGKHGPLGDNEERTRVSTDKRQVKRTGLVVVKNMKIVGLHCSSEDLHAGQIALIKHGSRLKNCDLYFSRKPCSACLKMIVNAGVNRISYWPADPEISLLTEASSSEDAKLDAKAVERLKSNSRAHVCVLLQPLVCYMVQFVEETSYKCDFIQKITKTLPDANTDFYYECKQERIKEYEMLFLVSNEEMHKQILMTIGLENLCENPYFSNLRQNMKDLILLLATVASSVPNFKHFGFYRSNPEQINEIHNQSLPQEIARHCMVQARLLAYRTEDHKTGVGAVIWAEGKSRSCDGTGAMYFVGCGYNAFPVGSEYADFPHMDDKQKDREIRKFRYIIHAEQNALTFRCQEIKPEERSMIFVTKCPCDECVPLIKGAGIKQIYAGDVDVGKKKADISYMRFGELEGVSKFTWQLNPSGAYGLEQNEPERRENGVLRPVPQKEEQHQDKKLRLGIH

SEQ ID NO: 9092 - protein, 577 aa, Homo sapiens
MYLLEQIDMHGFGGTAATSPLTAVFSLSRSLLAAALLYGFCLGAIKTPWPEQHVPVLFSVFCGLLVALSYHLSRQSSDPTVLWSLIRSKLFPELEERSLETARAEPPDPLPDKMRQSVREVLHSDLVMCVVIAVLTFAISASTVFIALKSVLGFVLYALAGAVGFFTHYLLPQLRKQLPWFCLSQPVLKPLEYSQYEVRGAAQVMWFEKLYAGLQCVEKYLIYPAVVLNALTVDAHTVVSHPDKYCFYCRALLMTVAGLKLLRSAFCCPPQQYLTLAFTVLLFHFDYPRLSQGFLLDYFLMSLLCSKLWDLLYKLRFVLTYIAPWQITWGSAFHAFAQPFAVPHSAMLFVQALLSGLFSTPLNPLLGSAVFIMSYARPLKFWERDYNTKRVDHSNTRLVTQLDRNPGADDNNLNSIFYEHLTRSLQHTLCGDLVLGRWGNYGPGDCFVLASDYLNALVHLIEVGNGLVTFQLRGLEFRGTYCQQREVEAITEGVEEDEGCCCCEPGHLPRVLSFNAAFGQRWLAWEVTASKYVLEGYSISDNNAASMLQVFDLRKILITYYVKVRWAGVAGQQGPCG

SEQ ID NO: 9093 - protein, 89 aa, Homo sapiens
MKPATASALLLLLLGLAWTQGSHGWGADASSLQKRAGRADQVSLCPQVTLQGPWSPLALLPGLGNLKFSFTPPFNGFLSRVQDGRRWQL

SEQ ID NO: 9094 - protein, 492 aa, Homo sapiens
MKLLLLHPAFQSCLLLTLLGLWRTTPEAHASSPGAPAISAASFLQDLIHRYGEGDSLTLQQLKALLNHLDVGVGRGNVTQHVQGHRNLSTCFSSGDLFTAHNFSEQSRIGSSELQEFCPTILQQLDSRACTSENQENEENEQTEEGRPSAVEVWGYGLLCVTVISLCSLLGASVVPFMKKTFYKRLLLYFIALAIGTLYSNALFQLIPEAFGFNPLEDYYVSKSAVVFGGFYLFFFTEKILKILLKQKNEHHHGHSHYASESLPSKKDQEEGVMEKLQNGDLDHMIPQHCSSELDGKAPMVDEKVIVGSLSVQDLQASQSACYWLKGVRYSDIGTLAWMITLSDGLHNFIDGLAIGASFTVSVFQGISTSVAILCEEFPHELGDFVILLNAGMSIQQALFFNFLSACCCYLGLAFGILAGSHFSANWIFALAGGMFLYISLADMFPEMNEVCQEDERKGSILIPFIIQNLGLLTGFTIMVVLTMYSGQIQIG

SEQ ID NO: 9095 - protein, 116 aa, Homo sapiens
MGSGCPAQPTLSPWGILSRLLGVLAGTSCGVSTPAAAQGGPEIGCRAPHLHLSGHAPLACPCSFLPTSLGGVCVSAPAPALLSWGTLPAIWYWGCPHCLVLGPGPAHSGLALLVCS

SEQ ID NO: 9096 - protein, 147 aa, Homo sapiens
MWLWVWLIHTLHSGLQKPRERSLPEATFQNLLHPPTDLPSPCPLFESRCQVLPADTWLLEGRCSFHLTMQACFAVGRAVLSSSQLHTGITWRVQKLPASVKEHQCISTANIPNARLDSLQLPGPPGFSSFQELSDPGSSLNVGYKLT

SEQ ID NO: 9097 - protein, 149 aa, Homo sapiens [sequence omitted]

SEQ ID NO: 9098 - protein, 300 aa, Homo sapiens
MGRPRPRAAKTWMFLLLLGGAWAACGSLDLLTKLYAENLPCVHLNPQWPSQPSHCPRGWRSNPLPPAAGHSRAQEDKVLGGHECQPHSQPWQAALFQGQQLLCGGVLVGGNWVLTAAHCKKPKYTVRLGDHSLQNKDGPEQEIPVVQSIPHPCYNSSDVEDHNHDLMLLQLRDQASLGSKVKPISLADHCTQPGQKCTVSGWGTVTSPRENFPDTLNCAEVKIFPRRSVRMLTRGRSQMAWSVQAAAKGLTRARAILEAPWCVMVHSRASHPGAQTPVGGPTNLASIPTSAATWTGSRRS

SEQ ID NO: 9099 - protein, 251 aa, Homo sapiens
MLFHYDWISIPLVYTQVVTIAVYSFFALSLVGRQFVEPEAGAAKPQKLLKPGQEPAPALGDPDMYVPLTTLLQFFFYAGWLKVAEQIINPFGEDDDDFETNQLIDRNLQVSLLSVDEMYQNLPPAEKDQYWDEDQPQPPYTVATAAESLRPSFLGSTFNLRMSDDPEQSLQVEASPGSGRPAPAAQTPLLGRFLGVGAPSPAISLRNFGRVRGTPRPPHLLRFRAEEGGDPEAAARIEEESAESGDEALEP

SEQ ID NO: 9100 - protein, 44 aa, Homo sapiens
MGVALPSPLLCSLPLFLLFGDVSGSSSLLALLPFLHPWHHPSLS

SEQ ID NO: 9101 - protein, 264 aa, Homo sapiens
MCLLGALVLLGLGVLLFSGGLSESETGPMEEVERQVLPDPEVLEAVGDRQDGLREQLQAPVPPDSVPSLQNMGLLLDKLAKENQDIRLLQAQLQAQKEELQSLMHQPKGLEEENAQLRGALQQGEAFQRALESELQQLRARLQGLEADCVRGPDGVCLSGGRGPQGDKAIREQGPREQEPELSFLKQKEQLEAEAQALSLEEVAVQQTGDDDEVDDFEDFIFSHFFGDKALKKRSGKKDKHSQSPRAAGPREGHSHSHHHHHRG

SEQ ID NO: 9102 - protein, 40 aa, Homo sapiens
MCEYVLLLYIVLLCNRSYAVFTQCVLRSSPIDSSRNAVLL

SEQ ID NO: 9103 - protein, 551 aa, Homo sapiens
MGSWALLWPPLLFTGLLVRPPGTMAQAQYCSVNKDIFEVEENTNVTEPLVDIHVPEGQEVTLGALSTPFAFRIQGNQLFLNVTPDYEEKSLLEAQLLCQSGGTLVTQLRVFVSVLDVNDNAPEFPFKTKEIRVEEDTKVNSTVIPETQLQAEDRDKDDILFYTLQEMTAGASDYFSLVSVNRPALRLDRPLDFYERPNMTFWLLVRDTPGENVEPSHTATATLVLNVVPADLRPPWFLPCTFSDGYVCIQAQYHGAVPTGHILPSPLVLRPGPIYAEDGDRGINQPIIYSIFRGNVNGTFIIHPDSGNLTVARSVPSPMTFLLLVKGQQADLARYSVTQVTVEAVAAAGSPPRFPQSLYRGTVARGAGAGVVVKDAAAPSQPLRIQAQDPEFSDLNSAITYRITNHSHFRMEGEVVLTTTTLAQAGAFYAEVAAPRRTSASRWWIWRPWAGCWVRCCCWLSLASPSLSTSTMAPGSSAALAKLRSPSPKALTTRRSSLTTRPTGRPSPAPRTTPSPRRHRCPQSPHPPALPPQAVPLSPPQRPELAEAPRR

SEQ ID NO: 9104 - protein, 571 aa, Homo sapiens
MERAVRVESGVLVGVVCLLLACPATATGPEVAQPEVDTTLGRVRGRQVGVKGTDRLVNVFLGIPFAQPPLGPDRFSAPHPAQPWEGVRDASTAPPMCLQDVESMNSSRFVLNGKQQIFSVSEDCLVLNVYSPAEVPAGSGRPVMVWVHGGALITGAATSYDGSALAAYGDVVVVTVQYRLGVLGFFSTGDEHAPGNQGFLDVVAALRWVQENIAPFGGDLNCVTVFGGSAGGSIISGLVLSPVAAGLFHRAITQSGVITTPGIIDSHPWPLAQKIANTLACSSSSPAEMVQCLQQKEGEELVLSKKLKNTIYPLTVDGTVFPKSPKELLKEKPFHSVPFLMGVNNHEFSWLIPRGWGLLDTMEQMSREDMLAISTPVLTSLDVPPEMMPTVIDEYLGSNSDAQAKCQAFQEFMGDVFINVPTVSFSRYLRDSGSPVFFYEFQHRPSSFAKIKPAWVKADHGAEGAFVFGGPFLMDESSRLAFPEATEEEKQLSLTMMAQWTHFARTGDPNSKALPPWPQFNQAEQYLEINPVPRAGQKFREAWMQFWSETLPSKIQQWHQKQKNRKAQEDL

SEQ ID NO: 9105 - protein, 439 aa, Homo sapiens
MVPSSPRALFLLLLILACPEPRASQNCLSKQQLLSAIRQLQQLLKGQETRFAEGIRHMKSRLAALQNSVGRVGPDALPVSCPALNTPADGRKFGSKYLVDHEVHFTCNPGFRLVGPSSVVCLPNGTWTGEQPHCRGISECSSQPCQNGGTCVEGVNQYRCICPPGRTGNRCQHQAQTAAPEGSVAGDSAFSRAPRCAQVERAQHCSCEAGFHLSGAAGDSVCQDVNECELYGQEGRPRLCMHACVNTPGSYRCTCPGGYRTLADGKSCEDVDECVGLQPVCPQGTTCINTGGSFQCVSPECPEGSGNVSYVKTSPFQCERNPCPMDSRPCRHLPKTISFHYLSLPSNLKTPITLFRMATASAPGRAGPNSLRFGIVGGNSRGHFVMQRSDRQTGDLILVQNLEGPQTLEVDVDMSEYLDRSFQANHVSKVTIFVSPYDF

SEQ ID NO: 9106 - protein, 42 aa, Homo sapiens
MLLSWTVLIIILPFAGDVSSHLCILRPFAGSVSSCLSNFKRI

SEQ ID NO: 9107 - protein, 403 aa, Homo sapiens
MATAERRALGIGFQWLSLATLVLICAGQGGRREDGGPACYGGFDLYFILDKSGSVLHHWNEIYYFVEQLAHKFISPQLRMSFIVFSTRGTTLMKLTEDREQIRQGLEELQKVLPGGDTYMHEGFERASEQIYYENRQGYRTASVIIALTDGELHEDLFFYSEREANRSRDLGAIVYCVGVKDFNETQLARIADSKDHVFPVNDGFQALQGIIHSILKKSCIEILAAEPSTICAGESFQVVVRGNGFRHARNVDRVLCSFKINDSVTLNEKPFSVEDTYLLCPAPILKEVGMKAALQVSMNDGLSFISSSVIITTTHCSDGSILAIALLILFLLLALALLWWFWPLCCTVIIKEVPPPPAEESEVSDHSRMAVGGQGGRVGWRAGWAAGHLAPCRAELSQAQRI

SEQ ID NO: 9108 - protein, 164 aa, Homo sapiens [sequence omitted]

SEQ ID NO: 9109 - protein, 190 aa, Homo sapiens [sequence omitted]

SEQ ID NO: 9110 - protein, 691 aa, Homo sapiens
  SITE (466): Xaa equals any amino acid
  SITE (467): Xaa equals any amino acid
MASLVSLELGLLLAVLVVTATASPPAGLLSLLTSGQGALDQEALGGLLNTLADRVHCANGPCGKCLSVEDALGLGEPEGSGLPPGPVLEARYVARLSAAAVLYLSNPEGTCEDARAGLWASHADHLLALLESPKALTPGLSWLLQRMQARAAGQTPKTACVDIPQLLEEAVGAGAPGSAGGVLAALLDHVRSGSCFHALPSPQYFVDFVFQQHSSEVPMTLAELSALMQRLGVGREAHSDHSHRHRGASSRDPVPLISSSNSSSVWDTVCLSARDVMAAYGLSEQAGVTPEAWAQLSPALLQQQLSGACTSQSRPPVQDQLSQSERYLYGSLATLLICLCAVFGLLLLTCTGCRGVTHYILQTFLSLAVGALTGDAVLHLTPKVLGLHTHSEEGLSPQPTWRLLAMLAGLYAFFLFENLFNLLLPRDPEDLEDGPCGHSSHSHGGHSHGVSLQLAPSELRQPKPPXXGSRADLVAEESPELLNPEPRRLSPGEPQVATPEGLGDLGFVWSAGWGEGLVAEESPELLNPEPRRLSPELRLLPYMITLGDAVHNFADGLAVGAAFASSWKTGLATSLAVFCHELPHELGDFAALLHAGLSVRQALLLNLASALTAFAGLYVALAVGVSEESEAWILAVATGLFLYVALCDMLPAMLKVRDPRPWLLFLLHNVGLLGGWTVLLLLSLYEDDITF

SEQ ID NO: 9111 - protein, 604 aa, Homo sapiens
MVEEPGRFLPLWLHILLITVLLVLSGIFSGLNLGLMALDPMELRIVQNCGTEKERRYARKIEPIRRKGNYLLCSLLLGNVLVNTSLTILLDNLIGSGLMAVASSTIGIVIFGEILPQALCSRHGLAVGANTILLTKFFMLLTFPLSFPISKLLDFFLGQEIRTVYNREKLMEMLKVTEPYNDLVKEELNMIQGALELRTKTVEDIMTQLQDCFMIRSDAILDFNTMSEIMESGYTRIPVFEDEQSNIVDILYVKDLAFVDPDDCTPLKTITRFYNHPVHFVFHDTKLDAMLEEFKKGKSHLAIVQKVNNEGEGDPFYEVLGLVTLEDVIEEIIKSEILDESDMYTDNRSRKRVSEKNKRDFSAFKDADNELKVKISPQLLLAAHRFLATEVSQFSPSLISEKILLRLLKYPDVIQELKFDEHNKYYARHYLYTRNKPADYFILILQGKVEVEAGKENMKFETGAFSYYGTMALTSVPSDRSPAHPTPLSRSASLSYPDRTDVSTAATLAGSSNQFGSSVLGQYISDFSVRALVDLQYIKITRQQYQNGLLASRMENSPQFPIDGCTTHMENLAEKSELPVVDETTTLLNERNSLLHKASHENAI

SEQ ID NO: 9112 - protein, 262 aa, Homo sapiens; identical to SEQ ID NO: 6503

SEQ ID NO: 9113 - protein, 299 aa, Homo sapiens
  SITE (167): Xaa equals any amino acid
MMSSKPTSHAEVNETIPNPYPPSSFMAPGFQQPLGSINLENQAQGAQRAQPYGITSPGIFASSQPGQGNIQMINPSVGTAVMNFKEEAKALGVIQIMVGLMHIGFGIVLCLISFSFREVLGFASTAVIGGYPFWGGLSFIISGSLSVSASKELSRCLVKGSLGMNIXSSILAFIGVILLLVDMCINGVAGQDYWAVLSGKGISATLMIFSLLEFFVACATAHFANQANTTTNMSVLVIPNMYESNPVTPASSSAPPRCNNYSANAPKRKRGISLISWRKTTCKNFLRRCLLLSTMISSL

SEQ ID NO: 9114 - protein, 42 aa, Homo sapiens
MFKKDLICKRWSFFFWGLLISVVILTSFSNYSRRFYLDLYFS

SEQ ID NO: 9115 - protein, 150 aa, Homo sapiens [sequence omitted]

SEQ ID NO: 9116 - protein, 144 aa, Homo sapiens
  SITE (15): Xaa equals any amino acid
  SITE (16): Xaa equals any amino acid
  SITE (24): Xaa equals any amino acid
  SITE (70): Xaa equals any amino acid
QFHTGNSYDHDYAKXXYGNLYYRXSWYACRYRSGIPGSTHASEKIFLSKLIVCFLSTWLPFVLLQVIIVXLKVQIPAYIEMNIPWLYFVNSFLIATVYWFNCHKLNLKDIGLPLDPFVNWKCCFIPLTIPNLEQIEKPISIMIC

SEQ ID NO: 9117 - protein, 547 aa, Homo sapiens
MSSNTMLQKTLLILISFSVVTWMIFIISQNFTKLWSALNLSISVHYWNNSAKSLFPKTSLIPLKPLTETELRIKEIIEKLDQQIPPRPFTHVNTTTSATHSTATILNPRDTYCRGDQLDILLEVRDHLGQRKQYGGDFLRARMSSPALTAGASGKVMDFNNGTYLVSFTLFWEGQVSLSLLLIHPSEGASALWRARNQGYDKIIFKGKFVNGTSHVFTECGLTLNSNAELCEYLDDRDQEAFYCMKPQHMPCEALTYMTTRNREVSYLTDKENSLFHRSKVGVEMMKDRKHIDVTNCNKREKIEETCQVGMKPPVPGGYTLQGKWITTFCNQVQLDTIKINGCLKGKLIYLLGDSTLRQWIYYFPKVVKTLKFFDLHETGIFKKHLLLDAERHTQIQWKKHSYPFVTFQLYSLIDHDYIPREIDRLSGDKNTAIVITFGQHFRPFPIDIFIRRAIGVQKAIERLFLRSPATKVIIKTENIREMHIETERFGDFHGYIHYLIMKDIFKDLNVGIIDAWDMTIAYGTDTIHPPDHVIGNQINMFLNYIC

SEQ ID NO: 9118 - protein, 473 aa, Homo sapiens
  SITE (321): Xaa equals any amino acid
  SITE (386): Xaa equals any amino acid
  SITE (391): Xaa equals any amino acid
MASAVRGSRPWPRLGLQLQFAALLLGTLSPQVHTLRPENLLLVSTLDGSLHALSKQTGDLKWTLRDDPVIEGPMYVTEMAFLSDPADGSLYILGTQKQQGLMKLPFTIPELVHASPCRSSDGVFYTGRKQDAWFVVDPESGETQMTLTTEGPSTPRLYIGRTQYTVTMHDPRAPALRWNTTYRRYSAPPMDGSPGKYMSHLASCGMGLLLTVDPGSGTVLWTQDLGVPVMGVYTWHQDGLRQLPHLTLARDTLHFLALRWGHIRLPASGPRDTATLFSTLDTQLLMTLYVGKDETGFYVSKALVHTGVALVPRGLTLAPAXGPTTDEVTLQVSGEREGSPSTAVRYPSGSVALPSQWLLIGHHELPPVLHTTMLRVHPTLGSGTAXTRPPXNTQAPAFFLELLSLSREKLWDSELHPEEKTPDSYLGLGPQDLLAASLTAVLLGGWILFVMRQQQPQVVEKQQETPLAPAAWG

SEQ ID NO: 9119 - protein, 86 aa, Homo sapiens
MLTAVKMFRLSAVTLCAFSLTLHSGVQLCEQLVLRIALFQNCRAEDGFGLRVCWRRLMRSFCRSAKFWGSNDLRTWGSRFLWKDCT

SEQ ID NO: 9120 - protein, 123 aa, Homo sapiens
MANPGLGLLLALGLPFLLARWGRAWGQIQTTSANENSTVLPSSTSSSSDGNLRPEAITAIIVVFSLLAALLLAVGLALLVRKLREKRQTEGTYRPSSEEQFSHAAEARAPQDSKETVQGCLPI

SEQ ID NO: 9121 - protein, 376 aa, Homo sapiens
  SITE (30): Xaa equals any amino acid
MGLLAFLKTQFVLHLLVGFVFVVSGLVINXVQLCTLALWPVSKQLYRRLNCRLAYSLWSQLVMLLEWWSCTECTLFTDQATVERFGKEHAVIILNHNFEIDFLCGWTMCERFGVLGSSKVLAKKELLYVPLIGWTWYFLEIVFCKRKWEEDRDTVVEGLRRLSDYPEYMWFLLYCEGTRFTETKHRVSMEVAAAKGLPVLKYHLLPRTKGFTTAVKCLRGTVAAVYDVTLNFRGNKNPSLLGILYGKKYEADMCVRRFPLEDIPLDEKEAAQWLHKLYQEKDALQEIYNQKGMFPGEQFKPARRPWTLLNFLSWATILLSPLFSFVLGVFASGSPLLILTFLGFVGAASFGVRRLIGVTEIEKGSSYGNQEFKKKE

SEQ ID NO: 9122 - protein, 50 aa, Homo sapiens
MVAQLVGCVVSCLFVLLRFLISTFGIMSFNGFVIFVTVLAAYNFSAGAFT

SEQ ID NO: 9123 - protein, 43 aa, Homo sapiens
MNWYHENKEATCNCQIFGLYFIVSFLSPVLAAAHDAKKYPVWL

SEQ ID NO: 9124 - protein, 91 aa, Homo sapiens
MAAAEEEDGGPEAKIASGAGRARPSNVIYVWRLLGKLWSVCVATCTVGHVFISGWRHGQNGKSVQYVKLGSAERRLSRFMGEGARSPRIPD

SEQ ID NO: 9125 - protein, 114 aa, Homo sapiens
MEKPLFPLVPLHWFGFGYTALVVSGGIVGYVKTGSVPSLAAGLLFGSLAGLGAYQLYQDPRNVWGFLAATSVTFVGVMGMRSYYYGKFMPVGLIAGASLLMAAKVGVRMLMTSD

SEQ ID NO: 9126 - protein, 221 aa, Homo sapiens
MFHGIPATPGIGAPGNKPELYEEVKLYKNAREREKYDNMAELFAVVKTMQALEKAYIKDCVSPSEYTAACSRLLVQYKAAFRQVQGSEISSIDEFCRKFRLDCPLAMERIKEDRPITIKDDKGNLNRCIADVVSLFITVMDKLRLEIRAMDEIQPDLRELMETMHRMSHLPPDFEGRQTVSQWLQTLSGMSASDELDDSQVRQMLFDLESAYNAFNRFLHA

SEQ ID NO: 9127 - protein, 58 aa, Homo sapiens
MCMQLFGFLAFMIFMCWVGDVYPVYQPVGPKQYPYNNLYLERGGDPSKEPERVVHYEI

SEQ ID NO: 9128 - protein, 39 aa, Homo sapiens
MFILAIWNFFILYLFSTVAGLVCKSLCQNQTIFKTALCF

SEQ ID NO: 9129 - protein, 25 aa, Homo sapiens
MSLILLLSVTLLHLSFSVGFFLFRL

SEQ ID NO: 9130 - protein, 49 aa, Homo sapiens
MASILLLLVLSHSCCCKNTCLQVLCNFDSVHNLSTLILKIIIRVDVLVY

SEQ ID NO: 9131 - protein, 98 aa, Homo sapiens
MCMRLCAALLPAPCTLRASWGVRGAQWGFSSLHEPGDPRGGSIWDEPPPPNAQASPQDPGGGHHSGKPGVGVGFGLSTFLLQIPPTHPSPKSSPLALA

SEQ ID NO: 9132 - protein, 44 aa, Homo sapiens
MHLLTLFSSGLIFLGCSTPLSFCDCLPILLLWLEFPVETSGVCS

SEQ ID NO: 9133 - protein, 40 aa, Homo sapiens
MMGERCLALNVLFAGVASCQRLFSRNLSCHCFGDYCDPSL

SEQ ID NO: 9134 - protein, 46 aa, Homo sapiens
MILKHYILTFIFLFIFLFFMLNILHSNSNLIDLLKGNIRFRLLNSM

SEQ ID NO: 9135 - protein, 81 aa, Homo sapiens
MVFRGEGWSMWRKEVSLLGDRGTWGVHRMSYNLLLDTALPGEPALRLQDQNPCLHLSKHRGEKPQRKGRNLYIYNIKSLGD

SEQ ID NO: 9136 - protein, 70 aa, Homo sapiens [sequence omitted]

SEQ ID NO: 9137 - protein, 44 aa, Homo sapiens
MGQQSCWMGLGCWLSLSGLSGVVRASPRSPRPRRGAACGETLMP

SEQ ID NO: 9138 - protein, 79 aa, Homo sapiens
MVPWFLLWSSFFIGTSSAYIDKQVKIVRQKSTYWGEKFLKRCERERIKESEQSGKRGELRERQQKSNEAGCIYQSIILI

SEQ ID NO: 9139 - protein, 30 aa, Homo sapiens
MGTQGCPHPSWLLLLGLSWWGEGDGAVGPC

SEQ ID NO: 9140 - protein, 60 aa, Homo sapiens
MHIPLWPNWLLFVCKLLFLSHPILLACVKCKSQVFPAGSNVFLSLNQGPTGCLLLQIKFY

SEQ ID NO: 9141 - protein, 85 aa, Homo sapiens
  SITE (72): Xaa equals any amino acid
MLHLIYYFVVIIQLMIARADIPQIATVFPGQCVKSVLLCIILFNPHSYLLCVLILWIEMLRVRKVKPPFQSXIASYLQRKFSTDL

SEQ ID NO: 9142 - protein, 47 aa, Homo sapiens
MNFVAALIFSPDQYNFILRIRLFWFLIICVLSGILLLFPSRTFSLHP

SEQ ID NO: 9143 - protein, 76 aa, Homo sapiens
MLIPGFLLPVVTLLSTASITGALGLNTSAISPFVSSMDTVNNGLSTPALCQSQGVGWGDTEENIFLLDACCANSPL

SEQ ID NO: 9144 - protein, 51 aa, Homo sapiens
MIKHVAWLIFTNCIFFCPVAFFSFAPLITAISISPEIMKSVTLIFFPCLLA

SEQ ID NO: 9145 - protein, 76 aa, Homo sapiens
MTKARLFRLWLVLGSVFMILLIIVYWDSAAPRTSTCTRPSLGRTRGRRCPRPGRTGQGAHGRLRCRRVSGQFLMLA

SEQ ID NO: 9146 - protein, 72 aa, Homo sapiens
MGSAALEILGLVLCLVGWGGLILACGLPMWQVTAFLDHNIVTAQTTWKGLWMSCVVQSTGTCSAKCTTRCWL

SEQ ID NO: 9147 - protein, 91 aa, Homo sapiens
  SITE (12): Xaa equals any amino acid
  SITE (49): Xaa equals any amino acid
  SITE (51): Xaa equals any amino acid
MVLRGWGLAWSXSPVVCGYSGDMKGVCWGRSDHSLLPSEILLPPAPCPXSXVLHNPPPTPHLPSPVLVRIQEAPTWAQRSSLGASPLHKGD

SEQ ID NO: 9148 - protein, 4 aa, Homo sapiens
LREL

SEQ ID NO: 9149 - protein, 14 aa, Homo sapiens
GCSLYNSFNNLLCL

SEQ ID NO: 9150 - protein, 6 aa, Homo sapiens
WALPMS

SEQ ID NO: 9151 - protein, 118 aa, Homo sapiens
MCYLLLLLIQTAELLIHPQGLQAVSNGESALKGTRPTFSSPFILVTEGRKEWEGVFLSSGWKGNTLSNYYISLVFYYSRILQPYFYCLWGKLEMVTLIRSVWRGINGGDKISVGFGKC

SEQ ID NO: 9152 - protein, 18 aa, Homo sapiens
PGPHCFIGLAMRLYYGSR

SEQ ID NO: 9153 - protein, 169 aa, Homo sapiens
MWAVLRLALRPCARASPAGPRAYHGDSVASLGTQPDLGSALYQENYKQMKALVNQLHERVEHIKLGGGEKARALHISRGKLLPRERIDNLIDPGSPFLELSQFAGYQLYDNEEVPGGGIITGIGRVSGVECMIIANDATVKGGAYYPVTVKKQLRAQEIAMQTGSPAST

SEQ ID NO: 9154 - protein, 47 aa, Homo sapiens
MTAGFMGMAVAIILFGWIIGVLGCCWDRGLMQYVAGCSSSWEGKQWN

SEQ ID NO: 9155 - protein, 203 aa, Homo sapiens
MQLGSVLLTRCPFWGCFSQLMLYAERAEARRKPDIPVPYLYFDMGAAVLCASFMSFGVKRRWFALGAALQLAISTYAAYIGGYVHYGDWLKVRMYSRTVAIIGGFLVLASGAGELYRRKPRSRSLQSTGQVFLGIYLICVAYSLQHSKEDRLAYLNHLPGGELMIQLFFVLYGILAPGLSVRLLRDPRCPDPGCTAAPCHAAH

SEQ ID NO: 9156 - protein, 123 aa, Homo sapiens
MHDGSKPFPRYGYKPSPPNGCGSPLFGVHLNIGIPSLTKCCNQHDRCYETCGKSKNDCDEEFQYCLSKICRDVQKTLGLTQHVQACETTVELLFDSVIHLGCKPYLDSQRAACRCHYEEKTDL

SEQ ID NO: 9157 - protein, 91 aa, Homo sapiens
MLRCGGRGLLLGLAVAAAAVMAARLMGWWGPRAGFRLFIPEELSRYRGGPGDPGLYLALLGRVYDVSSGRSTTSLGPTIAASQAETHPELS

SEQ ID NO: 9158 - protein, 110 aa, Homo sapiens; identical to SEQ ID NO: 5664

SEQ ID NO: 9159 - protein, 189 aa, Homo sapiens
MGPVRLGILLFLFLAVHEAWAGMLKEEDDDTERLPSKCEVCKLLSTELQAELSRTGRSREVLELGQVLDTGKRKRHVPYSVSETRLEEALENLCERILDYSVHAERKGSLRYAKGQSQTMATLKGLVQKGVKVDLGIPLELWDEPSVEVTYLKKQCETMLEEEEEEEEEEGGDKMTKTGSHPKLDREDL

SEQ ID NO: 9160 - protein, 68 aa, Homo sapiens [sequence omitted]

SEQ ID NO: 9161 - protein, 29 aa, Homo sapiens
  SITE (11): Xaa equals any amino acid
  SITE (13): Xaa equals any amino acid
IPLWFISVSFXMXRFTILNQYHVTCRCQN

SEQ ID NO: 9162 - protein, 62 aa, Homo sapiens
VIPFYIHYFVYFNCFILVTLPFKIFKLPIVRCQWEWTPDGQIYKWQWLDQTRTLEDGRVGAK

SEQ ID NO: 9163 - protein, 225 aa, Homo sapiens
  SITE (11): Xaa equals any amino acid
  SITE (112): Xaa equals any amino acid
  SITE (166): Xaa equals any amino acid
RPDLERVRPWXPPLPECAQELREGAAPGIPPRGCPGLGRGAPDSTSWTPCSRGGERMTPPPSRCLFPPRGRPVLHKPARLGCPFVHRAGKGAPRGRSSKPCLSFTFTFFFFXFGREKNRVFDSALFMFLLGNKRWLCVCVFSCVGFLKKWEEEKKILRPFPRSRSXLRFFRPVPPPFFVLFCFVLLRVHIPVCNPWFARFSVFSKVSLRQKPRAEFLGLEGQNFP

SEQ ID NO: 9164 - protein, 211 aa, Homo sapiens
  SITE (64): Xaa equals any amino acid
  SITE (113): Xaa equals any amino acid
STHASGRTCALPAAATPRRVGAAAPGCAQGRATDGARRAELRREPAVVAHRHGHAGAHQGGAQXAAQPHRRLQVPQAQAGAHLAPGRESEDPQESEHGAGVHGEPAARAGGAXQAESPQPRQQRLPAAAPAPGARVLSPRAGRMRGHPPQGAGSRGGVVGAPDLERVRPWGPPLPECAQELREGAAPGDSPPPRVPRTRQAGPPAPGGASA

SEQ ID NO: 9165 - protein, 23 aa, Homo sapiens
LGSLSTAPSSALPTLGARRTRSK

SEQ ID NO: 9166 - protein, 196 aa, Homo sapiens
  SITE (171): Xaa equals any amino acid
  SITE (175): Xaa equals any amino acid
  SITE (177): Xaa equals any amino acid
  SITE (181): Xaa equals any amino acid
  SITE (185): Xaa equals any amino acid
  SITE (188): Xaa equals any amino acid
  SITE (189): Xaa equals any amino acid
  SITE (193): Xaa equals any amino acid
MSLLVDGDMNLSIIMTISSTLLALVLMPLCLWIYSWAWINTPIVQLLPLGTVTLTLCSTLIPIGLGVFIRYKYSRVADYIVKVSLWSLLVTLVVLFIMTGTMLGPELLASIPAAVYVIAIFMPLAGYASGYGLATLFHLPPNCKRTVCLETGSQNVQLCTAILKLAFHRIXRKHXHXSFAXCTFXVCXXGDFXFNL

SEQ ID NO: 9167 - protein, 60 aa, Homo sapiens
MGNCQAGHNLHLCLAHHPPLVCATLILLLLGLSGLGLGSFLLTHRTGLRTLTSPRTGSLF

SEQ ID NO: 9168 - protein, 178 aa, Homo sapiens [sequence omitted]

SEQ ID NO: 9169 - protein, 219 aa, Homo sapiens
  SITE (41): Xaa equals any amino acid
AAATAASLSPRGCRLRTPSSDVSPSRAPPPSAAPLPTGRAXMSPSGRLCLLTIVGLILPTRGQTLKDTTSSSSADSTIMDIQVPTRAPDAVYTELQPTSPTPTWPADETPQPQTQTQQLEGTDGPLVTDPETHKSTKAAHPTDDTTTLSERPSPSTDVQTDPQTLKPSGFHEDDPFFYDEHTLRKRGLLVAAVLFITGIIILTSGKCRQLSRLCRNHCR

SEQ ID NO: 9170 - protein, 76 aa, Homo sapiens
MAGPWTFTLLCGLLAATLIQATLSPTAVLILGPKVIKEKLTQELKDHNATSILQQLPLLSAMREKPAGASLCWAAW

SEQ ID NO: 9171 - protein, 173 aa, Homo sapiens
MEAPGPRALRTALCGGCCCLLLCAQLAVAGKGARGFGRGALIRLNIWPAVQGACKQLEVCEHCVEGDRARNLSSCMWEQCRPEEPGHCVAQSEVVKEGCSIYNRSEACPAAHHHPTYEPKTVTTGSPPVPEAHSPGFDGASFIGGVVLVLSLQAVAFFVLHFLKAKDSTYQTL

SEQ ID NO: 9172 - protein, 210 aa, Homo sapiens
  SITE (139): Xaa equals any amino acid
  SITE (187): Xaa equals any amino acid
MEAPGPRALRTALCGGCCCLLLCAQLAVAGKGARGFGRGALIRLNIWPAVQGACKQLEVCEHCVEGDRARNLSSCMWEQCRPEEPGHCVAQSEVVKEGCSIYNRSEACPAAHHHPTYEPKTVTTGSPPVPEAHSPGFDXASFIGGVVLVLSLQAVAFFVLTSSRPRTAPTRRCEYLASSKYLSPSSXLVPAHVPFSTQGAVFSTGKPSGR

SEQ ID NO: 9173 - protein, 99 aa, Homo sapiens
MEGPRGWLVLCVLAISLASMVTEDLCRAPDGKKGEAGRPGRRGRPGLKGEQGEPGAPGIRTGIQGLKGDQGEPGPSGNPGKVGYPGPSGPLRSPWHPGN

SEQ ID NO: 9174 - protein, 245 aa, Homo sapiens; identical to SEQ ID NO: 5690

SEQ ID NO: 9175 - protein, 250 aa, Homo sapiens; identical to SEQ ID NO: 5692

SEQ ID NO: 9176 - protein, 250 aa, Homo sapiens; identical to SEQ ID NO: 5692

SEQ ID NO: 9177 - protein, 281 aa, Homo sapiens
MSILTMISSWPFSRVVRFWFLHQMVLDLCLGQGVPQQNLGKPKGKKKLSSVRQKFDHRFQPQNPLSGAQQFVAKDPQDDDDLKLCSHTMMLPTRGQLEGRMIVTAYEHGLDNVTEEAVSAVVYAVENHLKDILTSVVSRRKAYRLRDGHFKYAFGSNVTPQPYLKNSVVAYNNLIESPPAFTAPCAGQNPASHPPPDDAEQQAALLLACSGDTLPASLPPVNMYDLFEALQVHREVIPTHTVYALNIERIITKLWHPNHEELQQDKVHRQRLAAKEGLLLC

SEQ ID NO: 9178 - protein, 105 aa, Homo sapiens
  SITE (70): Xaa equals any amino acid
MISYIVLLSILLWPLVVYHELIQRMYTRLEPLLMQLDYSMKAEANALHHKHDKRKRQGKNAPPGGDEPLXETESESEAELAGFSPVVDVKKTALALAIYRLRAVR

SEQ ID NO: 9179 - protein, 89 aa, Homo sapiens
  SITE (24): Xaa equals any amino acid
  SITE (75): Xaa equals any amino acid
MFKDYPPAIKPSYDVLLLLLLLVXLLQAGLNTGTAIQCVRFKVSARLQGASWDTQNGPQERLAGEVARSPLKEFXKEKAWRAVVVQMAQ

SEQ ID NO: 9180 - protein, 335 aa, Homo sapiens
MKKELPVDSCLPRSLELHPQKMDPKRQHIQLLSSLTECLTVDPLSASVWRQLYPKHLSQSSLLLEHLLSSWEQIPKKVQKSLQETIQSLKLTNQELLRKGSSNNQDVVTCDMACKGLLQQVQGPRLPWTRLLLLLLVFAVGFLCHDLRSHSSFQASLTGRLLRSSGFLPASQQACAKLYSYSLQGYSWLGETLPLWGSHLLTVVRPSLQLAWAHTNATVSFLSAHCASHLAWFGDSLTSLSQRLQIQLPDSVNQLLRYLRELPLLFHQNVLLPLWHLLLEALAWAQEHCHEACRGEVTWDCMKTQLSEAVHWTWLCLQDITVAFLDWALALISQQ

SEQ ID NO: 9181 - protein, 27 aa, Homo sapiens
MHQLFGLFVTLMFASVGGGLGGIILVL

SEQ ID NO: 9182 - protein, 54 aa, Homo sapiens
LAATRKFFLSSHSSSCKKGAMSQKEAPFHRQRLHRERGNRRLGNGGEWGRNWVQ

SEQ ID NO: 9183 - protein, 147 aa, Homo sapiens
MLAGAGRPGLPQGRHLCWLLCAFTLKLCQAEAPVQEEKLSASTSNLPCWLVEEFVVAEECSPCSNFRAKTTPECGPTGYVEKITCSSSKRNEFKSCRFSFEWNNAYFGSSKGAVVCVALIFACLVIIRQRQLDRKALEKVRKQIESI

SEQ ID NO: 9184 - protein, 70 aa, Homo sapiens
MTHWSGCAALYLIFLSLKLAFQAGAGRGAQVGSVLPPSGGAVVVDQYCCRLSAQTYFSLPALQKCIGICR

SEQ ID NO: 9185 - protein, 127 aa, Homo sapiens [sequence omitted]

SEQ ID NO: 9186 - protein, 9 aa, Homo sapiens
LGKPWRYPT

SEQ ID NO: 9187 - protein, 158 aa, Homo sapiens [sequence omitted]

SEQ ID NO: 9188 - protein, 106 aa, Homo sapiens
  SITE (26): Xaa equals any amino acid
PTFSDQYLAPHPYSPQPPPYHELPHXHGQSQRVLCGCYVAHCGARLGRALLVCDWVSWPSCACSYSAWAQPTSCCHTGDCGHCDSHQQCLVPPPSLRGRQGTFDYF

SEQ ID NO: 9189 - protein, 2 aa, Homo sapiens
LQ

SEQ ID NO: 9190 - protein, 708 aa, Homo sapiens
MKDMPLRIHVLLGLAITTLVQAVDKKVDCPRLCTCEIRPWFTPRSIYMEASTVDCNDLGLLTFPARLPANTQILLLQTNNIAKIEYSTDFPVNLTGLDLSQNNLSSVTNINVKKMPQLLSVYLEENKLTELPEKCLSELSNLQELYINHNLLSTISPGAFIGLHNLLRLHLNSNRLQMINSKWFDALPNLEILMIGENPIIRIKDMNFKPLINLRSLVIAGINLTEIPDNALVGLENLESISFYDNRLIKVPHVALQKVVNLKFLDLNKNPINRIRRGDFSNMLHLKELGINNMPELISIDSLAVDNLPDLRKIEATNNPRLSYIHPNAFFRLPKLESLMLNSNALSALYHGTIESLPNLKEISIHSNPIRCDCVIRWMNMNKTNIRFMEPDSLFCVDPPEFQGQNVRQVHFRDMMEICLPLIAPESFPSNLNVEAGSYVSFHCRATAEPQPEIYWITPSGQKLLPNTLTDKFYVHSEGTLDINGVTPKEGGLYTCIATNLVGADLKSVMIKVDGSFPQDNNGSLNIKIRDIQANSVLVSWKASSKILKSSVKWTAFVKTENSHAAQSARIPSDVKVYNLTHLNPSTEYKICIDIPTIYQKNRKKCVNVTTKGLHPDQKEYEKNNTTTLMACLGGLLGIIGVICLISCLSPEMNCDGGHSYVRNYLQKPTFALGELYPPLINLWEAGKEKSTSLKVKATVIGLPTNMS

SEQ ID NO: 9191 - protein, 244 aa, Homo sapiens
  SITE (231): Xaa equals any amino acid
  SITE (237): Xaa equals any amino acid
MRAPFNTLFGRLFGLLLVAIVLAHVLAFFWFHHYGPPPPPRAAFVEQPDGSLTPLRKAPRPWFGGPVVPLTFQFISLIIAAWYGAKLLSRPIQRLSAAAERLSVDLDSPPLVETGPREARQAASTFNLMQKRIREQVSQRARMLGAVSHDLRTPLSRLKLRLEQIEDPKLQGQMRQDLDDMIGMLDATLSYLHEQRTSETRHWLDVQALVESLSENAQDQGRDVQFFFGGXPPGGGXPKTPPPF

SEQ ID NO: 9192 - protein, 244 aa, Homo sapiens
  SITE (25): Xaa equals any amino acid
  SITE (40): Xaa equals any amino acid
  SITE (41): Xaa equals any amino acid
  SITE (43): Xaa equals any amino acid
  SITE (231): Xaa equals any amino acid
  SITE (237): Xaa equals any amino acid
MRAPFNTLFGRLFGLLLVAIVLAHXLAFFWFHHYGPPPPXXAXFVEQPDGSLTPLRKAPRPWFGGPVVPLTFQFISLIIAAWYGAKLLSRPIQRLSAAAERLSVDLDSPPLVETGPREARQAASTFNLMQKRIREQVSQRARMLGAVSHDLRTPLSRLKLRLEQIEDPKLQGQMRQDLDDMIGMLDATLSYLHEQRTSETRHWLDVQALVESLSENAQDQGRDVQFFFGGXPPGGGXPKTPPPF

SEQ ID NO: 9193 - protein, 10 aa, Homo sapiens
MGLFLFLVSS

SEQ ID NO: 9194 - protein, 146 aa, Homo sapiens; identical to SEQ ID NO: 5733

SEQ ID NO: 9195 - protein, 48 aa, Homo sapiens
MVTFASSTLWIAAFSYMMVWMVTIIGYTLGIPDVIMGDHLPGCWDQRA

SEQ ID NO: 9196 - protein, 941 aa, Homo sapiens
  SITE (807): Xaa equals any amino acid
  SITE (809): Xaa equals any amino acid
  SITE (815): Xaa equals any amino acid
  SITE (819): Xaa equals any amino acid
MVFLPLKWSLATMSFLLSSLLALLTVSTPSWCQSTEASPKRSDGTPFPWNKIRLPEYVIPVHYDLLIHANLTTLTFWGTTKVEITASQPTSTIILHSHHLQISRATLRKGAGERLSEEPLQVLEHPPQEQIALLAPEPLLVGLPYTVVIHYAGNLSETFHGFYKSTYRTKEGELRILASTQFEPTAARMAFPCFDEPAFKASFSIKIRREPRHLAISNMPLVKSVTVAEGLIEDHFDVTVKMSTYLVAFIISDFESVSKITKSGVKVSVYAVPDKMNQADYALDAAVTLLEFYEDYFSIPYPLPKQDLAAIPDFQSGAMENWGLTTYRESALLFDAEKSSASSKLGITMTVAHELAHQWFGNLVTMEWWNDLWLNEGFAKFMEFVSVSVTHPELKVGDYFFGKCFDAMEVDALNSSHPVSTPVENPAQIREMFDDVSYDKGACILNMLREYLSADAFKSGIVQYLQKHSYKNTKNEDLWDSMASICPTDGVKGMDGFCSRSQHSSSSSHWHQEGVDVKTMMNTWTLQRGFPLITITVRGRNVHMKQEHYMKGSDGAPDTGYLWHVPLTFITSKSDMVHRFLLKTKTDVLILPEEVEWIKFNVGMNGYYIVHYEDDGWDSLTGLLKGTHTAVSSNDRASLINNAFQLVSIGKLSIEKALDLSLYLKHETEIMPVFQGLNELIPMYKLMEKRDMNEVETQFKAFLIRLLRDLIDKQTWTDEGSVSERMLRSELLLLACVHNYQPCVQRAEGYFRKWKESNGNLSLPVDVTLAVFAVGAQSTEGWDFLYSKYQFSLSSTEKSQIEFALCXPXNKEKLXWLLXESFKGDKIKTQEFPQILTLIGRNPVGYPLAWQFLRKNWNKLVQKFELGSSSIAHMVMGTTNQFSTRTRLEEVKGFFSSLKENGSQLRCVQQTIETIEENIGWMDKNFDKIRVWLQSEKLERM

SEQ ID NO: 9197 - protein, 271 aa, Homo sapiens
MTQGKLSVANKAPGTEGQQQVHGEKKEAPAVPSAPPSYEEATSGEGMKAGAFPPAPTAVPLHPSWAYVDPSSSSSYDNGFPTGDHELFTTFSWDDQKVRRVFVRKVYTILLIQLLVTLAVVALFTFCDPVKDYVQANPGWYWASYAVFFATYLTLACCSGPRRHFPWEPDSPDRLYPVHGLPHWDAVQLLQHHLRAAVPGHHGPCLPLSHRLQLPDQVRLHLLPGRALRASHDSFLQRTHPGHPPTLPICALAPCSLCSTGSGCIYIVPGT

SEQ ID NO: 9198 - protein, 138 aa, Homo sapiens
MAYLTGMLSSYYNTTSVLLCLGITALVCLSVTVFSFQTKFDFTSCQGVLFVLLMTLFFSGLILAILLPFQYVPWLHAVYAALGAGVFTLFLALDTQLLMGNRRHSLSPEEYIFGALNIYLDIIYIFTFFLQLFGTNRE

SEQ ID NO: 9199 - protein, 108 aa, Homo sapiens
MALAGSVFVLGGVLVLCVERNGEGEMGWPQHLPKSQPLSPPVAVRRCSFERSWIDLLVETSSSMVTCRQQVGTPNGMEGRGGGPKTTFPIRLQLSGACAVRPEIQWEV

SEQ ID NO: 9200 - protein, 612 aa, Homo sapiens
  SITE (245): Xaa equals any amino acid
  SITE (246): Xaa equals any amino acid
  SITE (249): Xaa equals any amino acid
MAAAGRLPSSWALFSPLLAGLALLGVGPVPARALHNVTAELFGAEAWGTLAAFGDLNSDKQTDLFVLRERNDLIVFLADQNAPYFKPKVKVSFKNHSALITSVVPGDYDGDSQMDVLLTYLPKNYAKSELGAVIFWGQNQTLDPNNMTILNRTFQDEPLIMDFNGDLIPDIFGITNESNQPQILLGGNLSWHPALTTTSKMRIPHSHAFIDLTEDFTADLFLTTLNATTSTFQFEIWENLDGNFXXSTXLEKPQNMMVVGQSAFADFDGDGHMDHLLPGCEDKNCQKSTIYLVRSGMKQWVPVLQDFSNKGTLWGFVPFVDEQQPTEIPIPITLHIGDYNMDGYPDALVILKNTSGSNQQAFLLENVPCNNASCEEARRMFKVYWELTDLNQIKDAMVATFFDIYEDGILDIVVLSKGYTKNDFAIHTLKNNFEADAYFVKVIVLSGLCSNDCPRKITPFGVNQPGPYIMYTTVDANGYLKNGSAGQLSQSAHLALQLPYNVLGLGRSANFLDHLYVGIPRPSGEKSIRKQEWTAIIPNSQLIVIPYPHNVPRSWSAKLYLTPSNIVLLTAIALIGVCVFILAIIGILHWQEKKADDREKRQEAHRFHFDAM

SEQ ID NO: 9201 - protein, 456 aa, Homo sapiens
MAAAGRLPSSWALFSPLLAGLALLGVGPVPARALHNVTAELFGAEAWGTLAAFGDLNSDKQTDLFVLRERNDLIVFLADQNAPYFKPKVKVSFKNHSALITSVVPGDYDGDSQMDVLLTYLPKNYAKSELGAVIFWGQNQTLDPNNMTILNRTFQDEPLIMDFNGDLIPDIFGITNESNQPQILLGGNLSWHPALTTTSKMRIPHSHAFIDLTEDFTADLFLTTLNATTSTFQFEIWENLDGNFSVSTILEKPQNMMVVGQSAFADFDGDGHMDHLLPGCEDKNCQKSTIYLVRSGMKQWVPVLQDFSNKGTLWGFVPFVDEQQPTEIPIPITLHIGDYNMDGYPDALVILKNTSGSNQQAFLLENVPCNNASCEEARRMFKVYWELTDLNQIKDAMVATFFDIYEDGILDIVVLSKGYTKNDFAIHTLKNNFEADAYFVKVIVLSGLCSNDCPRR

SEQ ID NO: 9202 - protein, 157 aa, Homo sapiens
MVKSVIFLSFWQGMLLAILEKCGAIPKIHSARVSVGEGTVAAGYHDFIICVEMFFAALALRHPFTYNVYADKRLDAQGRCAPMKSISSSLKETMNPHDIVQDAIHNFSPAYQQYTQQSTLEPGPTWRGGAHGLSRSHSLSGARDNEKTLLLSSDDEF

SEQ ID NO: 9203 - protein, 118 aa, Homo sapiens
FLSSWQRPACGCQRPALPLHLGGAEQLGPSCPGGWVQTQAEDQPWPCPAICFHQAVSPPWLPFSLQAKVLLIPTPLVFACPALLFAWRVGGAQWQGISGPWGRGDGNMCPTAPSPPPP

SEQ ID NO: 9204 - protein, 264 aa, Homo sapiens
MPFRLLIPLGLLCALLPQHHGAPGPDGSAPDPAHYRERVKAMFYHAYDSYLENAFPFDELRPLTCDGHDTWGSFSLTLIDALDTLLILGNVSEFQRVVEVLQDSVDFDIDVNASVFETNIRVVGGLLSAHLLSKKAGVEVEAGWPCSGPLLRMAEEAARKLLPAFQTPTGMPYGTVNLLHGVNPGETPVTCTAGIGTFIVEFATLSSLTGDPVFEDVARVALMRLWESRSDIGLVGNHIDVLTGKGWPRTQASGLAWTPTLSTW

SEQ ID NO: 9205 - protein, 59 aa, Homo sapiens
MMKDVFFFLFLLAVWVVSFGVAKQAILIHNERRVDWLFRGPSTTPTSPSSGRSRATSTV

SEQ ID NO: 9206 - protein, 566 aa, Homo sapiens
MAPLALHLLVLVPILLSLVASQDWKAERSQDPFEKCMQDPDYEQLLKVVTWGLNRTLKPQRVIVVGAGVAGLVAAKVLSDAGHKVTILEADNRIGGRIFTYRDQNTGWIGELGAMRMPSSHRILHKLCQGLGLNLTKFTQYDKNTWTEVHEVKLRNYVVEKVPEKLGYALRPQEKGHSPEDIYQMALNQALKDLKALGCRKAMKKFERHTLLEYLLGEGNLSRPAVQLLGDVMSEDGFFYLSFAEALRAHSCLSDRLQYSRIVGGWDLLPRALLSSLSGLVLLNAPVVAMTQGPHDVHVQIETSPPARNLKVLKADVVLLTASGPAVKRITFSPPLPRHMQEALRRLHYVPATKVFLSFRRPFWREEHIEGGHSNTDRPSRMIFYPPPREGALLLASYTWSDAAAAFAGLSREEALRLALDDVAALHGPVVRQLWDGTGVVKRWAEDQHSQGGFVVQPPALWQTEKDDWTVPYGRIYFAGEHTAYPHGWVETAVKLLRAAIKINSRKGPASDTASPEGHASDMEGQGHVHGVASSPSHDLAKEEGSHPPVQGQLSLQNTTHTRTSH

SEQ ID NO: 9207 - protein, 319 aa, Homo sapiens
  SITE (68): Xaa equals any amino acid
  SITE (115): Xaa equals any amino acid
  SITE (213): Xaa equals any amino acid
MAPLALHLLVLVPILLSLVASQDWKAERSQDPFEKCMQDPDYEQLLKVTILEADNRIGGRIFTYRDQXTGWIGELGAMRMPSSHRILHKLCQGLGLNLTKFTQYDKNTWTEVHEXKLRNYVVEKVPEKLGYALRPQEKGHSPEDIYQMALNQALKDLKALGCRKAMKKFERHTLLEYLLGEGNLSRPAVQLLGDVMSEDGFFYLSFAEALRAXSCLSDRLQYSRIVGGWDLLPRALLSSLSGLVLLNAPVVAMTQGPHDVHVQIETSPPARNLKVLKADVVLLTASGPAVKRITFSPRCPATCRRRCGGCTTCRPPRCS

SEQ ID NO: 9208 - protein, 23 aa, Homo sapiens
LFLLLEISTHLCFWKSLRKLEGK

SEQ ID NO: 9209 - protein, 93 aa, Homo sapiens
  SITE (89): Xaa equals any amino acid
  SITE (92): Xaa equals any amino acid
MIFLLLMLSLELQLHQIAALFTVTVPKELYIIEHGSNVTLECNFDTGSHVNLGAITASLQKVENDTSPHRERATLLEEQLPLGKASFPXLKXK

SEQ ID NO: 9210 - protein, 46 aa, Homo sapiens; identical to SEQ ID NO: 5763

SEQ ID NO: 9211 - protein, 64 aa, Homo sapiens
  SITE (7): Xaa equals any amino acid
  SITE (27): Xaa equals any amino acid
SWVIVVXIWGYLLEGHGVPFCKSYGPXPWKLHTHHAAYNSGSSQVYRILGNSPCPVLIHCSFSG

SEQ ID NO: 9212 - protein, 14 aa, Homo sapiens
  SITE (9): Xaa equals any amino acid
  SITE (14): Xaa equals any amino acid
WKGLLEGSXEATMX

SEQ ID NO: 9213 - protein, 107 aa, Homo sapiens
  SITE (66): Xaa equals any amino acid
PLGREPLAGFLSFLSFSLLWCLEAFPRLQFLTTLTDFAIVLSPPLSFPKLTLWRLIKRKNHRPGAXLTPRRRANHLRCGVRDQPDQNRETPSLLNNTKLAGRGGARL

SEQ ID NO: 9214 - protein, 127 aa, Homo sapiens
MPRAPWRIPLCALPTLCLGSPLPSQPTHPIFYDHRAPTWKMAHPGGPRSSHSPRGPGGHPALRQRLPCRRGEPETALCSSAPGAGFAEPPCKASPGWGPPSRGPQGDRSQGEWLPALGTPCGGPDDS

SEQ ID NO: 9215 - protein, 90 aa, Homo sapiens
  SITE (31): Xaa equals any amino acid
  SITE (57): Xaa equals any amino acid
MPRAPWRIPLCALPTLCLGSPLPSQPTHPIXYDHRAPTWKMAHPGGPRSSHSPRTWXTPSSQTKAALPAGGARNSPLQLCTRSRFCGTPM

SEQ ID NO: 9216 - protein, 308 aa, Homo sapiens
  SITE (87): Xaa equals any amino acid
  SITE (185): Xaa equals any amino acid
MPVPWFLLSLALGRSPVVLSLERLVGPQDATHCSPGLSCRLWDSDILCLPGDIVPAPGPVLAPTHLQTELVLRCQKETDCDLCLRVXVHLAVHGHWEEPEDEEKFGGAADLGVEEPRNASLQAQVVLSFQAYPTARCVLLEVQVPAALVQFGQSVGSVVYDCFEAALGSEVRIWSYTQPRYEKEXNHTQQLPDCRGLEVWNSIPSCWALPWLNVSADGDNVHLVLNVSEEQHFGLSLYWNQVQGPPKPRWHKNLTGPQIITLNHTDLVPCLCIQVWPLEPDSVRRTSAPSGRTPAHTRTSGKPPDCDC

SEQ ID NO: 9217 - protein, 55 aa, Homo sapiens
MSSDFLCFFFKLCNQMILCFFFRGAEYWFLLLVVFSFLCHSCFFFVFSVSNTICI

SEQ ID NO: 9218 - protein, 214 aa, Homo sapiens
  SITE (199): Xaa equals any amino acid
  SITE (206): Xaa equals any amino acid
  SITE (214): Xaa equals any amino acid
MLGARAWLGRVLLLPRAGAGLAASRRCPGVWPRTWPHRSPSRGSSSRDKDRSATVSSSVPMPAGGKGSHPSSTPQRVPNRLIHEKSPYLLQHAYNPVDWYPWGQEAFDKARKENKPIFLSVGYSTCHWCHMMEEESFQNEEIGRLLSEDFVSVKVDREERPDVDKVYMTFVQATSSGGGWPMNVWLTPNLQPFVGGTIXLLKDGLXRVGSAQCX

SEQ ID NO: 9219 - protein, 43 aa, Homo sapiens
MLGARAWLGRVLLLPRAGAGLAASRRSACSPTSRLNSLRSLIP

SEQ ID NO: 9220 - protein, 44 aa, Homo sapiens [sequence omitted]

SEQ ID NO: 9221 - protein, 98 aa, Homo sapiens; identical to SEQ ID NO: 5777

SEQ ID NO: 9222 - protein, 22 aa, Homo sapiens
LPRPCAPSPVWRQVGREEASLL

SEQ ID NO: 9223 - protein, 25 aa, Homo sapiens
  SITE (9): Xaa equals any amino acid
CAVRFREQXAPERVFLPTRGRKSEP

SEQ ID NO: 9224 - protein, 333 aa, Homo sapiens
  SITE (100): Xaa equals any amino acid
  SITE (111): Xaa equals any amino acid
  SITE (227): Xaa equals any amino acid
MLTGIAVGALLALALVGVLILFMFRRLRQFRQAQPTPQYRFRKRDKVMFYGRKIMRKVTTLPNTLVENTALPRQRARKRTKVLSLAKRILRFKKEYPGLXPKDPRPSLLEXDFTEFDVKNSHLPSEVLYMLKNVRVLGHFEKPLFLELCKHIVFVQLQEGEHVFQPREPDPSICVVQDGRLEVCIQDTDGTEVVVKEVLAGDSVHSLLSILDIITGHAAPYKTVSVXAAIPSTILRLPAAAFHGVFEKYPETLVRVVQIIMVRLQRVTFLALHNYLGLTTELFNAESQAIPLVSVASVAAGKAKKQVFYGEEERLKKPPRLQESCDSDHGGGR

SEQ ID NO: 9225 - protein, 220 aa, Homo sapiens
  SITE (159): Xaa equals any amino acid
MKLLLWACIVCVAFARKRRFPFIGEDDNDDGHPLHPSLNIPYGIRNLPPPLYYRPVNTVPSYPGNTYTDTGLPSYPWILTSPGFPYVYHIRGFPLATQLNVPPLPPRGFPFVPPSRFFSAAAAPAAPPIAAEPAAAAPLTATPVAAEPAARGPVAAEPXGRGHLLELEPAAEAPVAAEPAAEAPVGVEPAAEEPSPAEPATAKPAAPEPHPSPSLEQANQ

SEQ ID NO: 9226 - protein, 108 aa, Homo sapiens
  SITE (48): Xaa equals any amino acid
  SITE (55): Xaa equals any amino acid
  SITE (58): Xaa equals any amino acid
  SITE (67): Xaa equals any amino acid
MFYKLTLILCELSVAGVTQAASQRPLQRLPRHICSQRNPPGRCLLKAXLQTTWGXPDXQFPGCPHPXRVTLNARQMGNGKEKKAADLKLKFPQKRFYLSAFSERIKAF

SEQ ID NO: 9227 - protein, 73 aa, Homo sapiens
  SITE (38): Xaa equals any amino acid
  SITE (48): Xaa equals any amino acid
  SITE (54): Xaa equals any amino acid
  SITE (55): Xaa equals any amino acid
  SITE (68): Xaa equals any amino acid
MFYKLTLILCELSVAGVTQAASQRPLQRLPRHICSQRXPPGRCLLKAXLQTTWXXPDKPIPRLSPPLXSDPKR

SEQ ID NO: 9228 - protein, 67 aa, Homo sapiens [sequence omitted]

SEQ ID NO: 9229 - protein, 67 aa, Homo sapiens [sequence omitted]

SEQ ID NO: 9230 - protein, 83 aa, Homo sapiens; identical to SEQ ID NO: 5782

SEQ ID NO: 9231 - protein, 29 aa, Homo sapiens
  SITE (26): Xaa equals any amino acid
  SITE (29): Xaa equals any amino acid
MYVWVSGALVLVLSPHPASRTLCLMXQAX

SEQ ID NO: 9232 - protein, 80 aa, Homo sapiens
PHCASRAVPYPPGPAAAAFPRQGLQLATTCGHSSDPACFGQCPCHLCANHPGYLWSYRVHLSPQPHLHPPQHLLPPHCTL

SEQ ID NO: 9233 - protein, 56 aa, Homo sapiens
MFVFVVVAWTGNSAGLLLYASLCLPACARGCQGLLGQSGHPFLQGSLQQLACPWWG

SEQ ID NO: 9234 - protein, 51 aa, Homo sapiens
  SITE (20): Xaa equals any amino acid
  SITE (38): Xaa equals any amino acid
MELLQAKKLLLLLGLFVSCXSNIRKTEPCFGLDSITFXDPKKKCLSNLKSC

SEQ ID NO: 9235 - protein, 1 aa, Homo sapiens
A

SEQ ID NO: 9236 - protein, 81 aa, Homo sapiens
MSKRSASFILLPLLFLKGSFAKLNARISDCLEERYCHNLWMVFQGCVITELHLSRMSKTLSSLCYDFVINVYIFFKFLDIT

SEQ ID NO: 9237 - protein, 415 aa, Homo sapiens
VGLVSMLGIPIPGAEGAPVLNSLVFLSGQSTPTQKGVGIAGAVCVSSKLRPRGQCRLEFSLAWDMPRIMFGAKGQVHYRRYTRFFGQDGDAAPALSHYALCRYAEWEERISAWQSPVLDDRSLPAWYKSALFNELYFLADGGTVWLEVLEDSLPEELGRNMCHLRPTLRDYGRFGYLEGQEYRMYNTYDVHFYASFALIMLWPKLELSLQYDMALATLREDLTRRRYLMSGVMAPVKRRNVIPHDIGDPDDEPWLRVNAYLIHDTADWKDLNLKFVLQVYRDYYLTGDQNFLKDMWPVCLAVMESEMKFDKDHDGLIENGGYADQTYDGWVTTGPSAYCGGLWLAAVAVMVQMAALCGAQDIQDKFSSILSRGQEAYERLLWNGRYYNYDSSSRPQSRSVMSDQCAGQWFLKACG

SEQ ID NO: 9238 - protein, 201 aa, Homo sapiens; identical to SEQ ID NO: 5803

SEQ ID NO: 9239 - protein, 203 aa, Homo sapiens
MTLRPSLLPLHLLLLLLLSAAVCRAEAGLETESPVRTLQVETLVEPPEPCAEPAAFGDTLHIHYTGSLVDGRIIDTSLTRDPLVIELGQKQVIPGLEQSLLDMCVGEKRRAIIPSHLAYGKRGFPPSVPADAVVQYDVELIALIRANYWLKLVKGILPLVGMAMVPPSWASLGITYTERPIDPKSPKRSSRKRNETRAKRNNK

SEQ ID NO: 9240 - protein, 313 aa, Homo sapiens
MAQLEGYYFSAALSCTFLVSCLLFSAFSRALREPYMDEIFHLPQAQRYCEGHFSLSQWDPMITTLPGLYLVSIGVIKPAIWIFGWSEHVVCSIGMLRFVNLLFSVGNFYLLYLLFCKVQPRNKAASSIQRVLSTLTLAVFPTLYFFNFLYYTEAGSMFFTLFAYLMCLYGNHKTSAFLGFCGFMFRQTNIIWAVFCAGNVIAQKLTEAWKTELQKKEDRLPPIKGPFAEFRKILQFLLAYSMSFKNLSMLLLLTWPYILLGFLFCAFVVVNGGIVIGDRSSHEACLHFPQLFYFFSFTLFFSFPHLLSQQINK

SEQ ID NO: 9241 - protein, 134 aa, Homo sapiens
  SITE (8): Xaa equals any amino acid
  SITE (73): Xaa equals any amino acid
  SITE (76): Xaa equals any amino acid
MAQLEGYXFSAALSCTFLVSCLLFSAFSRALREPYMDEIFHLPQAQRYCEGHFSLSQWDPMITTLPGLYLVSXGVXKPAIWIFGWSEHVVCSIGMLRFVNLLFSVGNFYLLYLLFCKYNPETRLPQVSRESCQH

SEQ ID NO: 9242 - protein, 121 aa, Homo sapiens; identical to SEQ ID NO: 5816

SEQ ID NO: 9243 - protein, 161 aa, Homo sapiens
  SITE (104): Xaa equals any amino acid
MPTTLPSDLMLLWLGLPSLPSPVEEEGRLVKGLRLTLAAPASEVLPDWEDPPSHPTAWAQPRTHQPDTPNSIKSGIYSPCGGAVLRGAGAIVLRKEVCPSVRLXGRPGPKWGRKRGTARVKIPAYSGWEYVQGGGAQAGVGAGGPAAAAPTRGPPHLGPYL

SEQ ID NO: 9244 - protein, 291 aa, Homo sapiens
MDCFITFSIRETTPSLSCTWSCKGWFILSTPGEVFGYCQELELSLHYLLLPYLLLGVNLFFFTLTCGTNPGIITKANELLFLHVYEFDEVMFPKNVRCSTCDLRKPARSKHCSVCNWCVHRFDHHCVWVNNCIGAWNIRYFLIYVLTLTASAATVAIVSTTFLVHLVVMSDLYQETYIDDLGHLHVMDTVFLIQYLFLTFPRIVFMLGFVVVLSFLLGGYLLFVLYLAATNQTTNEWYRGDWAWCQRCPLVAWPPSAEPQVHRNIHSHGLRSNLQEIFLPAFPCHERKKQE

SEQ ID NO: 9245 - protein, 184 aa, Homo sapiens
MLFLFSMATLLRTSFSDPGVIPRALPDEAAFIEMEIEATNGAVPQGQRPPPRIKNFQINNQIVKLKYCYTCKIFRPPRASHCSICDNCVERFDHHCPWVGNCVGKRNYRYFYLFILSLSLLTIYVFAFNIVYVALKSLKIGFLETLKGNSWNCSRSPHLLLYTLVRRGTDWISYFPRGSQPDNQ

SEQ ID NO: 9246 - protein, 91 aa, Homo sapiens
  SITE (29): Xaa equals any amino acid
  SITE (31): Xaa equals any amino acid
  SITE (43): Xaa equals any amino acid
MKASQCCCCLSHLLASVLLLLLLPELSGXLXVLLQAAEAAPGXGPPDPRPGHYRRCHRALTPAQQPGRGLAEAAGAAGLRGRQWQQPCGRA

SEQ ID NO: 9247 - protein, 122 aa, Homo sapiens
  SITE (89): Xaa equals any amino acid
  SITE (91): Xaa equals any amino acid
  SITE (94): Xaa equals any amino acid
  SITE (97): Xaa equals any amino acid
  SITE (98): Xaa equals any amino acid
MHRSEPFLKMSLLILLFLGLAEACTPREVNLLKGIIGLMSRLSPDEILGLLSLQVLHEETSGCKEEVKPFSGTTPSRKPLPKREEHVEXPXNAXTWXXTYLFVSYNKGDWFTFSSQVLLPLL

SEQ ID NO: 9248 - protein, 112 aa, Homo sapiens
MARGSLRRLLRLLVLGLWLALLRSVAGEQAPGTAPCSRGSSWSADLDKCMDCSTSCPLPAALAHPWGRSEPDLRAGAAFWLFGLETMPQREKFTTPIEETGGEGCPAVALIQ

SEQ ID NO: 9249 - protein, 155 aa, Homo sapiens
MARGSLRRLLRLLVLGLWLALLRSVAGEQAPGTAPCSRGSSWSADLDKCMDCSTSCPLPAALAHPWGRSEPDLRAGAAFWLFGLETMPQEREVHHPHRGDRRRGLPSCGADPVTMCPLPAGARPLIIHSSILEPVSASQTRREPSSSNHKGGGGR

SEQ ID NO: 9250 - protein, 153 aa, Homo sapiens
  SITE (98): Xaa equals any amino acid
MAATQTGTCLMVAALCFVLVLGSLVPCLPEFSSGSQTVKEDPLAADGVYTASQMPSRSLLFYDDGAGLWEDGRSTLLPMEPPDGWEINPGGPAEQRPXDHLQHDHLDSTHETTKYLSEAWPKDGGNGTSPDFSHSKEWFHDRDLGPNTTIKLS

SEQ ID NO: 9251 - protein, 229 aa, Homo sapiens; identical to SEQ ID NO: 5834
  SITE (206): Xaa equals any amino acid

SEQ ID NO: 9252 - protein, 85 aa, Homo sapiens
  SITE (33): Xaa equals any amino acid
  SITE (62): Xaa equals any amino acid
FLGTQAFAVPLLLISRSQTFGYNGRACQEWLPXLISSILMAYTVALANSYGRLISELKRQRXTEAQNKVFLARRAVALTSTKPAL

SEQ ID NO: 9253 - protein, 43 aa, Homo sapiens; identical to SEQ ID NO: 5845

SEQ ID NO: 9254 - protein, 2 aa, Homo sapiens
LH

SEQ ID NO: 9255 - protein, 549 aa, Homo sapiens
  SITE (132): Xaa equals any amino acid
  SITE (398): Xaa equals any amino acid
MGNACIPLKRIAYFLCLLSALLLTEGKKPAKPKCPAVCTCTKDNALCENARSIPRTVPPDVISLSFVRSGFTEISEGSFLFTPSLQLLLFTSNSFDVISDDAFIGLPHLEYLFIENNNIKSISRHTFRGLKXLIHLSLANNNLQTLPKDIFKGLDSLTNVDLRGNSFNCDCKLKWLVEWLGHTNATVEDIYCEGPPEYKKRKINSLSSKDFDCIITEFAKSQDLPYQSLSIDTFSYLNDEYVVIAQPFTGKCIFLEWDHVEKTFRNYDNITGTSTVVCKPIVIETQLYVIVAQLFGGSHIYKRDSFANKFIKIQDIEILKIRKPNDIETFKIENNWYFVVADSSKAGFTTIYKWNGNGFYSHQSLHAWYRDTDVEYLEIVRTPQTLRTPHLILSSSSXRPVIYQWNKATQLFTNQTDIPNMEDVYAVKHFSVKGDVYICLTRFIGDSKVMKWGGSSFQDIQRMPSRGSMVFQPLQINNYQYAILGSDYSFTQVYNWDAEKAKFVKFQELNVQAPRSFTHVSINKRNFLFASSFKGNTQIYKHVIVDLSA

SEQ ID NO: 9256 - protein, 66 aa, Homo sapiens
MGNACIPLKRIAYFLCLLSALLLTEGKKPANQNALPCVLVPKIMLYVRMPDPFHAPFLLMLSHYPL

SEQ ID NO: 9257 - protein, 181 aa, Homo sapiens
  SITE (110): Xaa equals any amino acid
MADPHVSFLSFRQLFSWAAVILLRGILGTVAPPPCPCVLDLAVYPLHLPVEAPCLEVVFKQKNGKDNCLVFYPDPIPLRGSLLGPFIKNQCHSSVIPLSDSATSKARALXLPGRETVLSVLPVFSSPTLPRTHALGDSLGVPGLLVCSETSTLNDHWCCRRAGAYIPINRRFSHLMPLAFS

SEQ ID NO: 9258 - protein, 87 aa, Homo sapiens [sequence omitted]

SEQ ID NO: 9259 - protein, 87 aa, Homo sapiens
  SITE (55): Xaa equals any amino acid
  SITE (66): Xaa equals any amino acid
MADPHVSFLSFRQLFSWAAVILLRGILGTVAPPPCPCVLDLAVYPLHLPVEAPCXEVVFKQKNGKXNCLVFYPDPIPLRGSLLGPFI

SEQ ID NO: 9260 - protein, 56 aa, Homo sapiens
  SITE (53): Xaa equals any amino acid
MHRLWIGPAFFLMTSLSVSGAVIPRNGGPGGVSSGPCLLQLLCGQAGSSTIRXIPS

SEQ ID NO: 9261 - protein, 67 aa, Homo sapiens [sequence omitted]

SEQ ID NO: 9262 - protein, 170 aa, Homo sapiens
MATAMDWLPWSLLLFSLMCETSAFYVPGVAPINFHQNDPVEIKAVKLTSSRTQLPYEYYSLPFCQPSKITYKAENLGEVLRGDRIVNTPFQVLMNSEKKCEVLCSQSNKPVTLTVEQSRLVAERITEDYYVHLIADNLPVATRLELYSNRDSDDKKKESDIKWASRWDTY

SEQ ID NO: 9263 - protein, 151 aa, Homo sapiens
HASGARRRLQAPPVPHDPQLPAGLRHSAVLYDPHRHLCSHAWDAVALQPGSSHDHSLLPLHVHGGVWRIFCWPSVPHFKRPSVEERSLLYGNSVPWCGFWHLLRIELLHLGKALIRSGALSHHGGSAVHVVRDLPAPRLLGLLLRLPKAAI

SEQ ID NO: 9264 - protein, 166 aa, Homo sapiens [sequence omitted]

SEQ ID NO: 9265 - protein, 26 aa, Homo sapiens
GLFLGQMNWIFSCCFSNNVTTTVKKR

SEQ ID NO: 9266 - protein, 20 aa, Homo sapiens
RLLNLSVPMFTFIVVKRYAT

SEQ ID NO: 9267 - protein, 74 aa, Homo sapiens; identical to SEQ ID NO: 5883

SEQ ID NO: 9268 - protein, 33 aa, Homo sapiens
HHVAQALPPAGAPRGRPHQPHPAPVGQGSPERG

SEQ ID NO: 9269 - protein, 53 aa, Homo sapiens
  SITE (40): Xaa equals any amino acid
SNPSHILMISILLSHASRGAGADPKRSCCPQRVGSRGRAXVRLTRLCSQPSPH

SEQ ID NO: 9270 - protein, 163 aa, Homo sapiens; identical to SEQ ID NO: 5890

SEQ ID NO: 9271 - protein, 92 aa, Homo sapiens
  SITE (61): Xaa equals any amino acid
  SITE (68): Xaa equals any amino acid
MGSTWGSPGWVRLALCLTGLVLSLYALHVKAARARDRDYRALCDVGTAISCSRVFSSRLPXDTLGLCXDAAELPGVSRWFCLPGLDPVLRAL

SEQ ID NO: 9272 - protein, 236 aa, Homo sapiens
  SITE (55): Xaa equals any amino acid
MISLPGPLVTNLLRFLFLGLSALAPPSRAQLQLHLPANRLQAVEGGEVVLPAWYXLHGEVSSSQPWEVPFVMWFFKQKEKEDQVLSYINGVTTSKPGVSLVYSMPSRNLSLRLEGLQEKDSGPYSCSVNVQDKQGKSRGHSIKTLELNVLVPPAPPSCRLQGVPHVGANVTLSCQSPRSKPAVQYQWDRQLPSFQTFFAPALDVIRGSLSLTNLSSSMAGVYVCKAHNEVGTANVM

SEQ ID NO: 9273 - protein, 95 aa, Homo sapiens
  SITE (46): Xaa equals any amino acid
MTSYILISFVLLIGVGCIEKDQSCPVFGGRKRLHLLFVGGQLRQVXLGAPRPPGGQDPSHQRLGRGELPLVRQHHRDLHHRGPHQEGLQVHHQHE

SEQ ID NO: 9274 - protein, 152 aa, Homo sapiens
  SITE (1): Xaa equals any amino acid
XPSWWGPRWCRSSCGVARTRVVHPVRVADGLDLALLEVGELPAGHALLAVLVVELHVAARLDPANYPSLLLGDGRHDHLGRGPEVGCPVAEHHAGGLIDASGDGVDGGFHINHRDPFPEDSGFASDALNTAHGIQERSDLQGRPAVTEKTRH

SEQ ID NO: 9275 - protein, 11 aa, Homo sapiens
MSGGLSFLLLV

SEQ ID NO: 9276 - protein, 302 aa, Homo sapiens
MARARGSPCPPLPPGRMSWPHGALLFLWLFSPPLGAGGGGVAVTSAAGGGSPPATSCPVACSCSNQASRVICTRRDLAEVPASIPVNTRYLNLQENGIQVIRTDTFKHLRHLEILQLSKNLVRKIEVGAFNGLPSLNTLELFDNRLTTVPTQAFEYLSKLRELWLRNNPIESIPSYAFNRVPSLRRLDLGELKRLEYISEAAFEGLVNLRYLNLGMCNLKDIPNLTALVRLEELELSGNRLDLIRPGSFQGLTSLRKLWLMHAQVATIERNAFDDLKSLEELNLSHNNLMSLPHDLFTPLHR

SEQ ID NO: 9277 - protein, 224 aa, Homo sapiens
  SITE (76): Xaa equals any amino acid
MARARGSPCPPLPPGRMSWPHGALLFLWLFSPPLGAGGGGVAVTSAAGGGSPPATSCPVACSCSNQASRVICTRRXLAEVPASIPVNTRYLNLQENGIQVIRTDTFKHLRHLEILQLSKNLVRKIEVGAFNGLPSLNTLELFDNRLTTVPTQAFEYLSKLRELWLRNNPIESIPSYAFNRVPSLRRLDLGELKRLEYISEAAFEGLVNLRYLNLGMCNLKDIPN

SEQ ID NO: 9278 - protein, 55 aa, Homo sapiens; identical to SEQ ID NO: 5909

SEQ ID NO: 9279 - protein, 314 aa, Homo sapiens
  SITE (129): Xaa equals any amino acid
YSKTHSIKSAQPGVPTSARSPRQPSPGPTPPPFPGNRGTALGGGSIRQSPLSSSSPFSNRPPLPPTPSRALDDKPPPPPPPVGNRPSIHREAVPPPPPQNNKPPVPSTPRPSAASQAPPPPPPPSRPGXPPLPPSSSGNDETPRLPQRNLSLSSSTPPLPSPGRSGPLPPPPSERPPPPVRDPPGRSGPLPPPPPVSRNGSTSRALPATPQLPSRSGVDSPRSGPRPPLPPDRPSAGAPPPPPPSTSIRNGFQDSPCEDEWESRFYFHPISDLPPPEPYVQTTKSYPSKLARNESRSGSNRRERGAPPLPPIPR

SEQ ID NO: 9280 - protein, 130 aa, Homo sapiens
STCCGWGPLGHSRVRGCHCHLGHVGRHQHFVVTNSTVTNIFGQIPFYTSRQLLVCNPTGQREGPVTWLSHCPAPQMVLGLLFSLGPANTTVFTSAHWLSAVVPGSQWHVSPRSSLIPQHTPKGSVANTLN

SEQ ID NO: 9281 - protein, 122 aa, Homo sapiens
  SITE (19): Xaa equals any amino acid
  SITE (73): Xaa equals any amino acid
KAPSSHPGLTCVSLSRLQXSLSLCFPSGPCWAGLLSSLALAGGAPGALPPWQPGQDSKMRTAELVGGSHGPAXGPGEAEPEPTAVVLWTVDPEGGLGQVPAEGPGGLCVPLGPGALVTWTPG

SEQ ID NO: 9282 - protein, 223 aa, Homo sapiens
  SITE (132): Xaa equals any amino acid
AWYLLRVQVLQLVAAYLSLPSNNLSHSLWEQLCAQGWQTPEIALIDSHKLLRSIILLLMGSDILSTQKAAVETSFLDYGENLVQKWQVLSEVLSCSEKLVCHLGRLGSVSEAKAFCLEALKLTTKLQIPRQXALFLVLKGELELARNDIDLCQSDLQQVLFLLESCTEFGGVTQHLDSVKKVHLQKGKQQAQVPCPPQLPEEELFLRGPALELVPLWPRSLAP

SEQ ID NO: 9283 - protein, 8 aa, Homo sapiens
AWFLVKPE

SEQ ID NO: 9284 - protein, 83 aa, Homo sapiens [sequence omitted]

SEQ ID NO: 9285 - protein, 143 aa, Homo sapiens
MATARPPWMWVLCALITALLLGVTEHVLANNDVSCDHPSNTVPSGSNQDLGAGAGEDARSDDSSSRIINGSDCDMHTQPWQAALLLRPNQLYCGAVLVHPQWLLTAAHLQEESFQSRLGHYSLSQFIESGPEMSRGSIQSRTG

SEQ ID NO: 9286 - protein, 293 aa, Homo sapiens; identical to SEQ ID NO: 5924

SEQ ID NO: 9287 - protein, 85 aa, Homo sapiens
MATARPPWMWVLCALITALLLGVTEHVLANNDVSCDHPSNTVPSGSNRTWELGPGKTPGRMTAAAASSMDPTAICTPSRGRPRCC

SEQ ID NO: 9288 - protein, 293 aa, Homo sapiens; identical to SEQ ID NO: 5924

SEQ ID NO: 9289 - protein, 293 aa, Homo sapiens; identical to SEQ ID NO: 5924

SEQ ID NO: 9290 - protein, 61 aa, Homo sapiens
MATARPPWMWVLCALITALLLGVTEHVLANNDVSCDHPSNTVPSGSNQDLGAGAGGRRPVG

SEQ ID NO: 9291 - protein, 243 aa, Homo sapiens; identical to SEQ ID NO: 5927

SEQ ID NO: 9292 - protein, 154 aa, Homo sapiens
  SITE (150): Xaa equals any amino acid
MARHGLPLLPLLSLLVGAWLKLGNGQATSMVQLQGGRFLMGTNSPDSRDGEGPVREATVKPFAIDIFPVTNKDFRDFVREKKYRTEAEMFGWSFVFEDFVSDELRNKATQPMKSVLWWLPVEKAFWRQPAGPGSGIRERLEHPVLHVSWXDARA

SEQ ID NO: 9293 - protein, 120 aa, Homo sapiens
  SITE (103): Xaa equals any amino acid
MGTVSSRRSWWPLPLLLLLLLLLGPAGARAQEDEDGDYEELVLALRSEEDGLAEAPEHGTTATFHRCAKDPWRLPGTYVVVLKEETHLSQSERTARRLQAQAXRRGYLPRSCMSSMAFFL

SEQ ID NO: 9294 - protein, 269 aa, Homo sapiens
  SITE (236): Xaa equals any amino acid
  SITE (257): Xaa equals any amino acid
MGTVSSRRSWWPLPLLLLLLLLLGPAGARAQEDEDGDYEELVLALRSEEDGLAEAPEHGTTATFHRCAKDPWRLPGTYVVVLKEETHLSQSERTARRLQAQAARRGYLTKILHVFHGLLPGFLVKMSGDLLELALKLPHVDYIEEDSSVFAQSIPWNLERITPPRYRADEYQPPDGGSLVEVYLLDTSIQSDHREIEGRVMVTDFENVPEEDGTRFHRQASKCDSHGPTWQGWSAXGMPAWPRVPACAACACFPKKXPLLGGPPQKKGG

SEQ ID NO: 9295 - protein, 17 aa, Homo sapiens
GWCSRRDSCWPSPPTMP

SEQ ID NO: 9296 - protein, 45 aa, Homo sapiens
TWWPPCPPAPMGQVGSCFAGLCGQHTRGLHGWPQPSPAAPQMRSC

SEQ ID NO: 9297 - protein, 70 aa, Homo sapiens; identical to SEQ ID NO: 5932

SEQ ID NO: 9298 - protein, 57 aa, Homo sapiens
MPCTCTWRNWRQWIRPLVAVIYLVSIVVAVPLCVWELQKLEVGIHTKAWFIAGIFLL

SEQ ID NO: 9299 - protein, 107 aa, Homo sapiens
  SITE (92): Xaa equals any amino acid
MVRYTYSMLSVIGISYAVLTWLSQTLWMPIYPLCVLAEAFAIYQSLPYFESFGTYSTKLPFDLSIYFPYVLKIYLMMLFIGMYFTYSHLYSXRRDILGIFPIKKKKM

SEQ ID NO: 9300 - protein, 37 aa, Homo sapiens
MVRYTYSMLSVIGISYAVLTWAQSNTMDANLSFVCSC

SEQ ID NO: 9301 - protein, 46 aa, Homo sapiens
MKSQCYSPSYFAFFCLVFFQITSASSQTLRGHVLCRTTLRDSSAYC

SEQ ID NO: 9302 - protein, 104 aa, Homo sapiens
MLWLLFFLVTAIHAELCQPGAENAFKVRLSIRTALGDKAYAWDTNEEYLFKAMVAFSMRKVPNREATEISHVLLCNVTQRYHSGLWLQTLQKITPFLLLRCNQP

SEQ ID NO: 9303 - protein, 442 aa, Homo sapiens
  SITE (364): Xaa equals any amino acid
MWFTYLLLYLHSVRAYSSRGAGCCCCWARWRRAVHTARGLRGRPRRQLLRPLRPAQGLAPGRHRLRPAVLPLHLQPLPGLWGGHAEWAALLYYGPFIVIFQFGWASTQISHLSLIPELVTNDHEKVELTALRYAFTVVANITVYGAAWLLLHLQGSSRVEPTQDISISDQLGGQDVPVFRNLSLLVVGVGAVFSLLFHLGTRERRRPHAEEPGEHTPLLAPATAQPLLLWKHWLREPAFYQVGILYMTTRLIVNLSQTYMAMYLTYSLHLPKKFIATIPLVMYLSGFLSSFLMKPINKCIGRNMTYFSGLLVILAFAAWVALAEGLGVAVYAAAVLLGAGCATILVTSLAMTADLIGPHTNSGXFVYGSMSFLDKVANGLAVMAIQSLHPCPSELCCRACVSFYHWAMVAVTGGVGVAAALCLCSLLLWPTRLRRWDRDARP

SEQ ID NO: 9304 - protein, 309 aa, Homo sapiens
  SITE (26): Xaa equals any amino acid
  SITE (84): Xaa equals any amino acid
  SITE (111): Xaa equals any amino acid
AADNYGIPRACRNSARSYGAAWLLLXPAGSSRVEPTQDISISDQLGGQDVPVFRNLSLLVVGVGAVFSLLFHLGTRERRRPHAXEPGEHTPLLAPATAQPLLLWKHWLREXAFYQVGILYMTTRLIVNLSQTYMAMYLTYSLHLPKKFIATIPLVMYLSGFLSSFLMKPINKCIGRNMTYFSGLLVILAFAAWVALAEGLGVAVYAAAVLLGAGCATILVTSLAMTADLIGPHTNSGAFVYGSMSFLDKVANGLAVMAIQSLHPCPSELCCRACVSFYHWAMVAVTGGVGVAAALCLCSLLLWPTRLRR

SEQ ID NO: 9305 - protein, 243 aa, Homo sapiens
  SITE (26): Xaa equals any amino acid
  SITE (84): Xaa equals any amino acid
  SITE (111): Xaa equals any amino acid
AADNYGIPRACRNSARSYGAAWLLLXPAGSSRVEPTQDISISDQLGGQDVPVFRNLSLLVVGVGAVFSLLFHLGTRERRRPHAXEPGEHTPLLAPATAQPLLLWKHWLREXAFYQVGILYMTTRLIVNLSQTYMAMYLTYSLHLPKKFIATIPLVMYLSGFLSSFLMKPINKCIGRNMTYFSGLLVILAFAAWVALAEGLGVAVYAAAVLLGAGCATILVTSLAMTADLIGPHTNSGLSCTAP

SEQ ID NO: 9306 - protein, 94 aa, Homo sapiens
  SITE (2): Xaa equals any amino acid
  SITE (30): Xaa equals any amino acid
  SITE (37): Xaa equals any amino acid
AXPSSGAPFLLLLLFKLWLVVPGSSTDISXDWEKDFXLDMTEEEVQMALSKVDASGEVSGPGGSEGSEPNGPGCESSPQPAQLSPQEGPCSCLR

SEQ ID NO: 9307 - protein, 47 aa, Homo sapiens
MLSIIPNDRLFINLIFLSNFLPSVLWEPAGQMWYTHVRYPSGRLLSL

SEQ ID NO: 9308 - protein, 148 aa, Homo sapiens
MAGSPLLWGPRAGGVGLLVLLLLGLFRPPPALCARPVKEPRGLSAASPPLARLALLAASGGQCPEVRRRGRCRPGAGAGASAGAERQERARAEAQRLRISRRASWRSCCASGAPPATLIRLWAWTTTPTRLQRSSLALCSAPALTLPP

SEQ ID NO: 9309 - protein, 80 aa, Homo sapiens; identical to SEQ ID NO: 5945

SEQ ID NO: 9310 - protein, 47 aa, Homo sapiens
ILKSEPKLVSFINILGKEERKKEGGRERKKERKKERKKERKKKKKNS

SEQ ID NO: 9311 - protein, 142 aa, Homo sapiens
  SITE (69): Xaa equals any amino acid
  SITE (76): Xaa equals any amino acid
  SITE (90): Xaa equals any amino acid
  SITE (108): Xaa equals any amino acid
MYVTLVFRVKGSRLVKPSLCLALLCPAFLVGVVRVAEYRNHWSDVLAGFLTGAAIATFLVTCVVHNFQXRPPSGRXLSPQSAYPRLPGPXFPHLHNGGDHPCPAGCRXGCESSAWMQPGGSHRAAFTGLALPWAGGRPHPKR

SEQ ID NO: 9312 - protein, 89 aa, Homo sapiens
MAKRTFSNLETFLIFLLVMMSAITVALLSLLFITSGTIENHKDLGGHFFSTTQSPPATQGSTAAQRSTATQHSTATQSSNSQLKLLQCL

SEQ ID NO: 9313 - protein, 486 aa, Homo sapiens; identical to SEQ ID NO: 7000

SEQ ID NO: 9314 - protein, 92 aa, Homo sapiens; identical to SEQ ID NO: 9271
  SITE (61): Xaa equals any amino acid
  SITE (68): Xaa equals any amino acid

SEQ ID NO: 9315 - protein, 151 aa, Homo sapiens; identical to SEQ ID NO: 5959

SEQ ID NO: 9316 - protein, 38 aa, Homo sapiens; identical to SEQ ID NO: 5965

SEQ ID NO: 9317 - protein, 190 aa, Homo sapiens
  SITE (25): Xaa equals any amino acid
MPVPTLCLLWALAMVTRPASAAPMXGPELAQHEELTLLFHGTLQLGQALNGVYRTTEGRLTKARNSLGLYGRTIELLGQEVSRGRDAAQELRASLLETQMEEDILQLQAEATAEVLGEVAQAQKVLRDSVQRLEVQLRSAWLGPAYREFEVLKAHADKQEPTSYGPHRPRQRQRREMVAQQHRLRQIQER

SEQ ID NO: 9318 - protein, 132 aa, Homo sapiens [sequence omitted]

SEQ ID NO: 9319 - protein, 42 aa, Homo sapiens
MEPAMVLKFLSSLPENLFLPSLLFFAWLCWNMVCGSPVSCPY

SEQ ID NO: 9320 - protein, 65 aa, Homo sapiens
  SITE (24): Xaa equals any amino acid
MCKGLKNPEGLLLLLLLLLFTDTXNSHCLPPYLSCFLHERQPELQSVCISAAYVLAPLQNPVSSL

SEQ ID NO: 9321 - protein, 299 aa, Homo sapiens
  SITE (172): Xaa equals any amino acid
  SITE (174): Xaa equals any amino acid
GGEEEGEEGAEISGLGAGRRSAPIAVGLGFLGVGGRGGSDMEANGSQGTSGSANDSQHDPGKMFIGGLSWQTSPDSLRDYFSKFGEIRECMVMRDPTTKRSRGFGFVTFADPASVDKVLGQPHHELDSKTIDPKVAFPRRAQPKMVTRTKKIFVGGLSANTVVEDVKQYFEXFXKVEDAMLMFDKTTNRHRGFGFVTFENEDVVEKVCEIHFHEINNKMVECKKAQPKEVMFPPGTRGRARGLPYTMDAFMLGMGMLGESGQDRRSPWTGRAMEASTPNWVTYQWGKLLHLSKPQFPCL

SEQ ID NO: 9322 - protein, 488 aa, Homo sapiens
  SITE (344): Xaa equals any amino acid
  SITE (416): Xaa equals any amino acid
  SITE (429): Xaa equals any amino acid
  SITE (430): Xaa equals any amino acid
MILSLLFSLGGPLGWGLLGAWAQASSTSLSDLQSSRTPGVWKAEAEDTSKDPVGRNWCPYPMSKLVTLLALCKTEKFLIHSQQPCPQGAPDCQKVKVMYRMAHKPVYQVKQKVLTSLAWRCCPGYTGPNCEHHDSMAIPEPADPGDSHQEPQDGPVSFKPGHLAAVINEVEVQQEQQEHLLGDLQNDVHRVADSLPGLWKALPGNLTAAVMEANQTGHEFPDRSLEQVLLPHVDTFLQVHFSPIWRSFNQSLHSLTQAIRNLSLDVEANRQAISRVQDSAVARADFQELGAKFEAKVQENTQRVGQLRQDVEERLHAQHFTLHRSISELQADVDTKLKRLHKAXEAPGTNGSLVLATPGAGARPEPDSLQARLGQLQRNLSELHMTTARREEELQYTLEDMRATLTRHVDEIKELXSESDETFDQISKXXRQVEELQVNHTALRELRVILMEKSLIMEENKEEVERQLLELNLTLQHLQGGMPTSSST

SEQ ID NO: 9323 - protein, 60 aa, Homo sapiens; identical to SEQ ID NO: 5985

SEQ ID NO: 9324 - protein, 54 aa, Homo sapiens
MSVWPRSTLLFCLLSLSTGLFLDKLGIIIPILLCGWKLNVIMMCVRCLHSAWRY

SEQ ID NO: 9325 - protein, 77 aa, Homo sapiens
MLLATLLLLLLGGALAHPDRIIFPNHACEDPPAVLLEVQGTLQRPLVRDSRTSPANCTWLTKRVQQMLLFHSYGIAQ

SEQ ID NO: 9326 - protein, 306 aa, Homo sapiens
  SITE (171): Xaa equals any amino acid
  SITE (180): Xaa equals any amino acid
  SITE (182): Xaa equals any amino acid
  SITE (188): Xaa equals any amino acid
  SITE (208): Xaa equals any amino acid
  SITE (210): Xaa equals any amino acid
  SITE (211): Xaa equals any amino acid
  SITE (218): Xaa equals any amino acid
  SITE (219): Xaa equals any amino acid
MALRLLRRAARGAAAAALLRLKASLAADIPRLGYSSSSHHKYIPRRAVLYVPGNDEKKIKKIPSLNVDCAVLDCEDGVAANKKNEARLRIVKTLEDIDLGPTEKCVRVNSVSSGLAEEDLETLLQSRVLPSSLMLPKVESPEEIQWAVCEETLKVGPQVGLFLDAVRFWRXRLSSHIGAXSXKETLDXLYARQKIVVIAKAFGLQAVXLXXIDFRDGXXLLRQSREGAAMGFTGKQVIHPNQIAVVQEQFSPSPEKIKWAEELIAAFKEHQQLGKGAFTFQGSMIDMPLLKQAQNTVTLATSIKEK

SEQ ID NO: 9327 - protein, 40 aa, Homo sapiens
MSGSSLPSALALSLLLVSGSLLPGPGAAQNVRVQSGQDQK

SEQ ID NO: 9328 - protein, 64 aa, Homo sapiens; identical to SEQ ID NO: 6017

SEQ ID NO: 9329 - protein, 26 aa, Homo sapiens
MSFPHASTLPFHKLSDLQHTLPNHQG

SEQ ID NO: 9330 - protein, 50 aa, Homo sapiens
  SITE (4): Xaa equals any amino acid
  SITE (10): Xaa equals any amino acid
  SITE (22): Xaa equals any amino acid
  SITE (35): Xaa equals any amino acid
  SITE (39): Xaa equals any amino acid
  SITE (42): Xaa equals any amino acid
VHAXTPFAGXCFDPVSLYWCYXNPGTHCYPTLRGXEQRXPSXRSHIVLRS

SEQ ID NO: 9331 - protein, 235 aa, Homo sapiens [sequence omitted]

SEQ ID NO: 9332 - protein, 120 aa, Homo sapiens; identical to SEQ ID NO: 6022

SEQ ID NO: 9333 - protein, 103 aa, Homo sapiens
  SITE (77): Xaa equals any amino acid
MAFLLERSGTLLICSMWWHHGYSNITGTEGERRNLKRNKTNFRRFQDGRIGTAPVYSSQCERCRRWVISAFPTEQTXHQKIISHAWLGGSHAHGASLIASTAV

SEQ ID NO: 9334 - protein, 957 aa, Homo sapiens [sequence omitted]

SEQ ID NO: 9335 - protein, 103 aa, Homo sapiens
MLTFFMAFLFNWIGFFLSFCLTTSAAGRYGAISGFGLSLIKWILIVRFSTYFPGYFDGQYWLWWVFLVLGFLLFLRGFINYAKVRKMPETFSNLPRTRVLFIY

SEQ ID NO: 9336 - protein, 198 aa, Homo sapiens; identical to SEQ ID NO: 6468
  SITE (29): Xaa equals any amino acid

SEQ ID NO: 9337 - protein, 106 aa, Homo sapiens
  SITE (3): Xaa equals any amino acid
MAXALAALAAVEPACAAGTSSCRMKKSLENLNRLQVMLLHLTAAFLQRAQFSTYFPGYFDGQYWLWWVFLVLGFLLFLRGFINYAKVRKMPETFSNLPRTRVLFIY

SEQ ID NO: 9338 - protein, 68 aa, Homo sapiens
  SITE (3): Xaa equals any amino acid
  SITE (16): Xaa equals any amino acid
  SITE (51): Xaa equals any amino acid
MAXALAALAAARAACXAGTSSCRMKKSLENLNRLQVMLLHLTAAFLQRAHXILTTRMSLGFQSPHLTM

SEQ ID NO: 9339 - protein, 23 aa, Homo sapiens
  SITE (3): Xaa equals any amino acid
  SITE (13): Xaa equals any amino acid
  SITE (16): Xaa equals any amino acid
MAXALAALAAVEXPAXPVPAVAE

SEQ ID NO: 9340 - protein, 60 aa, Homo sapiens
MRKVTISKKHALLLCFQLFRCLLSMYIWITFVLDGSCGIHCSLKPVSFPCTYHSVHSSTS

SEQ ID NO: 9341 - protein, 188 aa, Homo sapiens
  SITE (85): Xaa equals any amino acid
  SITE (104): Xaa equals any amino acid
  SITE (164): Xaa equals any amino acid
MRPAFALCLLWQALWPGPGGGEHPTADRAGCSASGACYSLHHATMKRQAAEEACILRGGALSTVRAGAELRAVLALLRAGPGPGXGSKDLLFWVALERRRSHCXLENEPLRGFSWLSSDPGGLESDTLQWVEEPQRSCTARRWVLPGHRWGRARSWKEMRCHLXANATCASTSLRSCVLRRAPGPPLT

SEQ ID NO: 9342 - protein, 57 aa, Homo sapiens
MLETLSQFISILFVLLWIISDLILCFLKCGNPGTLDMVLPIWTNQYIHSSRSILSFI

SEQ ID NO: 9343 - protein, 44 aa, Homo sapiens [sequence omitted]

SEQ ID NO: 9344 - protein, 44 aa, Homo sapiens [sequence omitted]

SEQ ID NO: 9345 - protein, 57 aa, Homo sapiens; identical to SEQ ID NO: 6062

SEQ ID NO: 9346 - protein, 93 aa, Homo sapiens
  SITE (24): Xaa equals any amino acid
  SITE (65): Xaa equals any amino acid
QVSLPTRLLQMPGMGLDSRFQAWXPSPYLGPQPRAPRPGLQPGPSLRGAEFRESCPRSQKRGREXGRPCPGCRPGGWGLPARLGQPQLQTGPG

SEQ ID NO: 9347 - protein, 48 aa, Homo sapiens
MRHVAIVTMIVVLSPPVLASSLKPPLFIDTYFMFGKRCSRWDTPACSK

SEQ ID NO: 9348 - protein, 36 aa, Homo sapiens; identical to SEQ ID NO: 6073

SEQ ID NO: 9349 - protein, 28 aa, Homo sapiens
LLLCKFKKVNYFLKVLISNFSIWAYDHH

SEQ ID NO: 9350 - protein, 34 aa, Homo sapiens
CKWVQNGGHPNVESSKYHCHEPKASLYTLEESTL

SEQ ID NO: 9351 - protein, 172 aa, Homo sapiens
  SITE (170): Xaa equals any amino acid
MRGSVECTWGWGHCAPSPLLLWTLLLFAAPFGLLGEKTRQLLEFDSTNVSDTAAKPLGRPYPPYSLADFSWNNITDSLDPATLSATFQGHPMNDPTRTFANGSLAFRVQAFSRSSRPAQPPRLLHTADTCQLEVALIGASPRGNRSLFGLEVATLGQGPDCPSMQEQHSXER

SEQ ID NO: 9352 - protein, 131 aa, Homo sapiens
MRGSVECTWGWGHCAPSPLLLWTLLLFAAPFGLLGEKTRQLLEFDSTNVSDTAAKPLGRPYPPYSLADFSWNNITDSLDPATLSATFQGHPMNDPTRTFANGSLAFRSRPFPGPADQPNPLASCTQQTPVS

SEQ ID NO: 9353 - protein, 121 aa, Homo sapiens
MCFLMIFTFLVCWMPYIVICFLVVNGHGHLVTPTISIVSYLFAKSNTVYNPVIYVFMIRKFRRSLLQLLCLRLLRCQRPAKDLPAAGSEMQIRPIVMSQKDGDRPKKSDFQLFFHHFYHHQ

SEQ ID NO: 9354 - protein, 49 aa, Homo sapiens
  SITE (41): Xaa equals any amino acid
MGAHSFGFQLFMSVSVLWGRLCLYGRFSVITFASPPTTFMXIQCCSHCS

SEQ ID NO: 9355 - protein, 79 aa, Homo sapiens
SGWQVPSSVKHLPYDNLRSHCVADEGETEVEGTRATWVEHSGRPGVGSGRPPGTSLTTLPLLLTHLSLTCPLGGDFSKR

SEQ ID NO: 9356 - protein, 104 aa, Homo sapiens; identical to SEQ ID NO: 6087

SEQ ID NO: 9357 - protein, 148 aa, Homo sapiens [sequence omitted]

SEQ ID NO: 9358 - protein, 88 aa, Homo sapiens
MKIAVLFCFFLLIIFQTDFGKNEEIPRKQRRKIYHRRLRKSSTSHKHRSNRQLGIPQTTVFTPVARLPIVNFDYSMEEKFESFQVFLE

SEQ ID NO: 9359 - protein, 20 aa, Homo sapiens
IFALSLSFYTCIHIHTHRHT

SEQ ID NO: 9360 - protein, 484 aa, Homo sapiens
MPRHLSGLLLLLWPLLLLLPPTPAAPGPLARPGLRRLGTRGPGGSPGRRPGSAVPTRAPYSGAGQPGGARGAGVCRSRPLDLVFIIDSSRSVRPLEFTKVKTFVSQIIDTLDIGAADTRVAVVNYASTVKIEFHLQTHSDKQSLKQAVARITPLSTGTMSGLAIQTAMDEAFTVEAGARGPTSNIPKVAIIVTDGRPQDQVNEVAARARASGIELYAVGVDRADMESLKMMASEPLDEHVFYVETYGVIEKLSSRFQETFCALDPCVLGTHRCQHVCVSDGEGKHHCECSQGYSLNADQKTCSAIDKCALNTHGCEHICVNDRTGSYHCECYEGYTLNQDRKTCSAQDQCAFGTHGCQHICVNDRDGSHHCECYEGYTLNADNKTCSVRSECAGGSHGCQHLCVDDGPAAYHCDCFPGYTLTEDRRTCAAIEEARRLVSTEDACGCEATLAFQERASSYLQRLNAKLDDILGKLQADAYGQIHR

SEQ ID NO: 9361 - protein, 266 aa, Homo sapiens
  SITE (45): Xaa equals any amino acid
  SITE (47): Xaa equals any amino acid
  SITE (51): Xaa equals any amino acid
  SITE (134): Xaa equals any amino acid
  SITE (183): Xaa equals any amino acid
  SITE (222): Xaa equals any amino acid
  SITE (224): Xaa equals any amino acid
  SITE (255): Xaa equals any amino acid
MPRHLSGLLLLLWPLLLLLPPTPAAPGPLARPGLRRLGTRGPGGXPXRRPXSAVPTRAPYSGAGQPGGARGAGVCRSRPLDLVFIIDSSRSVRPLEFTKVKTFVSQIIDTLDIGAADTRVAVVNYASTVKIEFXLQTHSDKQSLKQAVARITPLSTGTMSGLAIQTAMDEAFTVEAGARGPTXNIPKVAIIVTDGRPQDQVNEVAARARASGIELYAVGVDXAXMESLQDEWPAKPLDEHVFYVETYGVIEKPSXRFQETLLRSWN

SEQ ID NO: 9362 - protein, 5 aa, Homo sapiens
VLLIL

SEQ ID NO: 9363 - protein, 84 aa, Homo sapiens
KMHFNKNKSILKSFSFVRGNMNEIHSYLKTEYFTAKTLNISRAYHILNTLWSCSYFNIPGSGGQLACLWLRICFHACFLSFFYL

SEQ ID NO: 9364 - protein, 115 aa, Homo sapiens
  SITE (50): Xaa equals any amino acid
  SITE (70): Xaa equals any amino acid
  SITE (86): Xaa equals any amino acid
  SITE (100): Xaa equals any amino acid
MQPPSLLLLVLGLLAAPAAALVRIPLHKFTSVRRTMSELGGPVEDLIARXPISKYAQGVPSVAGGPVPEXLKETTWNAQILRGKFXHPGTPPRKLLPPVXPFEKRGSFPTLLGSP

SEQ ID NO: 9365 - protein, 92 aa, Homo sapiens
  SITE (43): Xaa equals any amino acid
  SITE (69): Xaa equals any amino acid
  SITE (70): Xaa equals any amino acid
LVVLGVCAAQHELTPRLRAGVPVQVEREDVLLHQLLLHQVIKXGKHIVDRDAGVGHAQDAVELGRDEGXXRLLGGFPERLPLHLDASQARQT

SEQ ID NO: 9366 - protein, 368 aa, Homo sapiens
  SITE (310): Xaa equals any amino acid
  SITE (365): Xaa equals any amino acid
MQPSSLLPLALCLLAAPASALVRIPLHKFTSIRRTMSEVGGSVEDLIAKGPVSKYSQAVPAVTEGPIPEVLKNYMDAQYYGEIGIGTPPQCFTVVFDTGSSNLWVPSIHCKLLDIACWIHHKYNSDKSSTYVKNGTSFDIHYGSGSLSGYLSQDTVSVPCQSASSASALGGVKVERQVFGEATKQPGITFIAAKFDGILGMAYPRISVNNVLPVFDNLMQQKLVDQNIFSFYLSRDPDAQPGGELMLGGTDSKYYKGSLSYLNVTRKAYWQVHLDQVEVASGLTLCKEGCEAIVDTGTSLMVGPVDEVRXLQKAIGAVPLIQGEYMIPCEKVSTLPAITLKLGGKGYKLSPEDYTLKVSQAGKTXCLS

SEQ ID NO: 9367 - protein, 112 aa, Homo sapiens
  SITE (103): Xaa equals any amino acid
  SITE (112): Xaa equals any amino acid
MKTLLLLVGLLLTWENGRVLGDQMVSDTELQEMSTEGSKYINREIKNALKGVKQIKTLIEQTNEERKSLLTNLEEAKKKKEDALNDTKDSEMKLKASPGVFNXTLDGPLGGX

SEQ ID NO: 9368 - protein, 112 aa, Homo sapiens
  SITE (71): Xaa equals any amino acid
  SITE (103): Xaa equals any amino acid
  SITE (112): Xaa equals any amino acid
MKTLLLLVGLLLTWENGRVLGDQMVSDTELQEMSTEGSKYINREIKNALKGVKQIKTLIEQTNEERKSLLXNLEEAKKKKEDALNDTKDSEMKLKASPGVFNXTLDGPLGGX

SEQ ID NO: 9369 - protein, 139 aa, Homo sapiens
MKTLLLLVGLLLTWENGRVLGDQMVSDTELQEMSTEGSKYINREIKNALKGVKQIKTLIEQTNEERKSLLTNLEEAKKKKEDALNDTKDSEMKLKASQGVCNDTMMALWEECKPCLKQTWGKGLRPSLQKQHRAGWPPG

SEQ ID NO: 9370 - protein, 7 aa, Homo sapiens
LLVVLLS

SEQ ID NO: 9371 - protein, 14 aa, Homo sapiens
LLLVGLQQLVVQAW

SEQ ID NO: 9372 - protein, 288 aa, Homo sapiens
  SITE (10): Xaa equals any amino acid
  SITE (15): Xaa equals any amino acid
  SITE (268): Xaa equals any amino acid
  SITE (271): Xaa equals any amino acid
  SITE (273): Xaa equals any amino acid
  SITE (274): Xaa equals any amino acid
  SITE (276): Xaa equals any amino acid
  SITE (286): Xaa equals any amino acid
FSSSACPSVXSLFVXLGKNPHDAQGHPRASEDQPSSGKPVTSYPGECGFVFTKEASLEIRDMLLANKVPAAARAGAIAPCEVTVPAQNTGLGPEKTSFFQALGITTKISRGTIEILSDVQLIKTGDKVGASEATLLNMLNISPFSFGLIIQQVFDNGSIYNPEVLDITEETLHSRFLEGVRNVASVCLQIGYPTVASVPHSIINGYKRVLALSVETDYTFPLAEKVKAFLADPSAFVAAAPVAAATTAAPAAAAAPAKVEAKEESEEXDEXIXXSXISKSNNSSQXIV

SEQ ID NO: 9373 - protein, 554 aa, Homo sapiens
GGGYALALLVLLLLGPGGWCLAEPPRDSLREELVITPLPSGDVAATFQFRTRWDSELQREGVSHYRLFPKALGQLISKYSLRELHLSFTQGFWRTRYWGPPFLQAPSDTDHYFLRYAVLPREVVCTENLTPWKKLLPCSSKAGLSVLLKADRLFHTSYHSQAVHIRPVCRNARCTSISWELRQTLSVVFDAFITGQGKKDWSLFRMFSRTLTEPCPLASESRVYVDITTYNQDNETLEVHPPPTTTYQDVILGTRKTYAIYDLLDTAMINNSRNLNIQLKWKRPPENEAPPVPFLHAQRYVSGYGLQKGELSTLLYNTHPYRAFPVLLLDTVPWYLRLYVHTLTITSKGKENKPSYIHYQPAQDRLQPHLLEMLIQLPANSVTKVSIQFERALLKWTEYTPDPNHGFYVSPSVLSALVPSMVAAKPVDWEESPLFNSLFPVSDGSNYFVRLYTEPLLVNLPTPDFSMPYNVICLTCTVVAVCYGSFYNLLTRTFPHRGAPHRWPGQAAGQPYPARPSVPPTLILALSSSCSCRFSLGRGAQGLFLPLALLRVGF

SEQ ID NO: 9374 - protein, 5 aa, Homo sapiens
GEIFL

SEQ ID NO: 9375 - protein, 453 aa, Homo sapiens
  SITE (432): Xaa equals any amino acid
MRMASIMVWVMIIMVILVLGYGIFHCYMEYSRLRGEAGSDVSLVDLGFQTDFRVYLHLRQTWLAFMIILSILEVIIILLLIFLRKRILIAIALIKEASRAVGYVMCSLLYPLVTFFLLCLCIAYWASTAVFLSTSNEAVYKIFDDSPCPFTAKTCNPETFPSSNESRQCPNARCQFAFYGGESGYHRALLGLQIFNAFMFFWLANFVLALGQVTLAGAFASYYWALRKPDDLPAFPLFSAFGRALRYHTGSLAFGALILAIVQIIRVILEYLDQRLKAAENKFAKCLMTCLKCCFWCLEKFIKFLNRNAYIMIAIYGTNFCTSARNAFFLLMRNIIRVAVLDKVTDFLFLLGKLLIVGSVGILAFFFFTHRIRIVQDTAPPLNYYWVPILTVIVGSYLIAHGFFSVYGMCVDTLFLCFLEDLERNDGSAERXYFMSSTLKKLLNKTNKKAAES

SEQ ID NO: 9376 - protein, 96 aa, Homo sapiens
  SITE (25): Xaa equals any amino acid
  SITE (77): Xaa equals any amino acid
  SITE (79): Xaa equals any amino acid
AAREGAPPPCPTSAIGRASLSLRDXGRGLRDARREKRRGVRGQDGGDYGWCGPARGRGVAAKGTAEGPTGENRAQGXKXGVRVAVEASSVRGPGRA

SEQ ID NO: 9377 - protein, 77 aa, Homo sapiens
  SITE (8): Xaa equals any amino acid
  SITE (9): Xaa equals any amino acid
  SITE (10): Xaa equals any amino acid
  SITE (16): Xaa equals any amino acid
LGGYALSXXXNRVTDXVMIYFFIIIVEYFYGKIFVVLIIPIKIMPNTKYEFYDVHFVLGIKRKKHTSWKSVSCFLLL

SEQ ID NO: 9378 - protein, 84 aa, Homo sapiens
TYSFCVCERAFVFGSVPRAEVEQGCTYHGKGGRKENWIACDLWWNLFLLPRPFRPCLISVGHFRLWQGRAGLQSEVPASSLEHN

SEQ ID NO: 9379 - protein, 469 aa, Homo sapiens
MRPPGFRNFLLLASSLLFAGLSAVPQSFSPSLRSWPGAACRLSRAESERRCRAPGQPPGAALCHGRGRCDCGVCICHVTEPGMFFGPLCECHEWVCETYDGSTCAGHGKCDCGKCKCDQGWYGDACQYPTNCDLTKKKSNQMCKNSQDIICSNAGTCHCGRCKCDNSDGSGLVYGKFCECDDRECIDDETEEICGGHGKCYCGNCYCKAGWHGDKCEFQCDITPWESKRRCTSPDGKICSSRGTCVCGECTCHDVDPTGDWGDIHGDTCECDERDCRAVYDRYSDDFCSGHGQCNCGRCDCKAGWYGKKCEHPQSCTLSAEESIRKCQGSSDLPCSGRGKCECGKCTCYPPGDRRVYGKTCECDDRRCEDLDGVVCGGHGTCSCGRCVCERGWFGKLCQHPRKCNMTEEQSKNLCESADGILCSGKGSCHCGKCICSAEEWYISGEFCDCDDRDCDKHDGLICTREWNM

SEQ ID NO: 9380 - protein, 161 aa, Homo sapiens
  SITE (123): Xaa equals any amino acid
  SITE (129): Xaa equals any amino acid
  SITE (145): Xaa equals any amino acid
  SITE (146): Xaa equals any amino acid
  SITE (157): Xaa equals any amino acid
MTTWSCLVAMIVSGVITAVWAVRAAPIWRSQVKQKMRIGKQGNCRPPRCICSALGLLAPWMAVVLSQLSVRCVVSWVQGKPSSPRPRGSAASPAPGATPPTPRKPVSWLGYRENHRPKKPKSXTRCLVXQNWSLPPISKDRTAGXXDTNRTRRSGLXLRLG

SEQ ID NO: 9381 - protein, 325 aa, Homo sapiens
  SITE (10): Xaa equals any amino acid
  SITE (136): Xaa equals any amino acid
  SITE (186): Xaa equals any amino acid
  SITE (234): Xaa equals any amino acid
VPPAVCPAGXFCQNQCFTKRQYPETKIIKTDGKGWGLVAKRDIRKGEFVNEYVGELIDEEECMARIKHAHENDITHFYMLTIDKDRIIDAGPKGNYSRFMNHSCQPNCETLKWTVNGDTRVGLFAVCDIPAGTELXFNYNLDCLGNEKTVCRCGASNCSGFLGDRPKTSTTLSSEEKGKKTKKKTXRRRAKGEGKRQSEDECFRCGDGGQLVLCDRKFCTKAYHLSCLGLGKRXFGKWECPWHHCDVCGKPSTSFCHLCPNSFCKEHQDGTAFSCTPDGRSYCCEHDLGAASVRSTKTEKPPPEPGKPKGKRRRRRGWRRVTEGK

SEQ ID NO: 9382 - protein, 40 aa, Homo sapiens; identical to SEQ ID NO: 6120

SEQ ID NO: 9383 - protein, 61 aa, Homo sapiens
MQGKFMKVQVYRFLKYLLMLLCMFVNRGMSKDSTKKPGQEKLKVSLGSILNMKSQRPLSWC

SEQ ID NO: 9384 - protein, 114 aa, Homo sapiens
MWTALVLIWIFSLSLSESHAASNDPRNFVPNKMWKGLVKRNASVETVDNKTSEDVTMAAASPVTLTKGTSAAHLNSMEVTTEDTSRTDAYESYKKKDYTQVDYLINGMYADSEM

SEQ ID NO: 9385 - protein, 61 aa, Homo sapiens
MRLLLEWRVYLRLTCATKDGMARECPTTWLSPPAKPDFAQRHSVKPTALQGGRWSRLGASP

SEQ ID NO: 9386 - protein, 315 aa, Homo sapiens
MPLTLLILSCLAELTMAEAEGNASCTVSLGGANMAETHKAMILQLNPSENCTWTIERPENKSIRIIFSYVQLDPDGSCESENIKVFDGTSSNGPLLGQVCSKNDYVPVFESSSSTLTFQIVTDSARIQRTVFVFYYFFSPNISIPNCGGYLDTLEGSFTSPNYPKPHPELAYCVWHIQVEKDYKIKLNFKEIFLEIDKQCKFDFLAIYDGPSTNSGLIGQVCGRVTPTFESSSNSLTVVLSTDYANSYRGFSASYTSIYAENINTTSLTCSSDRMRVIISKSYLEAFNSNGNNLQLKDPTWQTKIIKCCGIFCPS

SEQ ID NO: 9387 - protein, 72 aa, Homo sapiens
MPLTLLILSCLADWTMAEAEGNASCTVSLGGANMAETHKAMILQLNPSENCTWTIERPENKSIRIIFSYVPA

SEQ ID NO: 9388 - protein, 131 aa, Homo sapiens [sequence omitted]

SEQ ID NO: 9389 - protein, 49 aa, Homo sapiens; identical to SEQ ID NO: 6131

SEQ ID NO: 9390 - protein, 173 aa, Homo sapiens
MVFLKFFCMSFFCHLCQGYFDGPLYPEMSNGTLHHYFVPDGDYEENDDPEKCQLLFRVSDHRRCSQGEGSQVGSLLSLTLREEFTVLGHQVEGCWARAGGHQQKHLLRPRRGRELWQVPAAGVPPDRGMPTPTRTNPSLSWRASSSRARNRTAGRRAGSTRTFWECWSTPGPC

SEQ ID NO: 9391 - protein, 51 aa, Homo sapiens [sequence omitted]

SEQ ID NO: 9392 - protein, 48 aa, Homo sapiens [sequence omitted]

SEQ ID NO: 9393 - protein, 10 aa, Homo sapiens
IYQHFSLWLG

SEQ ID NO: 9394 - protein, 4 aa, Homo sapiens
MFKM

SEQ ID NO: 9395 - protein, 80 aa, Homo sapiens; identical to SEQ ID NO: 6140

SEQ ID NO: 9396 - protein, 145 aa, Homo sapiens
DPSGSFMGRSVMMRILGSPVFFPMHDTSVCLTYPNFYTVVSPTGSRPPSRNWNSETPGDEELGFEAAVAALGMKTTVSEAEHPLLCEGTRREKGDLALALMITYKDDQAKLKKKISRAWWRAPVVPATREAEVGELLEPRSLRLQ

SEQ ID NO: 9397 - protein, 115 aa, Homo sapiens
MVPNWIQGRWDVLLCVLTVGVLPSIGSRGGWFGTQVPCLIPGALASLHRGTALQLSYPFSMAGRTAERPCSMTNHSFHLLSIYWELGTVLSVKRVLTHLLQQPGKAVLPLAPAQS

SEQ ID NO: 9398 - protein, 174 aa, Homo sapiens [sequence omitted]

SEQ ID NO: 9399 - protein, 228 aa, Homo sapiens
  SITE (92): Xaa equals any amino acid
  SITE (134): Xaa equals any amino acid
  SITE (170): Xaa equals any amino acid
  SITE (195): Xaa equals any amino acid
  SITE (205): Xaa equals any amino acid
  SITE (209): Xaa equals any amino acid
  SITE (214): Xaa equals any amino acid
MVPNWIQGRWDVLLCVLTVGVLPSIGSRGGWFGTQVPCLIPGALASLHRGTALQLSYPFSMAGRTAERPCSMTNHSFHLLSIYWELGTVLSXKRVLTHLLQQPGKAGSSVSPCSKLGDLEHRRSSAWLKAHSSXVQILCPSWHPSLGGSGVGSLQSVPGGWMTKLQPSRXPTISIAQWSQKETDHFTDQRNKGAXLLNPGASDRXKPEXRTKKXPVNSEPGETLPFTN

SEQ ID NO: 9400 - protein, 84 aa, Homo sapiens
DNFLLGVAWFFRGRGSAHVGVVSRQKQWEEGTAKHAAWDYGCPQSCSFSKGVFCLFLRQGHTLSPRMECSGPILAHCNLELLGS

SEQ ID NO: 9401 - protein, 201 aa, Homo sapiens [sequence omitted]

SEQ ID NO: 9402 - protein, 392 aa, Homo sapiens
  SITE (251): Xaa equals any amino acid
MAPWPPKGLVPAVLWGLSLFLNLPGPIWLQPSPPPQSSPPPQPHPCHTCRGLVDSFNKGLERTIRDNFGGGNTAWEEENLSKYKDSETRLVEVLEGVCSKSDFECHRLLELSEELVESWWFHKQQEAPDLFQWLCSDSLKLCCPAGTFGPSCLPCPGGTERPCGGYGQCEGEGTRGGSGHCDCQAGYGGEACGQCGLGYFEAERNASHLVCSACFGPCARCSGPEESNCLQCKKGWALHHLKCVDCAKACXGCMGAGPGRCKKCSPGYQQVGSKCLDVDECETEVCPGENKQCENTEGGYRCICAEGYKQMEGICVKEQIPESAGFFSEMTEDELVVLQQMFFGIIICALATLAAKGDLVFTAIFIGAVAAMTGYWLSERSDRVLEGFIKGR

SEQ ID NO: 9403 - protein, 63 aa, Homo sapiens [sequence omitted]

SEQ ID NO: 9404 - protein, 69 aa, Homo sapiens
MSRKSLAFPIICSYLCFLTVATCSIACTTVFFANLRHTRYICIELSALETSGVISPQINNVPEVHGKYS

SEQ ID NO: 9405 - protein, 52 aa, Homo sapiens
  SITE (36): Xaa equals any amino acid
  SITE (37): Xaa equals any amino acid
MQRLGKAPGTWQAISKCWLLLLLSLPFSQSIIISLXXGTMSYLPLYFPQYFP

SEQ ID NO: 9406 - protein, 86 aa, Homo sapiens
SLKHFWSQGFWIKDTQCATCRMVVARWEERMESYCLMIQCFRLGRWKVLEMCDGYGCATMGRYLVLLNCAHLKMVKMINFVYVLKQ

SEQ ID NO: 9407 - protein, 54 aa, Homo sapiens; identical to SEQ ID NO: 6154

SEQ ID NO: 9408 - protein, 47 aa, Homo sapiens
MKTHLLMFLLSCMARCTGIVPKRPQPAFPLRGKEKKKLLFIFTFFQH

SEQ ID NO: 9409 - protein, 102 aa, Homo sapiens
MTVRRLSLLCRDLWALWLLLKAGAVRGARAGPRLPGRCCGATCGDAGRGWTFWAQPCPQKLLGQKPGAGGCRGWVLGWVPPRPEEPCSLAGKVCTGLARWMV

SEQ ID NO: 9410 - protein, 53 aa, Homo sapiens
  SITE (41): Xaa equals any amino acid
MCKAVCKHRLRLFAVSSFSLGLGWVCVLVLMLWPVRLSLAXRPVQLQQRRSHC

SEQ ID NO: 9411 - protein, 575 aa, Homo sapiens
MRVLVVTIAPIYWALARESGEALNGHSLTGGKFRQESHVEFATGELLTMTQWPGVWIPMASCSSTWWSMALSPDSLADADLQVQDFEEHYVQTGPGQLFVGSTQRFFQGGLPSFLRCNHSIQYNAARGPQPQLVQHLRASAISSAFDPEAEALRFQLATALQAEENEVGCPEGFELDSQGAFCVDVDECAWDAHLCREGQRCVNLLGSYRCLPDCGPGFRVADGAGCEDVDECLEGLDDCHYNQLCENTPGGHRCSCPRGYRMQGPSLPCLDVNECLQLPKACAYQCHNLQGSYRCLCPPGQTLLRDGKACTSLERNGQNVTTVSHRGPLLPWLRPWASIPGTSYHAWVSLRPGPMALSSVGRAWCPPGFIRQNGVCTDLDECRVRNLCQHACRNTEGSYQCLCPAGYRLLPSGKNCQDINECEEESIECGPGQMCFNTRGSYQCVDTPCPATYRQGPSPGTCFRRCSQDCGTGGPSTLQYRLLPLPLGVRAHHDVARLTAFSEVGVPANRTELSMLEPDPRSPFALRPLRAGLGAVYTRRALTRAGLYRLTVRAAAPRHQSVFVLLIAVSPYPY

SEQ ID NO: 9412 - protein, 146 aa, Homo sapiens
MRVLVVTIAPIYWALARESGEALNGHSLTGGKFRQSHTWSLLQGAAHDDPVARGLDPDGLLLLDVVVNGVVPGRAWLTQIFKCRTLKKHYVQTRAWPAVRGLHTALLPGRPPLVPTLQPQHPVQRGPGPPAPAGAAPAGLSYQLGL

SEQ ID NO: 9413 - protein, 472 aa, Homo sapiens; identical to SEQ ID NO: 6160

SEQ ID NO: 9414 - protein, 178 aa, Homo sapiens
SIYSPHTGIQEYQDGVPKIPTACITVEDAEMMSRMASHGIKIVIQLKMGAKTYPDTDSFNTVAEITGSKYPEQVVLVSGHLDSWDVGQGAMDDGGGAFISWEALSLIKDLGLRPKRTLRLVLWTAEEQGGVGAFQYYQLHKVNISNYSLVMESDAGTFLPTGLQFTGSEKARASWRRL

SEQ ID NO: 9415 - protein, 199 aa, Homo sapiens
  SITE (142): Xaa equals any amino acid
MKLGCVLMAWALYLSLGVLWVAQMLLAASFETLQCEGPVCTEESSCHTEDDLTDAREAGFQVKAYTFSEPFHLIVSYDWLILQGPAKPVFEGDLLVLRCQAWQDWPLTQVTFYRDGSALGPPGPNREFSITVVQKADSGHYXCSGIFQSPGPGIPETASVVAITVQELFPAPILLLQGWKDSAKQGGSPQNSRSPQLQK

SEQ ID NO: 9416 - protein, 2 aa, Homo sapiens
SW

SEQ ID NO: 9417 - protein, 32 aa, Homo sapiens
CLETFWSLYLGGWGMVGCVCYWHPVNRSQGCR

SEQ ID NO: 9418 - protein, 283 aa, Homo sapiens
MYLSALQSLIPSLFALVLQNAPFSSKAKLHGEVPQIEVTRFPRPMSPLQDVSTIIGSREQLAVLLQLYDYQLEQEGTTGWESLLWVVNQLLPQLIEIVGKINVTSTACVHEFSRFFWRLCRTFGKIFTNTKVKPQFQEILRLSEENIDSSAGNGVLTKATVPIYATGVLTCYIQEEDRKLLVGFLEDVMTLLSLSHAPLDSLKASFVELGANPAYHELLLTVLWYGVVHTSALVRCTAARMFEVCQHMPLLVSIIMIFFFLRRRREFFLIKRLCISKKKKKKK

SEQ ID NO: 9419 - protein, 286 aa, Homo sapiens
  SITE (204): Xaa equals any amino acid
  SITE (224): Xaa equals any amino acid
  SITE (228): Xaa equals any amino acid
  SITE (264): Xaa equals any amino acid
  SITE (271): Xaa equals any amino acid
MYLSALQSLIPSLFALVLQNAPFSSKAKLHGEVPQIEVTRFPRPMSPLQDVSTIIGSREQLAVLLQLYDYQLEQEGTTGWESLLWVVNQLLPQLIEIVGKINVTSTACVHEFSRFFWRLCRTFGKIFTNTKVKPQFQEILRLSEENIDSSAGNGVLTKATVPIYATGVLTCYIQEEDRKLLVGFLEDVMTLLSLSHAPLDSLKXSFVELGANQAYHELLLTVLXYGVXHTSALVRCTAARMFELLVKGVNETLVAQRVVPALHXLSPVDPXNLCQDCHNFQPLGLF

SEQ ID NO: 9420 - protein, 48 aa, Homo sapiens
  SITE (42): Xaa equals any amino acid
MWDTFVRDRDFSAYLFLHLLPPLSACGLNASLYTATPIVWVXHTSPQD

SEQ ID NO: 9421 - protein, 45 aa, Homo sapiens
  SITE (43): Xaa equals any amino acid
MQAPLQDCGRSVSLRLACVLAPLTTSSRGCHLQLPQDKGKARXDS

SEQ ID NO: 9422 - protein, 305 aa, Homo sapiens
MGILLGLLLLGHLTVDTYGRPILEVPESVTGPWKGDVNLPCTYDPLQGYTQVLVKWLVQRGSDPVTIFLRDSSGDHIQQAKYQGRLHVSHKVPGDVSLQLSTLEMDDRSHYTCEVTWQTPDGNQVVRDKITELRVQKHSSKLLKTKTEAPTTMTYPLKATSTVKQSWDWTTDMDGYLGETSAGPGKSLPVFAIILIISLCCMVVFTMAYIMLCRKTSQQEHVYEAARAHAREANDSGETMRVAIFASGCSSDEPTSQNLGNNYSDEPCIGQEYQIIAQINGNYARLLDTVPLDYEFLATEGKSVC

SEQ ID NO: 9423 - protein, 72 aa, Homo sapiens
MKFVPCLLLVTLSCLGTLGQAPRQKQGSTGEEFHFQTGGRDSCTMRPSSLGQGAGEVWLRVRLPQHRPDLLV

SEQ ID NO: 9424 - protein, 121 aa, Homo sapiens
MGLWLGMLACVFLATAAFVAYTARLDWKLAAEEAKKHSGRQQQQRAESTATRPGPEKAVLSSVATGSSPGITLTTYSRSECHVDFFRTPEEAHALSAPTSRLSVKQLVIRRGAALGAASAH

SEQ ID NO: 9425 - protein, 218 aa, Homo sapiens
  SITE (139): Xaa equals any amino acid
  SITE (217): Xaa equals any amino acid
MVSWMICRLVVLVFGMLCPAYASYKAVKTKNIREYVRWMMYWIVFALFMAAEIVTDIFISWFPFYYEIKMAFVLWLLSPYTKGASCFTASLSTRPCPAMRRRSTRTSCRPRSAATRPCSASGSGASTLPPPLLCRLPPXVRGRWPAGCGASPCRTCAPSLTHLPLPTMTPSTWRTRCPTGGHPLGTGPGACRTATPRMSVGQILRQSPGRQPGPERXP

SEQ ID NO: 9426 - protein, 59 aa, Homo sapiens; identical to SEQ ID NO: 6192

SEQ ID NO: 9427 - protein, 327 aa, Homo sapiens
  SITE (300): Xaa equals any amino acid
MWRPSVLLLLLLLRHGAQGKPSPDAGPHGQGRVHQAAPLSDAPHDDAHGNFQYDHEAFLGREVAKEFDQLTPEESQARLGRIVDRMDRAGDGDGWVSLAELRAWIAHTQQRHIRDSVSAAWDTYDTDRDGRVGWEELRNATYGHYAPGEEFHDVEDAETYKKMLARDERRFRVADQDGDSMATREELTAFLHPEEFPHMRDIVIAETLEDLDRNKDGYVQVEEYIADLYSAEPGEEEPAWVQTERQQFRDFRDLNKDGHLDGSEVGHWVLPPAQDQPLVEANHLLHESDTDKDGRLSKAXILGNWNMFVGSQATNYGEDLTRHHDEL

SEQ ID NO: 9428 - protein, 184 aa, Homo sapiens
  SITE (140): Xaa equals any amino acid
  SITE (145): Xaa equals any amino acid
  SITE (146): Xaa equals any amino acid
  SITE (148): Xaa equals any amino acid
  SITE (165): Xaa equals any amino acid
MWRPSVLLLLLLLRHGAQGKPSPDAGPHGQGRVHQAAPLSDAPHDDAHGNFQYDHEAFLGREVAKEFDQLTPEESQARLGRIVDRMDRAGDGDGWVSLAELRAWIAHTQQRHIRDSVSAAWDTYDTDRDGRVGWEELRNXTYGHXXPXEEFHDVEDAETYKKMLXRDERRFRVADQDGDSMATR

SEQ ID NO: 9429 - protein, 509 aa, Homo sapiens
MTWRMGPRFTMLLAMWLVCGSEPHPHATIRGSHGGRKVPLVSPDSSRPARFLRHTGRSRGIERSTLEEPNLQPLQRRRSVPVLRLARPTEPPARSDINGAAVRPEQRPAARGSPREMIRDEGSSARSRMLRFPSGSSSPNILASFAGKNRVWVISAPHASEGYYRLMMSLLKDDVYCELAERHIQQIVLFHQAGEEGGKVRRITSEGQILEQPLDPSLIPKLMSFLKLEKGKFGMVLLKKTLQVEERYPYPVRLEAMYEVIDQGPIRRIEKIRQKGFVQKCKASGVEGQVVAEGNDGGGGAGRPSLGSEKKKEDPRRAQVPPTRESRVKVLRKLAATAPAFPQPPSTPRATTLPPAPATTVTRSTSRAVTVAARPMTTTAFPTTQRPWTPSPSHRPPTTTEVITARRPSVSENLYPPSRKDQHRERPQTTRRPSKATSLESFTNAPPTTISEPSTRAAGPGRFRDNRMDRREHGHRDPNVVPGPPKPAKEKPPKKKAQDKILSNEYEEV

SEQ ID NO: 9430 - protein, 554 aa, Homo sapiens
MGPRFTMLLAMWLVCGSEPHPHATIRGSHGGRKVPLVSPDSSRPARFLRHTGRSRGIERSTLEEPNLQPLQRRRSVPVLRLARPTEPPARSDINGAAVRPEQRPAARGSPREMIRDEGSSARSRMLRFPSGSSSPNILASFAGKNRVWVISAPHASEGYYRLMMSLLKDDVYCELAERHIQQIVLFHQAGEEGGKVRRITSEGQILEQPLDPSLIPKLMSFLKLEKGKFGMVLLKKTLQVEERYPYPVRLEAMYEVIDQGPIRRIEKIRQKGFVQKCKASGVEGQVVAEGNDGGGGAGRPSQGSEKKKEDPRRAQVPPTRESRVKVLRKLAATAPAFPQPPSTPRATTLTPAPATTVTRSTSRAGNRCCKTYDHHWLSHHAEALDPLTLPTGPLQPLRVITARRPSVSRESLPSIPGRISTGRGHRQPGGPARPTSLESFTNAPPTTISEPSTRAAGPGRFRDNRMDRREHGHRDPNVVPGPPKPAKEKPPKKKAQDKILSNEYEEKYDLSRPTASQLEDELQVGNVPLKKAKESKKHEKLEKPEKEKKKKKKK

SEQ ID NO: 9431 - protein, 23 aa, Homo sapiens
MLALLGLLAGTEHPPGPQGPGPS

SEQ ID NO: 9432 - protein, 247 aa, Homo sapiens
  SITE (166): Xaa equals any amino acid
MHLARLVGSCSLLLLLGALSGWAASDDPIEKVIEGINRGLSNAEREVGKALDGINSGITHAGREVEKVFNGLSNMGSHTGKELDKGVQGLNHGMDKVAHEINHGIGQAGKEAEKLGHGVNNAAGQAGKEADKAVQGFHTGVHQAGKEAEKLGQGVNHAADQAGKEXEKLGPSAHHAAGQAGKELQNAHNGVNQASKEANQLLNGNHQSGSSSHQGGATTTPLASGASVNTPFINLPALWRSVANIMP

SEQ ID NO: 9433 - protein, 57 aa, Homo sapiens
MAGCCLKLFGVLSLCFLCGLISIERVICNPVSADFQVSTFCQRHCLLRSKVMFPIRG

SEQ ID NO: 9434 - protein, 42 aa, Homo sapiens; identical to SEQ ID NO: 6199

SEQ ID NO: 9435 - protein, 6 aa, Homo sapiens
LLLSSF

SEQ ID NO: 9436 - protein, 25 aa, Homo sapiens
MVNIFGFVSCIVFVVAVQLCYMKQP

SEQ ID NO: 9437 - protein, 41 aa, Homo sapiens; identical to SEQ ID NO: 6203

SEQ ID NO: 9438 - protein, 606 aa, Homo sapiens; identical to SEQ ID NO: 6210

SEQ ID NO: 9439 - protein, 295 aa, Homo sapiens; identical to SEQ ID NO: 6212

SEQ ID NO: 9440 - protein, 37 aa, Homo sapiens
MGLPVSWAPPALWVLGCCALLLSLWALCTACRSPRTL

SEQ ID NO: 9441 - protein, 172 aa, Homo sapiens
  SITE (107): Xaa equals any amino acid
  SITE (132): Xaa equals any amino acid
MSFLCLVVLYYIVWSLLFLRSLDVVAEQRRTHVTMAISWITIVVPLLTFEVLLVHRLDGHNTFSYVSIFVPLWLSLLTLMATTFRRKGGNHWWFGIRRDFCQFLLEXFPFLREYGNISYDLHHEDSEDAEEXSVPEAPKIAPIFGKKARVVITQSPGKYVPPPPKLNIDMPD

SEQ ID NO: 9442 - protein, 60 aa, Homo sapiens [sequence omitted]

SEQ ID NO: 9443 - protein, 17 aa, Homo sapiens
ITFSCFFCNNCSQVNLQ

SEQ ID NO: 9444 - protein, 56 aa, Homo sapiens
  SITE (9): Xaa equals any amino acid
  SITE (24): Xaa equals any amino acid
  SITE (30): Xaa equals any amino acid
MRFWFLVFXFFFFPEAHVYPTSWXVSEQGXATISVTPGILNWIFVEEENNTVLDFP

SEQ ID NO: 9445 - protein, 106 aa, Homo sapiens
RSRSKPRCNCEIVTIFFARFKIGPGRHRKRKIPKLCSSGSTIGRVYSLPGLLRRGSCLFGYITPDWFVLKINVIMLVSYLMVSLEHSPLILFERVGGRDCEGREKC

SEQ ID NO: 9446 - protein, 279 aa, Homo sapiens
EERWKSPEVRWAPGVAMEESGYESVLCVKPDVHVYRIPPRATNRGYRAAEWQLDQPSWSGRLRITAKGQMAYIKLEDRTSGELFAQAPVDQFPGTAVESVTDSSRYFVIRIEDGNGRRAFIGIGFGDRGDAFDFNVALQDHFKWVKQQCEFAKQAQNPDQGPKLDLGFKEGQTIKLNIANMKKKEGAAGNPRVRPASTGGLSLLPPPPGGKTSTLIPPPGEQLAVGGSLVQPAVAPSSGGAPVPWPQPNPATADIWGDFTKSTGSTSSQTQPGTGWVQF

SEQ ID NO: 9447 - protein, 40 aa, Homo sapiens
MLFPLLAWPHLLSLWVCLTATSPSKPSAPHSHQMDLCLLH

SEQ ID NO: 9448 - protein, 305 aa, Homo sapiens; identical to SEQ ID NO: 6224

SEQ ID NO: 9449 - protein, 190 aa, Homo sapiens
MSSGTELLWPGAALLVLLGVAASLCVRCSRPGAKRSEKIYQQRSLREDQQSFTGSRTYSLVGQAWPGPLADMAPTRKDKLLQFYPSLEDPASSRYQNFSKGSRHGSEEAYIDPIAMEYYNWGRFSKPPEDDDANSYENVLICKQKTTETGAQQEGIGGLCRGDLSLSLALKTGPTSGLCPSASPEEDEGI

SEQ ID NO: 9450 - protein, 142 aa, Homo sapiens
  SITE (92): Xaa equals any amino acid
  SITE (136): Xaa equals any amino acid
  SITE (138): Xaa equals any amino acid
MCAFPWLLLLLLLQEGSQRRLWRWCGSEEVVAVLQESISLPLEIPPDEEVENIIWSSHKSLATVVPGKEGHPATIMVTNPHYQGQVSFLDPXYSLHISNLSWEDSGLYQAQVNLRTSQISTMQQYNLCVYRWLSEXPXHCEL

SEQ ID NO: 9451 - protein, 122 aa, Homo sapiens
  SITE (92): Xaa equals any amino acid
  SITE (100): Xaa equals any amino acid
  SITE (109): Xaa equals any amino acid
  SITE (116): Xaa equals any amino acid
MLALTLAKADSPRTALLCSAWLLTASFSAQQHKGSLQVHQTLSVEMDQVLKALSFPKKKAALLSTAILCFLRTALRQSFSSAWNPGALKGPXTAATKDTXLTSLRMSKXGPGHWAXKTSWCK

SEQ ID NO: 9452 - protein, 216 aa, Homo sapiens
  SITE (6): Xaa equals any amino acid
  SITE (18): Xaa equals any amino acid
CFPWGXALRQKLFPSALXALVPSGAQPLPATKDTVLAPLRMSQVRSLVIGLQNLLVQKDPLLSQACVGCLEALLDYLDARSPDIALHVASQPWNRFLLFTLLDAGENSFLRPEILRLMTLFMRYRSSSVLSHEEVGDVLQGVALADLSTLSNTTLQALHGFFQQLQSMGHLADHSMAQTLQASLEGLPPSTSSGQPPLQDMLCLGGVAVSLSHIRN

SEQ ID NO: 9453 - protein, 122 aa, Homo sapiens; identical to SEQ ID NO: 6232

SEQ ID NO: 9454 - protein, 127 aa, Homo sapiens
MLPLLIICLLPAIEGKNCLRCWPELSALIDYDLQILWVTPGPPTELSQSIHSLFLEDNNFLKPWYLDRDHLEEETAKFFTQVHQAIKTLRDDKTVLLEEIYTHKNLFTERLNKISDGLKEKEPHPSP

SEQ ID NO: 9455 - protein, 164 aa, Homo sapiens
  SITE (126): Xaa equals any amino acid
MLPLLIICLLPAIEGKNCLRCWPELSALIDYDLQILWVTPGPPTELSQSIHSLFLEDNNFLKPWYLDRDHLEEETAKFFTQVHQAIKTLRDDKTVLLEEIYTHKNLFTERLNKISDGLKEKGAPPXSMNAFPAPSPTCTPEPLGSVCLPSTSVSLPSHLPGSLQ

SEQ ID NO: 9456 - protein, 77 aa, Homo sapiens
MALKNKFSCLWILGLCLVATTSSKIPSITDPHFIDNCIEAHNEWRGKVNPPAADMKYMIWDKGLAKMAKAWGKPVQI

SEQ ID NO: 9457 - protein, 257 aa, Homo sapiens
  SITE (27): Xaa equals any amino acid
MTAAVFFGCAFIAFGPALALYVFTIAXEPLRIIFLIAGAFFWLVSLLISSLVWFMARVIIDNKDGPTQKYLLIFGAFVSVYIQEMFRFAYYKLLKKASEGLKSINPGETAPSMRLLAYVSGLGFGIMSGVFSFVNTLSDSLGPGTVGIHGDSPQFFLYSAFMTLVIILLHVFWGIVFFDGCEKKKWGILLIVLLTHLLVSAQTFISSYYGINLASAFIILVLMGTWAFLAAGGSCRSLKLCLLCQDKNFLLYNQRSR

SEQ ID NO: 9458 - protein, 94 aa, Homo sapiens
  SITE (2): Xaa equals any amino acid
RXPIFIGENFYPPVRGRVGMSACQGGGGGGGGGGGGGGGGGGGGGGGGGGGGVDKLPCLTMCWCGNGAQPARLKVDGIPTGQRKSYADTPAWPG

SEQ ID NO: 9459 - protein, 82 aa, Homo sapiens
  SITE (26): Xaa equals any amino acid
  SITE (28): Xaa equals any amino acid
PGNEVTDGQPRQPLRRLRLPCGASLXRXPASPSDAIQRALPGRKLPRWNASPEQRVAVPCGGLTQWLNTGKELALGVRTSET

SEQ ID NO: 9460 - protein, 60 aa, Homo sapiens
  SITE (3): Xaa equals any amino acid
  SITE (17): Xaa equals any amino acid
NLXCCEPLKGTEIVHLXSSDFKAVACRCSQLNKALPSTTLRGFVCGSSCYISWFPNQETR

SEQ ID NO: 9461 - protein, 124 aa, Homo sapiens
  SITE (75): Xaa equals any amino acid
MSPRGTGCSAGLLMTVGWLLLAGLQSARGTNVTAAVQDAGLAHEGEGEEETENNDSETAENYAPSETEDVSNRNXVKEVEFGMCTVTCGIGVREVILTNGCPGGESKCVVRVEECPWTNRLWLG

SEQ ID NO: 9462 - protein, 159 aa, Homo sapiens
MWLFILLSLALISDAMVMDEKVKRSFVLDTASAICNYNAHYKNHPKYWCRGYFRDYCNIIAFSPNSTNHVALKDTGNQLIVTMSCLNKEDTGWYWCGIQRDFARDDMDFTELIVTDDKGTWPMTLVWERLSGTKPEAARLPKLSARLTAPGRPFSSFAY

SEQ ID NO: 9463 - protein, 71 aa, Homo sapiens
  SITE (40): Xaa equals any amino acid
  SITE (51): Xaa equals any amino acid
  SITE (55): Xaa equals any amino acid
MWLFILLSLALISDAMVMDEKVKRSLCWTRLLPSATTMPXTRITPNTGAEXISVXTATSSPSPLTAPIMWP

SEQ ID NO: 9464 - protein, 39 aa, Homo sapiens; identical to SEQ ID NO: 6253

SEQ ID NO: 9465 - protein, 38 aa, Homo sapiens; identical to SEQ ID NO: 6254

SEQ ID NO: 9466 - protein, 64 aa, Homo sapiens
RTLRMSPSAFCYSLTLLACWRAAWIPTCVPRAAGEMDSPGLADGHWCSGAARRSPHYVARSLVL

SEQ ID NO: 9467 - protein, 5 aa, Homo sapiens
AGTWS

SEQ ID NO: 9468 - protein, 170 aa, Homo sapiens
MILTMLLMLKLCTEVRVANELNARRRSFTDFDPHHFWQWSSFSDYVQCVLAFTGVAGYITYLSIDSALFVETLGFLAVLTEAMLGVPQLYRNHRHQSTEGMSIKMVLMWTSGDAFKTAYFLLKGAPLQFSVCGLLQVLVDLAILGQAYAFARHPQKPAPHAVHPTGTKAL

SEQ ID NO: 9469 - protein, 170 aa, Homo sapiens; identical to SEQ ID NO: 9468

SEQ ID NO: 9470 - protein, 60 aa, Homo sapiens
  SITE (2): Xaa equals any amino acid
MXLAFSVIILAGAGSSRSWNSVLVEKEVVEGGLGPWGNCSAEPLPHLLLPRTNLKAKVPG

SEQ ID NO: 9471 - protein, 240 aa, Homo sapiens
  SITE (67): Xaa equals any amino acid
GEGDDKEESVEKLDCHYSGHHPQPASFCTFGSRQIGRGYYVFDSRWNRLRCALNLMVEKHLNAQLWXKIPPVPSTTSPISTRIPHRTNSVPTSQCGVSYLAAATVSTSPVLLSSTCISPNSKSVPAHGTTLNAQPAASGAMDPVCSMQSRQVSSSSSSPSTPSGLSSVPSSPMSRKPQKLKSSKSLRPKESSGNSTNCQNASSSTSGGSGKKRKNSSPLLVHSSSSSSSSSSSSHSMGVF

SEQ ID NO: 9472 - protein, 362 aa, Homo sapiens
  SITE (307): Xaa equals any amino acid
MRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRRGREMFEVTGLHDVDQGWMRAVRKHAKGLHIVPRLLFEDWTYDDFRNVLDSEDEIEELSKTVVQVAKNQHFDGFVVEVWNQLLSQKRVTDQLGMFTHKEFEQLAPVLDGFSLMTYDYSTAHQPGPNAPLSWVRACVQVLDPKSKWRSKILLGLNFYGMDYATSKDAREPVVGARYIQTLKDHRPRMVWDSQXSEHFFEYKKSRSGRHVVFYPTLKSLQVRLELARELGVGVSIWELGQGLDYFYDLL

SEQ ID NO: 9473 - protein, 415 aa, Homo sapiens
  SITE (338): Xaa equals any amino acid
MRTLFNLLWLALACSPVHTTLSKSDAKKAASKTLLEKSQFSDKPVQDRGLVVTDLKAESVVLEHRSYCSAKARDRHFAGDVLGYVTPWNSHGYDVTKVFGSKFTQISPVWLQLKRRGREMFEVTGLHDVDQGWMRAVRKHAKGLHIVPRLLFEDWTYDDFRNVLDSEDEIEELSKTVVQVAKNQHFDGFVVEVWNQLLSQKRVGLIHMLTHLAEALHQARLLALLVIPPAITPGTDQLGMFTHKEFEQLAPVLDGFSLMTYDYSTAHQPGPNAPLSWVRACVQVLDPKSKWRSKILLGLNFYGMDYATSKDAREPVVGARYIQTLKDHRPRMVWDSQXSEHFFEYKKSRSGRHVVFYPTLKSLQVRLELARELGVGVSIWELARAWTTSTTCSRWALRPPRWTCSFLSHGVSEQV

SEQ ID NO: 9474 - protein, 71 aa, Homo sapiens; identical to SEQ ID NO: 6278

SEQ ID NO: 9475 - protein, 42 aa, Homo sapiens; identical to SEQ ID NO: 6281

SEQ ID NO: 9476 - protein, 76 aa, Homo sapiens
INFTYKRLSLDFIYIYMCVCVCVCVCVCVCVYLKRTCASIKGNKMREYIIDFVKSKYLNYGFSIFKNSCSFCTYFF

SEQ ID NO: 9477 - protein, 461 aa, Homo sapiens
  SITE (234): Xaa equals any amino acid
  SITE (236): Xaa equals any amino acid
MALMLSLVLSLLKLGSGQWQVFGPDKPVQALVGEDAAFSCFLSPKTNAEAMEVRFFRGQFSSVVHLYRDGKDQPFMQMPQYQGRTKLVKDSIAEGRISLRLENITVLDAGLYGCRISSQSYYQKAIWELQVSALGSVPLISITGYVDRDIQLLCQSSGWFPRPTAKWKGPQGQDLSTDSRTNRDMHGLFDVEISLTVQENAGSISCSMRHAHLSREVESRVQIGDTFFEPISWXLXTKVLGILCCGLFFGIVGLKIFFSKFQWKIQAELDWRRKHGQAELRDARKHAVEVTLDPETAHPKLCVSDLKTVTHRKAPQEVPHSEKRFTRKSVVASQSFQAGKHYWEVDGGHNKRWRVGVCRDDVDRRKEYVTLSPDHGYWVLRLNGEHLYFTLNPRFISVFPRTPPTKIGVFLDYECGTISFFNINDQSLIYTLTCRFEGLLRPYIEYPSYNEQNGTPRDKQQ

SEQ ID NO: 9478 - protein, 111 aa, Homo sapiens; identical to SEQ ID NO: 6287

SEQ ID NO: 9479 - protein, 91 aa, Homo sapiens
MLCHPHVHHHLVCLLATLTFSLNASCAEQTFHSQQSNGEFMATLPSISKQFGVIVWKPQRKDVIRLPVALSFSMGLGLLSPALGRFLASEL

SEQ ID NO: 9480 - protein, 78 aa, Homo sapiens; identical to SEQ ID NO: 6292

SEQ ID NO: 9481 - protein, 54 aa, Homo sapiens
MCWICVWLFFSPTKTSCFPWLIRPGPRSFTDSHGTPPWQCLEPSSFTYPGKQVW

SEQ ID NO: 9482 - protein, 145 aa, Homo sapiens
MSQAWVPGLAPTLLFSLLAGPQKIAAKCGLILACPKGFKCCGDSCCQENELFPGPVRIFVIIFLVILSVFCICGLAKCFCRNCREPEPDSPVDCRGPLELPSIIPPERVILKPSLGPTPTEPPPPYSFRPEEYTGDQRGIDNPAF

SEQ ID NO: 9483 - protein, 68 aa, Homo sapiens; identical to SEQ ID NO: 6297

SEQ ID NO: 9484 - protein, 142 aa, Homo sapiens [sequence omitted]

SEQ ID NO: 9485 - protein, 119 aa, Homo sapiens
MRRLLLVTSLVVVLLWEAGAVPAPKVPIKMQVKHWPSEQDPEKAWGARVVEPPEKDDQLVVLFPVQKPKLLTTEEKPRGTKAWMETEDTLGRVLSPEPDHDSLYHPPPEEDQGEERPRL

SEQ ID NO: 9486 - protein, 462 aa, Homo sapiens
  SITE (115): Xaa equals any amino acid
MRLRVRLLKRTWPLEVPETEPTLGHLRSHLRQSLLCTWGYSSNTRFTITLNYKDPLTGDEETLASYGIVSGDLICLILQDDIPAPNIPSSTDSEHSSLQNNEQPSLATSSNQTSXQDEQPSDSFQGQAAQSGVWNDDSMLGPSQNFEAESIQDNAHMAEGTGFYPSEPMLCSESVEGQVPHSLETLYQSADCSDANDALIVLIHLLMLESGYIPQGTEAKALSMPEKWKLSGVYKLQYMHPLCEGSSATLTCVPLGNLIVVNALNLPDVFGLVVLPLELKLRIFRLLDVRSVLSLSAVCRDLFTASNDPLLWRFLYLRDFRDNTVRVQDTDWKELYRKRHIQRKESPKGRFVMLLPSSTHTIPFYPNPLHPRPFPSSRLPPGIIGGEYDQRPTLPYVGDPISSLIPGPGETPSQFPPLRPRFDPVGPLPGPNPILPGRGGPNDRFPFRPSRGRPTDGRLSFM

SEQ ID NO: 9487 - protein, 174 aa, Homo sapiens
MFVPSCLCLRFVVTSLLLQMTHSCGGFYICVIFETILSEFKTQIGRLYRKRHIQRKESPKGRFVMLLPSSTHTIPFYPNPLHPRPFPSSRLPPGIIGGEYDQRPTLPYVGDPISSLIPGPGETPSQFPPLRPRFDPVGPLPGPNPILPGRGGPNDRFPFRPSRGRPTDGRLSFM

SEQ ID NO: 9488 - protein, 53 aa, Homo sapiens
MVTFINATLWIAVFSYIMVWLVTIIGYTLGIPDVIMGITFLAAGQVFQTAWPA

SEQ ID NO: 9489 - protein, 169 aa, Homo sapiens
  SITE (6): Xaa equals any amino acid
  SITE (39): Xaa equals any amino acid
  SITE (44): Xaa equals any amino acid
  SITE (71): Xaa equals any amino acid
MVTFIXATLWIAVFSYIMVWLVTIIGYTLGIPDVIMGIXFLAAXTSVPDCMASLIVARQGLGDMAVSNTIXSNVFDILVGLGVPWGLQTMVVNYGSTVKINSRGLVYSVVLLLGSVALTVLGIHLNKWRLDRKLGVYVLVLYAIFLCFSIMIEFNVFTFVNLPMCREDD

SEQ ID NO: 9490 - protein, 101 aa, Homo sapiens
  SITE (101): Xaa equals any amino acid
MKTLPAMLGTGKLFWVFFLIPYLDIWNIHGKESCDVQLYIKRQSEHSILAGDPFELECPVKYCANRPHVTWCKLNGTTCVKLEDRQTSWKKRRTFHFSSTX

SEQ ID NO: 9491 - protein, 48 aa, Homo sapiens
  SITE (45): Xaa equals any amino acid
  SITE (46): Xaa equals any amino acid
  SITE (48): Xaa equals any amino acid
MVQRLWVSRLLRHRKAQLLLVNLLTFGLEVCLAAGFTYVPLCCGXXVX

SEQ ID NO: 9492 - protein, 12 aa, Homo sapiens
ILQRRKQRLLRG

SEQ ID NO: 9493 - protein, 129 aa, Homo sapiens
RKVEGGASGLNGFPNHPSSLGPAWFPPLPLPSTLSRTGLMKALPKISPTPNFPLPPTFPTSSTTLFGATAGPEAQSAVSQAFVHLSPQSISVLGESHTETQEHPLPELREVLSLRGGLSAVCNNVVLFI

SEQ ID NO: 9494 - protein, 187 aa, Homo sapiens; identical to SEQ ID NO: 6311

SEQ ID NO: 9495 - protein, 105 aa, Homo sapiens
  SITE (69): Xaa equals any amino acid
MSGLAAAAHVFRVCLFPLSWGSSKTTFIHGLSSYIATPVLNSIFSSWKSRRKDTWTCLLHRLSAFPISXRRRNFALFSHSCVCIRSSSDDVGPTMYSFSVPCRVK

SEQ ID NO: 9496 - protein, 61 aa, Homo sapiens
MGSFLHPQWHLLITFCAVLGKGLHSDPSRPFEHGGALGKVPRGRSTLLSKEVLLKKKKKKR

SEQ ID NO: 9497 - protein, 886 aa, Homo sapiens
  SITE (26): Xaa equals any amino acid
  SITE (216): Xaa equals any amino acid
  SITE (234): Xaa equals any amino acid
  SITE (275): Xaa equals any amino acid
  SITE (871): Xaa equals any amino acid
MAARGRGLLLLTLSVLLAAGPSAAAXKLNIPKVLLPFTRATRVNFTLEASEGCYRWLSTRPEVASIEPLGLDEQQCSQKAVVQARLTQPARLTSIIFAEDITTGQVLRCDAIVDLIHDIQIVSTTRELYLEDSPLELKIQALDSEGNTFSTLAGLVFEWTIVKDSEADRFSDSHNALRILTFLESTYIPPSYISEMEKAAKQGDTILVSGMKTGSXKLKARIQEAVYKNVRPAXVRLLILENILLNPAYDVYLMVGTSIHYKVQKIRQGKITELXMPSDQYELQLQNSIPGPEGDPTRPVAVLAQDTSMVTALQLGQSSLVLGHRSIRMQGASRLPNSTIYVVEPGYLGFTVHPGDRWVLETGRLYEITIEVFDKFSNKVYVSDNIRIETVLPAEFFEVLSSSQNGSYHRIRALKRGQTAIDAALTSVVDQDGGVHILQVPVWNQQEVEIHIPITLYPSILTFPWQPKTGAYQYTIRAHGGSGNFSWSSSSHLVATVTVKGVMTTGSDIGFSVIQAHDVQNPLHFGEMKVYVIEPHSMEFAPCQVEARVGQALELPLRISGLMPGGASEVVTLSDCSHFDLAVEVENQGVFQPLPGRLPPGSEHCSGVRVKAEAQGSTTLLVSYRHGHVHLSAKITIAAYLPLKAVDPSSVALVTLGSSKEMLFEGGPRPWILEPSKFFQNVTAEDTDSIGLALFAPHSSRNYQQHWILVTCQALGEQVIALSVGNKPSLTNPFPAVEPAVVKFVCAPPSRLTLVPVYTSPQLDMSCPLLQQNKQVVPVSSHRNPLLDLAAYDQEGRRFDNFSSLSIQWESTRPVLASIEPELPMQLVSQDDESGQKKLHGLQAILVHEASGTTASLPLPLATRSPTSALXEQSSRMTLWCLCRPP

SEQ ID NO: 9498 - protein, 498 aa, Homo sapiens
  SITE (11): Xaa equals any amino acid
  SITE (20): Xaa equals any amino acid
  SITE (398): Xaa equals any amino acid
EALGGRCLWEXPVTFTVHFXDNSGDVFHAHSSVLNFATNRDDFVQIGKGPTNNTCVVRTVSVGLTLLRVWDAEHPGLSDFMPLPVLQAISPELSGAMVVGDVLCLATVLTSLEGLSGTWSSSANSILHIDPKTGVAVARAVGSVTVYYEVAGHLRTYKEVVVSVPQRIMARHLHPIQTSFQEATASKVIVAVGDRSSNLRGECTPTQREVIQALHPETLISCQSQFKPAVFDFPSQDVFTVEPQFDTALGQYFCSITMHRLTDKQRKHLSMKKTALVVSASLSSSHFSTEQVGAEVPFSPGLFADQAEILLSNHYTSSEIRVFGAPEVLENLEVKSGSPAVLAFAKEKSFGWPSFITYTVGVLDPAAGSQGPLSTTLTFSSPVTNQAIAIPVTVAFVXDRRGPGPYGASLFQHFLDSYQVMFFTLFALLAGTAVMIIAYHTVCTPRDLAVPAALTPRASPGHSPHYFAASSPTSPNALPPARKASPPSGLWSPAYASH

SEQ ID NO: 9499 - protein, 37 aa, Homo sapiens
LPWLPFFFSCLVSTLPSMSVSAFSLVVRGRRAFTSVR

SEQ ID NO: 9500 - protein, 16 aa, Homo sapiens
PLCLALELGWVCLSST

SEQ ID NO: 9501 - protein, 117 aa, Homo sapiens
  SITE (113): Xaa equals any amino acid
MLLWWQCLCCHAVLEPAATAMPEDAAPSSLPVPPNMTSSRFHYFWTLLQIKLTQFYSKPRSLSATPEKNIGLQEPERRERFTGESCRWELKAKSCLCPTRNSLGCTQCHCDGXKICN

SEQ ID NO: 9502 - protein, 40 aa, Homo sapiens; identical to SEQ ID NO: 6318

SEQ ID NO: 9503 - protein, 77 aa, Homo sapiens
MYASVLLTGLLSLQRCLAVTRPFLAPRCAARPWPAACCWRSGWPPCCSPSRPPSTATCGGTAYASCATRRRSTPPPT

SEQ ID NO: 9504 - protein, 150 aa, Homo sapiens
MLAVLAFPVGVFVVAVFWIIYAYDREMIYPKLLDNFIPGWLNHGMHTTVLPFILIEMRTSHHQYPSRSSGLTAICTFSVGYILWVCWVHHVTGMWVYPFLEHIGPGARIIFFGSTTILMNFLYLLGEVLNNYIWDTQKSMEEEKEKPKLE

SEQ ID NO: 9505 - protein, 102 aa, Homo sapiens
  SITE (70): Xaa equals any amino acid
MMISIVGFLSPFNMILGGIVVVLVFTGFVWAAHNKDVLRRMKKRYPTTFVMVVMLASYFLISMFGGVMVXVFGITFPLLLMFIHASLRLRNLKNKLENKMEG

SEQ ID NO: 9506 - protein, 188 aa, Homo sapiens; identical to SEQ ID NO: 6323

SEQ ID NO: 9507 - protein, 45 aa, Homo sapiens; identical to SEQ ID NO: 6324

SEQ ID NO: 9508 - protein, 136 aa, Homo sapiens
  SITE (1): Xaa equals any amino acid
  SITE (3): Xaa equals any amino acid
  SITE (8): Xaa equals any amino acid
  SITE (14): Xaa equals any amino acid
XYXSCRKXYLTYGXNSRVDPRVRHVCGVRAHGAGVPHLVSGGDEVSPGGAGPVSHSAEEQPVHQVDRLCGACPGQRVFLCPGEPGAKSGRHLSGGVPPYTECDHAQPLARPGAVESCNHEVCAQTGETVQPLMARR

SEQ ID NO: 9509 - protein, 141 aa, Homo sapiens
GGERHLHRTHPRLPGHRFLRLHRAPRVPHVCGVRAHGAGVPHLVSGGDEVSPGGAGPVSHSAEEQPVHQVDRLCGACPGQRVFLCPGEPGAKSGRHLSGGVPPYTECDHAQPLARPGAVESCNHEVCAQTGETVQPLMARR

SEQ ID NO: 9510 - protein, 84 aa, Homo sapiens
MKGWGWLALLLGALLGTAWARRSQDLHCGACRALVDELEWEIAQVDPKKTIQMGSFRINPDGSQSVVEVTVTVPPNKVAHSGFG

SEQ ID NO: 9511 - protein, 178 aa, Homo sapiens
  SITE (157): Xaa equals any amino acid
  SITE (170): Xaa equals any amino acid
  SITE (171): Xaa equals any amino acid
  SITE (177): Xaa equals any amino acid
MAAPRGRAAPWTTALLLLLASQVLSPGSCADEEEVPEEWVLLHVVQGQIGAGNYSYLRLNHEGKIVLRMRSLKGDADLYVSASSLHPSFDDYELQSATCGPDAVSIPAHFRRPVGIGVYGHPSHLESEFEMKVYYDGTVEQHPFGEAAYPADGQMPXRSTLVPRKTPRKXXNLFSGXY

SEQ ID NO: 9512 - protein, 8 aa, Homo sapiens
TAIFFLLV

SEQ ID NO: 9513 - protein, 88 aa, Homo sapiens; identical to SEQ ID NO: 6332

SEQ ID NO: 9514 - protein, 117 aa, Homo sapiens
  SITE (89): Xaa equals any amino acid
  SITE (111): Xaa equals any amino acid
  SITE (116): Xaa equals any amino acid
MTSIWHRPVCPLSWLVPSAAFSNWGPGCRAVCSPRWATPAKIPTPKCDRVAHEEGSALRVPSRVHSSSQLLRVAPASPTSSLSPVMSRXPPPSRVSVWLFVCLPTRLPVPXALPLXP

SEQ ID NO: 9515 - protein, 38 aa, Homo sapiens
ISHVLIDAYISLKRIKSSCNPTTLGMCSEDLLRLCHWS

SEQ ID NO: 9516 - protein, 130 aa, Homo sapiens
  SITE (64): Xaa equals any amino acid
  SITE (65): Xaa equals any amino acid
MLMPVHFLLLLLLLLGGPRTGLPHKFYKAKPIFSCLNTALSEAEKGQWEDASLLSKRSFHYLRXXTPLRERRRRAKRKRLSPSLGPGVEPEAPGTDTCPKHSPGESHARTRPRVPTAPSSPCPSTSPPTS

SEQ ID NO: 9517 - protein, 111 aa, Homo sapiens
  SITE (108): Xaa equals any amino acid
MRRLLLALPFALLPLAVAHAHEDHDHEHGSLGAHEHGVGRLNAVLDGQALELELDSPAMNLVGFEHVATSAADKAKVAAVRKQLENPSGPVQPAQSRSCVVSNQGINXRCS

SEQ ID NO: 9518 - protein, 91 aa, Homo sapiens
  SITE (84): Xaa equals any amino acid
MYGKSSTRAVLLLLGIQLTALWPIAAVEIYTSRVLEAVNGTDARLKCTFSSFAPVGDALTVTWNFRPLDGGPEQFVFYYHIDPXPTHEWAV

SEQ ID NO: 9519 - protein, 413 aa, Homo sapiens; identical to SEQ ID NO: 6341

SEQ ID NO: 9520 - protein, 365 aa, Homo sapiens
  SITE (144): Xaa equals any amino acid
  SITE (201): Xaa equals any amino acid
MFVGLMAFLLSFYLIFTNEGRALKTATSLAEGLSLVVSPDSIHSVAPENEGRLVHIIGALRTSKLLSDPNYGVHLPAVKLRRHVEMYQWVETEESREYTEDGQVKKETRYSYNTEWRSEIINSKNFDREIGHKNPSAMAVESFXATAPFVQIGRFFLSSGLIDKVDNFKSLSLSKLEDPHVDIIRRGDFFYHSENPKYPEXGDLRVSFSYAGLSGDDPDLGPAHVVTVIARQRGDQLVPFSTKSGDTLLLLHHGDFSAEEVFHRELRSNSMKTWGLRAAGWMAMFMGLNLMTRILYTLVDWFPVFRDLVNIGLKAFAFCVATSLTLLTVAAGWLFYRPLWALLIAGLALVPILVARTRVPAKKLE

SEQ ID NO: 9521 - protein, 47 aa, Homo sapiens; identical to SEQ ID NO: 6347

SEQ ID NO: 9522 - protein, 17 aa, Homo sapiens
MSKARFPFLLSLRWFSA

SEQ ID NO: 9523 - protein, 194 aa, Homo sapiens
  SITE (138): Xaa equals any amino acid
MKLASGFLVLWLSLGGGLAQSDTSPDTEESYSDWGLRHLRGSFESVNSYFDSFLELLGGKNGVCQYRCRYGKAPMPRPGYKPQEPNGCGSYFLGLKVPESMDLGIPAMTKCCNQLDVCYDTCGANKYRCDAKFRWCLXSICSDLKRSLGFVSKVEACDSLVDTVFNTVWTLGCRPFMNSQRAACICAEEEKEEL

SEQ ID NO: 9524 - protein, 66 aa, Homo sapiens
MLIYWLQSSFILSAFVLINSPVTTGIQKSCCKFFPVSINLCFASLHRMKVVTLVALQWLNIALRSS

SEQ ID NO: 9525 - protein, 47 aa, Homo sapiens
MAGTVLGVGAGVFILALLWVAVLLLCVLLSRASGAARFSVIFYSSVL

SEQ ID NO: 9526 - protein, 259 aa, Homo sapiens
MDPQGQTLLLFLFVDFHSAFPVQQMEIWGVYTLLTTHLNAILVESHSVVQGSIQFTVDKVLEQHHQAAKAQQKLQASLSVAVNSIMSILTGSTRSSFRKMCLQTLQAADTQEFRTKLHKVFREITQHQFLHHCSCEVKQLTLEKKDSAQGTEDAPDNSSLELLADTSGQAENKRLKRGSPRIEEMRALRSARAPSPSEAAPRRPEATAAPLTPRGREHREAHGRALAPGRASLGSRLEDVLWLQEVSNLSEWLSPSPGP

SEQ ID NO: 9527 - protein, 21 aa, Homo sapiens
DLHIKLLEHYCLTSCKKVLQL

SEQ ID NO: 9528 - protein, 67 aa, Homo sapiens
  SITE (13): Xaa equals any amino acid
PQSPQRGCYSMLXVLSVSHPQPNKWRCVVPRGPFSHCLASRRGVLQGYSFVCTCRLVGPEFFSHVQE

SEQ ID NO: 9529 - protein, 91 aa, Homo sapiens
  SITE (41): Xaa equals any amino acid
VWRRCVSWRSIRAQVTFPEDFLSLSSSVQFQVIHVLLDPGXTGISTDLLASFGLEYHSWLGAEAAGLIVIYHKVARKLPRGVRKAAGGGRV

SEQ ID NO: 9530 - protein, 215 aa, Homo sapiens
MYLSIIFLAFVSIDRCLQLTHSCKIYRIQEPGFAKMISTVVWLMVLLIMVPNMMIPIKDIKEKSNVGCMEFKKEFGRNWHLLTNFICVAIFLNFSAIILISNCLVIRQLYRNKDNENYPNVKKALINILLVTTGYIICFVPYHIVRIPYTLSQTEVITDCSTRISLFKAKEATLLLAVSNLCFDPILYYHLSKAFRSKVTETFASPKETKVRKKN

SEQ ID NO: 9531 - protein, 406 aa, Homo sapiens; identical to SEQ ID NO: 6370

SEQ ID NO: 9532 - protein, 18 aa, Homo sapiens
IPNEMAGSIWPLGYLATL

SEQ ID NO: 9533 - protein, 43 aa, Homo sapiens; identical to SEQ ID NO: 6373

SEQ ID NO: 9534 - protein, 72 aa, Homo sapiens
MLVLFKFLPLTSSGRFLSVTLYHRVHHQTFFAGAKSFSPASTLNLYICSSQFQSLQKLYCGVIPVLRYASIE

SEQ ID NO: 9535 - protein, 67 aa, Homo sapiens
MAPSGPLLLVLLVPLAAARPGPTSVPAGAAACPCGGTSCRGWGAGPTPGRTSTCPHLTCPRAGTGAT

SEQ ID NO: 9536 - protein, 14 aa, Homo sapiens
PQGPNDVTAKLLCP

SEQ ID NO: 9537 - protein, 6 aa, Homo sapiens
MLLLYL

SEQ ID NO: 9538 - protein, 97 aa, Homo sapiens
MYRAIDSFPRWRSYFYFITLIFFLAWLVKNVFIAVIIETFAEIRVQFQQMWGSRSSTTSTATTQMFHEDAAGGWQLVAVGCQQAPGTRPSLPPGAVQ

SEQ ID NO: 9539 - protein, 127 aa, Homo sapiens
  SITE (127): Xaa equals any amino acid
MFVLLYVTSFAICASGQPRGNQLKGENYSPRYICSIPGLPGPPGPPGANGSPGPHGRIGLPGRDGRDGRKGEKGEKGTAGLRGKTGPLGLAGEKGDQGETGKKGPIGPEGEKGEVGPIGPPGPKGDX

SEQ ID NO: 9540 - protein, 113 aa, Homo sapiens
  SITE (42): Xaa equals any amino acid
  SITE (50): Xaa equals any amino acid
  SITE (110): Xaa equals any amino acid
MPRCRWLSLILLTIPLALVARKDPKKNETGVLRKLKPVNAFXCQRGSSVXGFAMQEYNKESEDKYVFLVVKTLQAQLQVTNLLEYLIDVEIARSDCRKPLSTNEIAPFKXTPS

SEQ ID NO: 9541 - protein, 61 aa, Homo sapiens; identical to SEQ ID NO: 6393

SEQ ID NO: 9542 - protein, 322 aa, Homo sapiens
  SITE (28): Xaa equals any amino acid
RAPRRTGPASFSSRPAGTCSDNRVTSFXDLIHDQDEDEEEEEGQRFYAGGSERSGQQIVGPPRKKSPNELVDDLFKGAKEHGAVAVERVTKSPGETSKPRPFAGGGYRLGAAPEEESAYVAGEKRQHSSQDVHVVLKLWKSGFSLDNGELRSYQDPSNAQFLESIRRGEVPAELRRLAHGGQVNLDMEDHRDEDFVKPKGAFKAFTGEGQKLGSTAPQVLSTSSPAQQAENEAKASSSILIDESEPTTNIQIRLADGGRLVQKFNHSHRISDIRLFIVDARPAMAATSFILMTTFPNKELADESQTLKEANLLNAVIVQRLT

SEQ ID NO: 9543 - protein, 13 aa, Homo sapiens
SCISWVFVMINGL

SEQ ID NO: 9544 - protein, 140 aa, Homo sapiens
  SITE (136): Xaa equals any amino acid
MASLGLQLVGYILGLLGLLGTLVAMLLPSWKTSSYVGASIVTAVGFSKGLWMECATHSTGITQCDIYSTLLGLPADIQAAQAMMVTSSAISSLACIISVVGMRCTVFCQESRAKDRVAVAGGVFFILGSLLGFIPXAWNL

SEQ ID NO: 9545 - protein, 86 aa, Homo sapiens
  SITE (33): Xaa equals any amino acid
  SITE (43): Xaa equals any amino acid
RRFYSPLVPDSMKFEIGEALYLGIISSLFSLIXGIILCFSCSXQRNRSNYYDAYQAQPLATRSSPRPGQPPKVKSEFNSYSLTGYV

SEQ ID NO: 9546 - protein, 261 aa, Homo sapiens [sequence omitted]

SEQ ID NO: 9547 - protein, 72 aa, Homo sapiens
IVNPMFCNFHFRSLTYFFLSHKNTFVLIVGEIFSAFCMFFLIFVGLNILVVITVIIQQKAYPFKNFSTMSFF

SEQ ID NO: 9548 - protein, 182 aa, Homo sapiens; identical to SEQ ID NO: 6329

SEQ ID NO: 9549 - protein, 325 aa, Homo sapiens
  SITE (286): Xaa equals any amino acid
  SITE (318): Xaa equals any amino acid
MIAELVSSALGLALYLNTLSADFCYDDSRAIKTNQDLLPETPWTHIFYNDFWGTLLTHSGSHKSYRPLCTLSFRLNHAIGGLNPWSYHLVNVLLHAAVTGLFTSFSKILLGDGYWTFMAGLMFASHPIHTEAVAGIVGRADVGASLFFLLSLLCYIKHCSTRGYSARTWGWFLGSGLCAGCSMLWKEQGVTVLAVSAVYDVFVFHRLKIKQILPTIYKRKNLSLFLSISLLIFWGSSLLGARLYWMGNKPPSFSNSDNPAADSDSLLTRTLTFFYLPTKNLWLLLXPDTLSFEWSMDAVPLLKTVCDWRNLHTVGLLXWDSFSLA

SEQ ID NO: 9550 - protein, 170 aa, Homo sapiens
  SITE (163): Xaa equals any amino acid
MAAGPGTHLSLFWARIATLAVWAAAALVTVPTAVFGVEGEVCGVRLCLLRFPSRYWLGAYQLQRVVLAFMVPLGVITTSYLLLLAFLQRRQRRRQDSRVVARSVRILVASFFLCWFPNHVVTLWGVLVKFDLVPWNSTFYTIQTYVFPVTTCLAHSNSCLNPXAYVLSRI

SEQ ID NO: 9551 - protein, 35 aa, Homo sapiens
MLCPYTLFSWFLSPLLCLQGWAAATALASSLSASE

SEQ ID NO: 9552 - protein, 151 aa, Homo sapiens; identical to SEQ ID NO: 6417

SEQ ID NO: 9553 - protein, 299 aa, Homo sapiens; identical to SEQ ID NO: 6418

SEQ ID NO: 9554 - protein, 172 aa, Homo sapiens
MIHVRHCTPIPALLVCCGATAVIMLVGDTYTLINYVSFINYLCYGVTILGLLLLRWRRPALHRPIKVNLLIPVAYLVFWAFLLVFSFISEPMVCGVGVIIILTGVPIFFLGVFWRSKPKCVHRLTESMTHWGQELCFVVYPQDAPEEEEEWPLPTLPAACHRQALEATMRFL

SEQ ID NO: 9555 - protein, 225 aa, Homo sapiens; identical to SEQ ID NO: 6419
  SITE (66): Xaa equals any amino acid
  SITE (101): Xaa equals any amino acid

SEQ ID NO: 9556 - protein, 344 aa, Homo sapiens
GTRSSHVPISDSKSIQKSELLGLLKTYNCYHEGKSFQLRHREEEGTLIIEGLLNIAWGLRRPIRLQMQDDREQVHLPSTSWMPRRPSCPLGCWSLLLGLSSLSLPAAISALQLSVFRKEPSPQNGNITAQGPSIQPVHKAESSTDSSGPLEEAEEAPQLMRTKSDASCMSQRRPKCRAPGEAQRIRRHRFSINGHFYNHKTSVFTPAYGSVTNVRVNSTMTTLQVLTLLLNKFRVEDGPSEFALYIVHESGERTKLKDCEYPLISRILHGPCEKIARIFLMEADLGVEVPHEVAQYIKFEMPVLDSFVEKLKEEEEREIIKLTMKFQALRLTMLQRLEQLVEAK

SEQ ID NO: 9557 - protein, 43 aa, Homo sapiens; identical to SEQ ID NO: 6424

SEQ ID NO: 9558 - protein, 245 aa, Homo sapiens
AWRRRRSGTSGKATWWCSGLRRASPTPSRRVQSWATAVMWKPSPSSSPASWSCTALRAPQSCLRAATVRPVTLQARADSPTVPEPVHRPQDPWHIPGVPEPVHRPQDPWHIPGVPEPVHRPQDPWHIPGVPEPVHRPQDPWPWLQLVPPAELAYCLLMLLLAHCMKQQARPGHPDFLHREAWACLSAAGGLASPGLLLWATARPRASGEAGPGRALVGADAACCPRHSVLSLVDIPSGQVLPQGQ

SEQ ID NO: 9559 - protein, 77 aa, Homo sapiens
APRRQAQEWLGRTGNTFAPRLAVTSVKADRREMGPSSSVVAASPSLQDRVIITINNPSRVKKKKKKKKKKKKKKKKK

SEQ ID NO: 9560 - protein, 47 aa, Homo sapiens
  SITE (31): Xaa equals any amino acid
MSCIGRMRLICFIILRICGLEHLFGNMGLGXKNGHLPGHYGHSLEFF

SEQ ID NO: 9561 - protein, 26 aa, Homo sapiens
MIHLSRFYLLLIMLPHVLFFTGDLHS

SEQ ID NO: 9562 - protein, 94 aa, Homo sapiens; identical to SEQ ID NO: 6438

SEQ ID NO: 9563 - protein, 83 aa, Homo sapiens
  SITE (82): Xaa equals any amino acid
IWMHFISFLYPIALATTSSTVLNRSGECGHPCLVPVLRENAFSLSPFGMMFAVGLSYMAFFTLRYVPSVPILLRVFIIQECXF

SEQ ID NO: 9564 - protein, 7 aa, Homo sapiens
MYKCWYR

SEQ ID NO: 9565 - protein, 28 aa, Homo sapiens
  SITE (2): Xaa equals any amino acid
MXLNKTKSLTLLELVFLPGETVSKPSTK

SEQ ID NO: 9566 - protein, 34 aa, Homo sapiens
PLLSSLLGRVQQKQNNKVTAFCSSQKENKSLILV

SEQ ID NO: 9567 - protein, 60 aa, Homo sapiens
  SITE (8): Xaa equals any amino acid
  SITE (27): Xaa equals any amino acid
MCIHVFMXVLWVLFLLNPLCTGLWPLXNCFSVLRHADWVLGADYKGEELNRHQGPMKPKD

SEQ ID NO: 9568 - protein, 85 aa, Homo sapiens [sequence omitted]

SEQ ID NO: 9569 - protein, 45 aa, Homo sapiens
  SITE (28): Xaa equals any amino acid
MKKSLENLNRLQVMLLHLTAAFLQRAHXILTTRMSLGFQSPHLTM

SEQ ID NO: 9570 - protein, 84 aa, Homo sapiens
  SITE (71): Xaa equals any amino acid
MGCIPLIKSISDWRVIALAALWFCLIGLICQALCSEDGHKRRILTLGLGFLVIPFLPASNLFFRVGFVVAXCSSTSPALGTVCC

SEQ ID NO: 9571 - protein, 464 aa, Homo sapiens; identical to SEQ ID NO: 6474

SEQ ID NO: 9572 - protein, 206 aa, Homo sapiens
  SITE (200): Xaa equals any amino acid
MVRLAAELLLLLGLLLLTLHITVLRGSGAADGPDAAAGNASQAQLQNNLNVGSDTTSETSFSLSKEAPREHLDHQAAHQPFPRPRFRQETGHPSLQRDFPRSFLLDLPNFPDLSKADINGQNPNIQVTIEVVDGPDSEADKDQHPENKPSWSVPSPDWRAWWQRSLSLARANSGDQDYQYDSTSDDSNFLNPPRGWDHTXPGHRDF

SEQ ID NO: 9573 - protein, 107 aa, Homo sapiens
  SITE (52): Xaa equals any amino acid
HFSKGKQQNKWEKDNGPHFTYFNTILTIFSSTNISPINKYKRGGGSIWGILXFYVLRKQKKLHYFCKVFIESRIIVHQAIVNMTWSYGVELRKNKVGSYSIFYFAKF

SEQ ID NO: 9574 - protein, 37 aa, Homo sapiens
MFQECIPISLFFLNWLKECCSFTCPNSHINNCLTGIR

SEQ ID NO: 9575 - protein, 100 aa, Homo sapiens
  SITE (22): Xaa equals any amino acid
  SITE (83): Xaa equals any amino acid
  SITE (92): Xaa equals any amino acid
  SITE (95): Xaa equals any amino acid
MIASCLCYLLLPATRLFRALSXAFFTCRKNVLLANSSSPQVEGDFAMAPRGPEQEECEGLLQQWREEGLSQVLSTASEGPLIXKGLAQSSLXLLXDNPGE

SEQ ID NO: 9576 - protein, 136 aa, Homo sapiens
ARAKPERPAGWAESVLEEDASELEPAFSRTVGTIQHCLHLTSVYTHFLPQRGRPEVTTMPLGLGMTVDYIFFSAESCENGNRTDHRLYRDGTLKLLGRLSLLSEEILWAANGLPNPFCSSDHLCLLASFGMEVTAP

SEQ ID NO: 9577 - protein, 164 aa, Homo sapiens
MSTRRLGVAVAVLGGFLYAVGGSDGTSPLNTVERYNPQENRWHTIAPMGTRRKHLGCAVYQDMIYAVGGRDDTTELSSAERYNPRTNQWSPVVAMTSRRSGVGLAVVNGQLMAVGGFDGTTYLKTIEVFDPDANTWRLYGGMNYRRLGGGVGVIKMTHCESHIW

SEQ ID NO: 9578 - protein, 61 aa, Homo sapiens
SQHFGRPRWKDCLKPGVRDQPGQHSKTPSLCKKKGIILYFLLIRFICVSNLHLQFDFFSDL

SEQ ID NO: 9579 - protein, 125 aa, Homo sapiens
MTAGFMGMAVAIILFGWIIGVLGCCWDRGLMQYVAGLLFLMGGTFCIISLCTCVAGINFELSRYPRYLYGLPDDISHGYGWSMFCAWGGLGLTLISGFFCTLAPSVQPVPRTNYPKSRPENGTVC

SEQ ID NO: 9580 - protein, 145 aa, Homo sapiens
PFTFQHDCEASPATWNYLRRMTAGFMGMAVAIILFGWIIGVLGCCWDRGLMQYVAGLLFLMGGTFCIISLCTCVAGINFELSRYPRYLYGLPDDISHGYGWSMFCAWGGLGLTLISGFFCTLAPSVQPVPRTNYPKSRPENGTVC

SEQ ID NO: 9581 - protein, 33 aa, Homo sapiens
MHRYITFFKCFRSVILDLLFILSPLSQGCFILF

SEQ ID NO: 9582 - protein, 120 aa, Homo sapiens
MRPVSVWQWSPWGLLLCLLCSSCLGSPSPSTGPEKKAGSQGLRFRLAGFPRKPYEGRVEIQRAGEWGTICDDDFKLQAAQILCRELGFTEPQLDPQCQIWPWNSRIWLDNLSCMGPSRCD

SEQ ID NO: 9583 - protein, 99 aa, Homo sapiens
  SITE (6): Xaa equals any amino acid
  SITE (60): Xaa equals any amino acid
MHVKWXLIMFLICISLESNVNGYLFMCLLFGYLLWRNVYPNLLPILNFNSCLLDLELQEXFVYSKYQTFNKYMICKCFFSHAVCYSFTFLIVFFEAQTF

SEQ ID NO: 9584 - protein, 88 aa, Homo sapiens; identical to SEQ ID NO: 6500

SEQ ID NO: 9585 - protein, 16 aa, Homo sapiens
VLGLGVVLTPIIPVLW

SEQ ID NO: 9586 - protein, 55 aa, Homo sapiens
  SITE (30): Xaa equals any amino acid
NNLCFISPFTSMYWLAQFIVSEKQGTHLHXLQETVLPFNLKTRKLNFNRNLLSML

SEQ ID NO: 9587 - protein, 179 aa, Homo sapiens
  SITE (48): Xaa equals any amino acid
MAAASAGATRLLLLLLMAVAAPSRARGSGCRAGTGARGAGAEGREGEXPVSSAIPRRVCWSLLSPRPTRPPGPAPCPLPSAGRGAAGLGPLAQQPVSPAPASPMAPCSPRGFPPAHGVEPEILATMPVLTSHPPTPSPCSLGTCRLLSSLCAFVPGGLTLLSLAGLGGPVQAPAAPPSL

SEQ ID NO: 9588 - protein, 162 aa, Homo sapiens
  SITE (134): Xaa equals any amino acid
  SITE (142): Xaa equals any amino acid
  SITE (154): Xaa equals any amino acid
  SITE (161): Xaa equals any amino acid
MALPRCTWPNYVWRAVMACLVHRGLGAPLTLCMLGCLLQAGHVLSQKLDDVDPLVATNFGKIRGIKKELNNEILGPVIQFLGVPYAAPPTGERRFQPPEPPSPWSDIRNATQFAPVCPQNIIDGRLPEVMLPVXFTNNLDVXSSYVQDQSERLXIFKYICXD

SEQ ID NO: 9589 - protein, 98 aa, Homo sapiens
MVHINRALKLIIRLFLVEDLVDSLKLAVFMWLMTYVGAVFNGITLLILAELLIFSVPIVYEKYKTQIDHYVGIARDQTKSIVEKIQAKLPGIAKKKAE

SEQ ID NO: 9590 - protein, 392 aa, Homo sapiens; identical to SEQ ID NO: 9402
  SITE (251): Xaa equals any amino acid

SEQ ID NO: 9591 - protein, 434 aa, Homo sapiens [sequence omitted]

SEQ ID NO: 9592 - protein, 85 aa, Homo sapiens [sequence omitted]

SEQ ID NO: 9593 - protein, 81 aa, Homo sapiens; identical to SEQ ID NO: 6510

SEQ ID NO: 9594 - protein, 65 aa, Homo sapiens
  SITE (50): Xaa equals any amino acid
MLLNTSFTREIIISQRESNWLVLLLLLFFPVICFIERSLCGGTDFLNTLXHTHTYTPSIYGAMHR

SEQ ID NO: 9595 - protein, 138 aa, Homo sapiens
MAVATLASETLPLLALTFITDNSLVAAGHDCFPVLFTYDAAAGMLSFGGRLDVPKQSSQRGLTARERFQNLDKKASSEGGTAAGAGLDSLHKNSVSQISVLSGGKAKCSQFCTTGMDGGMSIWDVKSLESALKDLKIK

SEQ ID NO: 9596 - protein, 73 aa, Homo sapiens
MSPAAAAEPDGDQQDRHVSKLIFCFFVFGAVLLCVGVLLSIFGFQACQYKPLPDCPMVLKWRGCMCRGWAWGL

SEQ ID NO: 9597 - protein, 115 aa, Homo sapiens
  SITE (96): Xaa equals any amino acid
  SITE (100): Xaa equals any amino acid
MLGLLGSTALVGWITGAAVAVLLLLLLLATCLFHGRQDCDVERNRTAAGGNRVRRAQPWPFRRRGHLGIFHHHRHPGHVSHVPNVGLHHHHHPRHXPHHXHHHHHPHRHHPRHAR

SEQ ID NO: 9598 - protein, 60 aa, Homo sapiens
MSPTGLLVVFAPVVLGLKAITLAALLLALATSRRSPGQEDVKTTGPAGAMNTLAWSKGQE

SEQ ID NO: 9599 - protein, 60 aa, Homo sapiens; identical to SEQ ID NO: 9598

SEQ ID NO: 9600 - protein, 310 aa, Homo sapiens; identical to SEQ ID NO: 6527

SEQ ID NO: 9601 - protein, 310 aa, Homo sapiens; identical to SEQ ID NO: 6527

SEQ ID NO: 9602 - protein, 310 aa, Homo sapiens; identical to SEQ ID NO: 6527

SEQ ID NO: 9603 - protein, 310 aa, Homo sapiens; identical to SEQ ID NO: 6527

SEQ ID NO: 9604 - protein, 49 aa, Homo sapiens; identical to SEQ ID NO: 6529

SEQ ID NO: 9605 - protein, 394 aa, Homo sapiens [sequence omitted]

SEQ ID NO: 9606 - protein, 212 aa, Homo sapiens
  SITE (9): Xaa equals any amino acid
GSAGTARIXGSTTRPDPEEPDGGELVLGGSDPAHYIPPLTFVPVTVPAYWQIHMERVKVGPGLTLCAKGCAAILDTGTSLITGPTEEIRALHAAIGGIPLLAGEYIILCSEIPKLPAVSFLLGGVWFNLTAHDYVIQTTRNGVRLCLSGFQALDVPPPAGPFWILGDVFLGTYVAVFDRGDMKSSARVGLARARTRGADLGWGETAQAQFPG

SEQ ID NO: 9607 - protein, 145 aa, Homo sapiens
MSPPPLLQPLLLLLPLLNVEPSGATLIRIPLHRVQPGRRILNLLRGWREPAELPKLGAPSPGDKPIFVPLSNYRDVQYFGEIGLGTPPQNFTVAFDTGSSNLWVPSRRCHFFSVPCWLHHRFDPKASSSFRPMGPSLPFNMELGG

SEQ ID NO: 9608 - protein, 145 aa, Homo sapiens [sequence omitted]

SEQ ID NO: 9609 - protein, 62 aa, Homo sapiens
QPALLYLVPACIGFPVLVALAKGEVTEMFSYEESNPKDPAAVTESKEGTEASASKGLEKKEK

SEQ ID NO: 9610 - protein, 51 aa, Homo sapiens
AVVPTWCSTVLLTFVPTARLVAGLEDVQVYDGEDAVFSLDLSTIIQGTWFP

SEQ ID NO: 9611 - protein, 33 aa, Homo sapiens
  SITE (28): Xaa equals any amino acid
MNFVLFFIGINVGCRGENSLKYFTVTVXCSPRD

SEQ ID NO: 9612 - protein, 82 aa, Homo sapiens; identical to SEQ ID NO: 6544

SEQ ID NO: 9613 - protein, 88 aa, Homo sapiens
LTTPYGGLCKQSTRGSIISTWQCTWWLCDLEKVSYSCLCVLTLETETLFVVFTLFQQQKLFQGKSYRTFKHVCIHTYPIPHYIKVILL

SEQ ID NO: 9614 - protein, 2 aa, Homo sapiens
YF

SEQ ID NO: 9615 - protein, 353 aa, Homo sapiens
  SITE (260): Xaa equals any amino acid
MPWPLLLLLAVSGAQTTRPCFPGCQCEVETFGLFDSFSLTRVDCSGLGPHIMPVPIPLDTAHLDLSSNRLEMVNESVLAGPGYTTLAGLDLSHNLLTSISPTAFSRLRYLESLDLSHNGLTALPAESFTSSPLSDVNLSHNQLREVSVSAFTTHSQGRALHVDLSHNLIHRLVPHPTRAGLPAPTIQSLNLAWNRLHAVPNLRDLPLRYLSLDGNPLAVIGPGAFAGLGGLTHLSLASLQRLPELAPSGFRELPGLQVLXLSGNPKLNWAGAEVFSGLSSLQELDLSGTNLVPLPEALLLHLPALQSVSVGQDVRCRRLVREGTYPRRPGSSPKVALHCVDTRESAARGPTIL

SEQ ID NO: 9616 - protein, 434 aa, Homo sapiens; identical to SEQ ID NO: 6546

SEQ ID NO: 9617 - protein, 357 aa, Homo sapiens
  SITE (140): Xaa equals any amino acid
  SITE (325): Xaa equals any amino acid
  SITE (329): Xaa equals any amino acid
  SITE (335): Xaa equals any amino acid
  SITE (338): Xaa equals any amino acid
  SITE (339): Xaa equals any amino acid
MGMGRGAGRSALGFWPTLAFLLCSFPAATSPCKILKCNSEFWSATSGSHAPASDDTPEFCAALRSYALCTRRTARTCRGDLAYHSAVHGIEDLMSQHNCSKDGPTSQPRLRTLPPAGDSQERSDSPEICHYEKSFHKHSXTPNYTHCGLFGDPHLRTFTDRFQTCKVQGAWPLIDNNYLNVQVTNTPVLPGSAATATSKLTIIFKNFQECVDQKVYQAEMDELPAAFVDGSKNGGDKHGANSLKITEKVSGQHVEIQAKYIGTTIVVRQVGRYLTFAVRMPEEVVNAVEDWDSQGLYLCLRGCPLNQQIDFQAFHTNAEGTGARXLAAXSLDPQXPRXXHTRQAVAKCKEKLPVEDL

SEQ ID NO: 9618 - protein, 179 aa, Homo sapiens
  SITE (91): Xaa equals any amino acid
  SITE (140): Xaa equals any amino acid
  SITE (169): Xaa equals any amino acid
MGMGRGAGRSALGFWPTLAFLLCSFPAATSPCKILKCNSEFWSATSGSHAPASDDTPEFCAALRSYALCTRRTARTCRGDLAYHSAVHGIXDLMSQHNCSKDGPTSQPRLRTLPPAETARSARTAPRSAITRRAFTSTRXPPTTRTVASSGTHTFRTFTDRFQTCKVQXRLAAHRQLIT

SEQ ID NO: 9619 - protein, 213 aa, Homo sapiens
LLFLSLLQMQELLGRGAWAPGCGRRPSGWGQLACPDPLLPPHNPKSPQPGPSTSGVWGEEQGLRTLSSEHPWQGLQPLISSLKPCGHTARRDLPLAPASFQPRVLIQGPRTVPPVLLCPQHKARLHSQKCSQALEGDPASSPTAPHPTHPSAAPLLFPRDLSYTGQEAAERVSPPPSKRSCSLCQNRVWAGGRALGARPLPLPAGFSWSLCWK

SEQ ID NO: 9620 - protein, 40 aa, Homo sapiens; identical to SEQ ID NO: 6548

SEQ ID NO: 9621 - protein, 5 aa, Homo sapiens
TTMTG

SEQ ID NO: 9622 - protein, 216 aa, Homo sapiens
  SITE (86): Xaa equals any amino acid
MKERKGFNLQGPLILWSFCLAIFSILGAVRMWGIMGTVLLTGGLKQTVCFINFIDNSTVKFWSWVFLLSKVIELGDTAFIILRKRXLIFIHWYHHSTVLVYTSFGYKNKVPAGGWFVTMNFGVHAIMYTYYTLKAANVKPPKMLPMLITSLQILQMFVGAIVSILTYIWRQDQGCHTTMEHLFWSFILYMTYFILFAHFFCQTYIRPKVKAKTKSQ

SEQ ID NO: 9623 - protein, 101 aa, Homo sapiens [sequence omitted]

SEQ ID NO: 9624 - protein, 82 aa, Homo sapiens
  SITE (17): Xaa equals any amino acid
MIRRLVFAAFPRLFPVXLPSMLTHWASLAVIPTMTATSVGKAPPGPLPDASPSLRLPARRRPDPVGACRGVRGMADLMVPLP

SEQ ID NO: 9625 - protein, 125 aa, Homo sapiens; identical to SEQ ID NO: 6553

SEQ ID NO: 9626 - protein, 25 aa, Homo sapiens
  SITE (18): Xaa equals any amino acid
MQILLLFYFSRFLAPSRXPTLEGVQ

SEQ ID NO: 9627 - protein, 328 aa, Homo sapiens
GTSGADEKNCFSCQPGTFHCGTNLCIFETWRCDGQEDCQDGSDEHGCLAAVPRKVITAALIGSLVCGLLLVIALGCAFKLYSLRTQEYRAFETQMTRLEAEFVRREAPPSYGQLIAQGLIPPVEDFPVYSASQASVLQNLRTAMRRQMRRHASRRGPSRRRLGRLWNRLFHRPRAPRGQIPLLTAARPSQTVLGDGFLQPAPGAAPDPPAPLMDTGSTRAAGDRPPSAPGRAPEVGPSGPPLPSGLRDPECRPVDKDRKVCREPLADGPAPADAPREPCSAQDPHPQVSTASSTLGPHSPEPLGVCRNPPPPCSPMLEASDDEALLVC

SEQ ID NO: 9628 - protein, 29 aa, Homo sapiens
NSQYFTTNIALMFLFKKKKVYGCLHLSTV

SEQ ID NO: 9629 - protein, 77 aa, Homo sapiens; identical to SEQ ID NO: 6569

SEQ ID NO: 9630 - protein, 192 aa, Homo sapiens [sequence omitted]

SEQ ID NO: 9631 - protein, 192 aa, Homo sapiens [sequence omitted]

SEQ ID NO: 9632 - protein, 183 aa, Homo sapiens
  SITE (75): Xaa equals any amino acid
  SITE (125): Xaa equals any amino acid
MALARPGTPDPQALASVLLLLLWAPALSLLAGTVPSEPPSACASDPCAPGTECQATESGGYTCGPMEPRGCATQXCHHGALCVPQGPDPNGFRCYCVPGFQGPRCELDIDECASRPCHHGATLPXPGRSLRVPLPLGYAAPHLNPLSYVWGIPHLMRQRLPPDGDSKANDSKKLGPQKIYSGK

SEQ ID NO: 9633 - protein, 307 aa, Homo sapiens
  SITE (249): Xaa equals any amino acid
  SITE (261): Xaa equals any amino acid
MLRVVEGIFIFVVVSESVFGVLGNGFIGLVNCIDCAKNKLSTIGFILTGLAISRIFLIWIIITDGFIQIFSPNIYASGNLIEYISYFWVIGNQSSMWFATSLSIFYFLKIANFSNYIFLWLKSRTNMVLPFMIVFLLISSLLNFAYIAKILNDYKMKNDTVWDLNMYKSEYFIKQILLNLGVIFFFTLSLITCIFLIISLWRHNRQMQSNVTGLRDSNTEAHVKAMKVLISFIILFILYFIGMAIEISXFTVRENKLLLMXGMTTTAIYPWGHSFILILGNSKLKQASLRVLQQLKCCEKRKNLRVT

SEQ ID NO: 9634 - protein, 49 aa, Homo sapiens
  SITE (48): Xaa equals any amino acid
ISVIFNDTVKKTMQECSAMKQIFKDLFTGFLSWNIHLFPRCLCDSEIXP

SEQ ID NO: 9635 - protein, 80 aa, Homo sapiens; identical to SEQ ID NO: 6586

SEQ ID NO: 9636 - protein, 241 aa, Homo sapiens
  SITE (58): Xaa equals any amino acid
MFKLRQMRVEKFIYENHPDVFSDSSMDHFQKFLPTVGGQLGTAGQGFSYSKSNGRGGXQAGGSGSAGQYGSDQQHHLGSGSGAGGTGGPAGQAGRGGAAGTAGVGETGSGDQAGGEGKHITVFKTYISPWERAMGVDPQQKMELGIDLLAYGAKAELPKYKSFNRTAMPYGGYEKASKRMTFQMPKFDLGPLLSEPLVLYNQNLSNRPSFNRTPIPWLSSGEPVDYNVDIGIPLDGETEEL

SEQ ID NO: 9637 - protein, 147 aa, Homo sapiens [sequence omitted]

SEQ ID NO: 9638 - protein, 21 aa, Homo sapiens
PWASSHLGPRPYVHGLAPSGP

SEQ ID NO: 9639 - protein, 6 aa, Homo sapiens
PWPPLV

SEQ ID NO: 9640 - protein, 21 aa, Homo sapiens
MYSFSVLEITCFILFLWPSWV

SEQ ID NO: 9641 - protein, 51 aa, Homo sapiens; identical to SEQ ID NO: 6598

SEQ ID NO: 9642 - protein, 105 aa, Homo sapiens
MKGSRALLLVALTLFCICRMATGEDNDEFFMDFLQTLLVGTPEELYEGTLGKYNVNEDAKAAMTELKSCIDGLQPMHKAELVKLLVQVLGSQDGAGTDYKDDDDK

SEQ ID NO: 9643 - protein, 302 aa, Homo sapiens
MEATGTWALLLALALLLLLTLALSGTRARGHLPPGPTPLPLLGNLLQLRPGALYSGLMRLSKKYGPVFTIYLGPWRPVVVLVGQEAVREALGGQAEEFSGRGTVAMLEGTFDGHGVFFSNGERWRQLRKFTMLALRDLGMGKREGEELIQAEARCLVETFQGTEGRPFDPSLLLAQATSNVVCSLLFGLRFSYEDKEFQAVVRAAGGTLLGVSSQGGQVSGWDPSPTTFPEGSCQGPMRTSCPSPHRPTRCSPGSCGPCQAPTSSSSTTSAPWLPSQSGRCSSTRGTWMLRAPHVTLSMPSC

SEQ ID NO: 9644 - protein, 302 aa, Homo sapiens; identical to SEQ ID NO: 9643

SEQ ID NO: 9645 - protein, 254 aa, Homo sapiens
  SITE (218): Xaa equals any amino acid
  SITE (228): Xaa equals any amino acid
  SITE (240): Xaa equals any amino acid
ETRLHHVSTLAAFTVRQVQQHQGNLDASGPARDLVDAFLLKMAQEEQNPGTEFTNKNMLMTVIYLLFAGTMTVSTTVGYTLLLLMKYPHVQKWVREELNRELGAGQAPSLGDRTRSLTPTRFCMRRSGCWRWCPWEYPAPSCGPPASEGTPCPRARRSSPSLAPSCMTPTSSSTQKSSTQTVSWMQMDGSGSMRRSCLLLKEACLPWKGPGKSGALPXLHHHPTSLLXGEPVPAGHPEPXAHRQWPFQHSPSLP

SEQ ID NO: 9646 - protein, 159 aa, Homo sapiens
MGCLWGLALPLFFFCWEVGVSGSSAGPSTRRADTAMTTDDTEVPAMTLAPGHAALETQTLSAETSSRASTPAGPIPEAETRGAKRISPARETRSFTKTSPNFMVLIATSVETSAASGSPEGARMTTVQTITGSDPRKPSLTPFAPMTALKRQRHSQWTY

SEQ ID NO: 9647 - protein, 149 aa, Homo sapiens
  SITE (114): Xaa equals any amino acid
  SITE (123): Xaa equals any amino acid
  SITE (144): Xaa equals any amino acid
MGCLWGLALPLFFFCWEVGVSGSSAGPSTRRADTAMTTDDTEVPAMTLAPGHAALETQTLSAETSSRASTPAGPIPEAETRGAKRISPARETRSFTKTSPNFMVLIATSVETSXASGSPEGAXMTTVQTITGSDPREAIFDTLXTDDSS

SEQ ID NO: 9648 - protein, 231 aa, Homo sapiens
  SITE (146): Xaa equals any amino acid
  SITE (177): Xaa equals any amino acid
  SITE (193): Xaa equals any amino acid
  SITE (199): Xaa equals any amino acid
  SITE (208): Xaa equals any amino acid
  SITE (222): Xaa equals any amino acid
  SITE (231): Xaa equals any amino acid
MALSSLIVILLVVFALVLHGQNKKYKNCSTGKGISTMEESVTLDNGGFAALELSSRHLNVKSTFSKKNGTRSPPRPSPGGLHYSDEDICNKYNGAVLTESVSLKEKSADASESEATDSDYEDALPKHSFVNHYMSDPTYYNSWKRXAQGPRTCAAQVRGGGGLRGGRAAAPGHHHAXRGRRLHPRWPRRANFXYRLLLXRVSKSAALXQGGTEATFRSLFLXRQFNSNKLX

SEQ ID NO: 9649 - protein, 127 aa, Homo sapiens
EGFFKRLFVTSLQEAGLFLFLFFLREGVFHWCNGLAPPGPGRTSDLPSPGFLRLQDQLGRVKRGEGVEGQVRSQSCPGRPPSLSTSSSREPAAHTLLNAGHPRRLLGFEEQTFFPGLSAFCPNFICF

SEQ ID NO: 9650 - protein, 273 aa, Homo sapiens
  SITE (200): Xaa equals any amino acid
MRLPGVPLARPALLLLLPLLAPLLGTGAPAELRVRVRLPDGQVTEESLQADSDADSISLELRKPDGTLVSFTADFKKDVKVFRALILGELEKGQSQFQALCFVTQLQHNEIIPSEAMAKLRQKNPRAVRQAEEVRGLEHLHMDVAVNFSQGALLSPHLHNVCAEAVDAIYTRQEDVRFWLEQGVDSSVFEALPKASEQAXLPRCRQVGDRGKPCVCHYGLSLAWYPCMLKYCHSRDRPTPYKCGIRSCQKSYSFDFYVPQRQLCLWDEDPYPG

SEQ ID NO: 9651 - protein, 26 aa, Homo sapiens
MFSLPQYLKLVLSILVVSTLFSLPFS

SEQ ID NO: 9652 - protein, 128 aa, Homo sapiens
  SITE (47): Xaa equals any amino acid
  SITE (90): Xaa equals any amino acid
MRLESLCHLCLACLFFRLPATRTVYCMNEAEIVDVALGILIESRKQXKACEQPALAGADNPEHSPPCSVSPHTSSGSSSEEEDSGKQALXPGLSPSQRPGGSSSACSRSPEEEEEEDVLKYVREIFFS

SEQ ID NO: 9653 - protein, 59 aa, Homo sapiens; identical to SEQ ID NO: 6614

SEQ ID NO: 9654 - protein, 26 aa, Homo sapiens
MLRWHLWSWFCWFCLSEAGVLLDLPT

SEQ ID NO: 9655 - protein, 84 aa, Homo sapiens
  SITE (1): Xaa equals any amino acid
  SITE (25): Xaa equals any amino acid
  SITE (42): Xaa equals any amino acid
  SITE (64): Xaa equals any amino acid
  SITE (79): Xaa equals any amino acid
XMSRQHRLNPHGPDPAAPHRACRLXSPRQVTWLTPAEALPLXPCPSQCGAHCRQHGPEREGSAXPAALLRPGLPVFGHXLRLSQ

SEQ ID NO: 9656 - protein, 80 aa, Homo sapiens [sequence omitted]

SEQ ID NO: 9657 - protein, 73 aa, Homo sapiens
  SITE (38): Xaa equals any amino acid
HFSFWFIHFPHFHLKILTKCLAEFSKYNNFTLPADNEXIRVQNPFQLSKHLLSLYFVSDTGVKFWKCKRNLHL

SEQ ID NO: 9658 - protein, 69 aa, Homo sapiens; identical to SEQ ID NO: 6626

SEQ ID NO: 9659 - protein, 24 aa, Homo sapiens
MWHLWRRLLSCFPVAMLQDYKYSV

SEQ ID NO: 9660 - protein, 20 aa, Homo sapiens
SCLPVGTDPQQMQKHLVVIK

SEQ ID NO: 9661 - protein, 175 aa, Homo sapiens
  SITE (91): Xaa equals any amino acid
  SITE (173): Xaa equals any amino acid
  SITE (174): Xaa equals any amino acid
  SITE (175): Xaa equals any amino acid
VFGMLLGDTIILDNLDAANHYRKEVVKITHCPTLLTRDGDRIRSNGKFGGLQNKAPPMDKLRGMVFGAPVPKQCLILGEQIDLLQQYRSAXCKLDSVNKDLNSQLEYLRTPDMRKKKQELDEHEKNLKLIEEKLGMTPIRKCNDSLRHSPKVETTDCPVPPKRMRREAGDKRXXX

SEQ ID NO: 9662 - protein, 156 aa, Homo sapiens
  SITE (102): Xaa equals any amino acid
VVKITHCPTLLTRDGDRIRSNGKFGGLQNKAPPMDKLRGMVFGAPVPKQCLILGEQIDLLQQYRSAVCKLDSVNKDLNSQLEYLRTPDMRKKKQELDEHEKXLKLIEEKLGMTPIRKCNDSLRHSPKVETTDCPVPPKRMRREATRQNRIITKTDV

SEQ ID NO: 9663 - protein, 25 aa, Homo sapiens
MLLFLFVCLPITWMAEFLSQLRHLL

SEQ ID NO: 9664 - protein, 248 aa, Homo sapiens [sequence omitted]

SEQ ID NO: 9665 - protein, 31 aa, Homo sapiens
MAVGEAVFVPLQHPPLLHGSPIPKLLPGPLL

SEQ ID NO: 9666 - protein, 58 aa, Homo sapiens; identical to SEQ ID NO: 6649

SEQ ID NO: 9667 - protein, 41 aa, Homo sapiens
  SITE (16): Xaa equals any amino acid
QTVSAFLPPLFYVTFXLGKINYTKYHIIPSYKLLPENKSCV

SEQ ID NO: 9668 - protein, 7 aa, Homo sapiens
IFTCVLY

SEQ ID NO: 9669 - protein, 1 aa, Homo sapiens
I

SEQ ID NO: 9670 - protein, 2 aa, Homo sapiens
GR

SEQ ID NO: 9671 - protein, 125 aa, Homo sapiens
MAFNGIIHALASPLLAPPQPQAVLAPEAPPVAAGVGAVLAAGALLGLVAGALYLRARGKPMGFGFSAFQAEDDADDDFSPWQEGTNPTLVSVPNPVFGSDTFCEPFDDSLLEEDFPDTQRILTVK

SEQ ID NO: 9672 - protein, 264 aa, Homo sapiens
MHNPDGSASPTADPGSELQTLGQAARRPPPPRAGHDAPRRTRPSARKPLSCFSRRPMPTREPPKTRGSRGHLHTHPPGPGPPLQGLAPRGLKTSAPRPPCQPQPGPHKAKTKKIVFEDELLSQALLGAKKPIGAIPKGHKPRPHPVPDYELKYPPVSSERERSRYVAVFQDQYGEFLELQHEVGCAQAKLRQLEALLSSLPPPQSQKEAQVAARVWREFEMKRMDPGFLDKQARCHYLKGKLRHLKTQIQKFDDQGDSEGSVYF

SEQ ID NO: 9673 - protein, 58 aa, Homo sapiens
MHGDAGPLHFLVSLSFSSCSSPYQGSLSPGLQMPLQFGLSSDSPSSRKAFQDFLLWVL

SEQ ID NO: 9674 - protein, 99 aa, Homo sapiens; identical to SEQ ID NO: 6664

SEQ ID NO: 9675 - protein, 110 aa, Homo sapiens
  SITE (8): Xaa equals any amino acid
MRLSCPRXPGWMGPFFPYSLLSFFPCSFSSPSFIFLLLILKTGCSLFPCCPISPLCPYFSQSLSPLKSRAGRCYWCFFTLGPSSIFVFSVYPLPDTSFSPSLGPKAENQC

SEQ ID NO: 9676 - protein, 76 aa, Homo sapiens
  SITE (11): Xaa equals any amino acid
MGPFFPYSLLXFFPCSFSSPSFIFLLLILKTGCSLFPCCPISPLCPYFSQSLSPLKSRAGRCYWCFFTLGPSSYLL

SEQ ID NO: 9677 - protein, 61 aa, Homo sapiens
TLTQHQGAHLGPFLDMSFLHYHSHEPPTSGIADQGWGENVACCFLVLVIIYLNKQCCKYLP

SEQ ID NO: 9678 - protein, 33 aa, Homo sapiens
MLVLVSGIIFSLADRSSSSTIRMDALAFLQGLL

SEQ ID NO: 9679 - protein, 75 aa, Homo sapiens
  SITE (23): Xaa equals any amino acid
  SITE (36): Xaa equals any amino acid
  SITE (44): Xaa equals any amino acid
MASYKTLKMLFSCLLTCSVSNEXYAVIFNFFPLYIXFLSDCFKXFSLSLVLSNLIIIYLGVIFFIFFVLDIHRSS

SEQ ID NO: 9680 - protein, 72 aa, Homo sapiens
  SITE (1): Xaa equals any amino acid
  SITE (10): Xaa equals any amino acid
  SITE (11): Xaa equals any amino acid
XYTFVNSRSXXLIDFLCVIMGHLFLVHFMPDILKFKTKYCEFYLVLCWIFFVFLSTIMSFLLGCSYSHWKQF

SEQ ID NO: 9681 - protein, 43 aa, Homo sapiens; identical to SEQ ID NO: 6671

SEQ ID NO: 9682 - protein, 79 aa, Homo sapiens
  SITE (34): Xaa equals any amino acid
LGIWLIPGLRRANPKISLEYLMVPENKYSKNCEXMLKGLRSQPEGAANGQSWNNSNKVNKYSIGLLLNKCMIHESTLKD

SEQ ID NO: 9683 - protein, 53 aa, Homo sapiens; identical to SEQ ID NO: 6673

SEQ ID NO: 9684 - protein, 53 aa, Homo sapiens
  SITE (21): Xaa equals any amino acid
KQGSLLGWSRVIMVRGAQSYXKGVLCRHWKKFGFYSKWNWKPLECFQNRSDVI

SEQ ID NO: 9685 - protein, 118 aa, Homo sapiens [sequence omitted]

SEQ ID NO: 9686 - protein, 43 aa, Homo sapiens
  SITE (13): Xaa equals any amino acid
MLYVRLLKNTKIXVLILPLFILFLTLFLFIPNGFLFVFVSLYF

SEQ ID NO: 9687 - protein, 111 aa, Homo sapiens
  SITE (45): Xaa equals any amino acid
  SITE (99): Xaa equals any amino acid
  SITE (104): Xaa equals any amino acid
  SITE (108): Xaa equals any amino acid
  SITE (109): Xaa equals any amino acid
  SITE (111): Xaa equals any amino acid
VQVLTQYYQSNILNILSQVICLSIVYFEGFLSFTFNLFFISISSXVALSYSYPDIHLISEGLDITLVKMQSDLILFLKQTAVLLERPRAHRFSTRVGYXVSVHXSGSXXVX

SEQ ID NO: 9688 - protein, 76 aa, Homo sapiens
MLVLLSLLASGGLPLLLVGDVLASKSSTVLFLPGDSSPGCSMITPLPPSRMCLKAGSSGEQTVVPLSLLLRSKSSK

SEQ ID NO: 9689 - protein, 42 aa, Homo sapiens
  SITE (21): Xaa equals any amino acid
  SITE (23): Xaa equals any amino acid
  SITE (42): Xaa equals any amino acid
HSPESCYSFNLGSRMRISVEXKXAKSNSAADNPETLRKGYVX

SEQ ID NO: 9690 - protein, 64 aa, Homo sapiens
  SITE (55): Xaa equals any amino acid
  SITE (59): Xaa equals any amino acid
  SITE (63): Xaa equals any amino acid
SIKSCSSFYLGSRVNRAQLTNYPPAMRTYVYECHCDKSTSRATAGPSIFHPGGVXGMWXIFAXV

SEQ ID NO: 9691 - protein, 11 aa, Homo sapiens
MWRWLSSFWLL

SEQ ID NO: 9692 - protein, 11 aa, Homo sapiens
MWRWLSSFWLL

SEQ ID NO: 9693 - protein, 77 aa, Homo sapiens; identical to SEQ ID NO: 6677

SEQ ID NO: 9694 - protein, 63 aa, Homo sapiens
ENKRLHFGEASTLSGLLFCFMSWCLGEDLAGFIQSGRVWAILENVPSISENKSAPSTCLHPGD

SEQ ID NO: 9695 - protein, 29 aa, Homo sapiens
MHLVGGTLLVLAPRGAVLPLSSQSMPFLQ

SEQ ID NO: 9696 - protein, 70 aa, Homo sapiens
  SITE (2): Xaa equals any amino acid
  SITE (3): Xaa equals any amino acid
MXXHESILLVSLDLLPTSILLVSLWICSPPPSSWVNPGSFVGYLERKRQKLICQMTRTNRLFGMKRKTSG

SEQ ID NO: 9697 - protein, 53 aa, Homo sapiens
  SITE (47): Xaa equals any amino acid
SLALNSPPPGLRVPREERLLATSLLQGALPAGPCPSTTLLSWHRPAXPPGAQG

SEQ ID NO: 9698 - protein, 13 aa, Homo sapiens
PPRASWSPREHVL

SEQ ID NO: 9699 - protein, 56 aa, Homo sapiens
MKTVSLLLTLWFSQTFSFNLFFAPPHSLLQSSIFFSVSSITTVHPILVFFFAFFRT

SEQ ID NO: 9700 - protein, 54 aa, Homo sapiens
  SITE (34): Xaa equals any amino acid
  SITE (35): Xaa equals any amino acid
  SITE (46): Xaa equals any amino acid
MKTVSLLLTLWFSQTFSFNLFFAPPHSLLQSSIXXSVSSITTVHPXLGLLFCIL

SEQ ID NO: 9701 - protein, 37 aa, Homo sapiens
ILLGLWQSVLGSSIWGQPLSYNCQEPHNCLFNHSDFK

SEQ ID NO: 9702 - protein, 85 aa, Homo sapiens
GIGSRVRAAFIALEPSLGMGFSKNWQAHRLPSKWVRTAYPSIETHYLFYLFLSGSGARCSYFSHLRWDILGQTREILEAISVVNP

SEQ ID NO: 9703 - protein, 98 aa, Homo sapiens
  SITE (72): Xaa equals any amino acid
MPLQRRVKVKTTSSRCLPGTTWGLTLFSMLCCFWPLGIAAFYFSQGTSKAISKGDFRLASTTSRRALFLATXAIAVGAGLYVAVVVALAAYMSQNGHG

SEQ ID NO: 9704 - protein, 78 aa, Homo sapiens
RHLQVGGGQHQCGQACLDSSYRPLLCMMWEPGHSHAPSRAQGCGSTTEHPLSHCPPLPRALPSPPLLHHSSFKVPLLY

SEQ ID NO: 9705 - protein, 103 aa, Homo sapiens
MDPAAVALLALSLPCALVGVQWEQAPWGPWRLSLLSPHPRDPIVAPVSTQGLSQAWPEVGRGQREPHRSLYQPLSYHRVGALPSHRVSGLWAPPSCTGPRGHF

SEQ ID NO: 9706 - protein, 70 aa, Homo sapiens
  SITE (29): Xaa equals any amino acid
  SITE (34): Xaa equals any amino acid
  SITE (37): Xaa equals any amino acid
MDPAAVALLALSLPCALVGVQWEQAPWGXWRLSXSAXTPETPSWRLCPLRDYPKPGQRSGGDRGSHIRSL

SEQ ID NO: 9707 - protein, 194 aa, Homo sapiens
  SITE (3): Xaa equals any amino acid
  SITE (17): Xaa equals any amino acid
  SITE (33): Xaa equals any amino acid
QWXGQGSLCPWYCCPGXVSAVTLLPSWWLLRPXFVLLFLPKCLSSPSCIKYPCCATNYLELGDFTTTACQRPAVDEGLGGMAGPAQGSLAEVGAEAARHWRLGLSHTPWLLGGCILLSSLSSRGCTLGCRPPVSLTGYSWGSLRSWRCPQPPSPRLPPPHTLRPQRFVRVHEILELPGCSFCNIFNICNPVKYQ

SEQ ID NO: 9708 - protein, 122 aa, Homo sapiens; identical to SEQ ID NO: 6696

SEQ ID NO: 9709 - protein, 122 aa, Homo sapiens; identical to SEQ ID NO: 6696

SEQ ID NO: 9710 - protein, 69 aa, Homo sapiens
MGPGTWETATSGNAVGEGQALGSHPSCLLRIMGCVGRVWWLTSIIPALWEAKVSGSPEVRSSRPAWPTW

SEQ ID NO: 9711 - protein, 81 aa, Homo sapiens; identical to SEQ ID NO: 6702

SEQ ID NO: 9712 - protein, 275 aa, Homo sapiens
  SITE (59): Xaa equals any amino acid
MANFKGHALPGSFFLIIGLCWSVKYPLKYFSHTRKNSPLHYYQRLEIVEAAIRTLFSVXGILAEQFVPDGPHLHLYHENHWIKLMNWQHSTMYLFFAVSGIVDMLTYLVSHVPLGVDRLVMAVAVFMEGFLFYYHVHNRPPLDQHIHSLLLYALFGGCVSISLEVIFRDHIVLELFRTSLIILQGTWFWQIGFVLFPPFGTPEWDQKDDANLMFITMCFCWHYLAALSIVAVNYSLVYCLLTRMKRHGRGEIIGIQKLNSDDTYQTALLSGSDEE

SEQ ID NO: 9713 - protein, 206 aa, Homo sapiens
  SITE (176): Xaa equals any amino acid
  SITE (180): Xaa equals any amino acid
  SITE (188): Xaa equals any amino acid
  SITE (189): Xaa equals any amino acid
  SITE (198): Xaa equals any amino acid
  SITE (200): Xaa equals any amino acid
  SITE (206): Xaa equals any amino acid
MANFKGHALPGSFFLIIGLCWSVKYPLKYFSHTRKNSPLHYYQRLEIVEAAIRTLFSVTVSGIVDMLTYLVSHVPLGVDRLVMAVAVFMEGFLFYYHVHNRPPLDQHIHSLLLYALFGGCVSISLEVIFRDHIVLELFRTSLIILQGTWFWQIGFVLFPPFGTPEWDQKDDANLMXITMXFCCTTWLXXTLWPQLFSXYXLFDSDX

SEQ ID NO: 9714 - protein, 196 aa, Homo sapiens; identical to SEQ ID NO: 6712

SEQ ID NO: 9715 - protein, 53 aa, Homo sapiens
MAAACRSVKGLVAVITGGASGLGLATADDLWGREPLLCFWTCPTRVGRPKPRS

SEQ ID NO: 9716 - protein, 23 aa, Homo sapiens
MLVEKILLIECLSSESQLIGFLL

SEQ ID NO: 9717 - protein, 265 aa, Homo sapiens
  SITE (112): Xaa equals any amino acid
  SITE (113): Xaa equals any amino acid
  SITE (193): Xaa equals any amino acid
  SITE (222): Xaa equals any amino acid
  SITE (238): Xaa equals any amino acid
  SITE (258): Xaa equals any amino acid
MDLLQFLAFLFVLLLSGMGATGTLRTSLDPSLEIYKKMFEVKRREQLLALKNLAQLNDIHQQYKILDVMLKGLFKVLEDSRTVLTAADVLPDGPFPQDEKLKDAFSHVVENXXFFGDVVLRFPKIVHYYFDHNSNWNLLIRWGISFCNQTGVFNQGPHSPILSLMAQELGISEKDSNFQNPFKIDRTEFIPSXDPFQKALREEEKRRKKEEKRKEIRKGPKXLPDSHLELLGPWSSFXVQGATRRQVREGRRGWSFGXWLEEAPF

SEQ ID NO: 9718 - protein, 82 aa, Homo sapiens [sequence omitted]

SEQ ID NO: 9719 - protein, 253 aa, Homo sapiens
  SITE (215): Xaa equals any amino acid
  SITE (252): Xaa equals any amino acid
  SITE (253): Xaa equals any amino acid
MQACVLLLGLVLSAQLQSPENMRMGGGRVLLRAHPVPAGGGQCQSSAKGPWVGTGPEREERDSPEGRWASYWAQSWEGVAASTGWAWTPLAPTPSGCGCSLSLESRTGPGCLGGCQVPPELPRAPTCKCQPQGSAQMRPSQLQPAMPWDAHREGGGFGLLSPWERLGAVTARLAQAHCRVGWLPQPGLGGTPGSGPPCLESQWGDGEETWPPMAXGQLRTRTCWSWKCCGVEGWGGQLLTPASCLLLSTFPXX

SEQ ID NO: 9720 - protein, 102 aa, Homo sapiens
NSEKGQKKQRGPRWICQLFCRCFLPLLWVVCSPLQTSARREGLNLPAPQDLLPSGPSPALRSLPDRRVDRATWAARETHGGPPCGQPCQLPPSPELHLHLEE

SEQ ID NO: 9721 - protein, 143 aa, Homo sapiens
MKWERGSPMVLLALVYDVCCASRRGGQSHPTSGSDVLPLPVPALAQPAQPSRLDACAKARGSQRAAGWPRAGSRLGPAVGRAASPSSLQTHGSSSQSSRQLPGPEMSSSPPWGQALPWPSSVNPSFLCAVSGLLTVVCVCARL

SEQ ID NO: 9722 - protein, 63 aa, Homo sapiens
MGAPAASLLLLLLLFACCWAPGGANLSQDDSQPWTSDETVVAGGTVVLKCQVKDHEDSSLQWS

SEQ ID NO: 9723 - protein, 296 aa, Homo sapiens
MFSLSWQLSLVTFMGFPIIMMVSNIYGKYYKRLSKEVQNALARASNTAEETISAMKTVRSFANEEEEAEVYLRKLQQVYKLNRKEAAAYMYYVWGSGLTLLVVQVSILYYGGHLVISGQMTSGNLIAFIIYEFVLGDCMENVSFSLSPGKVTALVGPSGSGKSSCVNILENFYPLEGGRVLLDGKPISAYDHKYLHRVISLVSQEPVLFARSITDNISYGLPTVPFEMVVEAAQKANAHGFIMELQDGYSTETGEKGAQLSGGQKQRVAWPGLWCGTPQSSSWMKPPALWMPRASI

SEQ ID NO: 9724 - protein, 73 aa, Homo sapiens
FSSSMSLSFLPFLPFLSPCSETAAGSYLSRPTPFPMVAVLSAGAGSCRWRIREKSTEQLPAERAGPGEPSGGS

SEQ ID NO: 9725 - protein, 219 aa, Homo sapiens
VTILCIDLGTDMVPAISLAYEQAESDIMKRQPRNPKTDKLVNERLISMAYGQIGMIQALGGFFTYFVILAENGFLPIHLLGLRVDWDDRWINDVEDSYGQQWTYEQRKIVEFTCHTAFFVSIVVVQWADLVICKTRRNSVFQQGMKNKILIFGLFEETALAAFLSYCPGMGVALRMYPLKPTWWFCAFPYSLLIFVYDEVRKLIIRRRPGGWVEKETYY

SEQ ID NO: 9726 - protein, 108 aa, Homo sapiens
  SITE (19): Xaa equals any amino acid
  SITE (21): Xaa equals any amino acid
  SITE (29): Xaa equals any amino acid
  SITE (87): Xaa equals any amino acid
MFSLSWQLSLVTFMGFPIXMXVSNIYGKXYKRLSKEVQNALARASNTAEETISAMKTVRSFANEEEEAEVYLRKLQQVYKLNRKEAXAYMYYVWGSGLTLLVVQVSIL

SEQ ID NO: 9727 - protein, 45 aa, Homo sapiens
MLSASIWLVLIISRGNARQKVKLCFLLMLLATWKRRRGRGKRGRS

SEQ ID NO: 9728 - protein, 201 aa, Homo sapiens; identical to SEQ ID NO: 6730

SEQ ID NO: 9729 - protein, 201 aa, Homo sapiens; identical to SEQ ID NO: 6730

SEQ ID NO: 9730 - protein, 12 aa, Homo sapiens
MGSSLAFILFLP

SEQ ID NO: 9731 - protein, 144 aa, Homo sapiens
  SITE (138): Xaa equals any amino acid
MVTLAELLVLLAALLATVSGYFVSIDAHAEECFFERVTSGTKMGLIFEVAEGGFLDIDVEVRASCPQLRLGRVATRGLVAPGTGAGPVWGVGLEVAVRVLEKPRPPPPAPPRPRRPPNGPFSRDLPGFRDPLGAPSAXLVALGF

SEQ ID NO: 9732 - protein, 136 aa, Homo sapiens; identical to SEQ ID NO: 6731

SEQ ID NO: 9733 - protein, 81 aa, Homo sapiens
MVVAGVVVLILALVLAWLSTYVADSGSNQLLGAIVSAGDTSVLHLGHVDHLVAGQGNPEPTELPHPSEDKQVQAAAVQRPP

SEQ ID NO: 9734 - protein, 13 aa, Homo sapiens
MGQGACKNMSVGS

SEQ ID NO: 9735 - protein, 259 aa, Homo sapiens
  SITE (62): Xaa equals any amino acid
AGAWVSLGPCLFPAPADSEQRPWVRRVGVGPLPAEPGQGELQESPLCPCSWNVPQRPHLKGXCAGGVAQSHTASTLSSGTGDSGCSGKGLLDVTYNSVRLETDAGGGRAGPPGITDHRKMGGGSRGPAPTPSCLTLLSCPHPCAFVPETRVATQAGPGSSLILPLPSEPCSSLPSPLPPLPRRVTSDRAPLAIQGGSRGLDRRARRLPAVAGASCPCRVGELSGREPYLPSAKTVKVYRLFTDFYLNCKSADFVNVLGV

SEQ ID NO: 9736 - protein, 102 aa, Homo sapiens; identical to SEQ ID NO: 9720

SEQ ID NO: 9737 - protein, 35 aa, Homo sapiens
KFKQVIKSFYKIHLAKEILSMNIKLRKVLYVFLVN

SEQ ID NO: 9738 - protein, 54 aa, Homo sapiens
  SITE (47): Xaa equals any amino acid
  SITE (51): Xaa equals any amino acid
MSIVMSPLLLPICYLNLLLFFVNLAKNLSILFVSSKKYTFVFMISLXFFHXYFI

SEQ ID NO: 9739 - protein, 99 aa, Homo sapiens [sequence omitted]

SEQ ID NO: 9740 - protein, 99 aa, Homo sapiens [sequence omitted]

SEQ ID NO: 9741 - protein, 291 aa, Homo sapiens
MAVTLSLLLGGRVCAAVTRCGFATRGVAGPGPIGREPDPDSDWEPEERELQEVESTLKRQKQAIRFQKIRRQMEAPGAPPRTLTWEAMEQIRYLHEEFPESWSVPRLAEGFDVSTDVIRRVLKSKFLPTLEQKLKQDQKVLKKAGLAHSLQHLRGSGNTSKLLPAGHSVSGSLLMPGHEASSKDPNHSTALKVIESDTHRTNTPRRRKGRNKEIQDLEESFVPVAAPLGHPRELQKYSSDSESPRGTGSGALPSGQKLEELKAEEPDNFSSKVVQRGREFFDSNGNFLYRI

SEQ ID NO: 9742 - protein, 56 aa, Homo sapiens
MAVTLSLLLGGRVCAPSLAVGSRPGGWRAQALLAGSRTPIPTGSRRNGSCRRWRAP

SEQ ID NO: 9743 - protein, 57 aa, Homo sapiens; identical to SEQ ID NO: 6742

SEQ ID NO: 9744 - protein, 55 aa, Homo sapiens
MLHWGVLCSLFLMLFNEGASASLSNKRSMREDRAVHGYGYWTRIFGKVKADHWIW

SEQ ID NO: 9745 - protein, 45 aa, Homo sapiens
MPALVLLPRVLPPGQGEVQRVRCPYVGNSSGRKIWFGFILRAIKH

SEQ ID NO: 9746 - protein, 39 aa, Homo sapiens
MEAKFGLLCFLVSTPWAELLSLLLHLTQVPFPGSQGPGF

SEQ ID NO: 9747 - protein, 46 aa, Homo sapiens
MCCASHPCQREGWLCVIFTVFLKVTVCVFTFVQITGSKAANSAITC

SEQ ID NO: 9748 - protein, 108 aa, Homo sapiens
MAILLACFTAVLAFICLQFWCVRCHEPRWSYRAGHMEEANGLVRWPEEAPDLGQREEDLQGLPLVEMPRKNSRDGAELDPEANQDAPDAGALQRGGGDPPAILPHCGE

SEQ ID NO: 9749 - protein, 100 aa, Homo sapiens
  SITE (20): Xaa equals any amino acid
  SITE (37): Xaa equals any amino acid
MLPSAWGPLQVASFFLLSFXFCFLSSSPHLGRQETHXVVLEDDEGAPCPAEDELALQDNGFLSKNEVLRTRCLGSRSGSASATPPTTSGTARAARPPSQC

SEQ ID NO: 9750 - protein, 21 aa, Homo sapiens
MKNSFFTVSWALTCSFSWATV

SEQ ID NO: 9751 - protein, 199 aa, Homo sapiens
  SITE (2): Xaa equals any amino acid
  SITE (6): Xaa equals any amino acid
  SITE (14): Xaa equals any amino acid
  SITE (34): Xaa equals any amino acid
  SITE (51): Xaa equals any amino acid
QXKPPXPAAPAAPXAPAPLEKPIRSHEATGGGEXACGVTGASTPEGTAPPXPAAPAPPKGEKEGQRPTQPVYQIQNRGMGTAAPAAMDRELGLGSTRLGTGVSSQILTASSVSCFLQSPAVVGQAKLLPPERMKHSIKLVDDQMNWCDSAIEVPRGPALPELPHILHPLIFHLSVGNTRLEGFEATYSSERGWYQNILT

SEQ ID NO: 9752 - protein, 78 aa, Homo sapiens
DPQNIYWEHLSIRGFIWWLRCLVINVVLFILLFFLTTPAIIITTMDKFNVTKPVEYLNVRPHAPVTFHAGSQHTDTRP

SEQ ID NO: 9753 - protein, 21 aa, Homo sapiens
HLSLPRLLWTLQIPQCPQLQD

SEQ ID NO: 9754 - protein, 36 aa, Homo sapiens
  SITE (8): Xaa equals any amino acid
  SITE (12): Xaa equals any amino acid
  SITE (16): Xaa equals any amino acid
  SITE (18): Xaa equals any amino acid
  SITE (19): Xaa equals any amino acid
  SITE (23): Xaa equals any amino acid
WRHLTVSXGLQXRLSXRXXWEGXPRSTTAAGWGRTG

SEQ ID NO: 9755 - protein, 550 aa, Homo sapiens
MKRASAGGSRLLAWVLWLQAWQVAAPCPGACVCYNEPKVTTSCPQQGLQAVPVGIPAASQRIFLHGNRISHVPAASFRACRNLTILWLHSNVLARIDAAAFTGLALLEQLDLSDNAQLRSVDPATFHGLGRLHTLHLDRCGLQELGPGLFRGLAALQYLYLQDNALQALPDDTFRDLGNLTHLFLHGNRISSVPERAFRGLHSLDRLLLHQNRVAHVHPHAFRDLGRLMTLYLFANNLSALPTEALAPLRALQYLRLNDNPWVCDCRARPLWAWLQKFRGSSSEVPCSLPQRLAGRDLKRLAANDLQGCAVATGPYHPIWTGRATDEEPLGLPKCCQPDAADKASVLEPGRPASAGNALKGRVPPGDSPPGNGFWPKGTLMTYPFGTLPGLAEPPVSALRPEGSEPPGSPLRALRRRPGCSRKNRTRSHAVWARQAAGVAGLVTQKAQVPYPASPAASPPWAWRWCCGQCLGPADPQRTQERAQQPGVCTYGVSLHAAKPAGRPTRGAGQARSSLMDACRPPPPSPPHHVYRVRRQRLFQNAASHPDRGI

SEQ ID NO: 9756 - protein, 380 aa, Homo sapiens
MKRASAGGSRLLAWVLWLQAWQVAAPCPGACVCYNEPKVTTSCPQQGLQAVPVGIPAASQRIFLHGNRISHVPAASFRACRNLTILWLHSNVLARIDAAAFTGLALLEQLDLSDNAQLRSVDPATFHGLGRLHTVHLDRCGLQELGPGLFRGLAALQYLYLQDNALQALPDDTFRDLGNLTHLFLHGNRISSVPERAFRGLHSLDRLLLHQNRVAHVHPHAFRDLGRLMTLYLFANNLSALPTEALAPLRALQYLRLNDNPWVCDCRARPLWAWLQKFRGSSSEVPCSLPQRLAGRDLKRLAANDLQGCAVATGPYHPIWTGRATDEEPLGLPKCCQPDAADKASVLEPGRPASAGNALKGPRAGRGQARRETVFGPREH

SEQ ID NO: 9757 - protein, 104 aa, Homo sapiens
  SITE (89): Xaa equals any amino acid
MPTSSYRSVWPLTLLALKSTACALAFTRMPGFQTPSEFLENPSQSSRLTAPFRKHVRPKKQHEIRRLGELVKKPSDFTGCTQVVDVGSXQGHLSRFMALGLGLM

SEQ ID NO: 9758 - protein, 205 aa, Homo sapiens
  SITE (80): Xaa equals any amino acid
  SITE (93): Xaa equals any amino acid
MLGAKPHWLPGPLHSPGLPLVLVLLALGAGWAQEGSEPVLLEGECLVVCEPGRAAAGGPGGAALGEAPPGRVAFAAVRSXHHEPAGETGNGTXGAIYFDQVLVNEGGGFDRASGSFVAPVRGVYSFRFHVVKVYNRQTVQVSLMLNTWPVISAFANDPDVTREAATSSVLLPLDPGDRVSLRLRRGNLLGGWKYSSFSGFLIFPL

SEQ ID NO: 9759 - protein, 322 aa, Homo sapiens
  SITE (131): Xaa equals any amino acid
  SITE (185): Xaa equals any amino acid
  SITE (218): Xaa equals any amino acid
  SITE (220): Xaa equals any amino acid
  SITE (250): Xaa equals any amino acid
  SITE (312): Xaa equals any amino acid
MALPPGPAALRHTLLLLPALLSSGWGELEPQIDGQTWAERALRENERHAFTCRVAGGPGTPRLAWYLDGQLQEASTSRLLSVGGEAFSGGTSTFTVTAHRAQHELNCSLQDPRSGRSANASVILNVQFKPXIAQVGAKYQEAQGPGLLVVLFALVRANPPANVTWIDQDGPVTVNTSDFLVLDAXNYPWLTNHTVQLQLRSLAHNLSVVATNDVGVTXAXLPAPGPSRHPSLISSDSNNLKLNNVRLPRXNMSLPSNLQLNDLTPDSRAVKPADRQMAQNNSRPELLDPEPGGLLTSQGFIRLPVLGYIYRXSSVSSDEIWL

SEQ ID NO: 9760 - protein, 20 aa, Homo sapiens
LLMRQPWVGQGWGPVVEETC

SEQ ID NO: 9761 - protein, 23 aa, Homo sapiens
AWIQCTLLLYPRRTSQGIHQVPG

SEQ ID NO: 9762 - protein, 153 aa, Homo sapiens
  SITE (111): Xaa equals any amino acid
  SITE (124): Xaa equals any amino acid
  SITE (125): Xaa equals any amino acid
  SITE (135): Xaa equals any amino acid
  SITE (144): Xaa equals any amino acid
MVAPVWYLVAAALLVGFILFLTRSRGRAASAGQEPLHNEELAGAGRVAQPGPLEPEEPRAGGRPRRRRDLGSRLQAQRRAQRVAWAEADENEEEAVILAQEEEGVEKPAEXHLSGKIGAKKLRXXEEKQARKAQXEAEEAEREXRKRLESQRE

SEQ ID NO: 9763 - protein, 489 aa, Homo sapiens
  SITE (79): Xaa equals any amino acid
  SITE (321): Xaa equals any amino acid
MPQASEHRLGRTREPPVNIQPRVGSKLPFAPRARSKERRNPASGPNPMLRPLPPRPGLPDERLKKLELGRGRTSGPRPXGPLRADHGVPLPGSPPPTVALPLPSRTNLARSKSVSSGDLRPMGIALGGHRGTGELGAALSRLALRPEPPTLRRSTSLRRLGGFPGPPTLFSIRTEPPASHGSFHMISARSSEPFYSDDKMAHHTLLLGSGHVGLRNLGNTCFLNAVLQCLSSTRPLRDFCLRRDFRQEVPGGGRAQELTEAFADVIGALWHPDSCEAVNPTRFRAVFQKYVPSFSGYSQQDAQEFLKLLMERLHLEINRRXRRAPPILANGPVPSPPRRGGALLEEPELSDDDRANLMWKRYLEREDSKIVDLFVGQLKSCLKCQACGYRSTTFEVFCDLSLPIPKKGFAGGKVSLRDCFNLFTKEEELESENAPVCDRCRQKTRSTKKLTVQRFPRILVLHLNRFSASRGSIKKSSVGVDFSTAATEP

SEQ ID NO: 9764 - protein, 44 aa, Homo sapiens
MMKMVLGLFFLMNLLSGKKSVRHHSKNYVKKMQTFQFPRVYKLM

SEQ ID NO: 9765 - protein, 8 aa, Homo sapiens
MHVYLNYK

SEQ ID NO: 9766 - protein, 102 aa, Homo sapiens
  SITE (78): Xaa equals any amino acid
  SITE (80): Xaa equals any amino acid
  SITE (81): Xaa equals any amino acid
  SITE (82): Xaa equals any amino acid
MAPRALPGSAVLAAAVFVGGAVSSPLVAPDNGSSRTLHSRTETTPSPSNDTGNGHPEYIAYALVPVFFIMGLFGVLIXPXXXKKKGYRCTTEAEQDIEEEKG

SEQ ID NO: 9767 - protein, 106 aa, Homo sapiens; identical to SEQ ID NO: 6803

SEQ ID NO: 9768 - protein, 10 aa, Homo sapiens
MVESNLPGPA

SEQ ID NO: 9769 - protein, 314 aa, Homo sapiens
MPHAFKPGDLVFAKMKGYPHWPARIDDIADGAVKPPPNKYPIFFFGTHETAFLGPKDLFPYDKCKDKYGKPNKRKGFNEGLWEIQNNPHASYSAPPPVSSSDSEAPEANPADGSDADEDDEDRGVMAVTAVTATAASDRMESDSDSDKSSDNSGLKRKTPALKMSVSKRARKASSDLDQASVSPSEEENSESSSESEKTSDQDFTPEKKAAVRAPRRGPLGGRKKKKAPSASDSDSKADSDGAKPEPVAMARSASSSSSSSSSSDSDVSVKKPPRGRKPTEKPLPKPRGRKPKPERPPSSSSSDSDSDEVDRIT

SEQ ID NO: 9770 - protein, 64 aa, Homo sapiens; identical to SEQ ID NO: 6811

SEQ ID NO: 9771 - protein, 95 aa, Homo sapiens
MTLALAYLLALPQVLDANRCFEKQSPSALSLQLAAYYYSLQIYARLAPCFRDKCHPLYRELITYVSRMYSKWQAALGFPVFDKVASPGISWRTVV

SEQ ID NO: 9772 - protein, 137 aa, Homo sapiens
  SITE (52): Xaa equals any amino acid
  SITE (117): Xaa equals any amino acid
  SITE (133): Xaa equals any amino acid
  SITE (137): Xaa equals any amino acid
MVEEPGRFLPLWLHILLITVLLVLSGIFSGLNLGLMALDPMELRIVQNCGTXKERRYARKIEPIRRKGNYLLCSLLLGNVLVNTSLTILLDNLIGSGLMAVASFTIGICHLWGDPTXGPCAPRHGAWLVGCQXPCFX

SEQ ID NO: 9773 - protein, 157 aa, Homo sapiens
  SITE (90): Xaa equals any amino acid
LKPFSQTPYFESPSFSPSWGWRQEDMWEATEAGSLCPLLCGWQGSPGLIHPLMEPQERRAPPKGMQLAAPLSHTCDPSVRGHPALAEVSXTVLRALPSCEFLPWRLFPGAESGPAAKLQASQGWGGCGTKVHVGPSTGCSRSWVPRAWQVKLCRPSA

SEQ ID NO: 9774 - protein, 42 aa, Homo sapiens
MGLPRGSFFWLLLLLTAACSGLLFALYFSAVQRYPGPAAGAR

SEQ ID NO: 9775 - protein, 335 aa, Homo sapiens
MRGPSWSRPRPLLLLLLLLSPWPVWAQVSATASPSGSLGAPDCPEVCTCVPGGLASCSALSLPAVPPGLSLRLRALLLDHNRVRALPPGAFAGAGALQRLDLRENGLHSVHVRAFWGLGALQLLDLSANQLEALAPGTFAPLRALRNLSLAGNRLARLEPAALGALPLLRSLSLQDNELAALAPGLLGRLPALDALHLRGNPWGCGCALRPLCAWLRRHPLPASEAETVLCVWPGRLTLSPLTAFSDAAFSHCAQPLALRDLAVVYTLGPASFLVSLASCLALGSGLTACRARRRRLRTAALRPPRPSRPEPRSRPPRLCLARGPGEPRPLPPKP

SEQ ID NO: 9776 - protein, 249 aa, Homo sapiens
MRGPSWSRPRPLLLLLLLLSPWPVWAQVSARASPSGSLGAPDCPEVCTCVPGGLPAVGTLAARRAPGPEPAPARAAAGPQPRPCAAARCLRGSGRATAPGPARERAALGACASLLGPGRAAAAGPERQPAGSTGTRDFRAAARAAQPLIGRQPAGAPGARGARRAPAAALTQPAGQRAGGTRAGAAGPPARSRRAAPARQPLGLRVRAAPALRLAAPAPAARVRGRDGALRVAGTPDAQPPDCLFRRRL

SEQ ID NO: 9777 - protein, 128 aa, Homo sapiens
MLSSPILASGPAWLACSFSHVQWWVCLIAQVQFSAATVSPGRAGTGAAPSVPAVWAAEARGPSVPSTLQGSPVLQRDLANPPPKKKKKKKKKKKKKKKKKKKKKKKKKKKKKKKKKKKKKKKKKKGGP

SEQ ID NO: 9778 - protein, 88 aa, Homo sapiens [sequence omitted]

SEQ ID NO: 9779 - protein, 64 aa, Homo sapiens [sequence omitted]

SEQ ID NO: 9780 - protein, 7 aa, Homo sapiens
MFGCPFC

SEQ ID NO: 9781 - protein, 11 aa, Homo sapiens
FLLSLHLAALQ

SEQ ID NO: 9782 - protein, 261 aa, Homo sapiens
GIFRSLRVLFPLFSVGRPQFARSLSAAPQLSDTADTMGFGDLKSPAGLQVLNDYLADKSYIEGYVPSQADVAVFEAVSSPPPADLCHALRWYNHIKSYEKEKASLPGVKKALGKYGPADVEDTTGSGATDSKDDDDIDLFGSDDEEESEEAKRLREERLAQYESKKAKKPALVAKSSILLDVKPWDDETDMAKLEECVRSIQADGLVWGSSKLVPVGYGIKKLQIQCVVEDDKVGTDMLEEQITAFEDYVQSMDVAAFNKI

SEQ ID NO: 9783 - protein, 44 aa, Homo sapiens; identical to SEQ ID NO: 6822

SEQ ID NO: 9784 - protein, 261 aa, Homo sapiens; identical to SEQ ID NO: 9782

SEQ ID NO: 9785 - protein, 53 aa, Homo sapiens
  SITE (23): Xaa equals any amino acid
FIIHSISPVALNPQAHDLPFSLXSCVSVFNLRSFPTMDSCTTLNETSIFQRRV

SEQ ID NO: 9786 - protein, 79 aa, Homo sapiens
  SITE (42): Xaa equals any amino acid
  SITE (49): Xaa equals any amino acid
  SITE (69): Xaa equals any amino acid
  SITE (76): Xaa equals any amino acid
MLVKGEGVRLVLRLLGRNGLHLAPLPALLLHFLMLPLSAPVXYSLPAGXCLQGTGSSSFYSVKFSGSLXGGKGKPXNWP

SEQ ID NO: 9787 - protein, 86 aa, Homo sapiens
MRLVTAALLLGLMMVVTGDEDENSPCAHEALLDEDTLFCQGLEVFYPELGNIGCKVVPDCNNYRQKITSWMEADSQVPGGRGRRNL

SEQ ID NO: 9788 - protein, 245 aa, Homo sapiens
MAELPGPFLCGALLGFLCLSGLAVEVKVPTEPLSTPLGKTAELTCTYSTSVGDSFALEWSFVQPGKPISESHPILYFTNGHLYPTGSKSKRVSLLQNPPTVGVATLKLTDVHPSDTGTYLCQVNNPPDFYTNGLGLINLTVLVPPSNPLCSQSGQTSVGGSTALRCSSSEGAPKPVYNWVRLGTFPTPSPGSMVQDEVSGQLILTNLSLTSSGTYRCVATNQMGSASCELTLSVTEPSQGRVAEL

SEQ ID NO: 9789 - protein, 61 aa, Homo sapiens; identical to SEQ ID NO: 6832

SEQ ID NO: 9790 - protein, 61 aa, Homo sapiens; identical to SEQ ID NO: 6832

SEQ ID NO: 9791 - protein, 237 aa, Homo sapiens
  SITE (137): Xaa equals any amino acid
  SITE (151): Xaa equals any amino acid
MKGILVAGITAVLVAAVESLSCVQCNSWEKSCVNSIASECPSHANTSCISSSASSSLETPVRLYQNMFCSAENCSEETHITAFTVHVSAEEHFHFVSQCCQGKECSNTSDALDPPLKNVSSNAECPACYESNGTSCXGKPWKCYEEEQCVXLVAELKNDIESKSLVLKGCSNVSNATCQFLSGENKTLGGVIFRKFECANVNSLTPTSAPTTSHNVGSKASLYLLALASLLLRGLLP

SEQ ID NO: 9792 - protein, 14 aa, Homo sapiens
ASSLLVSLQCLLQL

SEQ ID NO: 9793 - protein, 137 aa, Homo sapiens
  SITE (15): Xaa equals any amino acid
  SITE (39): Xaa equals any amino acid
AHCHISRSHCPTLRXKDTCGGWEPTSALGSSTLSHVPHXLLERRDLWRREAEARKQSQPDPAMPPGHTRMPENQRLETLTKLLQSQSQLLRELVLLPAGADSLRAQSHRAELDRKLVQVEEAIKIFSRPKVFVKMDD

SEQ ID NO: 9794 - protein, 82 aa, Homo sapiens; identical to SEQ ID NO: 6837

SEQ ID NO: 9795 - protein, 304 aa, Homo sapiens
  SITE (15): Xaa equals any amino acid
  SITE (30): Xaa equals any amino acid
  SITE (32): Xaa equals any amino acid
  SITE (187): Xaa equals any amino acid
MLQFQRTWKYKGEFXLHQGNAERHFMQVTXVXEISTGKRDNEFSNSGRSIPLKSVFLTQQKVPTIQQVHKFDIYDKLFPQNSVIIEYKRLHAEKESLIGNECEEFNQSTYLSKDIGIPPGEKPYESHDFSKLLSFHSLFTQHQTTHFGKLPHGYDECGDAFSCYSFFTQPQRIHSGEKPYACNDCGXAFSPTSFSVNIKELILGRNLMNVRNVTKLSDRVLTLLNIRGSTLERNRLRAMNVGRPLAVMPSLLNIREFTQVRNHMNVKNVIKPSDRVLTLINIRGFTLERNPMNVISVEKPSADA

SEQ ID NO: 9796 - protein, 46 aa, Homo sapiens
  SITE (21): Xaa equals any amino acid
LINVTNVGIILAVSQPLDDIXEFIIEKRSDYNKYRKENMWLPLNPY

SEQ ID NO: 9797 - protein, 50 aa, Homo sapiens
CYRCIFSIVSNRFIFSNPWISSCIFTISKQSDSIAKRQKCEFFFKLVNTC

SEQ ID NO: 9798 - protein, 71 aa, Homo sapiens
  SITE (43): Xaa equals any amino acid
  SITE (48): Xaa equals any amino acid
VGGFWFGDIQSLKPGGCGQGLHFMKLPSKLRSLGPQDPPNWPXTWCHXAAAARICAFPQVPCLSCVHPGAW

SEQ ID NO: 9799 - protein, 95 aa, Homo sapiens
  SITE (11): Xaa equals any amino acid
  SITE (35): Xaa equals any amino acid
  SITE (38): Xaa equals any amino acid
MFHVLMAQVTXVIITTVSVLVFDFRPSLEFFLEAXSVXLSIFIYNASKPQVPEYAPRQERIRDLSGNLWERSSGDGEELERLTKPKSDESDEDTF

SEQ ID NO: 9800 - protein, 98 aa, Homo sapiens; identical to SEQ ID NO: 6847

SEQ ID NO: 9801 - protein, 193 aa, Homo sapiens
  SITE (140): Xaa equals any amino acid
  SITE (142): Xaa equals any amino acid
  SITE (147): Xaa equals any amino acid
  SITE (155): Xaa equals any amino acid
  SITE (162): Xaa equals any amino acid
MAGPTCRSLLLLKCLAEGRCLVCPSPSVVHCLVSVVFQMTILRDLEKLAGWHRIAIIFILSGITGNLASAIFLPYRAEVGPAGSQFGLLACSSWSSSRAGRCWRGPGRPSSTSRPSCSSWSSVASCPGSTHRPHLRASSXAXLLAFXFLPYITFXHQATSTXSGHLIPGGHLAGPLAGPSLARPFGAWGLGTF

SEQ ID NO: 9802 - protein, 349 aa, Homo sapiens
GKLVRLQVPVRNSRVDPRVRDDTGPPMDKSDLGQKRTSGAVCHQDPRTCEEPASSGAHIWPDDITKWPICTEQARSNHTGFLHVDCEIKGRPCCIGTKGSCEITTREYCEFMHGYFHEEATLCSQVHCLDKVCGLLPFLNPEVPDQFYRLWLSLFLHAGVVHCLVSVVFQMTILRDLEKLAGWHRIAIIFILSGITGNLASAIFLPYRAEVGPAGSQFGLLACLFVELFQSWPLLERPWKAFLNLSAIVLFLFICGLLPWIDNIAHIFGFLSGLLLAFAFLPYITFGTSDKYRKRALILVSLLAFAGLFAALVLWLYIYPINWPWIEHLTCFPFTSRFCEKYELDQVLH

SEQ ID NO: 9803 - protein, 207 aa, Homo sapiens
  SITE (70): Xaa equals any amino acid
  SITE (71): Xaa equals any amino acid
  SITE (72): Xaa equals any amino acid
  SITE (73): Xaa equals any amino acid
  SITE (75): Xaa equals any amino acid
  SITE (81): Xaa equals any amino acid
  SITE (89): Xaa equals any amino acid
  SITE (90): Xaa equals any amino acid
  SITE (95): Xaa equals any amino acid
  SITE (97): Xaa equals any amino acid
  SITE (99): Xaa equals any amino acid
  SITE (105): Xaa equals any amino acid
  SITE (127): Xaa equals any amino acid
  SITE (141): Xaa equals any amino acid
  SITE (169): Xaa equals any amino acid
  SITE (178): Xaa equals any amino acid
  SITE (187): Xaa equals any amino acid
  SITE (194): Xaa equals any amino acid
MYYIAHLLKGALLFITIALIGSGWAFIKYVLSDKEKKVFGIVIPMQVLATWPTSSSSPARKAPATTCCGXXXXPXGPHLLXCHPVPVVXXHPASXGXVXPQDGKXASEPGQSLKLVPGIYYVMGHLXRLLSPGSIGHPACXVAWCPFSSGKWACTQASWVGRASTLGPXFGAYRAYKXSGPQGNKPXTLNLPKXGQGGMVKMEQVMD

SEQ ID NO: 9804 - protein, 553 aa, Homo sapiens
VDPRVRVAPEMAVSERRGLGRGSPAEWGQRLLLVLLLGGCSGRIHRLALTGEKRADIQLNSFGFYTNGSLEVELSVLRLGLREAEEKSLLVGFSLSRVRSGRVRSYSTRDFQDCPLQKNSSSFLVLFLINTKDLQVQVRKYGEQKTLFIFPGLLPEAPSKPGLPKPQATVPRKVDGGGTSAASKPKSTPAVIQGPSGKDKDLVLGLSHLNNSYNFSFHVVIGSQAEEGQYSLNFHNCNNSVPGKEHPFDITVMIREKNPDGFLSAAEMPLFKLYMVMSACFLAAGIFWVSILCRNTYSVFKIHWLMAALAFTKSISLLFHSINYYFINSQGHPIEGLAVMYYIAHLLKGALLFITIALIGSGWAFIKYVLSDKEKKVFGIVIPMQVLANVAYIIIESREEGASDYVLWKEILFLVDLICCGAILFPVVWSIRHLQDASGTDGKVAVNLAKLKLFRHYYVMVICYVYFTRIIAILLQVAVPFQWQWLYQLLVEGSTLAFFVLTGYKFQPTGNNPYLQLPQEDEEDVQMEQVMTDSGFREGLSKVNKTASGRELL

SEQ ID NO: 9805 - protein, 44 aa, Homo sapiens; identical to SEQ ID NO: 6851

SEQ ID NO: 9806 - protein, 15 aa, Homo sapiens
PAPLPLRWSPAGPGQ

SEQ ID NO: 9807 - protein, 32 aa, Homo sapiens
WNPISMKNKLKILKIKKKKKKKKKKKKKKGRP

SEQ ID NO: 9808 - protein, 388 aa, Homo sapiens
  SITE (277): Xaa equals any amino acid
MMTITFLPYTFSLMVTFPDVPLGIFLFCVCVIAIGVVQALIVGYAFHFPHLLSPQIQRSAHRALYRRHVLGIVLQGPALCFAAAIFSLFFVPLSYLLMVTVILLPYVSKVTGWCRDRLLGHREPSAHPVEVFSFDLHEPLSKERVEAFSDGVYAIVATLLILDICEDNVPDPKDVKERFSGSLVAALSATGPRFLAYFGSFATVGLLWFAHHSLFLHVRKATRAMGLLNTLSLAFVGGLPLAYQQTSAFARQPRDELERVRVSCTIIFLASIFQLAXWTTALLHQAETLQPSVWFGGREHVLMFAKLALYPCASLLAFASTCLLSRFSVGIFHLMQIAVPCAFLLLRLLVGLALATLRVLRGLARPEHPPPAPTGQDDPQSQLLPAPC

SEQ ID NO: 9809 - protein, 76 aa, Homo sapiens
  SITE (62): Xaa equals any amino acid
  SITE (70): Xaa equals any amino acid
  SITE (71): Xaa equals any amino acid
  SITE (74): Xaa equals any amino acid
MLHMYSQKDPLILCVRLAVLLAVTLTVPVVLFPIRRALQQLLFPGKAFSWPRHVAIALILLXLVNVLASXXQPXGI

SEQ ID NO: 9810 - protein, 148 aa, Homo sapiens
  SITE (2): Xaa equals any amino acid
  SITE (17): Xaa equals any amino acid
LXMYSQKDPLILCVRLXVLLAVTLTVPVVLFPIRRALQQLLFPGKAFSWPRHVAIALILLVLVNVLVICVPTIRDIFGVIGSTSAPSLIFILPSIFYLRIVPSEVEPFLSWPKIQALCFGVLGVLFMAVSLGFMFANWATGQSRMSGH

SEQ ID NO: 9811 - protein, 54 aa, Homo sapiens
  SITE (26): Xaa equals any amino acid
  SITE (27): Xaa equals any amino acid
  SITE (36): Xaa equals any amino acid
  SITE (40): Xaa equals any amino acid
  SITE (44): Xaa equals any amino acid
  SITE (47): Xaa equals any amino acid
  SITE (49): Xaa equals any amino acid
MLHMYSQKDPLILCVPPGRAARGDPXXASRAGPYPXGPAXAAFXRQXLXLGTTW

SEQ ID NO: 9812 - protein, 142 aa, Homo sapiens
  SITE (104): Xaa equals any amino acid
  SITE (105): Xaa equals any amino acid
  SITE (115): Xaa equals any amino acid
MTLIEVLVSVLILAVGLLRAAVIQLNALKYTDSSRMTSQASFIAYDMLDRIRANSGADYSWGQGERAPSTTSVASVRDLDLHDFEANIVGFAGESAKGSVAVNXXEVTISISWDXSRGANAQGTRETFTLTSRVAVDPRVLP

SEQ ID NO: 9813 - protein, 41 aa, Homo sapiens
MFMLCNLLLPLLEFIFGSTYLSTDLYLHTCMKNVFLHIHSF

SEQ ID NO: 9814 - protein, 35 aa, Homo sapiens
MGANSLLHETRALFLHLMQPLLGEEVGIIGNKQQF

SEQ ID NO: 9815 - protein, 105 aa, Homo sapiens
MCLLPGGVLLIWSCASGTPASHTKDWGRCKFSAATKRTAESNLESTQLMLASQIDPLLAECWHLCASVSSSVNGGDKKCVHTSRAVGRIKLCSDTIRACSGWYLQ

SEQ ID NO: 9816 - protein, 68 aa, Homo sapiens
  SITE (25): Xaa equals any amino acid
  SITE (51): Xaa equals any amino acid
  SITE (56): Xaa equals any amino acid
MLLPLFTLLILLLRVFPKEIIQNRXKLKAEKCWNMTLFIAVGKMGGWGTWXMLEIXALCEGPVGEDAL

SEQ ID NO: 9817 - protein, 8 aa, Homo sapiens
RVFPVTTL

SEQ ID NO: 9818 - protein, 88 aa, Homo sapiens
APCSPSCVEFPPQGPAPGPDTRSPSQSTLILPLPTGPHILSGHGIIWHSLAIFSHLLPQLPGLLALTSFYKPGQCLGINENPDLRPGS

SEQ ID NO: 9819 - protein, 202 aa, Homo sapiens
MAEGDNRSTNLLAAETASLEEQLQGWGEVMLMADKVLRWERAWFPPAIMGVVSLVFLIIYYLDPSVLSGVSCFVMFLCLADYLVPILAPRIFGSNKWTTEQQQRFHEICSNLVKTRRRAVGWWKRLFTLKEEKPKMYFMTMIVSLAAVAWVGQQVHNLLLTYLIVTSLLLLPGLNQHGIILKYIGMAKREINKLLKQKKKKK

SEQ ID NO: 9820 - protein, 155 aa, Homo sapiens [sequence omitted]

SEQ ID NO: 9821 - protein, 234 aa, Homo sapiens
PTRPPTRPVRVSVGGLVGEVACACRDCIPETMAEGDNRSTNLLAAETASLEEQLQGWGEVMLMADKVLRWERAWFPPAIMGVVSLVFLIIYYLDPSVLSGVSCFVMFLCLADYLVPILAPRIFGSNKWTTEQQQRFHEICSNLVKTRRRAVGWWKRLFTLKEEKPKMYFMTMIVSLAAVAWVGQQVHNLLLTYLIVTSLLLLPGLNQHGIILKYIGMAKREINKLLKQKEKKNE

SEQ ID NO: 9822 - protein, 58 aa, Homo sapiens; identical to SEQ ID NO: 6880

SEQ ID NO: 9823 - protein, 134 aa, Homo sapiens
SPARHPTTSSRHTWWESGNAVPPGSPFHGRPLLLLQPAGPVPFQDQPFDPSQGPWPGLHCRPQGLMHSMCLPDLTPEDGGKAQDHTALGHSREQDTPGVQENFQGAAPLDRYTRRFNTLYYLGNQRRGIIKTRK

SEQ ID NO: 9824 - protein, 27 aa, Homo sapiens
MRARTLPPSLLCLWCLAPYLNICWMNG

SEQ ID NO: 9825 - protein, 28 aa, Homo sapiens
  SITE (14): Xaa equals any amino acid
AQWLTPVIPALWWXEEGGSPEVRSSRPA

SEQ ID NO: 9826 - protein, 212 aa, Homo sapiens
MPSLRFLALALLLAILPALPNAHAAPGIGGLIGGGSQASAKEEPQSNAQPSADERKQRLLSQAEETRQRLTDLKAELAGAPKEISEAQRTLSKLVSEDNSDLPERLSKLSVPVLEQRLAARVDELALWQQALSAANSMLISAQTRPERAQADISKNQLRIDEINGLLKSGRENNKPLTDERRALLESTSRAAAGPSIFHPGGVPGKCTQFAL

SEQ ID NO: 9827 - protein, 85 aa, Homo sapiens
ELQPNPHARAKPCCYLLFLSCLIPSMFSLSVDPVSPVLRIVPGSDHFSLPLLLPPPLAWIIAAASQLALLCPSLFSPSVCSQQRS

SEQ ID NO: 9828 - protein, 346 aa, Homo sapiens
MLLGVGLVVLALIAGWVLQQANRSAQQLTATGQSLMQSQRLAKSVSQALVGSPQAFPDVVESSGVLARNVRALNGGDNELDVQALGEPFRPELDAITPLVERAERNAGVVMGQQKILTQVGDALRTINRQSSDLLEIAETVSSLKLQQNAPASEISAAGQLVMLTQRIGKSANEFQTTEGVSPEAVFLLGKDLNSFKEIARGMLDGSADLRLAATRDAQTREQLESLIKLYEQTRTQAGAILGNLQGLVSAREAQSAILADSEPLRRQLEGLQSKLSAQSGMGAASSLRSPSPVSSSCCAAWVFRACSCWTAAAAKPRPKHSSVMPSARNRKPSASTTPTRRPFCD

SEQ ID NO: 9829 - protein, 144 aa, Homo sapiens
  SITE (77): Xaa equals any amino acid
  SITE (122): Xaa equals any amino acid
  SITE (141): Xaa equals any amino acid
MLLGVGLVVLALIAGWVLQQANRSAQQLTATGQSLMQSQRLAKSVSQALVGSPQAFPDVVESSGVLARNVRALNGGXNELDVQALGEPFRPELDAITPLVERAERNAGVVMGQQKILTQVGXALRTIKPPVLGPCWRSRRXSSS

SEQ ID NO: 9830 - protein, 187 aa, Homo sapiens
  SITE (16): Xaa equals any amino acid
  SITE (72): Xaa equals any amino acid
TSRVWCPHVRRNRPSXQTAEPCAVNWKACKATVGTIGHGCGPAIALAVAGIFVLLCGVGISRVQLLDSRSRXATAEAQQRDAKRQEQEAKRINDANQAAILRLMNELQSVAEGDLTQEATVTEDITGAIADSVNYTVEESASWWATCRTPRPGWPRPPRRWTAPLRNCWRLRPSSCVKSVKRAVRCS

SEQ ID NO: 9831 - protein, 9 aa, Homo sapiens
MNEKFLPPL

SEQ ID NO: 9832 - protein, 3 aa, Homo sapiens
DLK

SEQ ID NO: 9833 - protein, 305 aa, Homo sapiens
  SITE (4): Xaa equals any amino acid
  SITE (6): Xaa equals any amino acid
MPAXAXASFPFFLFALFVIACGLGCLETAANPYATVLGEPQGAERRLNLAQSFNGLGQFFGPLIGGAMFFSAGSTPASDMSSLQTTYVVIAVLVLLVALLIARTPLPDLRAQEQALQPTAGKGLWQHREFVGGVITQFFYVAAQVGVGAFFINYVTEHWAQMGNQQAAYLLSIAMLAFMFGRFFSTWLMGRVSAQKLLLIYALINIALCGLVVIGLEGISVIALIAVFFFMSIMFPTLFAMGVKNLGPHTKRGSSFMIMAIVGGALMPYLMGKVADNSTVALAYLLPMGCFVIVAVYARSRLRHP

SEQ ID NO: 9834 - protein, 11 aa, Homo sapiens
MTLSNWEYGFH

SEQ ID NO: 9835 - protein, 65 aa, Homo sapiens
KLTQAGSGYVHREIFPRVCFFDILSPSFYLLAGISCPTTPVIICKPLYSFQCLKVIHKEGRNKRV

SEQ ID NO: 9836 - protein, 24 aa, Homo sapiens
ICLWGRPNLTTQGTLKGISGRRSQ

SEQ ID NO: 9837 - protein, 128 aa, Homo sapiens
PETFLLVTGSQWGILGCQGPRVTCVQLFYGSRGLSLRQATKCPGCHPPWSPSVPHAWSPASPRIPVAFISGQLPARPGLGHGLRHEARPPPAPLPRGSSIPLHFWNVCASMMFVYLRHLKIYFRYEGK

SEQ ID NO: 9838 - protein, 53 aa, Homo sapiens
  SITE (28): Xaa equals any amino acid
MDIQGKALYIRFLLTLCQMVVSVMGKRXQGRRGLGGAAAVGREICRRWGCCVT

SEQ ID NO: 9839 - protein, 12 aa, Homo sapiens
LCWTRSSVIGAH

SEQ ID NO: 9840 - protein, 60 aa, Homo sapiens
  SITE (7): Xaa equals any amino acid
  SITE (34): Xaa equals any amino acid
VFKTIRXREIILYHENSTGKTHPHDSLISHWVPXTTQGNYGSYKMRFGWGHRARPYQPPK

SEQ ID NO: 9841 - protein, 124 aa, Homo sapiens
MRQVAPARRAQLEHSGLHASLCLLSLLSLLPTLEANMSGFHQAPLTLLPSCTQGDGEARGHHTQPSFWRTEMKCPVEALLEHLATRAVVGRNGDHGAQQEHRTASEGQQQPLAESSPWWQPPHG

SEQ ID NO: 9842 - protein, 56 aa, Homo sapiens; identical to SEQ ID NO: 6901

SEQ ID NO: 9843 - protein, 29 aa, Homo sapiens
MLVIIIMTALVSHVPSVHSVPHAVPFTSS

SEQ ID NO: 9844 - protein, 56 aa, Homo sapiens
  SITE (3): Xaa equals any amino acid
  SITE (46): Xaa equals any amino acid
AEXAPLHFHLGDGERLHLKKKKNKKKKPKQGWARWLTPVISALLEXGAGVSPEVMS

SEQ ID NO: 9845 - protein, 150 aa, Homo sapiens
MDAMILLNVLALTRLAKAAATNFVAQGRGTIINIGSIVALAPKVLNGVYGGTKAFVQAFSESLQHELSDKGVVVQVVLPGATATEFWDIAGLPVKQPAGSHGDDHRKPGGRRPGRPCPGRSRDDSVPAGQRRLGHLRTRAAGPGSEPVAP

SEQ ID NO: 9846 - protein, 157 aa, Homo sapiens
  SITE (114): Xaa equals any amino acid
  SITE (119): Xaa equals any amino acid
  SITE (120): Xaa equals any amino acid
  SITE (121): Xaa equals any amino acid
MDAMILLNVLALTRLAKAAATNFVAQGRGTIINIGSIVALAPKVLNGVYGGTKAFVQAFSESLQHELSDKGVVVQVVLPGATATEFWDIAGLPVKQPAGSHGDDHRKPGGRRPXRPCPXXXVTIPSLPDSADWDTTNARGWPWVRTCRTVNPPLVMG

SEQ ID NO: 9847 - protein, 211 aa, Homo sapiens
MANAGLQLLGFILAFLGWIGAIVSTALPQWRIYSYAGDNIVTAQAMYEGLWMSCVSQSTGQIQCKVFDSLLNLSSTLQATRALMVVGILLGVIAIFVATVGMKCMKCLEDDEVQKMRMAVIGGAIFLLAGLAILVATAWYGNRIVQEFYDPMTPVNARYEFGQALFTGWAAASLCLLGGALLCCSCPRKTTSYPTPRPYPKPAPSSGKDYV

SEQ ID NO: 9848 - protein, 211 aa, Homo sapiens; identical to SEQ ID NO: 6910
  SITE (99): Xaa equals any amino acid

SEQ ID NO: 9849 - protein, 80 aa, Homo sapiens [sequence omitted]

SEQ ID NO: 9850 - protein, 225 aa, Homo sapiens
  SITE (5): Xaa equals any amino acid
HERAXGPSRGHGELLSCVLGPRLYKIYRERDSERAPASVPETPTAVTAPHSSSWDTYYQPRALEKHADSILALASVFWSISYYSSPFAFFYLYRKGYLSLSKVVPFSHYAGTLLLLLAGVACSEALAAGPTPSTGSSSPSWKQHIGTSLQKTRGSLPTTTLTSGAGQSTSTGKNPAAGRSLEGALPAGVWPCFAQSPCTGGQQTPSSTGLRSCLVRSPATWWRTP

SEQ ID NO: 9851 - protein, 313 aa, Homo sapiens
  SITE (49): Xaa equals any amino acid
  SITE (167): Xaa equals any amino acid
MNQLSFLLFLIATTRGWSTDEANTYFKEWTCSSSPSLPRSCKEIKDECXSAFDGLYFLRTENGVIYQTFCDMTSGGGGWTLVASVHENDMRGKCTVGDRWSSQQGSKADYPEGDGNWANYNTFGSAEAATSDDYKNPGYYDIQAKDLGIWHVPNKSPMQHWRNSSLXRYRTDTGFLQTLGHNLFGIYQKYPVKYGEGKCWTDNGPVIPVVYDFGDAQKTASYYSPYGQREFTAGFVQFRVFNNERAANALCAGMRVTGCNTEHHCIGGGGYFPEASPQQCGDFSGFDWSGYGTHVGYSSSREITEAAVLLFYR

SEQ ID NO: 9852 - protein, 80 aa, Homo sapiens [sequence omitted]

SEQ ID NO: 9853 - protein, 121 aa, Homo sapiens
  SITE (114): Xaa equals any amino acid
KLRLREVKSIAQGHVARIWQSHDSDPGLLILIPVSFLAYHVASKDCSSLFTRKLFLPNLHLHLTPSFLKHYVCVFISIIFIVFGIHVLVCVWKKNLFYQLALGPTWKKKSLNVXAMYSLKM

SEQ ID NO: 9854 - protein, 706 aa, Homo sapiens
MLHALQHPCIVALIGISIHPLCFALELAPLSSLNTVLSENARDSSFIPLGHMLTQKIAYQIASGLAYLHKKNIIFCDLKSDNILVWSLDVKEHINIKLSDYGISRQSFHEGALGVEGTPGYQAPEIRPRIVYDEKVDMFSYGMVLYELLSGQRPALGHHQLQIAKKLSKGIRPVLGQPEEVQFRRLQALMMECWDTKPEKRPLALSVVSQMKDPTFATFMYELCCGKQTAFFSSQGQEYTVVFWDGKEESRNYTVVNTEKGLMEVQRMCCPGMKVSCQLQVQRSLWTATEDQKIYIYTLKGMCPLNTPQQALDTPAVVTCFLAVPVIKKNSYLVLAGLADGLVAVFPVVRGTPKDSCSYLCSHTANRSKFSIADEDARQNPYPVKAMEVVNSGSEVWYSNGPGLLVIDCASLEICRRLEPYMAPSMVTSVVCSSEGRGEEVVWCLDDKANSLVMYHSTTYQLCARYFCGVPSPLRDMFPVRPLDTEPPAASHTANPKVPEGDSIADVSIMYSEELGTQILIHQESLTDYCSMSSYSSSPPRQAARSPSSLPSSPASSSSVPFSTDCEDSDMLHTPGAASDRSEHDLTPMDGETFSQHLQAVKILAVRDLIWVPRRGGDVIVIGLEKDSEAQRGRVIAVLKARELTPHGVLVDAAVVAKDTVVCTFENENTEWCLAVWRGWGAREFDIFYQSYEELGRLEACTRKRR

SEQ ID NO: 9855 - protein, 112 aa, Homo sapiens
MLISGWARWLMPLVPALWEAEAGESGVQDQPGQCGETLSLLKIKKKKKKKWLISESYSGLNSVIQPKLITLCYLWEPHLKSKDPDTCLILWQGSNESNKMLVKVRTGSILNT

SEQ ID NO: 9856 - protein, 94 aa, Homo sapiens; identical to SEQ ID NO: 6921

SEQ ID NO: 9857 - protein, 245 aa, Homo sapiens
  SITE (110): Xaa equals any amino acid
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAXVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPGNILNVSIKICLTLSPST

SEQ ID NO: 9858 - protein, 31 aa, Homo sapiens
FAIFIYFSVSYIADGNEFEVPRAEDPCLLCF

SEQ ID NO: 9859 - protein, 11 aa, Homo sapiens
WHILQMKGLTW

SEQ ID NO: 9860 - protein, 53 aa, Homo sapiens; identical to SEQ ID NO: 6925

SEQ ID NO: 9861 - protein, 95 aa, Homo sapiens
PPRTRLFLVILFCCFRRNDTSFCFFEEKVFHVTVARTNTKRSRLQMLQACAVVCVCVCVCVCVCTYIYGKHIYCCAARGKPAKKCVCLYEMFEKR

SEQ ID NO: 9862 - protein, 91 aa, Homo sapiens
  SITE (40): Xaa equals any amino acid
SVSKKKKKKKVFCILYKLVVVGSRGLSTDDLMRSVSRFAXSQTFVLLNSSSFFSFLETESSSVTRLECSGTIKAYCSLYLPGSRNPPTLAS

SEQ ID NO: 9863 - protein, 17 aa, Homo sapiens
QLILSLLRGFCKTERVG

SEQ ID NO: 9864 - protein, 348 aa, Homo sapiens
  SITE (283): Xaa equals any amino acid
  SITE (293): Xaa equals any amino acid
  SITE (325): Xaa equals any amino acid
  SITE (326): Xaa equals any amino acid
MLCPWRTANLGLLLILTIFLVAEAEGAAQPNNSLMLQTSKENHALASSSLCMDEKQITQNYSKVLAEVNTSWPVKMATNAVLCCPPIALRNLIIITWEIILRGQPSCTKAYKKETNETKETNCTDERITWVSRPDQNSDLQIRTVAITHDGYYRCIMVTPDGNFHRGYHLQVLVTPEVTLFQNRNRTAVCKAVAGKPAAHISWIPEGDCATKQEYWSNGTVTVKSTCHWEVHNVSTVNCHVSHLTGNKSLYIELLPVPGAKKSSKLYIPYIILTIIILTIVGXIWLLKVNGCXKYKLNKPESTPVVEEDEMQPYAFYTEKNNPLXXTTNKVKASEALQSEVDTDLHTL

SEQ ID NO: 9865 - protein, 705 aa, Homo sapiens
  SITE (236): Xaa equals any amino acid
  SITE (264): Xaa equals any amino acid
  SITE (633): Xaa equals any amino acid
  SITE (636): Xaa equals any amino acid
MSRDLLFKHYCYPERDPEEVFAFLLRFPHVALFTFDGLDELHSDLDLSRVPDSSCPWEPAHPLVLLANLLSGKLLKGASKLLTARTGIEVPRQFLRKKVLLRGFSPSHLRAYARRMFPERALQDRLLSQLEANPNLCSLCSVPLFCWIIFRCFQHFRAAFEGSPQLPDCTMTLTDVFLLVTEVHLNRMQPSSLVQRNTRSPVETLHAGRDTLCSLGQVAHRGMEKSLFVFTQEEVXASGLQERDMQLGFLRALPELGPGGDQQXYEFFHLTLQAFFTAFFLVLDDRVGTQELLRFFQEWMPPAGAATTSCYPPFLPFQCLQGSGPAREDLFKNKDHFQFTNLFLCGLLSKAKQKLLRHLVPAAALRRKRKALWAHLFSSLRGYLKSLPRVQVESFNQVQAMPTFIWMLRCIYETQSQKVGQLAARGICANYLKLTYCNACSADCSALSFVLHHFPKRLALDLDNNNLNDYGVRELQPCFSRLTVLRLSVNQITDGGVKVLSEELTKYKIVTYLGLYNNQITDVGARYVTKILDECKGLTHLKLGKNKITSEGGKYLALAVKNSKSISEVGMWGNQVGDEGAKAFAEALRNHPSLTTLSLASNGISTEGGKSLARALQQNTSLEILWLTQNELXDEXAESLAEMLKVNQTLKHLWLIQNQITAKGTAQLADALQSNTGITEICLNGNLIKPEEAKVYEDEKRIICF

SEQ ID NO: 9866 - protein, 35 aa, Homo sapiens
MGRGPWDAGPSRRLLPLLLLLGLARGAAERRAPTV

SEQ ID NO: 9867 - protein, 10 aa, Homo sapiens
PFPAGPHSWI

SEQ ID NO: 9868 - protein, 10 aa, Homo sapiens
PQTAGPQKCA

SEQ ID NO: 9869 - protein, 639 aa, Homo sapiens
MLLPLLLSSLLGGSQAMDGRFWIRVQESVMVPEACDISVPCSFSYPRQDWTGSTPAYGYWFKAVTETTKGAPVATNHQSREVEMSTRGRFQLTGDPAKGNCSLVIRDAQMQDESQYFFRVERGSYVRYNFMNDGFFLKVTVLSFTPRPQDHNTDLTCHVDFSRKGVSAQRTVRLRVAYAPRDLVISISRDNTPALEPQPQGNVPYLEAQKGQFLRLLCAADSQPPATLSWVLQNRVLSSSHPWGPRPLGLELPGVKAGDSGRYTCRAENRLGSQQRALDLSVQYPPENLRVMVSQANRTVLENLGNGTSLPVLEGQSLCLVCVTHSSPPARLSWTQRGQVLSPSQPSDPGVLELPRVQVEHEGEFTCHARHPLGSQHVSLSLSVHYSPKLLGPSCSWEAEGLHCSCSSQASPAPSLRWWLGEELLEGNSSQDSFEVTPSSAGPWANSSLSLHGGLSSGLRLRCEAWNVHGAQSGSILQLPDKKGLISTAFSNGAFLGIGITALLFLCLALIIMKILPKRRTQTETPRPRFSRHSTILDYINVVPTAGPLAQKRNQKATPNSPRTPLPPGAPSPESKKNQKKQYQLPSFPEPKSSTQAPESQESQEELHYATLNFPGVRPRPEARMPKGTQADYAEVKFQ

SEQ ID NO: 9870 - protein, 127 aa, Homo sapiens
MLLPLLLSSLLGGSQAMDGRFWIRVQESVMVPEGLCISVPCSFSYPRQDWTGSTPAYGYWFKAVTETTKGAPVATNHQSREVEMSTRGRFPGSLGDPAKGNCSLVIRRRADARMSHSTSFGWREEAM

SEQ ID NO: 9871 - protein, 477 aa, Homo sapiens [sequence omitted]

SEQ ID NO: 9872 - protein, 316 aa, Homo sapiens
MLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSILRVVLGANGTYSCLVRNPVLQQDAHSSVTITGQPMTFPPEALWVTVGLSVCLIALLVALAFVCWRKIKQSCEEENAGAEDQDGEGEGSKTALQPLKHSDSKEDDGQEIA

SEQ ID NO: 9873 - protein, 302 aa, Homo sapiens
  SITE (128): Xaa equals any amino acid
MRLGSPGLLFLLFSSLRADTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSXEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGHV

SEQ ID NO: 9874 - protein, 419 aa, Homo sapiens; identical to SEQ ID NO: 6942

SEQ ID NO: 9875 - protein, 53 aa, Homo sapiens; identical to SEQ ID NO: 6947

SEQ ID NO: 9876 - protein, 4 aa, Homo sapiens
FLSS

SEQ ID NO: 9877 - protein, 19 aa, Homo sapiens [sequence omitted]

SEQ ID NO: 9878 - protein, 51 aa, Homo sapiens
QASWVWWLTTVIPALWEARAGGSLEPRSSRLAWATQKVFISKKKKKKKRAA

SEQ ID NO: 9879 - protein, 42 aa, Homo sapiens
MRVRIGLTLLLCAVLLSLASASSDEEGSQDESLGFQDYFDIR

SEQ ID NO: 9880 - protein, 39 aa, Homo sapiens
MAGQFRSYVWDPLLILSQSSSCRPCITARWACGWRWWTG

SEQ ID NO: 9881 - protein, 66 aa, Homo sapiens
  SITE (43): Xaa equals any amino acid
MAGQFRSYVWDPLLILSQIVLMQTVYYGSLGLWLALVDGLVRXAPRWTRCSTPRSWAFPPLQAGSP

SEQ ID NO: 9882 - protein, 124 aa, Homo sapiens
  SITE (28): Xaa equals any amino acid
TQIPTHISRYTPLHSSLGNRARLRLKKXKIKYAYLCPPSLKQLLNYAVINGLSSANYFCLYTKVPQAMLLLASGLSSAFPYDSLGFTLSMLLFFERNKSRVEVLAKEPSAPSSYWDSENRGCQL

SEQ ID NO: 9883 - protein, 262 aa, Homo sapiens
MRLRLRLLALLLLLLAPPARAPKPSAQDVSLGVDWLTRYGYLPPPHPAQAQLQSPEKLRDAIKVMQRFAGLPETGRMDPGTVATMRKPRCSLPDVLGVAGLVRRGRRYALSGSVWKKRTLTWRVRSFPQSSQLSQETVRVLMSYALMAWGMESGLTFHEVDSPQGQEPDILIDFARAFHQDSYPFDGLGGTLAHAFFPGEHPISGDTHFDDEETWTFGSKDGEGTDLFAVAVHEFGHALGLGHSSAPNSIMRPFYQGPVGRP

SEQ ID NO: 9884 - protein, 61 aa, Homo sapiens
  SITE (58): Xaa equals any amino acid
MHSKQTLLWKELLLAIPCIIASPRSLWPRWASGKVKDWVNTARVGRTSLRLPVRKVEXAWV

SEQ ID NO: 9885 - protein, 1 aa, Homo sapiens
N

SEQ ID NO: 9886 - protein, 197 aa, Homo sapiens
VEIVHELKGEGKAQRKISAIHILDVLVLNGTDVREQHFNQRIQLAEKFVKAVSKPSRPDMNPIRVKEVYRLEEMEKIFVRLEMKIIKGSSGTPKLSYTGRDDRHFVPMGLYIVRTVNEPWTMGFSKSFKKKFFYNKKTKDSTFDLPADSIAPFHICYYGRLFWEWGDGIRVHDSQKPQDQDKLSKEDVLSFIQMHRA

SEQ ID NO: 9887 - protein, 18 aa, Homo sapiens
VHKSAGLLWEATGEGPGS

SEQ ID NO: 9888 - protein, 109 aa, Homo sapiens
  SITE (94): Xaa equals any amino acid
MNTLVLWIFGFLICLGIILAIGNSIWESQTGDQFRTFLFWNEGEKSSVFSGFLTFWSYIIILNTVVPISLYVSVEVIRLGHSYFINWDRKMYYXRKAIPAVARTTTLNE

SEQ ID NO: 9889 - protein, 46 aa, Homo sapiens
  SITE (45): Xaa equals any amino acid
INHVFIWGSIAIYFSILFTMHSNGIFGIFPNQFPFVGNARHSLTXK

SEQ ID NO: 9890 - protein, 6 aa, Homo sapiens
TVAIYD

SEQ ID NO: 9891 - protein, 11 aa, Homo sapiens
FLVCLLLGPRS

SEQ ID NO: 9892 - protein, 56 aa, Homo sapiens
  SITE (35): Xaa equals any amino acid
  SITE (42): Xaa equals any amino acid
  SITE (46): Xaa equals any amino acid
KSQMQSFTIVTAYGRCLSLTCLPTLNQMLVFKSNXSLVSPHXLTFXNIFARFENFQ

SEQ ID NO: 9893 - protein, 53 aa, Homo sapiens
NYNRGGTFLYQKAKIKHHVLMVFYKSTSNSTESLIWSLLNSWSDKVTFPKRVR

SEQ ID NO: 9894 - protein, 137 aa, Homo sapiens
MKLLVILLFSGLITGFRSDSSSSLPPKLLLVSFDGFRADYLKNYEFPHLQNFIKEGVLVEHVKNVFITKTFPNHYSIVTGLYEESHGIVANSMYDAVTKKHFSDSNDKDPFWWNEAVPIWVTNQLQETDQVAAAMWA

SEQ ID NO: 9895 - protein, 12 aa, Homo sapiens
LLTILLWSALSY

SEQ ID NO: 9896 - protein, 101 aa, Homo sapiens
  SITE (97): Xaa equals any amino acid
SFSFKVVDVFEVSKIVAEYFILGPCNGVSFNDCIIVIGGYEFQKSILGIQLMSGFYIGWNRKVCPVSILTLSTRHLPICLSLRSQNINSNCKLSKNXKSIC

SEQ ID NO: 9897 - protein, 6 aa, Homo sapiens
KMMMIL

SEQ ID NO: 9898 - protein, 45 aa, Homo sapiens
INSCNIKGLKCFYIVFGCLLLVPISDKLYGLLHLIPFIWRVLLPC

SEQ ID NO: 9899 - protein, 31 aa, Homo sapiens
  SITE (18): Xaa equals any amino acid
  SITE (25): Xaa equals any amino acid
LSSIAMFGSFLVLLTLDXDLDTVQXDKIYVF

SEQ ID NO: 9900 - protein, 105 aa, Homo sapiens
  SITE (92): Xaa equals any amino acid
  SITE (99): Xaa equals any amino acid
LYFAFYIIMKLRSGERIKLIPLLCIVCTSVVWGFALFFFFQGLSTWQKTPAESREHNRDCILLDFFDDHDIWHFLSSIAMFGSFLVLLTLDXDLDTVQXDKIYVF

SEQ ID NO: 9901 - protein, 168 aa, Homo sapiens
  SITE (39): Xaa equals any amino acid
MPLLRGLLWLQVLCAGPLHTEAVVLLVPSDDGRAFLLRXRLLHPEAHVPPAADRGASLQCVLHQAAPKSRPRSPAAGAALLHRPRRTGDEPCREFHGNGFPGPTQLTPGECGLPAPSSLLQHASAPVRTGSEGQVVGCPRARGETGEGLSLAFLSSLMFTSRNGLVGC

SEQ ID NO: 9902 - protein, 134 aa, Homo sapiens
  SITE (39): Xaa equals any amino acid
MPLLRGLLWLQVLCAGPLHTEAVVLLVPSDDGRAFLLRXGFFIRRRMYPPPLIEEPAFNVSYTRQPPNPGPGAQQPGPPYYTDPGGPGMNPVGNSMAMAFQVPPNSPQGSVACPPPPAYCNTPPPPYEQVVKAK

SEQ ID NO: 9903 - protein, 134 aa, Homo sapiens; identical to SEQ ID NO: 9902
  SITE (39): Xaa equals any amino acid

SEQ ID NO: 9904 - protein, 168 aa, Homo sapiens; identical to SEQ ID NO: 9901
  SITE (39): Xaa equals any amino acid

SEQ ID NO: 9905 - protein, 135 aa, Homo sapiens
  SITE (118): Xaa equals any amino acid
  SITE (121): Xaa equals any amino acid
MPLLRGLLWLQVLCAGPLHTEAVVLLVPSDDGRAFLLRSRLLHPEAHVPPAADRGASLQCVLHQAAPKSRPRSPAAGAALLHRPRRTGDEPCREFHGNGFPGPTQLTPGECGLPAPSXLLXHASAPVRTVCALTW

SEQ ID NO: 9906 - protein, 168 aa, Homo sapiens; identical to SEQ ID NO: 6307
  SITE (83): Xaa equals any amino acid

SEQ ID NO: 9907 - protein, 228 aa, Homo sapiens
  SITE (164): Xaa equals any amino acid
  SITE (167): Xaa equals any amino acid
  SITE (200): Xaa equals any amino acid
  SITE (206): Xaa equals any amino acid
  SITE (221): Xaa equals any amino acid
MAAAGSVKAALQVAEVLEAIVSCCVGPEGRQVLCTKPTGEVLLSRNGGRLLEALHLEHPIARMIVDCVSSHLKKTGDGAKTFIIFLCHLLRGLHAITDREKDPLMCENIQTHGRHWKNCSRWKFISQALLTFQTQILDGIMDQYLSRHFLSIFSSAKERTLCRXSLXLLLEAYFCGKVGRNNHKFISQLMCDYFFKCMTXKSGIGXFELGDDHFVKLNVGXLAFLFKF

SEQ ID NO: 9908 - protein, 33 aa, Homo sapiens
KILVSYLMPGMMRIENFSIFMCLTGCLGINFAF

SEQ ID NO: 9909 - protein, 180 aa, Homo sapiens
  SITE (140): Xaa equals any amino acid
MPAPARSCQRAALSLWASGLGWLSAQPTVAFRGSSWDWEPPQGQADGVRFVLGLVLPMLGGGGAPRTDQPCFSCNAVTLSLNTWIHVWPGLAGSRSPARVGSHGPALEPPSGPGAAEAASEGLPRPAFHRWGAQPSKAAXTPPRPVCQGAGHNPAGPRTGLQASPCAPAGRPCSREEVLG

SEQ ID NO: 9910 - protein, 131 aa, Homo sapiens
  SITE (24): Xaa equals any amino acid
  SITE (122): Xaa equals any amino acid
  SITE (123): Xaa equals any amino acid
EAKGTAMQRPWGRTAPGMREEQSXERRAGRAGPCGPQGGLGHLPRGSGAPGCVSRWERQGRICGDLTRAGEAETRVQPPPPKAGPSQRRGRAGQEVSGCLLGLVWFCFVLFIVVKYKIYRLXXKKKKKGRP

SEQ ID NO: 9911 - protein, 101 aa, Homo sapiens [sequence omitted]

SEQ ID NO: 9912 - protein, 67 aa, Homo sapiens
MSLCRILGYSFSSRLSSLILPLAVFHYCLSCPLHFKLSFKYLPFPSFPFSSLPCPALPCPALPSPPL

SEQ ID NO: 9913 - protein, 227 aa, Homo sapiens
  SITE (171): Xaa equals any amino acid
MVGKIKRLKKSAFVVLILLITAKLLVLPLLCREMVELLDKGDSVVNHTSLSNYAFLYGVFPVAPGVAIFATQFNMEVEIITSGMVISTFVSAPIMYVSAWLLTFPTMDPKPLAYAIQNVSFDISIVSLISLIWSLAILLLSKKYKQLPHMLTTNLLIAQSIVCAGMMIWNXVKEKNFVGQILVFVLLYSSLYSTYLWTGLLAISLFLLKKRERVQIPVGIIIISGWG

SEQ ID NO: 9914 - protein, 177 aa, Homo sapiens
  SITE (98): Xaa equals any amino acid
  SITE (134): Xaa equals any amino acid
  SITE (148): Xaa equals any amino acid
  SITE (171): Xaa equals any amino acid
  SITE (172): Xaa equals any amino acid
MVGKIKRLKKSAFVVLILLITAKLLVLPLLCREMVELLDKGDSVVNHTSLSNYAFLYGVFPVAPGVAIFATQFNMEVEIITSGMVISTFVSAPIMYVXAWLLTFPTMDPKPLAYAIQNVSFDISIVSLISLIWXLAILLLSKKYKQLXHMLTTNLLIAQSIVCAGMMIWNXXKEKNF

SEQ ID NO: 9915 - protein, 177 aa, Homo sapiens
  SITE (120): Xaa equals any amino acid
  SITE (124): Xaa equals any amino acid
  SITE (126): Xaa equals any amino acid
  SITE (148): Xaa equals any amino acid
  SITE (171): Xaa equals any amino acid
  SITE (172): Xaa equals any amino acid
MVGKIKRLKKSAFVVLILLITAKLLVLPLLCREMVELLDKGDSVVNHTSLSNYAFLYGVFPVAPGVAIFATQFNMEVEIITSGMVISTFVSAPIMYVSAWLLTFPTMDPKPLAYAIQNVXFDIXIXSLISLIWSLAILLLSKKYKQLXHMLTTNLLIAQSIVCAGMMIWNXXKEKNF

SEQ ID NO: 9916 - protein, 447 aa, Homo sapiens
TTTKFAAASTFHPASKSNIKKVWMAEQKISYDKKKQEELMQQYLKEQESYDNRLLMGDERVKNGLNFMYEAPPGAKKENKEKEETEGETEYKFEWQKGAPREKYAKDDMNIRDQPFGIQVRNVRCIKCHKWGHVNTDRECPLFGLSGINASSVPTDGSGPSMHPSELIAEMRNSGFALKRNVLGRNLTANDPSQEYVASEGEEDPEVEFLKSLTTKQKQKLLRKLDRLEKKKKKKDRKKKKFQKSRSKHKKHKSSSSSSSSSSSSSSTETSESSSESESNNKEKKIQRKKRKKNKCSGHNNSDSEEKDKSKKRKLHEELSSSHHNREKAKEKPRFLKHESSREDSKWSHSDSDKKSRTHKHSPEKRGSERKEGSSRSHGREERSRRSRSRSPGSYKQRETRKRAQRNPGEEQSRRNDSRSHGTDLYRGEKMYREHPGGTHTKVTQRE

SEQ ID NO: 9917 - protein, 146 aa, Homo sapiens
  SITE (115): Xaa equals any amino acid
  SITE (123): Xaa equals any amino acid
  SITE (140): Xaa equals any amino acid
MQWRALVLGLVLLRLGLHGVLWLVFGLGPSMGFYQRFPLSFGFQRLRSPDGPASPTSGPVGRPGGVSGPSWLQPPGTGAAQSPRKAPRRPGPGMCGPANWGYVLGRPGRGPDEYXEAATAAPXLRNLRARCPELARGMVXFWATTL

SEQ ID NO: 9918 - protein, 87 aa, Homo sapiens
  SITE (61): Xaa equals any amino acid
  SITE (82): Xaa equals any amino acid
MQWRALVLGLVLLRLGLHGVLWLVFGLGPSMGFYQRFPLSFGFQRLRSPDGPASPTFGARXPAWGGIRAVVACNRRGTGQRXTRAKL

SEQ ID NO: 9919 - protein, 103 aa, Homo sapiens
MMCVVLTTLPCLTFSIAVTEVQKSINGSADVLPDMLPDLPVSLVLLSLIMVDIIEKLRIYPLRGSQKSSENGHIHSTSLQHIKTVTEQVRQSPENAASPQATN

SEQ ID NO: 9920 - protein, 48 aa, Homo sapiens
  SITE (15): Xaa equals any amino acid
  SITE (29): Xaa equals any amino acid
MKPPPLFFFLKIVLXIWGPLWFHMNFRFXFSISMKNAIGILIGIALNL

SEQ ID NO: 9921 - protein, 73 aa, Homo sapiens
TLFVSYQLSNPQYSSFISQNRKLKQREEKLHERFYTAVRSLNWILNLAFWLESPSFYQLCIAVRVDSPWKGKS

SEQ ID NO: 9922 - protein, 99 aa, Homo sapiens
  SITE (91): Xaa equals any amino acid
MAALLLLPLLLLLPLLLLKLHLWPQLRWLPADLAFAVRALCCKRALRARALAAAAADPEGPEGGCSLAWRLAELAQQRAELLLRSRALATXRRSARVTG

SEQ ID NO: 9923 - protein, 458 aa, Homo sapiens; identical to SEQ ID NO: 6976

SEQ ID NO: 9924 - protein, 153 aa, Homo sapiens
  SITE (77): Xaa equals any amino acid
  SITE (82): Xaa equals any amino acid
  SITE (83): Xaa equals any amino acid
  SITE (86): Xaa equals any amino acid
  SITE (91): Xaa equals any amino acid
  SITE (122): Xaa equals any amino acid
  SITE (124): Xaa equals any amino acid
MMLIPMASVMAVTEPKWVSVWSRFLWVTLLSMVLGSLLALLLPLGAVEEQCLAVLKGLYLLRSKPDRAQHAAPSAPXRPRSXXSPXGARRXLVAKTKAFSSGVKFGKAQELALEPRPWKIKXAXGQSRGKKAQKSSFNAPPFKEWDPGNFPGD

SEQ ID NO: 9925 - protein, 361 aa, Homo sapiens
  SITE (2): Xaa equals any amino acid
  SITE (4): Xaa equals any amino acid
  SITE (19): Xaa equals any amino acid
AXPXGKLEARAALNQALEXKRQGKREKAQKLFMHALKMDPDFVDALTEFGIFSEEDKDIIQADYLYTRALTISPYHEKALVNRDRTLPLVEEIDQRYFSIIDSKVKKVMSIPKGNSALRRVMEETYYHHIYHTVAIEGNTLTLSEIRHILETRYAVPGKSLEEQNEVIGMHAAMKYINTTLVSRIGSVTISDVLEIHRRVLGYVDPVEAGRFRTTQVLVGHHIPPHPQDVEKQMQEFVQWLNSEEAMNLHPVEFAALAHYKLVYIHPFIDGNGRTSRLLMNLILMQAGYPPITIRKEQRSDYYHVLEAANEGDVRPFIRFIAKCTETTLDTLLFATTEYSVALPEAQPNHSGFKETLPVKP

SEQ ID NO: 9926 - protein, 120 aa, Homo sapiens
  SITE (116): Xaa equals any amino acid
  SITE (120): Xaa equals any amino acid
MILWLDWALFLLVFPGQFFCWFCLGSLMRLQVAAGSASVWGSAGMTWPLSACGPLSSMMVSGFQASKPQCTSIYPAFACIALAHVSLAKTDHVAKLRVSVGRVYTSAWILKGMIHXGPLX

SEQ ID NO: 9927 - protein, 53 aa, Homo sapiens
  SITE (11): Xaa equals any amino acid
KYSYCSHLHFXMNESALFCSNFHWKPVGSERLWPPLIIYDLKPACNREPLQSL

SEQ ID NO: 9928 - protein, 90 aa, Homo sapiens [sequence omitted]

SEQ ID NO: 9929 - protein, 485 aa, Homo sapiens [sequence omitted]

SEQ ID NO: 9930 - protein, 485 aa, Homo sapiens [sequence omitted]

SEQ ID NO: 9931 - protein, 149 aa, Homo sapiens
  SITE (87): Xaa equals any amino acid
  SITE (95): Xaa equals any amino acid
  SITE (107): Xaa equals any amino acid
MGAPLLSPGWGAGAAGRRWWMLLAPLLPALLLVRPAGALVEGLYCGTRDCYEVLGVSRSAGKAEIARAYRQLARRYHPDRYRPQPGXEGPGRTPXSAEEAFLLVATXYETLKDEETRKDYDYMLDHPEEYYSHYYHYYSRRLALRWMLE

SEQ ID NO: 9932 - protein, 143 aa, Homo sapiens [sequence omitted]

SEQ ID NO: 9933 - protein, 120 aa, Homo sapiens [sequence omitted]

SEQ ID NO: 9934 - protein, 62 aa, Homo sapiens
  SITE (23): Xaa equals any amino acid
DVLQITFWWPLVTAVSLQGLNKXLSPIPFHTCVVYYWQASVLRVSNGTDGCQTLWISASPGW

SEQ ID NO: 9935 - protein, 96 aa, Homo sapiens; identical to SEQ ID NO: 6986

SEQ ID NO: 9936 - protein, 9 aa, Homo sapiens
LGAFSWSPK

SEQ ID NO: 9937 - protein, 44 aa, Homo sapiens
  SITE (3): Xaa equals any amino acid
LKXITICCLQKTHLHSKGTERMKVKGWERVYWGNITEGNMMNLY

SEQ ID NO: 9938 - protein, 347 aa, Homo sapiens [sequence omitted]

SEQ ID NO: 9939 - protein, 347 aa, Homo sapiens [sequence omitted]

SEQ ID NO: 9940 - protein, 77 aa, Homo sapiens [sequence omitted]

SEQ ID NO: 9941 - protein, 26 aa, Homo sapiens
  SITE (3): Xaa equals any amino acid
  SITE (5): Xaa equals any amino acid
MLXFXFFLLFFFFFWWCCLAFFSFPF

SEQ ID NO: 9942 - protein, 128 aa, Homo sapiens
  SITE (122): Xaa equals any amino acid
MESHLSTWPCHPSCCLFLILLFPSHPTSMTKSKARLPHLENCSQNDTSKPLGQARPPSSPTRTTDLTTGPTSSPAPLGILHTAVRVTHLHTLTLMGEEKAVFVARAQVGNLGLVFRKARGSXFPTLGR

SEQ ID NO: 9943 - protein, 138 aa, Homo sapiens; identical to SEQ ID NO: 6993

SEQ ID NO: 9944 - protein, 71 aa, Homo sapiens
  SITE (18): Xaa equals any amino acid
  SITE (57): Xaa equals any amino acid
FCKGQAALALAACGVLLXSGGPAAAWEADPAGRCGRVPTARGRSWRKPLCGAFQPGXSWPEAPRRCRTSPC

SEQ ID NO: 9945 - protein, 52 aa, Homo sapiens
  SITE (3): Xaa equals any amino acid
  SITE (4): Xaa equals any amino acid
  SITE (25): Xaa equals any amino acid
  SITE (37): Xaa equals any amino acid
  SITE (49): Xaa equals any amino acid
NSXXDPDNVLWPGRWTQFCCIKVKXDFQEEASVGVSXGGYRIGVDENQXKGC

SEQ ID NO: 9946 - protein, 175 aa, Homo sapiens [sequence omitted]

SEQ ID NO: 9947 - protein, 93 aa, Homo sapiens [sequence omitted]

SEQ ID NO: 9948 - protein, 48 aa, Homo sapiens
MSCENNLKKKNTTLLSYLIFLALVMYLTFMFLSSVSTSRISLSNSMII

SEQ ID NO: 9949 - protein, 34 aa, Homo sapiens; identical to SEQ ID NO: 7002

SEQ ID NO: 9950 - protein, 41 aa, Homo sapiens; identical to SEQ ID NO: 7003

SEQ ID NO: 9951 - protein, 434 aa, Homo sapiens [sequence omitted]

SEQ ID NO: 9952 - protein, 286 aa, Homo sapiens
  SITE (173): Xaa equals any amino acid
MLMLMLLMMFAVHCTWVTSNAYSSPSVVLASYNHDGTRNILDDFREAYFWLRQNTDEHARVMSWWDYGYQIAGMANRTTLVDNNTWNNSHIALVGKAMSSNETAAYKIMRTLDVDYVLVIFGGVIGYSGDDINKFLWMVRIAEGEHPKDIRESDYFTPQGEFRVDKAGSPTLXNCLMYKMSYYRFGEMQLDFRTPPGFDRTRNAEIGNKDIKFKHLEEAFTSEHWLVRIYKVKAPDNRETLDHKPRVTNIFPKQKYLSKKTTKRKRGYIKNKLVFKKGKKISKKTV

SEQ ID NO: 9953 - protein, 60 aa, Homo sapiens
MCLWGQANLGLILFQHCLTKFMGGYCFGLGSCTRPLRDQTKMESLILKLQVTEPKLSCFI

SEQ ID NO: 9954 - protein, 31 aa, Homo sapiens; identical to SEQ ID NO: 7025

SEQ ID NO: 9955 - protein, 26 aa, Homo sapiens [sequence omitted]

SEQ ID NO: 9956 - protein, 113 aa, Homo sapiens; identical to SEQ ID NO: 7033

SEQ ID NO: 9957 - protein, 111 aa, Homo sapiens
MFLARVPFLFTIVPFSVLRSMLSKVVRSTEQGTLFACIAFLETLGGVTAVSTFNGIYSATVAWYPGFTFLLSAGLLLLPAISLCVVKCTSWNEGSYELLIQEESSEDASDR

SEQ ID NO: 9958 - protein, 111 aa, Homo sapiens; identical to SEQ ID NO: 9957

SEQ ID NO: 9959 - protein, 37 aa, Homo sapiens
MQRKVSDFIIHQRLTVNLCVISFFFFLPICIFSLAKK

SEQ ID NO: 9960 - protein, 87 aa, Homo sapiens; identical to SEQ ID NO: 7042

SEQ ID NO: 9961 - protein, 131 aa, Homo sapiens
NIFLEWILRRILSLWRGTFLMHGRAGVNRISYWPADPEISLLTEASSSEDAKLDAKAVERLKSNSRAHVCVLLQPLVCYMVQFVEETSYKCDFIQKITKTLPDANTDFYYECKQERIKEYEMLKKKKKKKT

SEQ ID NO: 9962 - protein, 94 aa, Homo sapiens [sequence omitted]

SEQ ID NO: 9963 - protein, 133 aa, Homo sapiens
HQAIKPGYSAENVAHTDHTLGCVTIVWCTCWKNSSMLLGDIISVGNMPLTDFFFFLFAVGLGQLIQQSIFFFFLSPNLNRSKMCSGIPGNRCVCKVKNRLFRNSLFRYLHPASHVKYLSLKGLRCTSFISYFS

SEQ ID NO: 9964 - protein, 104 aa, Homo sapiens; identical to SEQ ID NO: 7047

SEQ ID NO: 9965 - protein, 69 aa, Homo sapiens
  SITE (59): Xaa equals any amino acid
MPTSILLTWHLLTWHLLGCHKTDKSFHVRLDTCQGGVSKLGHRQHPRPGHWVEETVLGXTRREGPGLFP

SEQ ID NO: 9966 - protein, 76 aa, Homo sapiens
  SITE (67): Xaa equals any amino acid
  SITE (74): Xaa equals any amino acid
MIWRSRAGAELFSLMALWEWIALSLHCWVLAVAAVSDQHATSPFDWLLSDKGPFHRSQEYTDFVDRXRQGFSTXYK

SEQ ID NO: 9967 - protein, 24 aa, Homo sapiens
MAGNQQFVNLLLRSVIHSVAYFLS

SEQ ID NO: 9968 - protein, 57 aa, Homo sapiens
  SITE (33): Xaa equals any amino acid
MKVLATSFVLGSLGLAFYLPLVVTTPKTLAIPXEAARSCGESYHQCHNLYCHLWPWL

SEQ ID NO: 9969 - protein, 14 aa, Homo sapiens
MIYQIYGIICSLFP

SEQ ID NO: 9970 - protein, 31 aa, Homo sapiens
GPFCDVTTLHLPGLLCTQCSLDPVDLYLWRS

SEQ ID NO: 9971 - protein, 72 aa, Homo sapiens
MGNFTSYLFLFAFSGIILAFIKNGLAAEIVLILSEAGCSQDKSKMVYLSPGEGKLIKISYFCLVWFCFFLLL

SEQ ID NO: 9972 - protein, 333 aa, Homo sapiens
  SITE (288): Xaa equals any amino acid
MAAAAWLQVLPVILLLLGAHPSPLSFFSAGPATVAAADRSKWHIPIPSGKNYFSFGKILFRNTTIFLKFDGEPCDLSLNITWYLKSADCYNEIYNFKAEEVELYLEKLKEKRGLSGKYQTSSKLFQNCSELFKTQTFSGDFMHRLPLLGEKQEAKENGTNLTFIGDKTAMHEPLQTWQDAPYIFIVHIGISSSKESSKENSLSNLFTMTVEVKGPYEYLTLEDYPLMIFFMVMCIVYVLFGVLWLAWSACYWRDLLRIQFWIGAVIFLGMLEKAVFYAEFQNIRYKGXSVQGALILAELLSAVKRSLARTLVIIVSLGYGIVKPRLESLFIRL

SEQ ID NO: 9973 - protein, 9 aa, Homo sapiens
MPSGACCSP

SEQ ID NO: 9974 - protein, 107 aa, Homo sapiens
MEPLAAYPLKCSGPRAKVFAVLLSIVLCTVTLFLLQLKFLKPKINSFYAFEVKDAKGRTVSLEKYKGKVSLVVNVASDCQLTDRNYLGLKELHKEFGPSHFSVLAFP

SEQ ID NO: 9975 - protein, 209 aa, Homo sapiens; identical to SEQ ID NO: 7078

SEQ ID NO: 9976 - protein, 182 aa, Homo sapiens
  SITE (104): Xaa equals any amino acid
  SITE (147): Xaa equals any amino acid
  SITE (151): Xaa equals any amino acid
  SITE (176): Xaa equals any amino acid
  SITE (179): Xaa equals any amino acid
MLWFSGVGALAERYCRRSPGITCCVLLLLNCSGVPMSLASSFLTGSVAKCENEGEVLQIPFITDNPCIMCVCLNKEVTCKREKCPVLSRDCALAIKQRGACCEXCKGCTYEGNTYNSSFKWQSPAEPCVLRQCQEGVVTESGVRCVXHCKXPLEHLGMCCPTCPGCVFEGVQYQEXEEXQPE

SEQ ID NO: 9977 - protein, 47 aa, Homo sapiens
SSSLLIIYVCMMDVTIYMSCVEIKGCLDAMLILLSMRKYLKKLLHNI

SEQ ID NO: 9978 - protein, 270 aa, Homo sapiens
  SITE (113): Xaa equals any amino acid
  SITE (118): Xaa equals any amino acid
  SITE (157): Xaa equals any amino acid
  SITE (268): Xaa equals any amino acid
GEEFQPEGSKCTKCSCTGGRTQCVREVCPILSCPQHLSHIPPGQCCPKCLGQRKVFDLPFGSCLFRSDVYDNGSSFLYDNCTACTCRDSTVVCKRKCSHPGGCDQGQEGCCEXCLLRXPPEDIKVCKFGNKIFQDGEMWSSINCTICACVKGRTECXNKQCIPISSCPQGKILNRKGCCPICTEKPGVCTVFGDPHYNTFDGRTFNFQGTCQYVLTKDCSSPASPFQVLVKNDARRTRSFSWTKSVELVLGETGSACSSTSPCAGTAXAS

SEQ ID NO: 9979 - protein, 30 aa, Homo sapiens
  SITE (28): Xaa equals any amino acid
MRLFSQMLKSWMALFMRNVWLEMTIATXIQ

SEQ ID NO: 9980 - protein, 170 aa, Homo sapiens
  SITE (159): Xaa equals any amino acid
MRGPAQAKLLPGSAIQALVGLARPLVLALLLVSAALSSVVSRTDSPSPTVLNSHISTPNVNALTHENQTKPSISQISTTLPPTTSTKKSGGASVVPHPSPTPLSQEEADNNEDPSIEEEDLLMLNSSPSTAKDTLDNGDYGEPDYDWTTGPRDDDESDXHLGRKQGLHGN

SEQ ID NO: 9981 - protein, 63 aa, Homo sapiens
  SITE (54): Xaa equals any amino acid
MNHCCSSQRFLNILSFCISPPFPLTFIYLIMYLFIYLYTFAPFSTNTKQSKKKXYIYISVYVL

SEQ ID NO: 9982 - protein, 31 aa, Homo sapiens
  SITE (9): Xaa equals any amino acid
PGPPLSFFXFFFFFFFFFFFFFFKHCIQVSL

SEQ ID NO: 9983 - protein, 84 aa, Homo sapiens; identical to SEQ ID NO: 7088

SEQ ID NO: 9984 - protein, 84 aa, Homo sapiens
  SITE (17): Xaa equals any amino acid
MGTFSLMLLLLPSVVCXSFKVRPLFCRAAVVCSGSTSDPIHLGPSHTWRCHQWRLQNSKDGCLLLPPGSPSQRETDLMLAGMLL

SEQ ID NO: 9985 - protein, 25 aa, Homo sapiens
GLFALSFLFLLVVMLGCQFDIFLAF

SEQ ID NO: 9986 - protein, 68 aa, Homo sapiens
  SITE (68): Xaa equals any amino acid
MISSLLSKAVLSLWISVFSWNVLGCKKLKTIILQCFKEASDLVLRERYLGVVQALSDDFSFCFTILSX

SEQ ID NO: 9987 - protein, 56 aa, Homo sapiens
VSKLFDLVRVALWESTFLSLSLSVPSVCAMFRSSEESKISSEFKIIFVFLLFNVME

SEQ ID NO: 9988 - protein, 275 aa, Homo sapiens
  SITE (71): Xaa equals any amino acid
  SITE (153): Xaa equals any amino acid
MWSYHLIGLIWTSEFILACQQMTIAGAVVTCYFNRSKNDPPDHPILSSLSILFFYHQGTIVKGSFLISVVXIPRIIVMYMQNALKEQQHGALSRYLFRCCYCCFWCLDKYLLHLNQNAYTTTAINGTDFCTSAKDAFKILSKNSSHFTSINCXGDFIIFLGKVLVVCFTVFGGLMAFNYNRAFQVWAVPLLLVAFFAYLVAHSFLSVFETVLDALFLCFAVDLETNDGSSEKPYFMDQEFLSFVKRSNKLNNARAQQDKHSLRNEEGTELQAIVR

SEQ ID NO: 9989 - protein, 85 aa, Homo sapiens
  SITE (8): Xaa equals any amino acid
  SITE (33): Xaa equals any amino acid
MVGLPAVXQLFWGLCLCTCGLYPAPQSWLSSGXYKVTSGAPSERMWPQRHASGFRLSGRTCLRATAPSPSFPFFSAVINLSACSK

SEQ ID NO: 9990 - protein, 85 aa, Homo sapiens
PSVALCWIFFIPLGKWEFFYRPAILLLCQIALYYQDTPMAHFRLTELFLYECTVVIFWAVCEFLVTHPLTTKALSEQYKSIKAQI

SEQ ID NO: 9991 - protein, 353 aa, Homo sapiens [sequence omitted]

SEQ ID NO: 9992 - protein, 81 aa, Homo sapiens
  SITE (67): Xaa equals any amino acid
  SITE (76): Xaa equals any amino acid
  SITE (81): Xaa equals any amino acid
MILGIHWGIFLLLLLSWLELQRTVIFFFSPFPIQKHYTLGHFSFSQRRFMDSQTELCATGKVKREKXADEVTWLHXLHHAX

SEQ ID NO: 9993 - protein, 9 aa, Homo sapiens
WGLLYLELN

SEQ ID NO: 9994 - protein, 73 aa, Homo sapiens
IFLLLLLSWLELQRTVIFFFSPFPIQKHYTLGHFSFSQRRFMDSQTELCATGKVKREKAADEVTWLHVLHHAE

SEQ ID NO: 9995 - protein, 56 aa, Homo sapiens
MWKVLRPSLFTAGLFTASFFYSDLKVSTELMKLQHMVFKSFPLKCTLENWVPQPHY

SEQ ID NO: 9996 - protein, 88 aa, Homo sapiens
  SITE (1): Xaa equals any amino acid
  SITE (19): Xaa equals any amino acid
  SITE (81): Xaa equals any amino acid
XHKTFPSEGSSCLSSVTLXTTAQAYFTLPPPTHHCPLSATKPHYSSNDASLVSGKPIWCTKMLCNTKWLLPLILLNNVNSXRINFMLC

SEQ ID NO: 9997 - protein, 370 aa, Homo sapiens; identical to SEQ ID NO: 7098

SEQ ID NO: 9998 - protein, 370 aa, Homo sapiens
  SITE (216): Xaa equals any amino acid
MHRLIFVYTLICANFCSCRDTSATPQSASIKALRNANLRRDESNHLTDLYRRDETIQVKGNGYVQSPRFPNSYPRNLLLTWRLHSQENTRIQLVFDNQFGLEEAENDICRYDFVEVEDISETSTIIRGRWCGHKEVPPRIKSRTNQIKITFKSDDYFVAKPGFKIYYSLLEDFQPAAASETNWESVTSSISGVSYNSPSVTDPTLIADALDKKIAXFDTVEDLLKYFNPESWQEDLENMYLDTPRYRGRSYHDRKSKVDLDRLNDDAKRYSCTPRNYSVNIREELKLANVVFFPRCLLVQRCGGNCGCGTVNWRSCTCNSGKTVKKYHEVLQFEPGHIKRRGRAKTMALVDIQLDHHERCDCICSSRPPR

SEQ ID NO: 9999 - protein, 159 aa, Homo sapiens
  SITE (153): Xaa equals any amino acid
  SITE (158): Xaa equals any amino acid
MHRLIFVYTLICANFCSCRDTSATPQSASIKALRNANLRRDESNHLTDLYRRDETIQVKGNGYVQSPRFPNSYPRNLLLTWRLHSQENTRIQLVVDNQFGLEEAENDICRYDFVEVEDISETSTIIRGRWCGHKEVPPRIKSRTNHIKITFKXDDYFXA

SEQ ID NO: 10000 - protein, 89 aa, Homo sapiens
  SITE (33): Xaa equals any amino acid
  SITE (63): Xaa equals any amino acid
LIIKKGKIWFPEKRPIPKHFFHEKHCILTYVDXNNLSPKPCHNNISALEIKSLCFLCILLRHXYSFNTYLKNLLRRFFIIVLQKTMYKL

SEQ ID NO: 10001 - protein, 24 aa, Homo sapiens
  SITE (9): Xaa equals any amino acid
  SITE (18): Xaa equals any amino acid
MSWRVWALXFFPAVCVCXCVCVYT

SEQ ID NO: 10002 - protein, 65 aa, Homo sapiens
VLMRSDGFIRGFSPFCWALLLLPPREEGCVCFPFCHDCKFPVASPSLRNCESIKALFFIKKKKKN

SEQ ID NO: 10003 - protein, 37 aa, Homo sapiens; identical to SEQ ID NO: 7100

SEQ ID NO: 10004 - protein, 623 aa, Homo sapiens
  SITE (111): Xaa equals any amino acid
  SITE (575): Xaa equals any amino acid
MFMRIAKAYAALTDEESRKNWEEFGNPDGPQATSFGIALPAWIVDQKNSILVLLVYGLAFMVILPVVVGSWWYRSIRYSGDQILIRTTQIYTYFVYKTRNMDMKRLIMVLXGASEFDPQYNKDATSRPTDNILIPQLIREIGSINLKKNEPPLTCPYSLKARVLLLSHLARMKIPETLEEDQQFMLKKCPALLQEMVNVICQLIVMARNREEREFRAPTLASLENCMKLSQMAVQGLQQFKSPLLQLPHIEEDNLRRVSNHKKYKIKTIQDLVSLKESDRHTLLHFLEDEKYEEVMAVLGSFPYVTMDIKSQVLDDEDSNNITVGSLVTVLVKLTRQTMAEVFEKEQSICAAEEQPAEDGQGETNKNRTKGGWQQKSKGPKKTAKSKKKKPLKKKPTPVLLPQSKQQKQKQANGVVGNEAAVKEDEEEVSDKGSDSEEEETNRDSQSEKDDGSDRDSDREQDEKQNKDDEAEWQELQQSIQRKERALLETKSKITHPVYSLYFPEEKQEWWWLYIADRKEQTLISMPYHVCTLKDTEEVELKFPAPGKPGNYQYTVFLRSDSYMGLDQIKPLEVXKFMRLKPVPENHPQWDTAIEGDEDQEDSEGFEDSFEGGRGREEGRWWT

SEQ ID NO: 10005 - protein, 289 aa, Homo sapiens; identical to SEQ ID NO: 7116

SEQ ID NO: 10006 - protein, 204 aa, Homo sapiens
  SITE (162): Xaa equals any amino acid
  SITE (204): Xaa equals any amino acid
MAALAYNLGKREINHYFSVRSAKVLALVAVLLLAACHLASRRYRGNDSCEYLLSSGRFLGEKVWQPHSCMMHKYKISEAKNCLVDKHIAFIGDSRIRQLFYSFVKIINPQFKEEGNKHENIPFEDKTASVKVDFLWHPEVNGSMKQCIKVWTEDSIAKPHVXVAGAATWSIKIHNGSSEALSQYKMNITFIAPLLEKLAKTSDX

SEQ ID NO: 10007 - protein, 85 aa, Homo sapiens
  SITE (15): Xaa equals any amino acid
ELHKPFEYLIQDNGXVLLLQNNVYVCMYIWFSIYIKGLDEPPKNWLRTLQWNLQASICKSARHKTTCSLRAKRMRFSQILIILNV

SEQ ID NO: 10008 - protein, 305 aa, Homo sapiens [sequence omitted]

SEQ ID NO: 10009 - protein, 136 aa, Homo sapiens
  SITE (133): Xaa equals any amino acid
MACILKRKSVIAVSFIAAFLFLLVVRLVNEVNFPLLLNCFGQPGTKWIPFSYTYRRPLRTHYGYINVKTQEPLQLDCDLCAIVSNSGQMVGQKVGNEIDRSSCIWRMNNAPTKGYEEDVGRMTMIRVVPIPAXLFC

SEQ ID NO: 10010 - protein, 64 aa, Homo sapiens
VFTSAKYYGELSLKCAILDKGLLPTLFCNFDTSIFTPINITKPQFYRWKELLFFCCSLMQFLIL

SEQ ID NO: 10011 - protein, 870 aa, Homo sapiens
  SITE (534): Xaa equals any amino acid
MGPPSLVLCLLSATVFSLLGGSSAFLSHHRLKGRFQRDRRNIRPNIILVLTDDQDVELGSMQVMNKTRRIMEQGGAHFINAFVTTPMCCPSRSSILTGKYVHNHNTYTNNENCSSPSWQAQHESRTFAVYLNSTGYRTAFFGKYLNEYNGSYVPPGWKEWVGLLKNSRFYNYTLCRNGVKEKHGSDYSKDYLTDLITNDSVSFFRTSKKMYPHRPVLMVISHAAPHGPEDSAPQYSRLFPNASQHITPSYNYAPNPDKHWIMRYTGPMKPIHMEFTNMLQRKRLQTLMSVDDSMETIYNMLVETGELDNTYIVYTADHGYHIGQFGLVKGKSMPYEFDIRVPFYVRGPNVEAGCLNPHIVLNIDLAPTILDIAGLDIPADMDGKSILKLLDTERPVNRFHLKKKMRVWRDSFLVERGKLLHKRDNDKVDAQEENFLPKYQRVKDLCQRAEYQTACEQLGQKWQCVEDATGKLKLHKCKGPMRLGGSRALSNLVPKYYGQGSEACTCDSGDYKLSLAGRRKKLFKKKYKASYVRXRSIRSVAIEVDGRVYHVGLGDAAQPRNLTKRHWPGAPEDQDDKDGGDFSGTGGLPDYSAANPIKVTHRCYILENDTVQCDLDLYKSLQAWKDHKLHIDHEIETLQNKIKNLREVRGHLKKKRPEECDCHKISYHTQHKGRLKHRGSSLHPFRKGLQEKDKVWLLREQKRKKKLRKLLKRLQNNDTCSMPGLTCFTHDNQHWQTAPFWTLGPFCACTSANNNTYWCMRTINETHNFLFCEFATGFLEYFDLNTDPYQLMNAVNTLDRDVLNQLHVQLMELRSCKGYKQCNPRTRNMDLGLKDGGSYEQYRQFQRRKWPEMKRPSSKSLGQLWEGWEG

SEQ ID NO: 10012 - protein, 11 aa, Homo sapiens
WQILLIALLLI

SEQ ID NO: 10013 - protein, 21 aa, Homo sapiens
  SITE (15): Xaa equals any amino acid
RWRGASTPHRDYLSXRYCACG

SEQ ID NO: 10014 - protein, 332 aa, Homo sapiens
  SITE (204): Xaa equals any amino acid
  SITE (283): Xaa equals any amino acid
  SITE (305): Xaa equals any amino acid
MEVRKLSISWQFLIVLVLILQILSALDFDPYRVLGVSRTASQADIKKAYKKLAREWHPDKNKDPGAEDKFIQISKAYEILSNEEKRSNYDQYGDAGENQGYQKQQQQREYRFRHFHENFYFDESFFHFPFNSERRDSIDEKYLLHFSHYVNEVVPDSFKKPYLIKITSDWCFSCIHIEPVWKEVIQELEELGVGIGVVHAGYEXRLAHHLGAHSTPSILGIINGKISFFHNAVVRENLRQFVESLLPGNLVEKVTNKNYVRFLSGWQQENKPHVLLFDQTPIXPLLYKLTAFAYKDYLSFGYVYXGLRGTEEMTRRYNINIYAPTLLALKNI

SEQ ID NO: 10015 - protein, 204 aa, Homo sapiens
MMPLLSLIFSALFILFGTVIVQAFSDSNDERESSPPEKEEAQEKTGKTEPSFTKENSSKIPKKGFVEVTELTDVTYTSNLVRLRPGHMNVVLILSNSTKTSLLQKFALEVYTFTGSSCLHFSFLSLDKHREWLEYLLEFAQDAAPIPNQYDKHFMERDYTGYVLALNGHKKYFCLFKPQKTVEEEEAIGSCSDVDSSLYLGESR

SEQ ID NO: 10016 - protein, 42 aa, Homo sapiens; identical to SEQ ID NO: 7123

SEQ ID NO: 10017 - protein, 111 aa, Homo sapiens
CGSHRMSWKMYCPLHFSGRVCEELKFFFSFFFFLRRSLTPAQATAGDSVSKKQREERKKEKKEGRRKEGRNEGTKEGRKRKEGRKKERERERKKERKKERKKEKKKKKTGT

SEQ ID NO: 10018 - protein, 52 aa, Homo sapiens [sequence omitted]

SEQ ID NO: 10019 - protein, 70 aa, Homo sapiens
MENPTSTPTLPCFLFFFSPRSLDVLTPPHCLLSGTGWDLEEDKAFLDYPSYSVSLFLTQRGRQNQSGLFQ

SEQ ID NO: 10020 - protein, 56 aa, Homo sapiens; identical to SEQ ID NO: 7128

SEQ ID NO: 10021 - protein, 75 aa, Homo sapiens
EDMPRRKEELTDYQKKKVILQNLKHSLFLSLLSHYFYSNPLEYLHFASEQRDKFFSHHVCTGVVLILDIAGTNFS

SEQ ID NO: 10022 - protein, 135 aa, Homo sapiens
VVGTGTSLALSSLLSLLLFAGMQMYSRQLASTEWLTIQGGLLGSGLFVFSLTAFNNLENLVFGKGFQAKIFPEILLCLLLALFASGLIHRVCVTTCFIFSMVGLYYINKISSTLYQAAAPVLTPAKVTGKSKKRN

SEQ ID NO: 10023 - protein, 55 aa, Homo sapiens; identical to SEQ ID NO: 7132

SEQ ID NO: 10024 - protein, 75 aa, Homo sapiens; identical to SEQ ID NO: 10021

SEQ ID NO: 10025 - protein, 318 aa, Homo sapiens
MRLLAGWLCLSLASVWLARRMWTLRSPLTRSLYVNMTSGPGGPAAAAGGRKENHQWYVCNREKLCESLQAVFVQSYLDQGTQIFLNNSIEKSGWLFIQLYHSFVSSVFSLFMSRTSINGLLGRGSMFVFSPDQFQRLLKINPDWKTHRLLDLGAGDGEVTKIMSPHFEEIYATELSETMIWQLQKKKYRVLGINEWQNTGFQYDVISCLNLLDRCDQPLTLLKDIRSVLEPTRGRVILALVLPFHPYVENVGGKWEKPSEILEIKGQNWEEQVNSLPEVFRKAGFVIEAFTRLPYLCEGDMYNDYYVLDDAVFVLKPV

SEQ ID NO: 10026 - protein, 97 aa, Homo sapiens
  SITE (87): Xaa equals any amino acid
  SITE (92): Xaa equals any amino acid
LGAEHFKCITWVAGWAVPGLKGVGSFFQGAPSASWHRTLAPAHPKLTLVGVGPLTQTWPLPSLVLLPQLSPVCGRVCLDRLWAGQGXGQAEXEFVLG

SEQ ID NO: 10027 - protein, 42 aa, Homo sapiens
YTFQCLSQTCSYDIKCYFLVAKIILDSVIKVYWNLNFKMSPD

SEQ ID NO: 10028 - protein, 195 aa, Homo sapiens
  SITE (159): Xaa equals any amino acid
  SITE (175): Xaa equals any amino acid
MWTLFALSGPLFLFQVLTFMIYIVSTVFCGHLGKVELASVTLAVAFVNVCGVSVGVGLSSACDTLMSQSFGSPNKKHVGVILQRGALVLLLCCLPCWALFLNTQHILLLFRQDPDVSRLTQDYVMIFIPGLPVIFLYNLLAKYLQNQVQVFSVWGGPSXSTLPYSSGRGAWGFPXLSTICEPALERGSLPTHLPY

SEQ ID NO: 10029 - protein, 3 aa, Homo sapiens
IPG

SEQ ID NO: 10030 - protein, 37 aa, Homo sapiens
LAGPVFIYFRRSPGPKSSVVWWATVSTVWPTMPWFLC

SEQ ID NO: 10031 - protein, 160 aa, Homo sapiens
  SITE (146): Xaa equals any amino acid
  SITE (151): Xaa equals any amino acid
MRLLCGLWLWLSLLKVLQAQTPTPLPLPPPMQSFQGNQFQGEWFVLGLAGNSFRPEHRALLNAFTATFELSDDGRFEVWNAMTRGQHCDTWSYVLIPAAQPGQFTVDHGVGRSWLLPPGTLDQFICLGRAQGLSDDNIVFPDVTGXALDLXSLPWVAAPA

SEQ ID NO: 10032 - protein, 110 aa, Homo sapiens; identical to SEQ ID NO: 7142

SEQ ID NO: 10033 - protein, 382 aa, Homo sapiens
GPERGRYYPKSHKNVDLNDVLVPKPFSQFWQPLLRGLHSQNFTQALLERMLSELPALGISGIRPTYILRWTVELIVANTKTGRNARRFSAGQWEARRGWRLFNCSASLDWPRMVESCLGSPCWASPQLLRIIFKAMGQGLPDEEQEKLLRICSIYTQSGENSLVQEGSEASPIGKSPYTLDSLYWSVKPASSSFGSEAKAQQQEEQGSVNDVKEEEKEEKEVLPDQVEEEEENDDQEEEEEDEDDEDDEEEDRMEVGPFSTGQESPTAENARLLAQKRGALQGSAWQVSSEDVRWDTFPLGRMPGQTEDPAELMLENYDTMYLLDQPVLEQRLEPSTCKTDTLGLSCGVGSGNCSNSSSSNFEGLLWSQGQLHGLKTGLQLF

SEQ ID NO: 10034 - protein, 159 aa, Homo sapiens [sequence omitted]

SEQ ID NO: 10035 - protein, 157 aa, Homo sapiens
MRPRGLPPLLVVLLGCWASVSAQTDATPAVTTEGLNSTEAALATFGTFPSTRPPGTPRAPGPSSGPRPTPVTDVAVLCVCDLSPAQCDINCCCDPDCSSVDFSVFSACSVPVVTGDSQFCSQKAVIYSLNFTANPPQRVFELVDQINPSIFCIHITN

SEQ ID NO: 10036 - protein, 587 aa, Homo sapiens; identical to SEQ ID NO: 7145

SEQ ID NO: 10037 - protein, 67 aa, Homo sapiens
  SITE (12): Xaa equals any amino acid
KDKCILLKRQSXTHEEQCKLKPNQRLGVAAMPVIPALWEAEVGRLLEIRSLSLGNIVKPCLYKKYKN

SEQ ID NO: 10038 - protein, 114 aa, Homo sapiens
MVTRAGAGTAVAGAVVVALLSAALALYGPPLDAVLERAFSLRKAHSIKDMENTLQLVRNIIPPLSSTKHKGQDGRIGVVGGCQEYTGAPYFAESQLSKWAQTCPTCSVPVRPHL

SEQ ID NO: 10039 - protein, 114 aa, Homo sapiens; identical to SEQ ID NO: 10038

SEQ ID NO: 10040 - protein, 114 aa, Homo sapiens; identical to SEQ ID NO: 10038

SEQ ID NO: 10041 - protein, 114 aa, Homo sapiens; identical to SEQ ID NO: 10038

SEQ ID NO: 10042 - protein, 167 aa, Homo sapiens; identical to SEQ ID NO: 7399
  SITE (140): Xaa equals any amino acid

SEQ ID NO: 10043 - protein, 52 aa, Homo sapiens
MPAVSAFFSLAALAEVAAMENVHRGQRSTPLTHDGQPKEMPQAPVLISCADQ

SEQ ID NO: 10044 - protein, 186 aa, Homo sapiens
  SITE (122): Xaa equals any amino acid
  SITE (136): Xaa equals any amino acid
  SITE (142): Xaa equals any amino acid
MKTLMTICPGTVLLVFSISLWIIAAWTVRVCESPESPAQPSGSSLPAWYHDQQDVTSNFLGAMWLISITFLSIGYGDMVPHTYCGKGVCLLTGIMGAGCTALVVAVVARKLELTKAEKHVHXFMMDTQLTKRIKNXAANVLXETWLIYKHTKLLKKIDHAKVRNTRGSSSKYPPVEERQDGTEEAE

SEQ ID NO: 10045 - protein, 36 aa, Homo sapiens
MLSFKLLLLAVALGFFEGDAKFGERNEGSGQGGEGA

SEQ ID NO: 10046 - protein, 404 aa, Homo sapiens
  SITE (41): Xaa equals any amino acid
  SITE (77): Xaa equals any amino acid
  SITE (96): Xaa equals any amino acid
  SITE (98): Xaa equals any amino acid
  SITE (108): Xaa equals any amino acid
  SITE (122): Xaa equals any amino acid
  SITE (124): Xaa equals any amino acid
  SITE (126): Xaa equals any amino acid
  SITE (175): Xaa equals any amino acid
  SITE (192): Xaa equals any amino acid
  SITE (210): Xaa equals any amino acid
  SITE (236): Xaa equals any amino acid
  SITE (239): Xaa equals any amino acid
  SITE (309): Xaa equals any amino acid
  SITE (335): Xaa equals any amino acid
  SITE (389): Xaa equals any amino acid
MHPIPSSFMIKAVSSFLTAEEASVGNPEGAFMKVLQARKNXTSTELIVEPEEPSDSSGINLSGFGSEQLDTNDESDXISTLSYILPYFSAVNLDVXSXLLPFIKLPTXGNSLAKIQTVGQNXQXVXRVLMGPRSIQKRHFKEVGRQSIRREQGAQASVENAAEEKRLGSPAPREXEQPHTQQGPEKLAGNAXYTKPSFTQEHKAAVSVLXPFSKGAPSTSSPAKALPQVRDRWKDXTHXISILESAKARVTNMKASKPISHSRKKYRFHKTRSRMTHRTPKVKKSPKFRKKSYLSRLMLANRPPFSAAXSLINSPSQGAFSSLGDLSPQENPFLXVSAPSEHFIETTNIKDTTARNALEENVFMENTNMPEVTISENTNYNHPPEADSXGTAFNLGPTVKQTET

SEQ ID NO: 10047 - protein, 45 aa, Homo sapiens
MVTSGMLVFSIKTFSSKAFLAVVSFILVVSIKCSEGADTSRKGFS

SEQ ID NO: 10048 - protein, 45 aa, Homo sapiens; identical to SEQ ID NO: 10047

SEQ ID NO: 10049 - protein, 404 aa, Homo sapiens; identical to SEQ ID NO: 10046
  SITE (41): Xaa equals any amino acid
  SITE (77): Xaa equals any amino acid
  SITE (96): Xaa equals any amino acid
  SITE (98): Xaa equals any amino acid
  SITE (108): Xaa equals any amino acid
  SITE (122): Xaa equals any amino acid
  SITE (124): Xaa equals any amino acid
  SITE (126): Xaa equals any amino acid
  SITE (175): Xaa equals any amino acid
  SITE (192): Xaa equals any amino acid
  SITE (210): Xaa equals any amino acid
  SITE (236): Xaa equals any amino acid
  SITE (239): Xaa equals any amino acid
  SITE (309): Xaa equals any amino acid
  SITE (335): Xaa equals any amino acid
  SITE (389): Xaa equals any amino acid

SEQ ID NO: 10050 - protein, 136 aa, Homo sapiens; identical to SEQ ID NO: 7168

SEQ ID NO: 10051 - protein, 113 aa, Homo sapiens
MARGSLRRLLRLLVLGLWLALLRSVAGEQAPGTAPCSRGSSWSADLDKCMDCASCRARPHSDFCLGCAAAPPAPFRLLWPILGGALSLTFVLGLLSGFLVWRRCRRERSSPPP

SEQ ID NO: 10052 - protein, 185 aa, Homo sapiens; identical to SEQ ID NO: 5679

SEQ ID NO: 10053 - protein, 178 aa, Homo sapiens [sequence omitted]

SEQ ID NO: 10054 - protein, 13 aa, Homo sapiens
  SITE (13): Xaa equals any amino acid
MFKCLQTTFLFIX

SEQ ID NO: 10055 - protein, 78 aa, Homo sapiens
MRPLLGLLLVFAGCTFALYLLSTRLPRGRRLGSTEEAGGRSLWFPSDLAELRELSEVLREYRKEHQAYVFLLFCGAYL

SEQ ID NO: 10056 - protein, 181 aa, Homo sapiens; identical to SEQ ID NO: 7176

SEQ ID NO: 10057 - protein, 54 aa, Homo sapiens
  SITE (4): Xaa equals any amino acid
  SITE (23): Xaa equals any amino acid
IETXRFGGKQMELQEIKSIISSXMWWLMPLILVTQEAEAGGSLEARSLRPPWAT

SEQ ID NO: 10058 - protein, 47 aa, Homo sapiens
SQLLRKLRWEDGLSLGGRVCSEPRLHHCTPAWVIGPGLVLTTTTEKK

SEQ ID NO: 10059 - protein, 13 aa, Homo sapiens
WPSSSRTLSSSRR

SEQ ID NO: 10060 - protein, 166 aa, Homo sapiens; identical to SEQ ID NO: 7183

SEQ ID NO: 10061 - protein, 314 aa, Homo sapiens
  SITE (147): Xaa equals any amino acid
  SITE (211): Xaa equals any amino acid
MLPARLPFRLLSLFLRGSAPTAARHGLREPLLERRCAAASSFQHSSSLGRELPYDPVDTEGFGEGGDMQERFLFPEYILDPEPQPTREKQLQELQQQQEEEERQRQQRREERRQQNLRARSREHPVVGHPDPALPPSGVNCSGCGAXLHCQDAGVPGYLPREKFLRTAEADGGLARTVCQRCWLLSHHRRALRLQVSREQYLELVSAALRXPGPSLVLYMVDLLDLPDALLPDLPALVGPKQLIVLGNKVDLLPQDAPGYRQRLRERLWEDCARAGLLLAPGTKGHSAPSRTSHRTGRIRIRRTGPAQWSGTCG

SEQ ID NO: 10062 - protein, 118 aa, Homo sapiens
  SITE (107): Xaa equals any amino acid
MVFVHLYLGNVLALLLFVHYSNGDESSDPGPQHRAQGPGPEPTLGPLTRLEGIKVGHERKVQLVTDRDHFIRTLSLKPLLFEIPGFLTDEECRLIIHLAQMKGLQRXRSCLLKSMKRQ

SEQ ID NO: 10063 - protein, 265 aa, Homo sapiens
  SITE (22): Xaa equals any amino acid
PKLELHRGGGRSRTSGSPGLQXFGTRRTRGRSGRAQGRLKRPGKLACRKFPGRRQRVVPELTDVLMNEILHGADGTSIKCGIIGEIGCSWPLTESERKVLQATAHAQAQLGCPVIIHPGRSSRAPFQIIRILQEAGADISKTVMSHLDRTILDKKELLEFAQLGCYLEYDLFGTELLHYQLGPDIDMPDDNKRIRRVRLLVEEGCEDRILVAHDIHTKTRLMKYGGHGYSHILTNVVPKMLLRGITENVLDKILIENPKQWLTFK

SEQ ID NO: 10064 - protein, 71 aa, Homo sapiens
  SITE (64): Xaa equals any amino acid
MAHVVVARNECLIRAFLFLLHCVSLLPSPGEVNIRHTLFTVEERLTTPRALKLSLSLIVSLHAXCRKQECS

SEQ ID NO: 10065 - protein, 99 aa, Homo sapiens
  SITE (44): Xaa equals any amino acid
MLLLLVFLVACFINRKCQKQRKKKPAEDILEEYPLNTKVEVPKXHPDRVEKNVNRHYCTVRNVNILSEPEAAYTFKGAKVKRLNLEVRVHNNLQDGTEV

SEQ ID NO: 10066 - protein, 5 aa, Homo sapiens
MPVLL

SEQ ID NO: 10067 - protein, 255 aa, Homo sapiens
LLLWTMSVIFFACVVRVRDGLPLSASTDFYHTQDFLEWRRRLKSLALRLAQYPGRGSAEGCDFSIHFSSFGDVACMAICSCQCPAAMAFCFLETLWWEFTASYDTTCIGLASRPYAFLEFDSIIQKVKWHFNYVSSSQMECSLEKIQEELKLQPPAVLTLEDTDVANGVMNGHTPMHLEPAPNFRMEPVTALGILSLILNIMCAALNLIRGVHLAEHSLQVAHEEIGNILAFLVPFVACIFQDPRSWFCWLDQTS

SEQ ID NO: 10068 - protein, 491 aa, Homo sapiens
  SITE (42): Xaa equals any amino acid
  SITE (43): Xaa equals any amino acid
  SITE (44): Xaa equals any amino acid
AARVGRHGRRRRSAAMAGRGGSALLALCGALAACGWLLGAEXXXPGAPAAGMRRRRRLQQEDGISFEYHRYPELREALVSVWLQCTAISRIYTVGRSFEGRELLVIELSDNPGVHEPGEPEFKYIGNMHGNEAVGRELLIFLAQYLCNEYQKGNETIVNLIHSTRIHIMPSLNPDGFEKAASQPGELKDWFVGRSNAQGIDLNRNFPDLDRIVYVNEKEGGPNNHLLKNMKKIVDQNTKLAPETKAVIHWIMDIPFVLSANLHGGDLVANYPYDETRSGSAHEYSSSPDDAIFQSLARAYSSFNPAMSDPNRPPCRKNDDDSSFVDGTTNGGAWYSVPGGMQDFNYLSSNCFEITVELSCEKFPPEETLKTYWEDNKNSLISYLEQIHRGVKGFVRDLQGNPIANATISVEGIDHDVTSAKDGDYWRLLIPGNYKLTASAPGYLAITKKVAVPYSPAAGVDFELESFSERKEEEKEELMEWWKMMSETLNF

SEQ ID NO: 10069 - protein, 56 aa, Homo sapiens [sequence omitted]

SEQ ID NO: 10070 - protein, 4 aa, Homo sapiens
VWMP

SEQ ID NO: 10071 - protein, 53 aa, Homo sapiens
CLILQEENRKELSNLANRYKIDSRVLSPTLGWQPVGQTPKTVADVFFCLPSLG

SEQ ID NO: 10072 - protein, 17 aa, Homo sapiens
GIVLLIGVLVQVSAVDD

SEQ ID NO: 10073 - protein, 53 aa, Homo sapiens
ILLCSWPTGLVGGRDPGSSRGSSASLTPSPGRQPCSRRRGYSVGRRSSPPDGS

SEQ ID NO: 10074 - protein, 129 aa, Homo sapiens [sequence omitted]

SEQ ID NO: 10075 - protein, 438 aa, Homo sapiens
  SITE (42): Xaa equals any amino acid
LTITVHDPNAAQWYYGMSWGLRLYIPGFDVGTMFTIQKKILXSWSPPKPIRPLTDLGDPIFQKHPDKVDLTVPQPFLVPRPQLQQQHLQPSLMSILGGVHHLLNLTQPKLAQDCWLCLKAKPPYYVGLGVEATLKRGPLSCHTRPRALTIGDVSGNASCLISTGYNLSASPFQATCNQSLLTYISTSVSYQAPNNTWLACTSGLTRCINGTEPGPLLCVLVHVLPQVYVYSGPEGRQLIAPPELHPRLHQAVPLLVPLLAGLSIAGSAAIGTAALVQGETGLISLSQQVDADFSNLQSAIDILHSQVESLAEVVLQNCRCLDLLFLSQGGLCAALGESCCFYANQSGVIKGTVKKVRENLDRHQQERENNIPWYQSMFNWNPWLTTLITGLAGPLLILLLSLIFGPCILNSFLNFIKQRIASVKLTYLKTQYDTLVNN

SEQ ID NO: 10076 - protein, 63 aa, Homo sapiens [sequence omitted]

SEQ ID NO: 10077 - protein, 85 aa, Homo sapiens
  SITE (81): Xaa equals any amino acid
  SITE (84): Xaa equals any amino acid
MDILMLLLLLCVIYGRFSQDEYSLNQAIRKEFTRNARNCLGGLRNIADWWDWSLTTLLDGLYPGGTPSARVPGASAWSSWXKMXT

SEQ ID NO: 10078 - protein, 114 aa, Homo sapiens
  SITE (7): Xaa equals any amino acid
  SITE (22): Xaa equals any amino acid
  SITE (24): Xaa equals any amino acid
  SITE (111): Xaa equals any amino acid
QRAMACXFGILLIVSATLCFGXLXGFLMTLPQKRKSFQSKSFVRLKDVTAYMWEKVLTFLRLETPKLEEAEMVENHNYYLDEFANLLDELLMKINGLSDSLQLPLLEKTSXNTG

SEQ ID NO: 10079 - protein, 59 aa, Homo sapiens [sequence omitted]

SEQ ID NO: 10080 - protein, 30 aa, Homo sapiens
  SITE (21): Xaa equals any amino acid
MKTLFLGVTLGLALPCPSPWXRRISQGPGT

SEQ ID NO: 10081 - protein, 155 aa, Homo sapiens
MASSLAFLLLNFHVSLLLVQLLTPCSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSNLHVGSEGL

SEQ ID NO: 10082 - protein, 264 aa, Homo sapiens
  SITE (196): Xaa equals any amino acid
  SITE (224): Xaa equals any amino acid
  SITE (233): Xaa equals any amino acid
MLRLFETFLETAPQLTLVLAIMLQSGRAEYYQWVGICTSFLGISWALLDYHRALRTCLPSKPLLGLGSSVIYFLWNLLLLWPRVLAVALFSALFPSYVALHFLGLWLVLLLWVWLQGTDFMPDPSSEWLYRVTVATILYFSWFNVAEGRTRGRAIIHFAFLLSDSILLVATWVTHSSWLPSGIPLQLWLPVGCGCXFLGLALRLVYYHWLHPSCCWKPDPDQVXGARSLLSPXGYQLPQNRRMTHLAQKFFPKAKDEAASPVKG

SEQ ID NO: 10083 - protein, 115 aa, Homo sapiens
  SITE (60): Xaa equals any amino acid
  SITE (73): Xaa equals any amino acid
  SITE (75): Xaa equals any amino acid
  SITE (82): Xaa equals any amino acid
LPYPGLGGHRGCPLEFFLPSPTPFIQFMKQIFAKSSLCARNIILSLQPGTRPATSLASSXTCTNQSRVRSQMXEXRDAQLWXAPVRTSGISVKLAWPLLLLSRGCFSTKSLVSLV

SEQ ID NO: 10084 - protein, 448 aa, Homo sapiens
MAWASRLGLLLALLLPVVGASTPGTVVRLNKAALSYVSEIGKAPLQRALQVTVPHFLDWSGEALQPTRIRILNVHVPRLHLKFIAGFGVRLLAAANFTFKVFRAPEPLELTLPVELLADTRVTQSSIRTPVVSISACSLFSGHANEFDGSNSTSHALLVLVQKHIKAVLSNKLCLSISNLVQGVNVHLGTLIGLNPVGPESQIRYSMVSVPTVTSDYISLEVNAVLFLLGKPIILPTDATPFVLPRHVGTEGSMATVGLSQQLFDSALLLLQKAGALNLDITGQLRSDDNLLNTSALGRLIPEVARQFPEPMPVVLKVRLGATPVAMLHTNNATLRLQPFVEVLATASNSAFQSLFSLDVVVNLRLQLSVSKVKLQGTTSVLGDVQLTVASSNVGFIDTDQVRTLMGTVFEKPLLDHLNALLAMGIALPGVVNLHYVPLRSLSMRATW

SEQ ID NO: 10085 - protein, 246 aa, Homo sapiens
  SITE (213): Xaa equals any amino acid
MAAAAATKILLCLPLLLLLSGWSRAGRADPHSLCYDITVIPKFRPGPRWCAVQGQVDEKTFLHYDCGNKTVTPVSPLGKKLNVTTAWKAQNPVLREVVDILTEQLRDIQLENYTPKEPLTLQARMSCEQKAEGHSSGSWQFSFDGQIFLLFDSEKRMWTTVHPGARKMKEKWENDKVVAMSFHYFSMGDCIGWLEDFLMGMDSTLEPSAGAPXAMSSGTTQLRATATTLILCCLLIILPCFILPGI

SEQ ID NO: 10086 - protein, 108 aa, Homo sapiens
MFVSVTAFFFSLLFLGMFLSGMVAQIDANWNFLDFAYHFTVFVFYFGAFLLEAAATSLHDLHCNTTITGQPLLSDNQYNINVAASIFAFMTTAWYGCSLGLALRRWRP

SEQ ID NO: 10087 - protein, 108 aa, Homo sapiens
MFVSVTAFFFSLLFLGMFLSGMVAQIDANWNFLDFAYHFTVFVFYFGAFLLEAAATSLHDLHCNTTITGQPLLSDNQYNINVAASIFAFMTTACYGCSLGLALRRWRP

SEQ ID NO: 10088 - protein, 77 aa, Homo sapiens
NHIQHKNYFWLNSTEKYFNLPVEILVMERCQTVLNGRTSKSEATVPTTRGLLYCSTFSALYFLAEASPWSAMYKLGY

SEQ ID NO: 10089 - protein, 128 aa, Homo sapiens
MDRLKSHLTVCFLPSVPFLILVSTLATAKSVTNSTLNGTNVVLGSVPVIIARTDHIIVKEGNSALINCSVYGIPDPQFKWYNSIGKLLKEEEDEKERGGGKWQMHDSGLLNITKVSFSDRGKYTVCGF

SEQ ID NO: 10090 - protein, 120 aa, Homo sapiens
  SITE (5): Xaa equals any amino acid
  SITE (7): Xaa equals any amino acid
  SITE (8): Xaa equals any amino acid
  SITE (14): Xaa equals any amino acid
  SITE (40): Xaa equals any amino acid
LEFKXPXXQVPPWXWLSLFKKYRSATIANARTWVFCSFFXVLILLFLYNGVIVINTNCSFWFSPHCHFCPYVSLEHVPQRLWYQSPVPGLISTSHITFVMFQSSYEACYFFFIPQAYFHR

SEQ ID NO: 10091 - protein, 110 aa, Homo sapiens
  SITE (89): Xaa equals any amino acid
  SITE (96): Xaa equals any amino acid
  SITE (104): Xaa equals any amino acid
MYLQIPVKHMLHSGYQATFFSPKIGCSSILVFVCLLVFLRQSLALLPRLEYSGAILAHCNLHLLGSSDSPASASPVAGITGMHHHTQLXFCTFSRXGIYQLASXSPNPDL

SEQ ID NO: 10092 - protein, 57 aa, Homo sapiens
FNTPKIFFGTYHRQGTLISTGDTISCLGLLCSSAAREGIAICRILKKHKHKGAKLYI

SEQ ID NO: 10093 - protein, 117 aa, Homo sapiens; identical to SEQ ID NO: 7237

SEQ ID NO: 10094 - protein, 58 aa, Homo sapiens; identical to SEQ ID NO: 7238

SEQ ID NO: 10095 - protein, 74 aa, Homo sapiens
LYGKSKTEVKISPVSNLHSFRLQGVSLYVEAGSLVEFQGSKRGTNICRFCLLWGNSFNHQENSSIGFICSGLPR

SEQ ID NO: 10096 - protein, 71 aa, Homo sapiens; identical to SEQ ID NO: 7240

SEQ ID NO: 10097 - protein, 10 aa, Homo sapiens
FSCCLSLPIS

SEQ ID NO: 10098 - protein, 21 aa, Homo sapiens
MSLSLISLSFLFPAGAGRRSC

SEQ ID NO: 10099 - protein, 74 aa, Homo sapiens
ARREGRSRTAVGSTPAAPLSLTRGGQCPSRGSPLALFGHPLASQKHSETKTFPFPPPHMVLRLPAAMQLKQLIF

SEQ ID NO: 10100 - protein, 134 aa, Homo sapiens; identical to SEQ ID NO: 7247

SEQ ID NO: 10101 - protein, 71 aa, Homo sapiens; identical to SEQ ID NO: 7249

SEQ ID NO: 10102 - protein, 4 aa, Homo sapiens
APRG

SEQ ID NO: 10103 - protein, 67 aa, Homo sapiens
PIPWLCPPSPTLPLLSIFFLPTHPPPPSRRGGLGRPRPSLEKPSLSSAVVPPPNPITAAHPILTVIL

SEQ ID NO: 10104 - protein, 45 aa, Homo sapiens; identical to SEQ ID NO: 7252

SEQ ID NO: 10105 - protein, 177 aa, Homo sapiens; identical to SEQ ID NO: 7255
  SITE (67): Xaa equals any amino acid

SEQ ID NO: 10106 - protein, 173 aa, Homo sapiens
  SITE (76): Xaa equals any amino acid
  SITE (124): Xaa equals any amino acid
MLGSPCLLWLLAVTFLVPRAQPLAPQDFEEEEADETETAWPPLPAVPCDYDHCRHLQVPCKELQRVGPAACLCPGXSSPAQPPDPPRMGEVRIAAEEGRAVVHWCAPFSPVLHYWLLLWDGSEXRRRGPPLNATVRRAELKGLKPGGIYVVCVVAANEAGASRVPQAGGEGLE

SEQ ID NO: 10107 - protein, 143 aa, Homo sapiens
MRRALIPPCRGGPSASDRCCSCSPSGFSAGRGRCPVQGCLRPHRVQLLRRWGPGSPAGQRLSKGFQLLRWWGPGSPAPEPRKGPFPPPDPPWPVTAVTVMAGSVPSAQSVDALESPGPLALEGPSSPRNLLWREMSIFLPGIF

SEQ ID NO: 10108 - protein, 96 aa, Homo sapiens
  SITE (18): Xaa equals any amino acid
MRRALIPPCRGGPSASDXCCSCSPSGFSAGRGRCPVQGCLRPHRVQLLRRWGPGSPAGQRLSKGFQLLRWWGPGSPAPEPRKGPFPPPDPPWPVTL

SEQ ID NO: 10109 - protein, 125 aa, Homo sapiens [sequence omitted]

SEQ ID NO: 10110 - protein, 6 aa, Homo sapiens
  SITE (4): Xaa equals any amino acid
GTQXAL

SEQ ID NO: 10111 - protein, 156 aa, Homo sapiens; identical to SEQ ID NO: 7263

SEQ ID NO: 10112 - protein, 58 aa, Homo sapiens
MWTKNDKLKKFFFLRYLQNMVYFYVEKKSYEGSCYFKRKFIKSPRGMKMTACFSIILA

SEQ ID NO: 10113 - protein, 63 aa, Homo sapiens
LKSCLLLVSFLSGRVPSYDLIYVCSIALETGFVCEMALSFVDHFCREIVDLGRAEATADMPGV

SEQ ID NO: 10114 - protein, 36 aa, Homo sapiens
MCFILVVCFASLITECPCHCKCCRDVGRGPTVLYEM

SEQ ID NO: 10115 - protein, 419 aa, Homo sapiens
MKALLLLVLPWLSPANYIDNVGNLHFLYSELCKGASHYGLTKDRKRRSQDGCPDGCASLTATAPSPEVSAAATISLMTDEPGLDNPAYVSSAEDGQPAISPVDSGRSNRTRARPFERSTIRSRSFKKINRALSVLRRTKSGSAVANHADQGRENSENTTAPEVFPRLYHLIPDGEITSIKINRVDPSESLSIRLVGGSETPLVHIIIQHIYRDGVIARDGRLLPGDIILKVNGMDISNVPHNYAVRLLRQPCQVLWLTVMREQKFRSRNNGQAPDAYRPRDDSFHVILNKSSPEEQLGIKLVRKVDEPGVFIFNVLDGGVAYRHGQLEENDRVLAINGHDLRYGSPESAAHLIQASERRVHLVVSRQVRQRSPDIFQEAGWNSNGSWSPGPGERSNTPKPLHPTITCHEKVVNIQKRPR

SEQ ID NO: 10116 - protein, 306 aa, Homo sapiens
MKALLLLVLPWLSPANYIDNVGNLHFLYSELCKGASHYGLTKDRKRRSQDGCPDGCASLTATAPSPEVSAAATISLMTDEPGLDNPAYVSSAEDGQPAISPVDSGRSNRTRARPFERSTIRSRSFKKINRALSVLRRTKSGSAVANHADQGRENSENTTAPEVFPRLYHLIPDGEITSIKINRVDPSESLSIRLVGGSETPLVHIIIQHIYRDGVIARDGRLLPGDIILKVNGMDISNVPHNYAVRLLRQPCQVLWLTVMREQKFRSRNNGQAPDAYRPRDDSFHVILNKSRPRGAAWNKTGAQGG

SEQ ID NO: 10117 - protein, 50 aa, Homo sapiens; identical to SEQ ID NO: 7277

SEQ ID NO: 10118 - protein, 492 aa, Homo sapiens [sequence omitted]

SEQ ID NO: 10119 - protein, 128 aa, Homo sapiens
MGSAPWAPVLLLALGLRGLQAGARRAPDPGFQERFFQQRLDHFNFERFGNKTFPQRFLVSDRFWVRGEGPIFFYTGNEGDVWAFANNSAFVAELAAERGALLVFAEHRYYGKSLPFGAQSTQRGTRSC

SEQ ID NO: 10120 - protein, 63 aa, Homo sapiens
  SITE (50): Xaa equals any amino acid
  SITE (52): Xaa equals any amino acid
MECGLPKFAGCLFMILCLWNCPEAMECEDGFHCSSVGLLVFASIFYNKKXEXCWIIQGYILAS

SEQ ID NO: 10121 - protein, 243 aa, Homo sapiens
MRPQGPAASPQRLRGLLLLLLLQLPAPSSASEIPKGKQKAQLRQREVVDLYNGMCLQGPAGVPGRDGSPGANGIPGTPGIPGRDGFKGEKGECLRESFEESWTPNYKQCSWSSLNYGIDLGKIAECTFTKMRSNSALRVLFSGSLRLKCRNACCERWYFTFNGAECSGPLPIEAIIYLDQGSPEMNSTINIHRTSSVEGLCEGIGAGLVDVAIWVGTCSDYPKGDASTGWNSVSRIIIEELPK

SEQ ID NO: 10122 - protein, 93 aa, Homo sapiens [sequence omitted]

SEQ ID NO: 10123 - protein, 103 aa, Homo sapiens
MPLCSLLTCLGLNVLFLTLNEGAWYSVGALMISVPALLGYLQEVCRARLPDSELMRRKYHSVRQEDLQRVRLSRPEAVAEVKSFLIQLEAFLKPPVLHMLKPP

SEQ ID NO: 10124 - protein, 101 aa, Homo sapiens [sequence omitted]

SEQ ID NO: 10125 - protein, 119 aa, Homo sapiens
DLDLMESGVSTHNMSSWTLGIHCEQAGWGLPAQIGAILFCILFQGVLNTLKQVEAPAPDWELLERPPCVCVVLSWSHIESGWGSSTRQSPSNSQVLAPSGKADTLSWRRPRKSGLRVAA

SEQ ID NO: 10126 - protein, 58 aa, Homo sapiens
  SITE (24): Xaa equals any amino acid
RPSLPKCAALVHVPNGPSPHAPPXSGVGAPSEVSESLKCSFVRPLCSDSPGQATSNPL

SEQ ID NO: 10127 - protein, 97 aa, Homo sapiens
MLLSIGMLMLSATQVYTILTVQLFAFLNLLPVEADILAYNFENASQTFDDLPARFGYRLPAEGLKGFLINSKPENACEPIVPPPVKDNSSGHFHRVN

SEQ ID NO: 10128 - protein, 166 aa, Homo sapiens
MAAAVLAMTLAPTVSGTTSKCSSRRWCPVPASSSCVSHLLGSGCAPCAPWTAHPRQPSQCWSARAPRRLGSRPRRYLLTGQANGSLAMWDLTTAMDGLGQAPAGGLTEQELMEQLEHCELAPPAPFSSLMGLSPQPLTPHLPHQPPLSLQQHLLVWPPWEPKPPAG

SEQ ID NO: 10129 - protein, 137 aa, Homo sapiens; identical to SEQ ID NO: 7304

SEQ ID NO: 10130 - protein, 143 aa, Homo sapiens
  SITE (19): Xaa equals any amino acid
  SITE (47): Xaa equals any amino acid
  SITE (58): Xaa equals any amino acid
  SITE (104): Xaa equals any amino acid
FGPAVFGFGSPRGKPPGNXRGGPIRVPGFGRPRPISAPEVWEGRPLXAPRSCFRNFRXRRSGGHAVPPGSETHFRVAVVSSRFEGLSPLQRHRLVHAALAEELXGPVHALAIQARTPAQWRENSQLDTSPPCLGGNKKTLGTP

SEQ ID NO: 10131 - protein, 27 aa, Homo sapiens
MIIAPICLIPFLITLVVWRSKDSEAQA

SEQ ID NO: 10132 - protein, 119 aa, Homo sapiens
MGVLAEHGGHPAQEHFPKLLGLLFPLLARERHDRVRDNICGALARLLMASPTRKPEPQVLAALLHALPLKEDLEEWVTIGRLFSLLTFLAKQHTDSFQAALGSLPVDKAQELQAVLGLS

SEQ ID NO: 10133 - protein, 86 aa, Homo sapiens
  SITE (55): Xaa equals any amino acid
MGVLAEHGGHPAQEHFPKLLGLLFPLLARERHDRVRDNICGALARLLMASPTRKXRAPGAGCPTACPATEGGLGGVGQPLGASSAS

SEQ ID NO: 10134 - protein, 380 aa, Homo sapiens; identical to SEQ ID NO: 7308

SEQ ID NO: 10135 - protein, 165 aa, Homo sapiens
  SITE (54): Xaa equals any amino acid
  SITE (62): Xaa equals any amino acid
  SITE (64): Xaa equals any amino acid
  SITE (96): Xaa equals any amino acid
MARLGAVRSHYCALLLAAALAVCAFYYLGSGRETFSSATKRLKEARAGAPAAPXPPALELAXGXVAPAPGAKAKSLEGGGAGPVDYHLLMMFTKAXHNAALQAKARVALRSLLRLAKFEAHEVLNLHFVSEEASREVAKGLLRELLPPPLASSARSSSTICCADG

SEQ ID NO: 10136 - protein, 159 aa, Homo sapiens
ASKRMPAHHILTLGGCCTRILLMLTSLGVGFRIASLRKDFRTNWGLHKKTYLIIRVLTACISQLHPRTPLSFIPPNQLQVTRLYSESKFVIKEQRLATTRTCRRTVGTRKTHSKKPRPGTVVKPVIPTLWETEVGVSIEPRRSRSAWETQGGPHRYKIF

SEQ ID NO: 10137 - protein, 334 aa, Homo sapiens
  SITE (124): Xaa equals any amino acid
  SITE (129): Xaa equals any amino acid
  SITE (214): Xaa equals any amino acid
  SITE (224): Xaa equals any amino acid
MDQALSLWFLLGWIGGDSCNLIGSFLADQLPLQTYTAVYYVLADLVMLTLYFYYKFRTRPSLLSAPINSVLLFLMGMACATPLLSAAGPVAAPREAFRGRALLSVESGSKPFTRQEVIGFVIGXISSVXYLLSRLPQIRTNFLRKSTQGISYSLFALVMLGNTLYGLSVLLKNPEEGQSEGSYLLHHLPWLVGSLGVLLLDTIISIQFLVYRRXPPPRSLSPSXPADQNQAERRRTGTTGCHTRQEEVWTVMVRRPCISLRVASGSSVDRTVPPGTHLQVDPEASRPGLERRPQGLSGDSEAAPPTTYLILPTQDCPVNSRQLNKQAGYSGSHL

SEQ ID NO: 10138 - protein, 124 aa, Homo sapiens
  SITE (63): Xaa equals any amino acid
  SITE (86): Xaa equals any amino acid
MVVAVLLGFVAMVLSVVGMKCTRVGDSNPIAKGRVAIAGGALFILAGLCTLTAVSWYATLVTXEFFNPSTPVNARYEFGPALFVGXDSAGLAVLSGSFLCCTCPEPERPNSSPQALSAWTLCCC

SEQ ID NO: 10139 - protein, 97 aa, Homo sapiens
  SITE (49): Xaa equals any amino acid
NSARDQASGESIHHRTSPSLPRTFLGQLHSGLLHHLPCDHISHHVPRSXERSSASPSSLTLRGKVTETKSDEMTAMYTAVKGREGRNDTNGRELLGN

SEQ ID NO: 10140 - protein, 100 aa, Homo sapiens; identical to SEQ ID NO: 7312

SEQ ID NO: 10141 - protein, 248 aa, Homo sapiens
  SITE (117): Xaa equals any amino acid
  SITE (215): Xaa equals any amino acid
MGGLIILFLIAIIWFPLLFMSLVRSVVGVVNQPIDVTVTLKLGGYEPLFTMSAQQPSIIPFTAQAYEELSRQFDPQPLAMQFISQYSPEDIVTAQIEGSSGALWRISPPSRAQMKRXSTTARPTSPCASPGTSRGTWRREALWSMPTRSTCWPWPQQHCTAAVASLLEGTSDQSVVIPNLFPKYIRAPNGPEANPVKQLQPNEEADYLGVRIQLXREQGAGATGFPRMVGHRAAGVPDRLQPCCPWSF

SEQ ID NO: 10142 - protein, 247 aa, Homo sapiens
  SITE (14): Xaa equals any amino acid
  SITE (141): Xaa equals any amino acid
MAVPALTPAAVRAXGLLGVSWTWALFTPLVALGREGGSQDSATTPSRPPGRPRIVDIATIVHCYAEERQSAEDYEKEESHRQRRLKERERIGELGAPEVWGPSPKFPQLDSDEHTPVEDEEEVTHQKSSSSDSNSEEHRKXKTSRSRNKKKRKNKSSKRKHRKYSDSDSNSESDTNSDSDDDKKRVKAKKKKKKKKHKTKKKKNKKTKKESSDSSCKDSEEDLSEATWDGAAKCGRYYGFNRARSTY

SEQ ID NO: 10143 - protein, 103 aa, Homo sapiens; identical to SEQ ID NO: 7319

SEQ ID NO: 10144 - protein, 148 aa, Homo sapiens
  SITE (47): Xaa equals any amino acid
MGLFGKTQEKPPKELVNEWSLKIRKEMRVVDRQIRDIQREEEKVKRXCERCCQEGPEGCLHSSGQGDDQVKEGCEQAVCIQSTHELSAHGDEEPARGLASGWFPAEEHRSDEGHAKSCEDSRDSGHHEGVVQRNDEGWDHRGDVRGHF

SEQ ID NO: 10145 - protein, 102 aa, Homo sapiens [sequence omitted]

SEQ ID NO: 10146 - protein, 125 aa, Homo sapiens
MFRRLASVASKLKEFIGNMITTAGKVVVTILLGSSGMMLPSLTSSVYFFVFLGLCTWWSWCRTFDPLLFSCLCVLLAIFTAGHLIGLYLYQFQFFQEAVPPNDYYASFGQSEEFFYSTGTELIIP

SEQ ID NO: 10147 - protein, 123 aa, Homo sapiens
  SITE (92): Xaa equals any amino acid
  SITE (93): Xaa equals any amino acid
  SITE (108): Xaa equals any amino acid
  SITE (117): Xaa equals any amino acid
  SITE (122): Xaa equals any amino acid
MITTAGKVVVTILLGSSGMMLPSLTSSVYFFVFLGLCTWWSWCRTFDPLLFSCLCVLLAIFTAGHLIGLYLYQFQFFQEAVPPNDYYASFGXXEEFFYSTGTELIIPXRLLQAHHNXTYKQXY

SEQ ID NO: 10148 - protein, 52 aa, Homo sapiens
  SITE (37): Xaa equals any amino acid
PGLRKNRPSVPRRSSPGRISGLSSVAWNPDHSISVFXLAELTSRAQLAVGVS

SEQ ID NO: 10149 - protein, 182 aa, Homo sapiens
  SITE (88): Xaa equals any amino acid
  SITE (119): Xaa equals any amino acid
  SITE (120): Xaa equals any amino acid
  SITE (149): Xaa equals any amino acid
  SITE (151): Xaa equals any amino acid
  SITE (154): Xaa equals any amino acid
MVIYVTLALWPQIIQKKANGNCFWHFGLLLKLGFLLLFICFLAYSQGAFEKIFSLWPLSKCFELKGNVYEWWFRWRLDRYVVFHGMLXAFIYLALQKRQILSEGKGEPLFSNKISNFLXXISVVSFLTYSIWASSCKNKAECNELHPSXSXVQXLAFILIRNIPGYARQFTVHFLLGLEKFH

SEQ ID NO: 10150 - protein, 83 aa, Homo sapiens
  SITE (17): Xaa equals any amino acid
  SITE (18): Xaa equals any amino acid
IWAIDVFAFCLIFFYKXXVRGIHLFICCTDLIMILMFERLHLFAFTICGVKYIFCSQYMKIWSNLNSKQTFCGCLFLYWQSIN

SEQ ID NO: 10151 - protein, 857 aa, Homo sapiens
MSYYMADRKHRKAFLEARQSLEVKMNLEEQSQQQENLMLSILPKHVADEMLKDMKKDESQKDQQQFNTMYMYRHENVSILFADIVGFTQLSSACSAQELVKLLNELFARFDKLAAKYHQLRIKILGDCYYCICGLPDYREDHAVCSILMGLAMVEAISYVREKTKTGVDMRVGVHTGTVLGGVLGQKRWQYDVWSTDVTVANKMEAGGIPGRVHISQSTMDCLKGEFDVEPGDGGSRCDYLEEKGIETYLIIASKPEVKKTATQNGLNGSALPNGAPASSKSSSPALIETKEPNGSAHSSGSTSEKPEEQDAQADNPSFPNPRRRLRLQDLADRVVDASEDEHELNQLLNEALLERESAQVVKKRNTFLLSMRFMDPEMETRYSVEKEKQSGAAFSCSCVVLLCTALVEILIDPWLMTNYVTFMVGEILLLILTICSLAAIFPRAFPKKLVAFSTWIDRTRWARNTWAMLAIFILVMANVVDMVSHMVKLTLMLLVAGAVATINLYAWRPVFDEYDHKRFREHDLPMVALEQMQGFNPGLNGTDRLPLVPSKYSMTVMVFLMMLSFYYFSRHVEKLARTLFLWKIEVHDQKERVYEMRRWNEALVTNMLPEHVARHFLGSKKRDEELYSQTYDEIGVMFASLPNFADFYTEESINNGGIECLRFLNEIISDFDSLLDNPKFRVITKIKTIGSTYMAASGVTPDVNTNGFASSNKEDKSERERWQHLADLADFALAMKDTLTNINNQSFNNFMLRIGMNKGGVLAGVIGARKPHYDIWGNTVNVASRMESTGVMGNIQVVEETQVILREYGFRFVRRGPIFVKGKGELLTFFLKGRDKLATFPNGPSVTLPHQVVDNS

SEQ ID NO: 10152 - protein, 19 aa, Homo sapiens
TIACMLTFCFVLFCFVLHF

SEQ ID NO: 10153 - protein, 419 aa, Homo sapiens
MNNQKQQKPTLSGQRFKTRKRDEKERFDPTQFQDCIIQGLTETGTDLEAVAKFLDASGAKLDYRRYAETLFDILVAGGMLAPGGTLADDMMRTDVCVFAAQEDLETMQAFAQVFNKLIRRYKYLEKGFEDEVKKLLLFLKGFSESERNKLAMLTGVLLANGTLNASILNSLYNENLVKEGVSAAFAVKLFKSWINEKDINAVAASLRKVSMDNRLMELFPANKQSVEHFTKYFTEAGLKELSEYVRNQQTIGARKELQKELQEQMSRGDPFKDIILYVKEEMKKNNIPEPVVIGIVWSSVMSTVEWNKKEELVAEQAIKHLKQYSPLLAAFTTQGQSELTLLLKIQEYCYDNIHFMKAFQKIVVLFYKAEVLSEEPILKWYKDAHVAKGKSVFLEQMKKFVEWLKNAEEESESEAEEGD

SEQ ID NO: 10154 - protein, 188 aa, Homo sapiens; identical to SEQ ID NO: 7349

SEQ ID NO: 10155 - protein, 188 aa, Homo sapiens; identical to SEQ ID NO: 7349

SEQ ID NO: 10156 - protein, 330 aa, Homo sapiens
RPTRPLNCGRMRGSVECTWGWGHCAPSPLLLWTLLLFAAPFGLLGEKTRQLLEFDSTNVSDTAAKPLGRPYPPYSLADFSWNNITDSLDPATLSATFQGHPMNDPTRTFANGSLAFRVQAFSRSSRPAQPPRLLHTADTCQLEVALIGASPRGNRSLFGLEVATLGQGPDCPSMQEQHSIDDEYAPAVFQLDQLLWGSLPSGFAQWRPVAYSQKPGGRESALPCQASPLHPALAYSLPQSPIVRAFFGSQNNFCAFNLTFGASTGPGYWDQHYLSWSMLLGVGFPPVDGLSPLVLGIMAVALGAPGLMLLGGGLVLLLHHKKYSEYQSIN

SEQ ID NO: 10157 - protein, 188 aa, Homo sapiens; identical to SEQ ID NO: 7358

SEQ ID NO: 10158 - protein, 162 aa, Homo sapiens
MASALSYVSKFKSFVILFVTPLLLLPLVILMPAKVCVQYMKDTNMLFLGGLIVAVAVERWNLHKRIALRTLLWVGAKPARLMLGFMGVTALLSMWISNTATTAMMVPIVEAILQQMEATSAATEAGLELVDKGKAKELPGSQVIFEGPTLGQQEDQERKRLC

SEQ ID NO: 10159 - protein, 407 aa, Homo sapiens
  SITE (193): Xaa equals any amino acid
  SITE (357): Xaa equals any amino acid
MASALSYVSKFKSFVILFVTPLLLLPLVILMPAKVCVQYMKDTNMLFLGGLIVAVAVERWNLHKRIALRTLLWVGAKPARLMLGFMGVTALLSMWISNTATTAMMVPIVEAILQQMEATSAATEAGLELVDKGKAKELPGSQVIFEGPTLGQQEDQERKRLCKAMTLCICYAASIGGTATLTGTGPNVVLLGXMNELFPDSKDLVNFASWFAFAFPNMLVMLLFAWLWLQFVYMRFKYVSDATVAIFVATLLFIVPSQKPKFNFRSQTEEERKTPFYPPPLLDWKVTQEKVPWGIVLLLGGGFALAKGSEASGLSVWMGKQMEPLHAVPPAAITLILSLLVAVFTECTSNVATTTLXLPIFASMVKTGVIMNIIGVFCVFLAVNTWGRAIFDLDHFPDWANVTHIET

SEQ ID NO: 10160 - protein, 162 aa, Homo sapiens
  SITE (115): Xaa equals any amino acid
  SITE (143): Xaa equals any amino acid
MASALSYVSKFKSFVILFVTPLLLLPLVILMPAKVCVQYMKDTNMLFLGGLIVAVAVERWNLHKRIALRTLLWVGAKPARLMLGFMGVTALLSMWISNTATTAMMVPIVEAILQXMEATSAATEAGLELVDKGKAKELPGSQXIFEGPTLGQQEDQRAEEVV

SEQ ID NO: 10161 - protein, 173 aa, Homo sapiens
  SITE (59): Xaa equals any amino acid
  SITE (130): Xaa equals any amino acid
EEPQDHTHSPYPPQDYRTFWHTLYRVLGFTPQNDPTMSTHHQNPANGPPLPPSPDAEMXMGSWRVGSEMKGTPQWAAGPIFPKPCHYLCEGGQVAEGSGCRLLYPLCLKHPPHRALVFTRFVLDSLNGNXIPWLRAKTTTYQCPCPFQLTLSSLRSSLSLWKGHPSQGRNAWS

SEQ ID NO: 10162 - protein, 69 aa, Homo sapiens [sequence omitted]

SEQ ID NO: 10163 - protein, 199 aa, Homo sapiens
FSGVCFAGIAGSMATLLHDAVMNPAEVVKQRLQMYNSQHRSAISCIRTVWRTEGLGAFYRSYTTQLTMNIPFQSIHFITYEFLQEQVNPHRTYNPQSHIISGGLAGALAAAATTPLDVCKTLLNTQENVALSLANISGRLSGMANAFRTVYQLNGLAGYFKGIQARVIYQMPSTAISWSVYEFFKYFLTKRQLENRAPY

SEQ ID NO: 10164 - protein, 1 aa, Homo sapiens
S

SEQ ID NO: 10165 - protein, 3 aa, Homo sapiens
LLC

SEQ ID NO: 10166 - protein, 129 aa, Homo sapiens [sequence omitted]

SEQ ID NO: 10167 - protein, 53 aa, Homo sapiens
  SITE (1): Xaa equals any amino acid
  SITE (2): Xaa equals any amino acid
  SITE (52): Xaa equals any amino acid
  SITE (53): Xaa equals any amino acid
XXDTQGRVRGRHEEWGGRRWRKEGSEQRAPGMAWKRLSPWILWVGASGLTSXX

SEQ ID NO: 10168 - protein, 188 aa, Homo sapiens [sequence omitted]

SEQ ID NO: 10169 - protein, 32 aa, Homo sapiens
AWSHLSILLNYKLQRQEWHLFTYFEFVCNCLD

SEQ ID NO: 10170 - protein, 14 aa, Homo sapiens
  SITE (7): Xaa equals any amino acid
MMPAYPXLLAWILF

SEQ ID NO: 10171 - protein, 232 aa, Homo sapiens
MGNSLSVFCSWFCRRSWPCHRQPARLVREAFPAGRAHPAAPAPVPARGIVGRFPLLFNRQRHLGPSFPVRWDGAPMRLCLIPRNTGTPQRVLRPVVWSPPSRKKPVLSPHNSIMFGHLSPVRIPCLRGKFNLQLPSLDDQVIPARLPKTEVSAEEPKEATEVKDQVETQGQEDNKRGPCSNGEAASTSRPLETQGNLTSSWYNPRPLEGNVHLKSLTEKNQTDKAQVHAVSC

SEQ ID NO: 10172 - protein, 91 aa, Homo sapiens
  SITE (78): Xaa equals any amino acid
MHLGLVSLILFCQALEVDISLQGPGIVPGRSEVSLSLQGPRGGGCFPIATGAPFIVLLPLGLYLVFHLCCFFGLFCAXLRLREPGWDHLII

SEQ ID NO: 10173 - protein, 81 aa, Homo sapiens
  SITE (56): Xaa equals any amino acid
GLHFNIRVDHGMLWAPVLYKDVGQELPVVSTAPSHIALLMEPFTPDVLSRLMGRIXVCKDYVIDQLWSVLKEICQWIIPYG

SEQ ID NO: 10174 - protein, 62 aa, Homo sapiens
  SITE (51): Xaa equals any amino acid
MWSLVSVSVLVLTCAVDVAEGLGWGEVSTGGIELPRHMVLVVLVERESQRXRTCSVKTFSSR

SEQ ID NO: 10175 - protein, 60 aa, Homo sapiens; identical to SEQ ID NO: 7384

SEQ ID NO: 10176 - protein, 6 aa, Homo sapiens
PCDVHF

SEQ ID NO: 10177 - protein, 14 aa, Homo sapiens
WRRQARVESLLPML

SEQ ID NO: 10178 - protein, 52 aa, Homo sapiens; identical to SEQ ID NO: 7385

SEQ ID NO: 10179 - protein, 87 aa, Homo sapiens
PCCFLCLVCSSSDSHKASSSSSPTLSTPLPCLFSSHTSLLRNFHIASLLLTPPQAPQGWAFPASLTAAALVPGPVPGTQLVARMLIT

SEQ ID NO: 10180 - protein, 8 aa, Homo sapiens
PCCFLCLV

SEQ ID NO: 10181 - protein, 340 aa, Homo sapiens
  SITE (334): Xaa equals any amino acid
  SITE (335): Xaa equals any amino acid
MPGWLTLPTLCRFLLWAFTIFHKAQGDPASHPGPHYLLPPIHEVIHSHRGATATLPCVLGTTPPSYKVRWSKVEPGELRETLILITNGLHARGYGPLGGRARMRRGHRLDASLVIAGVRLEDEGRYRCELINGIEDESVALTLSLEGVVFPYQPSRGRYQFNYYEAKQACEEQDGRLATYSQLYQAWTEGLDWCNAGWLLEGSVRYPVLTARAPCGGRGRPGIRSYGPRDRMRDRYDAFCFTSALAGQVFFVPGRLTLSEAHAACRRRGAVVAKVGHLYAAWKFSGLDQCDGGWLADGSVRFPITTPRPRCGGLPDPGVRSFGFPRPQQAAYGXXCYAEN

SEQ ID NO: 10182 - protein, 523 aa, Homo sapiens
  SITE (248): Xaa equals any amino acid
  SITE (249): Xaa equals any amino acid
MLRNGNKYLLMLVSIIMLTACISQSRTSFIPPQDRESLLAEQPWPHNGFVAISWHNVEDEAADQRFMSVRTSALREQFAWLRENGYQPVSIAQIREAHRGGKPLPEKAVVLTFDDGYQSFYTRVFPILQAFQWPAVWAPVGSWVDTPADKQVKFGDELVDREYFATWQQVREVARSRLVELASHTWNSHYGIQANATGSLLPVYVNRAYFTDHARYETAAEYRERIRLDAVKMTEYLRTKVEVNPHVXXWPYGEANGIAIEELKKLGYDMFFTLESGLANASQLDSIPRVLIANNPSLKEFAQQIITVQEKSPQRIMHIDLDYVYDENLQQMDRNIDVLIQRVKDMQISTVYLQAFADPDGDGLVKEVWFPNRLLPMKADIFSRVAWQLRTRSGVNIYAWMPVLSWDLDPTLTRVKYLPTGEKKAQIHPEQYHRLSPFDDRVRAQVGMLYEDLAGHAAFDGILFHDDALLSDYEDASAPAITAYQQAGFSGSLSEIRQNPEQFKQWARFKSRALTDFTLELSA

SEQ ID NO: 10183 - protein, 85 aa, Homo sapiens; identical to SEQ ID NO: 7390

SEQ ID NO: 10184 - protein, 62 aa, Homo sapiens
  SITE (58): Xaa equals any amino acid
  SITE (62): Xaa equals any amino acid
MHFAAPFQLQSQTFRYEVGSVRKSQQVLKAVVTALLIPAFSSLSSKACKASFGKKKKXKGKX

SEQ ID NO: 10185 - protein, 58 aa, Homo sapiens
  SITE (37): Xaa equals any amino acid
  SITE (40): Xaa equals any amino acid
  SITE (47): Xaa equals any amino acid
EQLLESSLSSTSCETLSSYASGRWLLSPHTPACRVRXYIXGTDRMWXPRSMPSATDIA

SEQ ID NO: 10186 - protein, 26 aa, Homo sapiens
  SITE (9): Xaa equals any amino acid
QFKQYRYAXGMLRGPHIPVSYPNMYF

SEQ ID NO: 10187 - protein, 26 aa, Homo sapiens
MEAVFFLFFLLLLLTWTSKIAPILFS

SEQ ID NO: 10188 - protein, 167 aa, Homo sapiens; identical to SEQ ID NO: 7399
  SITE (140): Xaa equals any amino acid

SEQ ID NO: 10189 - protein, 93 aa, Homo sapiens; identical to SEQ ID NO: 7404

SEQ ID NO: 10190 - protein, 41 aa, Homo sapiens [sequence omitted]

SEQ ID NO: 10191 - protein, 261 aa, Homo sapiens
MELLQVTILFLLPSICSSNSTGVLEAANNSLVVTTTKPSITTPNTESLQKNVVTPTTGTTPKGTITNELLKMSLMSTATFLTSKDEGLKATTTDVRKNDSIISNVTVTSVTLPNAVSTLQSSKPKTETQSSIKTTEIPGSVLQPDASPSKTGTLTSIPVTIPENTSQSQVIGTEGGKNASTSATSRSYSSIILPVVIALIVITLSVFVLVGLYRMCWKADPGTPENGNDQPQSDKESVKLLTVKTISHESGEHSAQGKTKN

SEQ ID NO: 10192 - protein, 73 aa, Homo sapiens [sequence omitted]

SEQ ID NO: 10193 - protein, 83 aa, Homo sapiens; identical to SEQ ID NO: 7409

SEQ ID NO: 10194 - protein, 66 aa, Homo sapiens; identical to SEQ ID NO: 7411
  SITE (8): Xaa equals any amino acid
  SITE (11): Xaa equals any amino acid
  SITE (18): Xaa equals any amino acid
  SITE (61): Xaa equals any amino acid

SEQ ID NO: 10195 - protein, 9 aa, Homo sapiens
LLSCFYFFL

SEQ ID NO: 10196 - protein, 53 aa, Homo sapiens
KIELMVCTKSLVYVLVFQNNFYINIYIVKKFFLIFGWDIRKYLYYTLSYYNGT

SEQ ID NO: 10197 - protein, 51 aa, Homo sapiens
MSVWCGLCLMSFLTFRCRLFQLLLFHFPEDLCFCLPCEQAFGRTCLMQKRK

SEQ ID NO: 10198 - protein, 129 aa, Homo sapiens
MSASSLHRLPVLMALFPFQAAAAGSLGLQPPPTPMKGKPSIMLPPQYKRREGLKKKKKKIQKVALVSFGRADSIVGDGLPTNQGDKCQRERTMPGSKHISPQTPQVGKQARGSTNPSGRPGVQMLYSSI

SEQ ID NO: 10199 - protein, 621 aa, Homo sapiens
  SITE (137): Xaa equals any amino acid
MGLLSDPVRRRALARLVLRLNAPLCVLSYVAGIAWFLALVFPPLTQRTYMSENAMGSTMVEEQFAGGDRARAFARDFAAHRKKSGALPVAWLERTMRSVGLEVYTQSFSRKLPFPDETHERYMVSGTNVYGILRAPXAASTESLVLTVPCGSDSTNSQAVGLLLALAAHFRGQIYWAKDIVFLVTEHDLLGTEAWLEAYHDVNVTGMQSSPLQGRAGAIQAAVALELSSDVVTSLDVAVEGLNGQLPNLDLLNLFQTFCQKGGLLCTLQGKLQPEDWTSLDGPLQGLQTLLLMVLRQASGRPHGSHGLFLRYRVEALTLRGINSFRQYKYDLVAVGKALEGMFRKLNHLLERLHQSFFLYLLPGLSRFVSIGLYMPAVGFLLLVLGLKALELWMQLHEAGMGLEEPGGAPGPSVPLPPSQGVGLASLVAPLLISQAMGLALYVLPVLGQHVATQHFPVAEAEAVVLTLLAIYAAGLALPHNTHRVVSTQAPDRGWMALKLVALIYLALQLGCIALTNFSLGFLLATTMVPTAALAKPHGPRTLYAALLVLTSPAATLLGSLFLWRELQEAPLSLAEGWQLFLAALAQGVLEHHTYGALLFPLLSLGLYPCWLLFWNVLFWK

SEQ ID NO: 10200 - protein, 230 aa, Homo sapiens
  SITE (216): Xaa equals any amino acid
MGLALYVLPVLGQHVATQHFPVAEAEAVVLTLLAIYAAGLALPHNTHRVVSTQAPDRGWMALKLVALIYLALQLGCIALTNFSLGFLLATTMVPTAALAKPHGPRTLYAALLVLTSPAATLLGSLFLWRELQEAPLSLAEGWQLFLAALAQGVLEHHTTAPCSSHCCPWASTPAGCFSGMCSSGSEICLSGLGQRLPKDPILPPSGEINECLFQQXKKKKKKKKKKKKGG

SEQ ID NO: 10201 - protein, 31 aa, Homo sapiens; identical to SEQ ID NO: 7422

SEQ ID NO: 10202 - protein, 82 aa, Homo sapiens
  SITE (61): Xaa equals any amino acid
MASHSFLLDIYLVLSLWKCIPGLVQDVFLEMKVLTESALCKVMTLEPLQHSVLVFRCWQSXFQAKSSRPCQASIFAYYTLNF

SEQ ID NO: 10203 - protein, 14 aa, Homo sapiens
MWDYKTVLLAFKQL

SEQ ID NO: 10204 - protein, 67 aa, Homo sapiens
DWGFQTTFFSLGLYLFTIWWSTVGLPWTSSTQRELDMKLEAAALEGKFRLTWTAQAMAGRIPSSWGP

SEQ ID NO: 10205 - protein, 240 aa, Homo sapiens; identical to SEQ ID NO: 7433

SEQ ID NO: 10206 - protein, 55 aa, Homo sapiens
NERVLTYSLIGSSIIRKKCTVLFTAKFYLTVLILGVMKFKQCDLNLKKKKKKGRP

SEQ ID NO: 10207 - protein, 40 aa, Homo sapiens; identical to SEQ ID NO: 7436

SEQ ID NO: 10208 - protein, 71 aa, Homo sapiens
  SITE (38): Xaa equals any amino acid
MSPLSAARAALRVYAVGAAVILAQLLRRCRGGFLEPVXPPRPDRVAIVTGGTDGIGYSTANIWRDLACMLS

SEQ ID NO: 10209 - protein, 462 aa, Homo sapiens
  SITE (148): Xaa equals any amino acid
  SITE (149): Xaa equals any amino acid
  SITE (204): Xaa equals any amino acid
  SITE (292): Xaa equals any amino acid
  SITE (303): Xaa equals any amino acid
MVDYLQKAVLLNLGTIELYGSNDPYRREPRSPRKSRQPSGAGLCDISEGTVVPEDRCKSPTSAKMSRKLSLPTDLKPDLDVKDNSFSRSRSSSVTSIDKESREAISALHFCETFTRKTDSSPSPCLWVGTTLGTVLVIALNLPPGGEXXLLQPVIVSPSGTILRLKGAILRMAFLDTTGCLIPPAYEPWREHNVPEEKDEKEKXKKRRPVSVSPSSSQEISENQYAVICSEKQAKVISLPTQNCAYKQNITETSFVLRGDIVALSNSICLACFCANGHIMTFSLPSLRPLLXVYYLPLTNMRXARTFCFTNNGQALYLVSPTEIQRLTYSQETCENLQEMLGELFTPVETPEAPNRGFFKGLFGGGAQSLDREELFGESSSGKASRSLAQHIPGPGGIEGVKGAASGVVGELARARLALDERGQKLGDLEERTAAMLSSAESFSKHAHEIMLKYKDKKWYQF

SEQ ID NO: 10210 - protein, 88 aa, Homo sapiens; identical to SEQ ID NO: 7442

SEQ ID NO: 10211 - protein, 81 aa, Homo sapiens
MDWWFLAIAMALLWLTTSRKQCCSTWALLNYMALMILIGENPDLLVNLDSLQEPVCVILVKGLLFQRIAANLQPLQRCQGS

SEQ ID NO: 10212 - protein, 69 aa, Homo sapiens
MACRSWCFTLLANVSFTLLLPVHWGSAEAVFSVSITLGCRPPSSLSVPLSRGRRDLGSHVLALVASLWK

SEQ ID NO: 10213 - protein, 225 aa, Homo sapiens [sequence omitted]

SEQ ID NO: 10214 - protein, 4 aa, Homo sapiens
VLRN

SEQ ID NO: 10215 - protein, 116 aa, Homo sapiens
  SITE (14): Xaa equals any amino acid
  SITE (25): Xaa equals any amino acid
  SITE (33): Xaa equals any amino acid
VGFQGLEGNPPPAXLNGLEGKGKLXKKAQGTGXKIIFWPKESKTPSGSPKPAKAANSKSKESDEPHHSKNERPARPPPPIMTDGEDADYTHFTNQQSSTRHFSKSESSHKGFHYKH

SEQ ID NO: 10216 - protein, 20 aa, Homo sapiens
MNVRLVLNPFPLYSVYVIPN

SEQ ID NO: 10217 - protein, 11 aa, Homo sapiens
LEILVVKKLLA

SEQ ID NO: 10218 - protein, 49 aa, Homo sapiens; identical to SEQ ID NO: 5672

SEQ ID NO: 10219 - protein, 70 aa, Homo sapiens; identical to SEQ ID NO: 7452

SEQ ID NO: 10220 - protein, 62 aa, Homo sapiens; identical to SEQ ID NO: 7453

SEQ ID NO: 10221 - protein, 153 aa, Homo sapiens
MLVTAYLAFVGLLASCLGLELSRCRAKPPGRACSNPSFLRFQLDFYQVYFLALAADWLQAPYLYKLYQHYYFLEGQIAILYVCGLASTVLFGLVASSLVDWLGRKNSCVLFSLTYSLCCLTKLSQDYFVLLVGRALGGLSTAALLSLRGLVYP

SEQ ID NO: 10222 - protein, 58 aa, Homo sapiens [sequence omitted]

SEQ ID NO: 10223 - protein, 6 aa, Homo sapiens
TLTAKT

SEQ ID NO: 10224 - protein, 34 aa, Homo sapiens
LCVSHPGITCTPLWLCVISQNMELILMFRRPKLT

SEQ ID NO: 10225 - protein, 90 aa, Homo sapiens
  SITE (22): Xaa equals any amino acid
  SITE (25): Xaa equals any amino acid
  SITE (26): Xaa equals any amino acid
QNTIECGSSTAGVCCSQLWRLXVQXXGTGRLHVWWGPASWSIASTFSLHPYVVEEAGELSGVSFVTPFLRLVHSHDLITSQRPCLLTPLP

SEQ ID NO: 10226 - protein, 88 aa, Homo sapiens; identical to SEQ ID NO: 7458

SEQ ID NO: 10227 - protein, 106 aa, Homo sapiens
RMAIHKALVMCLGLPLFLFPGAWAQGHVPPGCSQGLNPLYYNLCDRSGAWGIVLEAVAGAGIVTTFVLTIILVASLPFVQDTKKRSLLGTQLRGRCHHTAGTMGSC

SEQ ID NO: 10228 - protein, 41 aa, Homo sapiens; identical to SEQ ID NO: 7464

SEQ ID NO: 10229 - protein, 53 aa, Homo sapiens
CVLEPTSSQSIAPDLGRESTFSIQRNKNMQFMVVLWTLTDCEGKVYPKAVICR

SEQ ID NO: 10230 - protein, 45 aa, Homo sapiens; identical to SEQ ID NO: 7466

SEQ ID NO: 10231 - protein, 37 aa, Homo sapiens
  SITE (29): Xaa equals any amino acid
LPPFPQCDKLAADCPTSCGAMGSAVCLCXRGLCRQNC

SEQ ID NO: 10232 - protein, 162 aa, Homo sapiens
  SITE (16): Xaa equals any amino acid
  SITE (17): Xaa equals any amino acid
  SITE (18): Xaa equals any amino acid
KTVMLPIAQEVQSPVXXXCDKLAADCAHELRRHGVSCVSLWPGIVQTELLKEHMAKEEVLQDPVLKQFKSAFSSAETTELSGKCVVALATDPNILSLSGKVLPSCDLARRYGLRDVDGRPVQDYLSLSSVLSHVSGLGWLASYLPSFLRVPKWIIALYTSKF

SEQ ID NO: 10233 - protein, 85 aa, Homo sapiens
  SITE (26): Xaa equals any amino acid
MAQSRVLLLLLLLPPQLHLGPVLAVXAPGFGRSGGHSLSPEENEFAEEEPVLVLSPEEPGPGPAAVSCPRDCACSQEGVVDCGGY

SEQ ID NO: 10234 - protein, 68 aa, Homo sapiens
  SITE (44): Xaa equals any amino acid
  SITE (57): Xaa equals any amino acid
MAQSRVLLLLLLLPPQLAPGTCACREGPRIWPNGGHSLSPEENXLRKKSRLLLIEAXKKPGAWAQAAV

SEQ ID NO: 10235 - protein, 56 aa, Homo sapiens
CDVKPADVKDIGGTVEASCMNFSWPAPTAQVHTRKRRVWACLRVDVSSEVRPGKAL

SEQ ID NO: 10236 - protein, 138 aa, Homo sapiens
MCYSCARRDQAPVGWTAHLPVASWRRRAGSTCPAPLSVGLVFGLAAALVLADCGLMDQALFISYTASGSALSHACFCYALICSIPVSTYIVLVTSLRYHLFIWSVFSPKLLYEGMHLLITAAVCVFFTAMDQTRLTQS

SEQ ID NO: 10237 - protein, 50 aa, Homo sapiens; identical to SEQ ID NO: 7472

SEQ ID NO: 10238 - protein, 135 aa, Homo sapiens
  SITE (33): Xaa equals any amino acid
  SITE (129): Xaa equals any amino acid
AKMPWTCSVSDPTSCDSQAQKMPGVRASRQPGXGRQCLLLLHQVQGIWLKACIFPGHKLPEPLKWEARQFQTNLFSTHHSTFKVCLLLLPVHPPSLQFFHSLTSERVPGGSMVNKLTCMLQKKKKKKIXAVRKGI

SEQ ID NO: 10239 - protein, 69 aa, Homo sapiens
  SITE (6): Xaa equals any amino acid
  SITE (13): Xaa equals any amino acid
  SITE (51): Xaa equals any amino acid
WYQGKXDLKGLGXVLDGSDGMAGGIPEGMAFTLYLGIWLSSPFPDCCIAFXFAYSSSPLSSGDTFQGPQ

SEQ ID NO: 10240 - protein, 2 aa, Homo sapiens
LL

SEQ ID NO: 10241 - protein, 77 aa, Homo sapiens [sequence omitted]

SEQ ID NO: 10242 - protein, 114 aa, Homo sapiens [sequence omitted]

SEQ ID NO: 10243 - protein, 142 aa, Homo sapiens
  SITE (47): Xaa equals any amino acid
  SITE (121): Xaa equals any amino acid
MRSLLLLSAFCLLEAALAAEVKKPAAAAAPGTAEKLSPKAATLAERXRPGLQLVPGHGQGPGSGEHPGVTRGGGLVAGARVAGRQGDHGVAGQGSAERRAAARRGGARRPGRAAALTQQLXGAQRDLEAGQPTVRTQLSELR

SEQ ID NO: 10244 - protein, 57 aa, Homo sapiens
  SITE (42): Xaa equals any amino acid
  SITE (44): Xaa equals any amino acid
LLSAMLPGENEIVAWINESVCVARSGLALDVDGAPALSPQLXSXKISNLEENGRTVE

SEQ ID NO: 10245 - protein, 24 aa, Homo sapiens
SACFCCAASSLFSSFSIVSPLWKK

SEQ ID NO: 10246 - protein, 200 aa, Homo sapiens
  SITE (140): Xaa equals any amino acid
  SITE (155): Xaa equals any amino acid
  SITE (165): Xaa equals any amino acid
  SITE (173): Xaa equals any amino acid
  SITE (194): Xaa equals any amino acid
  SITE (196): Xaa equals any amino acid
MAVYVGMLRLGRLCAGSSGVLGARAALSRSWQEARLQGVRFLSSREVDRMVSTPIGGLSYVQGCTKKHLNSKTVGQCLETTAQRVPEREALVVLHEDVRLTFAQLKEEVDKAASGLLSIGLCKGDRLGMWGPNSYAWVLXQLATGQAGIILVSVXPAYQAMEWSXSSKKWASXALVVPKQFKTKHNTTFLKQIXPXWRMP

SEQ ID NO: 10247 - protein, 100 aa, Homo sapiens
  SITE (3): Xaa equals any amino acid
  SITE (12): Xaa equals any amino acid
  SITE (57): Xaa equals any amino acid
  SITE (62): Xaa equals any amino acid
  SITE (80): Xaa equals any amino acid
MAXYVGMLRLGXLCAGSSGVLGARAALSRSWQEARLQGVRFLSSREVGSHGLHAHRXASATXRGAPKSILTARLWASAWXPQHRGSQNERPWSSSMKTSG

SEQ ID NO: 10248 - protein, 89 aa, Homo sapiens
  SITE (39): Xaa equals any amino acid
  SITE (65): Xaa equals any amino acid
MPVPLLASAAWCHLCAGALPAWLWLPGGQLLHNGTCVPXTACPCTQHSLPWGLTLTLEEQAQELXPGTVLTRNCTPLCLPLWSLQLLPR

SEQ ID NO: 10249 - protein, 79 aa, Homo sapiens; identical to SEQ ID NO: 9355

SEQ ID NO: 10250 - protein, 255 aa, Homo sapiens; identical to SEQ ID NO: 7062

SEQ ID NO: 10251 - protein, 177 aa, Homo sapiens
  SITE (121): Xaa equals any amino acid
  SITE (122): Xaa equals any amino acid
MKVLATSFVLGSLGLAFYLPLVVTTPKTLAIPEKLQEAVGKVIINATTCTVTCGLGYKEETVCEVGPDGVRRKCQTRRLECLTNWICGMLHFTILIGKEFELSCLSSDILEFGQEAFRFTXXLARGVISTDDEVFKPFQANSHFVKFKYAQEYDSGTYRCDVQLVKNLRLVKSSILG

SEQ ID NO: 10252 - protein, 5 aa, Homo sapiens
MSRLL

SEQ ID NO: 10253 - protein, 25 aa, Homo sapiens
MVELASCNSPFSFLPLSLPAFPILL

SEQ ID NO: 10254 - protein, 145 aa, Homo sapiens
  SITE (95): Xaa equals any amino acid
  SITE (100): Xaa equals any amino acid
MPSGFQTCLLFTLSPFSLSKIVGVPSQQLPGQLSEQGGLCGHEGEPARTVPETQLPLPFNSAGPPHLKCTGAGKRVWSPPRRAAQEVSLQLVSCXPCRQXTSRAFSLATDRTASARVCCRFPFKHTHSPHPRRPEVQGAWAVVPL

SEQ ID NO: 10255 - protein, 52 aa, Homo sapiens; identical to SEQ ID NO: 7503

SEQ ID NO: 10256 - protein, 304 aa, Homo sapiens
TCPLLRNSSHAEPAHRQDGDLALTPCLGPGLGNPGRVRQKAGNRSSGGYSLRGQQHLGPLLLATAGAAGARERGQALHGVEMVAVRADVWHVRGRWRQLGHRPVARLHQLFAVVLFQQLLQGRSILFLLCDQAHQDPNGVLIGILSPVGRVDSTASTSRAGPDLLVRRAVVALPLEEVAHQDAQQPHEAEDRDDGDDRVLGGCLLWATCPGAVPRLPCLTTAAGPCCHLHATSGPPPPLITAMSTQRCPGTWLTWNAGNPPRPKPPRPAVSTECISSCHAHLGLQPPPKAATGMGLAWAGAPCS

SEQ ID NO: 10257 - protein, 64 aa, Homo sapiens [sequence omitted]

SEQ ID NO: 10258 - protein, 4 aa, Homo sapiens
PNSP

SEQ ID NO: 10259 - protein, 118 aa, Homo sapiens; identical to SEQ ID NO: 7515

SEQ ID NO: 10260 - protein, 157 aa, Homo sapiens
SCLPPLPLNLPLPPCLCPLLQLNAAMTRKEKTKEGQRAAQFSAGADAGSGGGLSRQKDTKRPMLLVIHDVVLELLTSSDCHANPRKYPTCQKSEVLGVSIYVSICPSTRPRDKNKTKKRCQVLEAVLVSKPSGSCHQGSFEIVPHVKGNLAFTSSNH

SEQ ID NO: 10261 - protein, 104 aa, Homo sapiens
MAFVLLFCFVGLQSSRAGPYSELVLCQTPASAPDPVSTLCVLEEEPLDAYPDSPSACLVLNWEEPCNNGSEILAYTIDLGDTSITVGNTTMHVMKDLLPETTYR

SEQ ID NO: 10262 - protein, 21 aa, Homo sapiens
  SITE (7): Xaa equals any amino acid
  SITE (11): Xaa equals any amino acid
  SITE (16): Xaa equals any amino acid
MAFVLLXCFVXLQSSXGRAVQ

SEQ ID NO: 10263 - protein, 25 aa, Homo sapiens
MISLLWTLKLFSRNLDYSQKRKSWC

SEQ ID NO: 10264 - protein, 23 aa, Homo sapiens
  SITE (5): Xaa equals any amino acid
MRVTXSSHPCQRLVLQCSGFWLF

SEQ ID NO: 10265 - protein, 39 aa, Homo sapiens
LRVAVGLCPRDALLLSPPRVVVCGVTDVVVDKGVGLLVV

SEQ ID NO: 10266 - protein, 17 aa, Homo sapiens
RFPISPHPYQHAFLFFF

SEQ ID NO: 10267 - protein, 114 aa, Homo sapiens
MWNPWIAMCLLGLSYSLLACALWPMVAFVVPEHQLGTAYGFMQSIQNLGLAIISIIAGMILDSRGYLFLEVFFIACVSLSLLSVVLLYLVNRAQGGNLNYSARQREEIKFSHTE

SEQ ID NO: 10268 - protein, 114 aa, Homo sapiens; identical to SEQ ID NO: 10267

SEQ ID NO: 10269 - protein, 114 aa, Homo sapiens; identical to SEQ ID NO: 10267

SEQ ID NO: 10270 - protein, 59 aa, Homo sapiens
  SITE (45): Xaa equals any amino acid
MTLTLLLALSPKPPVSLGRMCMQHTHTHTKTKNKAKKKKIPNTTXHDCSMTPDAGRTGC

SEQ ID NO: 10271 - protein, 57 aa, Homo sapiens
MNVFLSLPLGSSLPPLLFPPSLPSLFFPLPLYLSFSAPSPATTPGFISLPGHIPSSS

SEQ ID NO: 10272 - protein, 52 aa, Homo sapiens
  SITE (50): Xaa equals any amino acid
KEPTLKYWGRVPPILLKLFQTIEKEGHLPNSFYEASIILILKPGRDTAKXKK

SEQ ID NO: 10273 - protein, 49 aa, Homo sapiens
  SITE (26): Xaa equals any amino acid
CHPQQPSCRIPLFVLFISQTSQHLGXIEGAYVEILGAGSPNTSETIPNN

SEQ ID NO: 10274 - protein, 256 aa, Homo sapiens
  SITE (184): Xaa equals any amino acid
MKSGAGLEQSLCRWRHHWGGRRAGVAFLVLMATIVAFCCARSQRNLKGVVSAKNDIRVEIVHKEPASGREGEEHSTIKQLMMDRGEFQQDSVLKQLEVLKEEEKEFQNLKDPTNGYYSVNTFKEHHSTPTISLSSCQPDLRPAGKQRVPTGMSFTNIYSTLSGQGPLRLRQRFVLGMGSSSIEXCEREFQRGSLSDSSSFLDTQCDSSVSSSGKQDGYVQFDKASKASASSSHHSQSSSQNSDPSRPLQRRMQTHV

SEQ ID NO: 10275 - protein, 27 aa, Homo sapiens
GTPAGTGPEFPGRPTRPIGVHLHSVRD

SEQ ID NO: 10276 - protein, 485 aa, Homo sapiens
ARGRLLPWWLAAGCSMSRLGALGGARAGLGLLLGTAAGLGFLCLLYSQRWKRTQRHGRSQSLPNSLDYTQTSDPGRHVMLLRAVPGGAGDASVLPSLPREGQEKVLDRLDFVLTSLVALRREVEELRSSLRGLAGEIVGEVRCHMEENQRVARRRRFPFVRERSDSTGSSSVYFTASSGATFTDAESEGGYTTANAESDNERDSDKESEDGEDEVSCETVKMGRKDSLDLEEEAASGASSALEAGGSSGLEDVLPLLQQADELHRGDEQGKREGFQLLLNNKLVYGSRQDFLWRLARAYSDMCELTEEVSEKKSYALDGKEEAEAALEKGDESADCHLWYAVLCGQLAEHESIQRRIQSGFSFKEHVDKAIALQPENPMAHFLLGRWCYQVSHLSWLEKKTATALLESPLSATVEDALQSFLKAEELQPGFSKAGRVYISKCYRELGKNSEARWWMKLALELPDVTKEDLAIQKDLEELEVILRD

SEQ ID NO: 10277 - protein, 95 aa, Homo sapiens; identical to SEQ ID NO: 7546

SEQ ID NO: 10278 - protein, 174 aa, Homo sapiens
KGVFYFFIFYLPLFSWLCSRVCVFACLLSCSFFFWMKTPAFPDSPPSSVLQFSEKSWDMWEGAWELGSLRLPGRQFRLCRKEQSPWEALGEGGAAGPARMVLPATGGLRVVSAPCISPSLLTFLLCFPPSVCQRGGTGNRTAVAALSLLSTVYSGLSGDSREPGHLAAVRPLNL

SEQ ID NO: 10279 - protein, 67 aa, Homo sapiens; identical to SEQ ID NO: 7551

SEQ ID NO: 10280 - protein, 14 aa, Homo sapiens
TTEICGTLILREMI

SEQ ID NO: 10281 - protein, 1 aa, Homo sapiens
M

SEQ ID NO: 10282 - protein, 167 aa, Homo sapiens
  SITE (82): Xaa equals any amino acid
  SITE (88): Xaa equals any amino acid
  SITE (96): Xaa equals any amino acid
  SITE (106): Xaa equals any amino acid
  SITE (111): Xaa equals any amino acid
GRCLDCFNPFLLSCPRIGLVEQGGVKIEPLPKEVKVYLLTTSSAPYCMHHSLVEFHLKELRNKDTNIEVTFLSSNITSSSKXTIPKQXRYGERNHXPMPTPQCQIXQVKFXFQSSNRVWKKDRTTIIGKFCTALLPVNDREKMVCLPEPVNLQASVTVSCDLKIACV

SEQ ID NO: 10283 - protein, 50 aa, Homo sapiens; identical to SEQ ID NO: 7552

SEQ ID NO: 10284 - protein, 2 aa, Homo sapiens
FL

SEQ ID NO: 10285 - protein, 13 aa, Homo sapiens
PFHFSTPSITGLF

SEQ ID NO: 10286 - protein, 228 aa, Homo sapiens
TQDHQKLCYSALILAMVFSMGEAVPYAHYEHLGTPFAQFLLNIVEDGLPLDTTEQLPDLCVNLLLALNLHLPAADQNVIMAALSKHANVKIFSEKLLLLLNRGDDPVRIFKHEPQPPHSVLKFLQDVFGSPATAAIFYHTDMMALIDITVRHIADLSPGDKLRMEYLSLMHAIVRTTPYLQHRHRLPDLQAILRRILNEEETSPQCQMDRMIVREMCKEFLVLGEAPS

SEQ ID NO: 10287 - protein, 46 aa, Homo sapiens
  SITE (38): Xaa equals any amino acid
NKPDTGRKILHDLICGILKKKKKKSQIYRVNKRVGYQXQVGGEWEM

SEQ ID NO: 10288 - protein, 137 aa, Homo sapiens
  SITE (1): Xaa equals any amino acid
  SITE (7): Xaa equals any amino acid
  SITE (33): Xaa equals any amino acid
XRCFTFXFTDIVIMPKRKFPENTEGKDGSKVTXQEPTRRSARLSAKPAPPKPEPKPRKTSAKKEPGAKISRGAKGKKEEKQEAGKEGTAPSENGETKAEEIHISRSTVNVSTSRGTPPSTLSVKGQIETVRVKGTEN

SEQ ID NO: 10289 - protein, 128 aa, Homo sapiens
  SITE (67): Xaa equals any amino acid
  SITE (68): Xaa equals any amino acid
  SITE (70): Xaa equals any amino acid
  SITE (96): Xaa equals any amino acid
MPVFVCSIGLCFLFSILLLFPPFQFSYICWLSQASVYSPSPSLSNLEVLLCLSILLMIIFPFLISIXXIXSIGRLSTHMGAHTHTHTHTHTHTHTXVCYWPLLLISQENEPFRMFLPLHSALTQNFCS

SEQ ID NO: 10290 - protein, 466 aa, Homo sapiens
  SITE (268): Xaa equals any amino acid
  SITE (458): Xaa equals any amino acid
  SITE (460): Xaa equals any amino acid
  SITE (461): Xaa equals any amino acid
  SITE (463): Xaa equals any amino acid
MSWPRRLLLRYLFPALLLHGLGEGSALLHPDSRSHPRSLEKSAWRAFKESQCHHMLKHLHNGARITVQMPPTIEGHWVSTGCEVRSGPEFITRSYRFYHNNTFKAYQFYYGSNRCTNPTYTLIIRGKIRLRQASWIIRGGTEADYQLHNVQVICHTEAVAEKLGQQVNRTCPGFLADGGPWVQDVAYDLWREENGCECTKAVNFAMHELQLIRVEKQYLHHNLDHLVEELFLGDIHTDATQRMFYRPSSYQPPLQNAKNHDHACIACXIIYRSDEHHPPILPPKADLTIGLHGEWVSQRCEVRPEVLFLTRHFIFHDNNNTWEGHYYHYSDPVCKHPTFSIYARGRYSRGVLSSRVMGGTEFVFKVNHMKVTPMDAATASLLNVFNGNECGAEGSWQVGIQQDVTHTNGCVALGIKLPHTEYEIFKMEQDARGRYLLFNGQRPSDGSSPDRPRRKKGXKXXKXAPP

SEQ ID NO: 10291 - protein, 215 aa, Homo sapiens
CEVRPEVLFLTRHFIFHDNNNTWEGHYYHYSDPVCKHPTFSIYARGRYSRGVLSSRVMGGTEFVFKVNHMKVTPMDAATASLLNVFNGNECGAEGSWQVGIQQDVTHTNGCVALGIKLPHTEYEIFKMEQDARGRYLLFNGQRPSDGSSPDRPEKRATSYQMPLVQCASSSPRAEDLAEDSGSSLYGRAPGRHTWSLLLAALACLVPLLHWNIRR

SEQ ID NO: 10292 - protein, 59 aa, Homo sapiens
MATFSLCYLMAFPLCAGIAGISVCVKISCFYKDISQTGLRPTLKAYLNFNLLFSGPIQI

SEQ ID NO: 10293 - protein, 93 aa, Homo sapiens; identical to SEQ ID NO: 7559

SEQ ID NO: 10294 - protein, 124 aa, Homo sapiens
  SITE (19): Xaa equals any amino acid
  SITE (25): Xaa equals any amino acid
  SITE (28): Xaa equals any amino acid
  SITE (56): Xaa equals any amino acid
  SITE (70): Xaa equals any amino acid
ALPFTLNKTSNYPQDLVLXSLLLGXNYXQLQILLECIFPVPHSLLYVVLPNSIDLXQKLPRDLPHLPCPXFLWPRPGSPPKCFLSLSLTALPLSSCRYTLPPSPHPLMPSPLLPSWVQPSCYLA

SEQ ID NO: 10295 - protein, 105 aa, Homo sapiens
  SITE (69): Xaa equals any amino acid
MFALAWKVIFSVMLQNPIRYPSVLGIKSSLLSSLVLVMVWGNEKSGPCPTPKSRKGRRSCPAQVGRGEXGSYWDPEFRLSRKSNQGLRRDYLSLYHFNLHFRDTF

SEQ ID NO: 10296 - protein, 37 aa, Homo sapiens
MVAVDFSCLSFILLGILVLYIYFVMYACSIPTLFSVL

SEQ ID NO: 10297 - protein, 1 aa, Homo sapiens
C

SEQ ID NO: 10298 - protein, 13 aa, Homo sapiens
CFHFFLCPILVLV

SEQ ID NO: 10299 - protein, 40 aa, Homo sapiens
MNGLFQLEISHKLWTKSKTSLMTLLSVMALLWKILWSRAI

SEQ ID NO: 10300 - protein, 58 aa, Homo sapiens; identical to SEQ ID NO: 7566

SEQ ID NO: 10301 - protein, 108 aa, Homo sapiens; identical to SEQ ID NO: 7570

SEQ ID NO: 10302 - protein, 29 aa, Homo sapiens
MDQFLQYLLECMLLCTTAGASGATYVPTR

SEQ ID NO: 10303 - protein, 293 aa, Homo sapiens
LAPLIALVYSVPRLSRWLAQPYYLLSALLSAAFLLVRKLPPLCHGLPTQREDGNPCDFDWREVEILMFLSAIVMMKNRRSITVEQHIGNIFMFSKVANTILFFRLDIRMGLLYITLCIVFLMTCKPPLYMGPEYIKYFNDKTIDEELERDKRVTWIVEFFANWSNDCQSFAPIYADLSLKYNCTGLNFGKVDVGRYTDVSTRYKVSTSPLTKQLPTLILFQGGKEAMRRPQIDKKGRAVSWTFSEENVIREFNLNELYQRAKKLSKAGDNIPEEQPVASTPTTVSDGENKKDK

SEQ ID NO: 10304 - protein, 363 aa, Homo sapiens
MGFLQLLVVAVLASEHRVAGAAEVFGNSSEGLIEFSVGKFRYFELNRPFPEEAILHDISSNVTFLIFQIHSQYQNTTVSFSPTLLSNSSETGTASGLVFILRPEQSTCTWYLGTSGIQPVQNMAILLSYSERDPVPGGCNLEFDLDIDPNIYLEYNFFETTIKFAPANLGYARGVDPPPCDAGTDQDSRWRLQYDVYQYFLPENDLTEEMLLKHLQRMVSVPQVKASALKVVTLTANDKTSVSFSSLPGQGVIYNVIVWDLFLNTSAAYIPAHTYACSFEAGEGSCASLGRVSSKVFFTLFALLGFFICFFGQRFWKTELFFIGFIIMGFFFYILITRLTPIKYDAEHTDLWSHWLLFGGFSH

SEQ ID NO: 10305 - protein, 285 aa, Homo sapiens
  SITE (259): Xaa equals any amino acid
  SITE (262): Xaa equals any amino acid
  SITE (280): Xaa equals any amino acid
MGFLQLLVVAVLASEHRVAGAAEVFGNSSEGLIEFSVGKFRYFELNRPFPEEAILHDISSNVTFLIFQIHSQYQNTTVSFSPTLLSNSSETGTASGLVFILRPEQSTCTWYLGTSGIQPVQNMAILLSYSERDPVPGGCNLEFDLDIDPNIYLEYNFFETTIKFAPANLGYARGVDPPPCDAGTDQDSRWRLQYDVYQYFLPENDLTEEMLLKHLQRMVSVPQVKASALKVVTLTANDKTSVSFSSLPGQGVIYNVIVXGPXSKYICCLHSCSHIRLQLXRAGRG

SEQ ID NO: 10306 - protein, 417 aa, Homo sapiens
LFLFSKYTHSIRIQLFPFLRGVDPPPCDAGTDQDSRWRLQYDVYQYFLPENDLTEEMLLKHLQRMVSVPQVKASALKVVTLTANDKTSVSFSSLPGQGVIYNVIVWDPFLNTSAAYIPAHTYACSFEAGEGSCASLGRVSSKVFFTLFALLGFFICFFGHRFWKTELFFIGFIIMGFFFYILITRLTPIKYDVNLILTAVTGSVGGMFLVAVWWRFGILSICMLCVGLVLGFLISSVTFFTPLGNLKIFHDDGVFWVTFSCIAILIPVVFMGCLRILNILTCGVIGSYSVVLAIDSYWSTSLSYITLNVLKRALNKDFHRAFTNVPFQTNDFIILAVWGMLAVSGITLQIRRERGRPFFPPHPYKLWKQERERRVTNILDPSYHIPPLRERLYGRLTQIKGLFQKEQPAGERTPLLL

SEQ ID NO: 10307 - protein, 127 aa, Homo sapiens
MVPGAAGWCCLVLWLPACVAAHGFRIHDYLYFQVLSPGDIRYIFTATPAKDFGGIFHTRYEQIHLVPAEPPEACGELSNGFFIQDQIALVERGGCSFLSKTRVVQEHGGRAVIISDNALTMTASTWR

SEQ ID NO: 10308 - protein, 91 aa, Homo sapiens
MGLKLNGRYISLILAVQIAYLVQAVRAAGKCDAVFKGFSDCLLKLGDTWPTTRSLGRQDEHQDRVHILGGFPQLHGHSPYGLPGRGERYVG

SEQ ID NO: 10309 - protein, 77 aa, Homo sapiens
MGTHPKYLEMMELDIGDATQVYVAFLVYLDLMESKSWHEVNCVGLPELQLICLVGTEIEGEGLQTVVPNPHHCFPQP

SEQ ID NO: 10310 - protein, 107 aa, Homo sapiens
GLDVQPVAQGSKLTQEVREGCLAVAGANGFRGGYDGYRPSFSNTPNSGYTQSQFSAPRDYSGYQRDGYQQNFKRGSGQSGPRGAPRGRGGPPRPNRGMPQMNTQQVN

SEQ ID NO: 10311 - protein, 75 aa, Homo sapiens; identical to SEQ ID NO: 7585

SEQ ID NO: 10312 - protein, 56 aa, Homo sapiens
  SITE (3): Xaa equals any amino acid
  SITE (4): Xaa equals any amino acid
  SITE (14): Xaa equals any amino acid
  SITE (21): Xaa equals any amino acid
FAXXDGFQLHPCPXKGHELIXFYGCIVFHGVYVPHFLNLVCHCWTFGLVPSLCYCE

SEQ ID NO: 10313 - protein, 43 aa, Homo sapiens
  SITE (7): Xaa equals any amino acid
YSMVYMXHIFLIQSIIDGHLGWFQVFAIVNSATVNIRVHVSLW

SEQ ID NO: 10314 - protein, 96 aa, Homo sapiens
MYRERLRTLLVIAVVMSLLNALSTSGGSISWNDFVHEMLAKGEVQRVQVVPESDVVEVYLHPGAVVFGRPRLALMYRMQLQILTSLKRSFEQLKMS

SEQ ID NO: 10315 - protein, 41 aa, Homo sapiens
MPSGCRCLHLVCLLCILGAPGQPVRADDCSPTVTWPTAAVN

SEQ ID NO: 10316 - protein, 20 aa, Homo sapiens
PGLCSQLHVPLLGGLCGCPL

SEQ ID NO: 10317 - protein, 553 aa, Homo sapiens
  SITE (39): Xaa equals any amino acid
  SITE (199): Xaa equals any amino acid
  SITE (201): Xaa equals any amino acid
  SITE (202): Xaa equals any amino acid
  SITE (228): Xaa equals any amino acid
  SITE (420): Xaa equals any amino acid
  SITE (434): Xaa equals any amino acid
  SITE (440): Xaa equals any amino acid
  SITE (452): Xaa equals any amino acid
MKIATVSVLLPLALCLIQDAASKNEDQEMCHEFQAFMKXGKLFCPQDKKFFQSLDGIMFINKCATCKMILEKEAKSQKRARHLARAPKATAPTELNCDDFKKGERDGDFICPDYYEAVCGTDGKTYDNRCALCAENAKTGSQIGVKSEGECKSSNPEQDVCSAFRPFVRDGRLGCTRENDPVLGPDGKTHGNKCAMCAXLXXKEAENAKREGETRIRRNAEKDFCKEXEKQVRNGRLFCTRESDPVRGPDGRMHGNKCALCAEIFKQRFSEENSKTDQNLGKAEEKTKVKREIVKLCSQYQNQAKNGILFCTRENDPIRGPDGKMHGNLCSMCQAYFQAENEEKKKAEARARNKRESGKATSYAELCSEYRKLVRNGKLACTRENNPIQGPDGKVHGNTCSMCEVFFQAEEEEKKKKEGXSRNKRQSKSTASFXELCSEXRKSRKNGRLFCXRENDPIQGPDGKMHGNTCSMCEAFFQQEERARAKAKREAAKEICSEFRDQVRNGTLICTREHNPVRGPDGKMHGNKCAMCASVFKLEKKKKKKKKKKGRPL

SEQ ID NO: 10318 - protein, 105 aa, Homo sapiens [sequence omitted]

SEQ ID NO: 10319 - protein, 153 aa, Homo sapiens
MLKDFSNLLLVVLCDYVLGEAEYLLLREPGHVALSNDTVYVDFQYFDGANGTLRNVSVLLLEANTNQTVTTKYLLTNQSQGTLKFECFYFKEAGDYWFTMTPEATDNSTPFPWWEKSAFLKVEWPVFHVDLNRSAKAAEGTFQVGLFTSQPLC

SEQ ID NO: 10320 - protein, 78 aa, Homo sapiens
SSPTSPKDNYQRVSSLSPSQCRKDKCQSFPTHPEFAFYDNTSFGLTEAEQRMLDLPGYFGSNEEDETTSTLSVEKLVI

SEQ ID NO: 10321 - protein, 101 aa, Homo sapiens
  SITE (47): Xaa equals any amino acid
  SITE (98): Xaa equals any amino acid
MSWVQATLLARGLCRAWGGTCGAALTGTSISQVPRRLPRGLHCSALXIALNSPWFPAHRNPGRGPPRLWCPLRTCLGRRLVGNGTRRASCRRCRNLRXQRA

SEQ ID NO: 10322 - protein, 178 aa, Homo sapiens
  SITE (123): Xaa equals any amino acid
  SITE (175): Xaa equals any amino acid
MAMVPGATLRRLLSVVLPTASQPQLLALLDSATERHVDHAAESDGGAEQADVGRRRKHQSWWQALDGKLRGDLISRGLEKMLWARKRKQSILKKTCLPLRERMIFSGKGSWPHLSLEPIGELXPVPIVGAETIDLLNTGEKLFIFRNPKEPEISLHVPPRKKKNFLNAKKAMRAXGMD

SEQ ID NO: 10323 - protein, 61 aa, Homo sapiens
MTLIEGVGDEVTVLFSVLACLLVLALAWVSTHTAEGGDPLPQPSGTPTPSQPSAAWQLPTA

SEQ ID NO: 10324 - protein, 277 aa, Homo sapiens
  SITE (158): Xaa equals any amino acid
  SITE (277): Xaa equals any amino acid
MGLRSWLAAPWGALPPRPPLLLLLLLLLLLQPPPPTWALSPRISLPLGSEERPFLRFEAEHISNYTALLLSRDGRTLYVGAREALFALSSNLSFLPGGEYQELLWGADAEKKQQCSFKGKDPQRDCQNYIKILLPLSGSHLFTCGTAAFSPMCTYINXENFTLARDEKGNVLLEDGKGRCPFDPNFKSTALVVDGELYTGTVSSFQGNDPAISRSQSLRPTKTESSLNWLQDPAFVASAYIPESLGSLQGDDDKIYFFFSETGQEFEFFENTIVSGX

SEQ ID NO: 10325 - protein, 57 aa, Homo sapiens
  SITE (8): Xaa equals any amino acid
  SITE (9): Xaa equals any amino acid
MRTDYPRXXRSCLCVSLSPPLVSKGSHRSRWLRTMAVPAGTQVWRQDLQPLGAVLLQ

SEQ ID NO: 10326 - protein, 386 aa, Homo sapiens
MKFQGPLACLLLALCLGSGEAGPLQSGEESTGTNIGEALGHGLGDALSEGVGKAIGKEAGGAAGSKVSEALGQGTREAVGTGVRQVPGFGAADALGNRVGEAAHALGNTGHEIGRQAEDVIRHGADAVRGSWQGVPGHNGAWETSGGHGIFGSQGGLGGQGQGNPGGLGTPWVHGYPGNSAGSFGMNPQGAPWGQGGNGGPPNFGTNTQGAVAQPGYGSVRASNQNEGCTNPPPSGSGGGSSNSGGGSGSQSGSSGSGSNGDNNNGSSSGGSSSGSSSGGSSGGSSGGSSGNSGGSRGDSGSESSWGSSTGSSSGNHGGSGGGNGHKPGCEKPGNEARGSGESGIQNSETSPGMFNFDTFWKNFKSKLGFINWDAINKDQRSSRIP

SEQ ID NO: 10327 - protein, 386 aa, Homo sapiens; identical to SEQ ID NO: 10326

SEQ ID NO: 10328 - protein, 107 aa, Homo sapiens [sequence omitted]

SEQ ID NO: 10329 - protein, 119 aa, Homo sapiens; identical to SEQ ID NO: 7610

SEQ ID NO: 10330 - protein, 535 aa, Homo sapiens
MLLLLLLLPPLLCGRVGAKEQKDYLLTMQKSVTVQEGLCVSVLCSFSYPQNGWTASDPVHGYWFRAGDHVSRNIPVATNNPARAVQEETRDRFHLLGDPQNKDCTLSIRDTRESDAGTYVFCVERGNMKWNYKYDQLSVNVTASQDLLSRYRLEVPESVTVQEGLCVSVPCSVLYPHYNWTASSPVYGSWFKEGADIPWDIPVATNTPSGKVQEDTHGRFLLLGDPQTNNCSLSIRDARKGDSGKYYFQVERGSRKWNYIYDKLSVHVTALTHMPTFSIPGTLESGHPRNLTCSVPWACEQGTPPTITWMGASVSSLDPTITRSSMLSLIPQPQDHGTSLTCQVTLPGAGVTMTRAVRLNISYPPQNLTMTVFQGDGTASTTLRNGSALSVLEGQSLHLVCAVDSNPPARLSWTWGSLTLSPSQSSNLGVLELPRVHVKDEGEFTCRAQNPLGSQHISLSLSLQNEYTGKMRPISGVTLGAFGGAGATALVFLYFCIIFVVVRSCRKKSARPAVAWGIQAWRTQTLSGAQPLRDP

SEQ ID NO: 10331 - protein, 595 aa, Homo sapiens
MLLLLLLLPPLLCGRVGAKEQKDYLLTMQKSVTVQEGLCVSVLCSFSYPQNGWTASDPVHGYWFRAGDHVSRNIPVATNNPARAVQEETRDRFHLLGDPQNKDCTLSIRDTRESDAGTYVFCVERGNMKWNYKYDQLSVNVTASQDLLSRYRLEVPESVTVQEGLCVSVPCSVLYPHYNWTASSPVYGSWFKEGADIPWDIPVATNTPSGKVQEDTHGRFLLLGDPQTNNCSLSIRDARKGDSGKYYFQVERGSRKWNYIYDKLSVHVTALTHMPTFSIPGTLESGHPRNLTCSVPWACEQGTPPTITWMGASVSSLDPTITRSSMLSLIPQPQDHGTSLTCQVTLPGAGVTMTRAVRLNISYPPQNLTMTVFQGDGTASTTLRNGSALSVLEGQSLHLVCAVDSNPPARLSWTWGSLTLSPSQSSNLGVLELPRVHVKDEGEFTCRAQNPLGSQHISLSLSLQNEYTGKMRPISGVTLGAFGGAGATALVFLYFCIIFVVVRSCRKKSARPAVGVGDTGMEDANAVRGSASQGPLIESPADDSPPHHAPPALATPSPEEGEIQYASLSFHKARPQYPQEQEAIGYEYSEINIPK

SEQ ID NO: 10332 - protein, 88 aa, Homo sapiens [sequence omitted]

SEQ ID NO: 10333 - protein, 63 aa, Homo sapiens
MRDLSFLYTLLWLPEIWQALAGGIRLDEVELLENEAVLGEEMRLYRKINEVVLSGNEVVLGGK

SEQ ID NO: 10334 - protein, 303 aa, Homo sapiens
  SITE (203): Xaa equals any amino acid
  SITE (267): Xaa equals any amino acid
  SITE (274): Xaa equals any amino acid
MGSGGDSLLGGRGSLPLLLLLIMGGMAQDSPPQILVHPQDQLFQGPGPARMSCRASGQPPPTIRWLLNGQPLSMVPPDPHHLLPDGTLLLLQPPARGHAHDGQALSTDLGVYTCEASNRLGTAVSRGARLSVAVLREDFQIQPRDMVAVVGEQFTLECGPPWGHPEPTVSWWKDGKPLALQPGRHTVSGGSLLMARAEKSDEXTYMCVATNSAGHRESRAARVSIQEPQDYTEPVELLAVRIQLENVTLLNPDPAEGPKPRPAVWLXWKVSGPXRLPNLTRPCSGPRLPREARELRGQRRNTG

SEQ ID NO: 10335 - protein, 136 aa, Homo sapiens
SAQALHHPPHQGPPLFPSSAHPTVPPYPSQATHHTTLGPGPQHQPSGTGPHCPLPVTGPHLQPQGPNSIPTPTASGFCPHPGSVALPWGFKDLSRHLQCLDRFQFTEHRCHQHFKTITMGQGGIKMDSKNIFLNVL

SEQ ID NO: 10336 - protein, 58 aa, Homo sapiens; identical to SEQ ID NO: 7627
  SITE (52): Xaa equals any amino acid

SEQ ID NO: 10337 - protein, 58 aa, Homo sapiens
MAVFLISSSYFLLCVFTIRSLRAWVLPFTSVPRAQGGSCCRSQWLYKTLPPCLVCKPV

SEQ ID NO: 10338 - protein, 39 aa, Homo sapiens
MGFLLLFFVISSTCYTLLAQSIFLEHFCISYGNKFYTLD

SEQ ID NO: 10339 - protein, 120 aa, Homo sapiens
MRLTRKRLCSFLIALYCLFSLYAAYHVFFGRRRQAPAGSPRGLRKGAAPARERRGREQSTLESEEWNPWEGDEKNEQQHRFKTSLQILDKSTKGKTDLSVQIWGKAAIVQAGSVSAHKTF

SEQ ID NO: 10340 - protein, 27 aa, Homo sapiens
MPYGPDPILSNVLLAGYIVLQTLSCPR

SEQ ID NO: 10341 - protein, 58 aa, Homo sapiens
  SITE (19): Xaa equals any amino acid
  SITE (25): Xaa equals any amino acid
  SITE (28): Xaa equals any amino acid
  SITE (46): Xaa equals any amino acid
SRCAGAPLQNNGPVREATXLTLQNXGPXREATHLTLQNNGPMREAXHLVLHKWSICLR

SEQ ID NO: 10342 - protein, 42 aa, Homo sapiens
MVPSVTLILHCPGFSTESHMCGKPLSPRPTRTVGRPVSNIPV

SEQ ID NO: 10343 - protein, 89 aa, Homo sapiens
  SITE (17): Xaa equals any amino acid
  SITE (47): Xaa equals any amino acid
VQGVVQALKTDHAFCPXLQGTESIRLRILEFELNQVRSVSQELPPGXPESPQTDGQPPRAWPQLGMPSNPTCFSFLPGYSGLRSSALNF

SEQ ID NO: 10344 - protein, 370 aa, Homo sapiens
LGGARVRRAVGLSGTGAEAGRAGAMVEKEEAGGGISEEEAAQYDRQIRLWGLEAQKRLRASRVLLVGLKGLGAEIAKNLILAGVKGLTMLDHEQVTPEDPGAQFLIRTGSVGRNRAEASLERAQNLNPMVDVKVDTEDIEKKPESFFTQFDAVCLTCCSRDVIVKVDQICHKNSIKFFTGDVFGYHGYTFANLGEHEFVEEKTKVAKVSQGVEDGPDTKRAKLDSSETTMVKKKVVFCPVKEALEVDWSSEKAKAALKRTTSDYFLLQVLLKFRTDKGRDPSSDTYEEDSELLLQIRNDVLDSLGISPDLLPEDFVRYCFSEMAPVCAVVGGILAQEIVKALSQRDPPHNNFFFFDGMKGNGIVECLGPK

SEQ ID NO: 10345 - protein, 4 aa, Homo sapiens
VGFL

SEQ ID NO: 10346 - protein, 38 aa, Homo sapiens
CFLLADVGNSIIFITNFMEQHQFRVKLENQCILIFVDY

SEQ ID NO: 10347 - protein, 322 aa, Homo sapiens; identical to SEQ ID NO: 7639

SEQ ID NO: 10348 - protein, 22 aa, Homo sapiens
MAAACGPGAAGTACSSACICFC

SEQ ID NO: 10349 - protein, 227 aa, Homo sapiens
MDFENLFSKPPNPALGKTATDSDERIDDEIDTEVEETQEEKIKLECEQIPKKFRHSAISPKSSLHRKSRSKDYDVYSDNDICSQESEDNFAKELQQYIQAREMANAAQPEESTKKEGVKDTPQAAKQKNKNLKAGHKNGKQKKMKRKWPGPGNKGSNALLRNSGSQEEDGKPKEKQQHLSQAFINQHTVERKGKQICKYFLERKCIKGDQCKFDHDAEIEKKKKKTR

SEQ ID NO: 10350 - protein, 53 aa, Homo sapiens
MCPPSQRAPTHLLCPWVDPGPVVLGLSLWVLAGGMGEGGEQLPAPLLCGSSFF

SEQ ID NO: 10351 - protein, 107 aa, Homo sapiens
MLVLLLDFLGLVHLGQLLIFHIYLKAKKMTTFEYLINNRKEESSKHQAVRKDPYVQMDKGVLQQGAGALGSSAQGVKAKSSLLIHKHLCHFCTSVNQDGDSTARVHL

SEQ ID NO: 10352 - protein, 6 aa, Homo sapiens
VFQIYL

SEQ ID NO: 10353 - protein, 6 aa, Homo sapiens
VFQIYL

SEQ ID NO: 10354 - protein, 49 aa, Homo sapiens
MCSLFESRFFCFVLFSEKIIQLCASIAFLCFVKHVPWPKWKRKCLINAF

SEQ ID NO: 10355 - protein, 167 aa, Homo sapiens; identical to SEQ ID NO: 7667

SEQ ID NO: 10356 - protein, 229 aa, Homo sapiens
MDPDRAFICGESRQFAQCLIFGFLFLTSGMLISVLGIWVPGCGSNWAQEPLNETDTGDSEPRMCGFLSLQIMGPLIVLVGLCFFVVAHVKKRNTLNAGQDASEREEGQIQIMEPVQVTVGDSVIIFPPPPPPYFPESSASAVAESPGTNSLLPNENPPSYYSIFNYGTPTSEGAASERDCESIYTISGTNSSSEASHTPHLPSELPPRYEEKENAAATFLPLSSEPSPP

SEQ ID NO: 10357 - protein, 105 aa, Homo sapiens
MLCMQTVMPQHTYLQHLVFGFCLLILCINLSVLAHRYTLCYFSMTGEYSIINGQLLVYLSNLSAQWKYRYFQTLLVLKKKKKKKKKKKKKKKKKKKKKKKKKKKK

SEQ ID NO: 10358 - protein, 84 aa, Homo sapiens
  SITE (76): Xaa equals any amino acid
  SITE (78): Xaa equals any amino acid
  SITE (79): Xaa equals any amino acid
  SITE (80): Xaa equals any amino acid
  SITE (84): Xaa equals any amino acid
MLCMQTVMPQHTYLQHLVFGFCLLILCINLSVLAHRYTLCYFSMTGEYSIINGQLLVYLSNLSAQWKYRYFQTLLXLXXXGVVX

SEQ ID NO: 10359 - protein, 75 aa, Homo sapiens
  SITE (62): Xaa equals any amino acid
MPLAPSPVMLILVILLLFCPSFQFLPISFYSFNVYAFAFSGISPPSCLHGWLHFIQSSFFLXYSDNILVSPSLYL

SEQ ID NO: 10360 - protein, 103 aa, Homo sapiens; identical to SEQ ID NO: 7672

SEQ ID NO: 10361 - protein, 81 aa, Homo sapiens; identical to SEQ ID NO: 7673

SEQ ID NO: 10362 - protein, 8 aa, Homo sapiens
MLILFLKK

SEQ ID NO: 10363 - protein, 495 aa, Homo sapiens
MSMLVVFLLLWGVTWGPVTEAAIFYETQPSLWAESESLLKPLANVTLTCQARLETPDFQLFKNGVAQEPVHLDSPAIKHQFLLTGDTQGRYRCRSGLSTGWTQLSKLLELTGPKSLPAPWLSMAPVSWITPGLKTTAVCRGVLRGVTFLLRREGDHEFLEVPEGQEDVEATFPVHQPGNYSCSYRTDGEGALSEPSATVTIEELAAPPPPVLMHHGESSQVLHPGNKVTLTCVAPLSGVDFQLRRGEKELLVPRSSTSPDRIFFHLNAVALGDGGHYTCRYRLHDNQNGWSGDSAPVELILSDETLPAPEFSPEPESGRALRLRCLAPLEGARFALVREDRGGRRVHRFQSPAGTEALFELHNISVADSANYSCVYVDLKPPFGGSAPSERLELHVDGPPPRPQLRATWSGAVLAGRDAVLRCEGPIPDVTFELLREGETKAVKTVRTPGAAANLELIFVGPQHAGNYRCRYRSWVPHTFESELSDPVELLVAES

SEQ ID NO: 10364 - protein, 495 aa, Homo sapiens
  SITE (330): Xaa equals any amino acid
  SITE (333): Xaa equals any amino acid
MSMLVVFLLLWGVTWGPVTEAAIFYETQPSLWAESESLLKPLANVTLTCQARLETPDFQLFKNGVAQEPVHLDSPAIKHQFLLTGDTQGRYRCRSGLSTGWTQLSKLLELTGPKSLPAPWLSMAPVSWITPGLKTTAVCRGVLRGVTFLLRREGDHEFLEVPEAQEDVEATFPVHQPGNYSCSYRTDGEGALSEPSATVTIEELAAPPPPVLMHHGESSQVLHPGNKVTLTCVAPLSGVDFQLRRGEKELLVPRSSTSPDRIFFHLNAVALGDGGHYTCRYRLHDNQNGWSGDSAPVELILSDETLPAPEFSPEPESGRALRLRCLAPLXGAXFALVREDRGGRRVHRFQSPAGTEALFELHNISVADSANYSCVYVDLKPPFGGSAPSERLELHVDGPPPRPQLRATWSGAVLAGRDAVLRCEGPIPDVTFELLREGETKAVKTVRTPGAAANLELIFVGPQHAGNYRCRYRSWVPHTFESELSDPVELLVAES

SEQ ID NO: 10365 - protein, 66 aa, Homo sapiens
MTYFSGLLVILAFAAWVALAEGLGVAVYAAAVLLGAGCATILVTSLAMTADLIGPHTNSGLSCTAP

SEQ ID NO: 10366 - protein, 390 aa, Homo sapiens
MLPTWWIVSSWLVWGVILFVYLVIRALRLWRTAKLQVTLKKYSVHLEDMATNSRAFTNLVRKALRLIQETEVISRGFTLVSAACPFNKAGQHPSQHLIGLRKAVYRTLRANFQAARLATLYMLKNYPLNSESDNVTNYICVVPFKELGLGLSEEQISEEEAHNFTDGFSLPALKVLFQLWVAQSSEFFRRLALLLSTANSPPGPLLTPALLPHRILSDVTQGLPHAHSACLEELKRSYEFYRYFETQHQSVPQCLSKTQQKSRELNNVHTAVRSLQLHLKALLNEVIILEDELEKLVCTKETQELVSEAYPILEQKLKLIQPHVQASNNCWEEAISQVDKLLRRNTDKKGKPEIACENPHCTVSTFEAAYSTHCRQRSNPRGAGIRSLCR

SEQ ID NO: 10367 - protein, 36 aa, Homo sapiens
MWTCPGIAALVLMIVPGCSLCPAQVVHHVGQRESPS

SEQ ID NO: 10368 - protein, 57 aa, Homo sapiens [sequence omitted]

SEQ ID NO: 10369 - protein, 34 aa, Homo sapiens
MTGFAQFCVILGLNLSLFGTFPYLLPSSESRCRK

SEQ ID NO: 10370 - protein, 73 aa, Homo sapiens
MAGNIQAVETGYVLICLIVPLLLCGLREGQEVPFDVNKAKYLPTFLKKKKKKKKKKKKKKKKKKKKKKKKKKI

SEQ ID NO: 10371 - protein, 65 aa, Homo sapiens [sequence omitted]

SEQ ID NO: 10372 - protein, 65 aa, Homo sapiens [sequence omitted]

SEQ ID NO: 10373 - protein, 49 aa, Homo sapiens; identical to SEQ ID NO: 7702

SEQ ID NO: 10374 - protein, 103 aa, Homo sapiens
SLDTALLSTLCSLAFTAASTSSTVAYVTNPKPLEHLVFGSLITTVCECSLLLRMAHWTLTGHFKAQLSDEELLQLLGLLKRLCLRHDSSGKRDFNDVFSGIHG

SEQ ID NO: 10375 - protein, 122 aa, Homo sapiens
MLMLAVLMAATHAVYGKLLLFEYRHRKMKPVQMVPAISQNWTFHGPGATGQAAANWIAGFGRGPCHQPCWVSGRMGMQPAGGYWAWTRSRVKSSWAACSTRSHCSFCSSGHPTSWPATGECL

SEQ ID NO: 10376 - protein, 64 aa, Homo sapiens
  SITE (38): Xaa equals any amino acid
  SITE (51): Xaa equals any amino acid
MKVLISSLLLLLPLMLMSMVSSSLNPGVARGHRDRGQXSRRWLQEGGQECXCKDWFLRAREENS

SEQ ID NO: 10377 - protein, 53 aa, Homo sapiens; identical to SEQ ID NO: 7706

SEQ ID NO: 10378 - protein, 53 aa, Homo sapiens; identical to SEQ ID NO: 7706

SEQ ID NO: 10379 - protein, 272 aa, Homo sapiens
MCCWPLLLLWGLLPGTAAGGSGRTYPHRTLLDSEGKYWLGWSQRGSQIAFRLQVRTAGYVGFGFSPTGAMASADIVVGGVAHGRPYLQDYFTNANRELKKDAQQDYHLEYAMENSTHTIIEFTRELHTCDINDKSITDSTVRVIWAYHHEDAGEAGPKYHDSNRGTKSLRLLNPEKTSVLSTALPYFDLVNQDVPIPNKDTTYWCQMFKIPVFQEKHHVIKVEPVIQRGHESLVHHILLYQCSNNFNDSVPGIRARIAITPTCPMHSSPVKL

SEQ ID NO: 10380 - protein, 341 aa, Homo sapiens
MLQPTHLSLQLRLQCLAASHLVTLLICLMAPASATGGSADLFGGFADFGSAAASGSFPSQVTATSGNGDFGDWSAFNQAPSGPVASSGEFFGSASQPAVELVSGSQSALGPPPAASNSSDLFDLMGSSQATMTSSQSMNFSMMSTNTVGLGLPMSRSQPLQNVSTVLQKPNPLYNQNTDMVQKSVSKTLPSTWSDPSVNISLDNLLPGMQPSKPQQPSLNTMIQQQNMQQPMNVMTQSFGAVNLSSPSNMLPVRPQTNALIGGPMPMSMPNVMTGTMGMAPLGNTPMMNQSMMGMNMNIGMSAAGMGLTGTMGMGMPNIAMTSGTVQPKQDAFANFANFSK

SEQ ID NO: 10381 - protein, 30 aa, Homo sapiens
TTLLFFFVFWLLECSICDTYLKFEISFCTV

SEQ ID NO: 10382 - protein, 39 aa, Homo sapiens; identical to SEQ ID NO: 7719

SEQ ID NO: 10383 - protein, 39 aa, Homo sapiens; identical to SEQ ID NO: 7719

SEQ ID NO: 10384 - protein, 21 aa, Homo sapiens
MLLFLILFFYEKNQCQSADPL

SEQ ID NO: 10385 - protein, 121 aa, Homo sapiens
MLRGTMTAWRGMRPEVTLACLLLATAGCFADLNEVPQVTVQPASTVQKPGGTVILGCVVEPPRMNVTWRLNGKELNGSDDALGVLITHGTLVITALNNHTVGRYQCVARMPAGAVATCQPL

SEQ ID NO: 10386 - protein, 268 aa, Homo sapiens
MEVAEPSSPTEEEEEEEEHSAEPRPRTRSNPEGAEDRAVGAQASVGSRSEGEGEAASADDGSLNTSGAGPKSWQVPPPAPEVQIRTPRVNCPEKVIICLDLSEEMSLPKLESFNGSKTNALNVSQKMIEMFVRTKHKIDKSHEFALVVVNDDTAWLSGLTSDPRELCSCLYDLETASCSTFNLEGLFSLIQQKTELPVTENVQTIPPPYVVRTILVYSRPPCQPQFSLTEPMKKMFQCPYFFFDVVYIHNGTEEKEEEDEAIEVEATV

SEQ ID NO: 10387 - protein, 379 aa, Homo sapiens
  SITE (264): Xaa equals any amino acid
  SITE (296): Xaa equals any amino acid
MARRSAFPAAALWLWSILLCLLALRAEAGPPQEESLYLWIDAHQARVLIGFEEDILIVSEGKMAPFTHDFRKAQQRMPAIPVNIHSMNFTWQAAGQAEYFYEFLSLRSLDKGIMADPTVNVPLLGTVPHKASVVQVGFPCLGKQDGVAAFEVDVIVMNSEGNTILQTPQNAIFFKTCQQAECPGGCRNGGFCNERRICECPDGFHGPHCEKALCTPRCMNGGLCVTPGFCICPPGFYGVNCDKANCSTTCFNGGTCFYPGKCIXPPGLEGEQCEISKCPQPCRNGGKCIGKSKCKXSKGYQGDLCSKPVCEPGCGAHGTCHEPNKCQCQEGWHGRHCNKRYEASLIHALRPAGAQLRQHTPSLKKAEERRDPPESNYIW

SEQ ID NO: 10388 - protein, 190 aa, Homo sapiens [sequence omitted]

SEQ ID NO: 10389 - protein, 88 aa, Homo sapiens
  SITE (63): Xaa equals any amino acid
  SITE (73): Xaa equals any amino acid
MPVGSLPHPGCLWAAFLTLDACGLPSSPWMPVGSLPHPGCLWAAFLTLDACGQPSSPWMPVGXLLTLDACGQXSSPGCLWAAFLTWSL

SEQ ID NO: 10390 - protein, 70 aa, Homo sapiens
AAMRRWASSSLEGEELSTQRDLTRKVHPPSTQEAPADSMCFRLCWPNGLCRDYSALPLWLQSDHRPSESE

SEQ ID NO: 10391 - protein, 61 aa, Homo sapiens
MVLINSGKPGSKCCWVFRPGLSAPCSALWWGCPGLALSLSGPQVRLFTRRYETTLPNTGPW

SEQ ID NO: 10392 - protein, 40 aa, Homo sapiens
MFVFLSVLYSLSLEYMFLFVFGKKISFTSLHSDQLGKKKA

SEQ ID NO: 10393 - protein, 161 aa, Homo sapiens
MTSALRGVADDQGQHPLLKMLLHLLAFSSAATGHLQASVLTQCLKVLVKLAENTSCDFLPRFQCVFQVLPKCLSPETPLPSVLLAVELLSLLADHDQLAPQLCSHSEGCLLLLLYMYITSRPDRVALETQWLQLEQEVVWLLAKLGVQEPLAPSHWLQLPV

SEQ ID NO: 10394 - protein, 90 aa, Homo sapiens
DLTCLLSSNFIIGINVHFFPVPVSEAFICVCMCVLNKCIRYLKNSNLNLNNLKNEIVILCVKVSDVLYSALKTIFIYSSTDTKYILKLLS

SEQ ID NO: 10395 - protein, 50 aa, Homo sapiens [sequence omitted]

SEQ ID NO: 10396 - protein, 65 aa, Homo sapiens
  SITE (9): Xaa equals any amino acid
  SITE (21): Xaa equals any amino acid
VVVELINRXQNYFQYIVYLYXKRDGPFYGGTLSMVVFCDVLFLLLLFALFSPITALLSLKRINFI

SEQ ID NO: 10397 - protein, 39 aa, Homo sapiens
MLGLLLLCTPRAWLTLSGPVCFQGRDPLRSHRGHPSCGS

SEQ ID NO: 10398 - protein, 82 aa, Homo sapiens
  SITE (21): Xaa equals any amino acid
  SITE (33): Xaa equals any amino acid
MKTSALLPFSSSQQPGILKPXGAGTCNAQEPSXHLESTSDPRWGGPCRPAVPGGLSMAVWKAWVAGMWLSLPPLNLRSCWET

SEQ ID NO: 10399 - protein, 41 aa, Homo sapiens
MTALVWRKGPDGGSRKPILLLFFFLPLILCFHSFIHSSNIC

SEQ ID NO: 10400 - protein, 36 aa, Homo sapiens
MLTWLDLDLLFCFLFLFLFILFYFLQLNEFWGGNPF

SEQ ID NO: 10401 - protein, 89 aa, Homo sapiens [sequence omitted]

SEQ ID NO: 10402 - protein, 89 aa, Homo sapiens
  SITE (87): Xaa equals any amino acid
MFLLRPLPILLVTGGGYAGYRQYEKYRERELEKLGLEIPPKLAGHWEVALYKSVPTRLLSRAWGRLNQVELPHWLRRPVYSLYIWTXGG

SEQ ID NO: 10403 - protein, 127 aa, Homo sapiens
  SITE (107): Xaa equals any amino acid
  SITE (109): Xaa equals any amino acid
  SITE (116): Xaa equals any amino acid
MFLLRPLPILLVTGGGYAGYRQYEKYRERELEKLGLEIPPKLAGHWEVALYKSVPTRLLSRAWGRLNQVELPHWLRRPVYSLYIWTFGVNMKEAAVEDLHHYRNLSXFXRRKLKAXGPACLWPAQRD

SEQ ID NO: 10404 - protein, 47 aa, Homo sapiens
MCLLSFNCKAVLSLSLISLSFLCCLELCLARCGGRRNVSAPLKMFII

SEQ ID NO: 10405 - protein, 9 aa, Homo sapiens
MWVCSITDQ

SEQ ID NO: 10406 - protein, 264 aa, Homo sapiens
  SITE (5): Xaa equals any amino acid
  SITE (7): Xaa equals any amino acid
  SITE (13): Xaa equals any amino acid
  SITE (63): Xaa equals any amino acid
  SITE (88): Xaa equals any amino acid
  SITE (170): Xaa equals any amino acid
  SITE (171): Xaa equals any amino acid
TWGKXKXPFIESXPGGKIGWGKKGLFFLKVNYWGKKAFNPRGHSKKVTFHQLGLKKNPFWGLXKEVLGKAFSTFSYLVQHQRIHTSEXPYECKECGKAFSTSSPLAKHQRIHTGEKPYECKECGKSFTVYGQLTRHQSIHTGEKPFECKECGKAFRLSSFLHAHQRIHAXXKPYGCKECGKTFSRASYLVQHGRLHTGEKPCECKECGKAFSTGSYLVQHQRIHTGEKPYECKECGKAFISRHQLTVHQRVHTGEKPYKCKEEG

SEQ ID NO: 10407 - protein, 93 aa, Homo sapiens
  SITE (5): Xaa equals any amino acid
QRIHXGEKPYECNKCGKAFTVYGQLIGHQSVHTGEKPFECKECGKAFRLNSFLTEHQRVHTGEKPFKCKKCGKTFRYSSALKVHLRKHMSVIP

SEQ ID NO: 10408 - protein, 90 aa, Homo sapiens
  SITE (8): Xaa equals any amino acid
PYECKECXKAFRVHVHLTQHRKIHTDVKPYECKECGKTFSRASYLVQHSRIHTGKKPYECKECGKAFSSGSYLVQHQRIHTGERPYWLTY

SEQ ID NO: 10409 - protein, 10 aa, Homo sapiens
LTYLAHLLCF

SEQ ID NO: 10410 - protein, 112 aa, Homo sapiens
  SITE (12): Xaa equals any amino acid
  SITE (52): Xaa equals any amino acid
  SITE (64): Xaa equals any amino acid
  SITE (67): Xaa equals any amino acid
  SITE (68): Xaa equals any amino acid
MTFCLFVLFCLXWSLALLPRVECSGAISAHCNLHLPGSGGFSCLSLLSSWDXRHAPPCPDNFCXFSXXGVSLCWQAGLEHLTRGPPASASQSTGITGVSHPAWPRMTFKRSN

SEQ ID NO: 10411 - protein, 56 aa, Homo sapiens; identical to SEQ ID NO: 7790

SEQ ID NO: 10412 - protein, 106 aa, Homo sapiens
QGFIFWTQYNIGYISLRSIGFQHKSLPIRKSKWRKHQIIIIITQQKCGDWQWFWGFISSIRASASHFMKLLPSERTLNTPRSYCSFFLNGILKNWLKREEHSKYIL

SEQ ID NO: 10413 - protein, 99 aa, Homo sapiens; identical to SEQ ID NO: 7791

SEQ ID NO: 10414 - protein, 98 aa, Homo sapiens
MTTRQPTAVSWPCWLMSSSLSTACLAWTLTGSLAREATRRARSLSPTWNCSARQVPPSPPHSGLGRRGWAHCHLTCLLVTQLFRVGRIHPILSLPLVT

SEQ ID NO: 10415 - protein, 41 aa, Homo sapiens; identical to SEQ ID NO: 7793

SEQ ID NO: 10416 - protein, 41 aa, Homo sapiens; identical to SEQ ID NO: 7793

SEQ ID NO: 10417 - protein, 292 aa, Homo sapiens
  SITE (288): Xaa equals any amino acid
  SITE (289): Xaa equals any amino acid
MNLCVILLILVFMVPFYIGYFIVSNIRLLHKQRLLFSCLLWLTFMYFFWKLGDPFPILSPKHGILSIEQLISRVGVIGVTLMALLSGFGAVNCPYTYMSYFLRNVTDTDILALERRLLQTMDMIISKKKRMAMARRTMFQKGEVHNKPSGFWGMIKSVTTSASGSENLTLIQQEVDALEELSRQLFLETADLYATKERIEYSKTFKGKYFNFLGYFFSIYCVWKIFMATINIVFDRVGKTDPVTRGIEITVNYLGIQFDVKFWSQHISFILVGIIIVTSIRGLLITLXXVIL

SEQ ID NO: 10418 - protein, 1275 aa, Homo sapiens
  SITE (141): Xaa equals any amino acid
  SITE (208): Xaa equals any amino acid
  SITE (226): Xaa equals any amino acid
  SITE (241): Xaa equals any amino acid
  SITE (290): Xaa equals any amino acid
  SITE (369): Xaa equals any amino acid
  SITE (459): Xaa equals any amino acid
  SITE (790): Xaa equals any amino acid
  SITE (871): Xaa equals any amino acid
  SITE (908): Xaa equals any amino acid
  SITE (914): Xaa equals any amino acid
  SITE (921): Xaa equals any amino acid
  SITE (925): Xaa equals any amino acid
  SITE (996): Xaa equals any amino acid
  SITE (1035): Xaa equals any amino acid
  SITE (1042): Xaa equals any amino acid
  SITE (1055): Xaa equals any amino acid
  SITE (1090): Xaa equals any amino acid
  SITE (1252): Xaa equals any amino acid
  SITE (1261): Xaa equals any amino acid
  SITE (1268): Xaa equals any amino acid
MTGSNSHITILTLNVNGLNAPIKRHRLANWIKSQDPSVCCIQETHLTCRDTHRLKIKGWRKIYQANGKQKKAGVAILVSDKTDFKPTKIKRDKEGHYIMVKGSIQQEELTILNIYAPNTGAPRFIKQVLSDLQRDLDSHTXIMGDFNTPLSTLDRSTRQKVNKDTQELNSALHQADLIDIYRTLHPKSTEYTFFSAPHHTYSKIDHIXGSKALLSKCKRTEIITNXLSDHSAIKLELRIKXLTQNRSTTWKLNNLLLNDYWVHNEMKAEIKMFFETNENKDTTYQNLWDXFKAVCRGKFIALNAHKRKQERSKIDTLTSQLKELEKQEQTHSKASRRQEITKIRAELKEIETQKTLQKINESRSWFFEXINKIDRPLARLIKKKREKNQIDAIKNDKGDITTDPTEIQTTIREYYKHLYANKLENLEEMDKFLDTYTLPRLNQEEVESLNRPITGSEIXAIINSLPTKKSPGPDGFTAEFYQRYKEELVPFLLKLFQSIEKEGILPNSFYEASIILIPKPGRDTTKKENFRPISLMNIDAKILNKILANRIQQHIKKLIHHDQVGFIPGMQGWFNIRKSINVIQHINRTKDKNHMIISIDAEKAFDKIQQPFMLKTLNKLGIDGTYLKIIRAIYDKPTANIILNGQKLEAFPLKTGTRQGCPLSPLLFNIVLEVLARAIRQEKEIKGIQLGKEEVKLSLFADDMIVYLENPIVSAQNLLKLISNFSKVSGYKINVQKSQAFLYTNNRQTESQIMSELPFTIASKRIKYLGIQLTRDVKDLFKENYKPLLXEIKEDTNKWKNIPCSWVGRINIVKMAILPKVIYRFNAIPIKLPMTFFTELEKTTLKFIWNQKRARIAKSILSQKNKAGGIXLPDFKLYYKATVTKTAWYWYQNRDIDQWNRTEPSEIXPHIYNXLIFDKPXKNKXWGKDSLFNKWCWENWLAICRKLKLDPFLTPYTKINSRWIKDLNVRPKTIKTLEENLGNTIQDIGMGKDFMXKTPKAMATKAKIDKWDLIKLKSFCTAKETTIRVNRQPTXWEKIFAXYSSDKGLISRIYXELKQIYKKKTNNPIKKWAKDMNRHFSKEDIYAAKXHMKKCSSSLAIREMQIKTTMRYHLTPVRMAIIKKSGNNRCWRGCGEIGTLLHCWWDCKLVQPLWKSVWRFLRDLELEIPFDPAIPLLGIYPKDYKSCCYKDTCTRMFIAALFTIAKTWNQPKCPTMIDWIKKMWHIYTMEYYAAIKNDEFMSFVGTWMKLEXIILSKLSQXQKTKHRXFSLIGGN

SEQ ID NO: 10419 - protein, 1010 aa, Homo sapiens
  SITE (25): Xaa equals any amino acid
  SITE (104): Xaa equals any amino acid
  SITE (194): Xaa equals any amino acid
  SITE (362): Xaa equals any amino acid
  SITE (525): Xaa equals any amino acid
  SITE (643): Xaa equals any amino acid
  SITE (649): Xaa equals any amino acid
  SITE (656): Xaa equals any amino acid
  SITE (660): Xaa equals any amino acid
  SITE (731): Xaa equals any amino acid
  SITE (770): Xaa equals any amino acid
  SITE (777): Xaa equals any amino acid
  SITE (790): Xaa equals any amino acid
  SITE (800): Xaa equals any amino acid
  SITE (825): Xaa equals any amino acid
  SITE (987): Xaa equals any amino acid
  SITE (996): Xaa equals any amino acid
  SITE (1003): Xaa equals any amino acid
MKAEIKMFFETNENKDTTYQNLWDXFKAVCRGKFIALNAHKRKQERSKIDTLTSQLKELEKQEQTHSKASRRQEITKIRAELKEIETQKTLQKINESRSWFFEXINKIDRPLARLIKKKREKNQIDAIKNDKGDITTDPTEIQTTIREYYKHLYANKLENLEEMDKFLDTYTLPRLNQEEVESLNRPITGSEIXAIINSLPTKKSPGPDGFTAEFYQRYKEELVPFLLKLFQSIEKEGILPNSFYEASIILIPKPGRDTTKKENFRPISLMNIDAKILNKILANRIQQHIKKLIHHDQVGFIPGMQGWFNIRKSINVIQHINRTKDKNHMIISIDAEKAFDKIQQPFMLKTLNKLGIDGTYXKIIRAIYDKPTANIILNGQKLEAFPLKTGTRQGCPLSPLLFNIVLEVLARAIRQEKEIKGIQLGKEEVKLSLFADDMIVYLENPIVSAQNLLKLISNFSKVSGYKINVQKSQAFLYTNNRQTESQIMSELPFTIASKRIKYLGIQLTRDVKDLFKENYKPLLXEIKEDTNKWKNIPCSWVGRINIVKMAILPKVIYRFNAIPIKLPMTFFTELEKTTLKFIWNQKRARIAKSILSQKNKAGGITLPDFKLYYKATVTKTAWYWYQNRDIDQWNRTEPSEIXPHIYNXLIFDKPXKNKXWGKDSLFNKWCWENWLAICRKLKLDPFLTPYTKINSRWIKDLNVRPKTIKTLEENLGNTIQDIGMGKDFMXKTPKAMATKAKIDKWDLIKLKSFCTAKETTIRVNRQPTXWEKIFAXYSSDKGLISRIYXELKQIYKKKXNNPIKKWAKDMNRHFSKEDIYAAKXHMKKCSSSLAIREMQIKTTMRYHLTPVRMAIIKKSGNNRCWRGCGEIGTLLHCWWDCKLVQPLWKSVWRFLRDLELEIPFDPAIPLLGIYPKDYKSCCYKDTCTRMFIAALFTIAKTWNQPKCPTMIDWIKKMWHIYTMEYYAAIKNDEFMSFVGTWMKLEXIILSKLSQXQKTKHRXFSLIGGN

SEQ ID NO: 10420 - protein, 19 aa, Homo sapiens
KLGFSTILLLSIFIMSEAN

SEQ ID NO: 10421 - protein, 12 aa, Homo sapiens
IGVNYLLLFFIF

SEQ ID NO: 10422 - protein, 43 aa, Homo sapiens
FLRFDGIIMEALYKLNEIGKGELTLSIMHSGLKIRFQNEMSDL

SEQ ID NO: 10423 - protein, 35 aa, Homo sapiens
  SITE (10): Xaa equals any amino acid
  SITE (27): Xaa equals any amino acid
MRASGVYVSXCSFVFMCVCVCMLNSRXTFDYGVCG

SEQ ID NO: 10424 - protein, 6 aa, Homo sapiens
VLPSAS

SEQ ID NO: 10425 - protein, 29 aa, Homo sapiens
VCVCVCLIARVYFCIYVCVWLHGCASVCL

SEQ ID NO: 10426 - protein, 23 aa, Homo sapiens
LCVCTGCPGGGPQIPFRWQTERG

SEQ ID NO: 10427 - protein, 89 aa, Homo sapiens
MWPRLAFCCWGLALVSGWATFQQMSPSRNFSFRLFPETAPGAPGSIPAPPAPGDEAAGSRVERLGQAFRRRVRLLRELSRAPGACLPGG

SEQ ID NO: 10428 - protein, 230 aa, Homo sapiens
  SITE (20): Xaa equals any amino acid
  SITE (79): Xaa equals any amino acid
  SITE (165): Xaa equals any amino acid
MWPRLAFCCWGLALVSGWAXFQQMSPSRNFSFRLFPETAPGAPGSIPAPPAPGDEAAGSRVERLGQAFRRRVRLLRELXERLELVFLVDDSSSVGEVNFRSELMFVRKLLSDFPVVPTATRVAIVTFSSKNYVVPRVDYISTRRARQHKCALLLQEIPAISYRGXGTYTKGAFQQAAQILLHARENSTKVVFLITDGYSKGETLAQLQRHCEIQEWRSSLLAYGKGTFES

SEQ ID NO: 10429 - protein, 124 aa, Homo sapiens
  SITE (20): Xaa equals any amino acid
MWPRLAFCCWGLALVSGWAXFQQMSPSRNFSFRLFPETAPGAPGSIPAPPAPGDEAAGSRVERLGQAFRRRVRLLRELNERLELASWWMIRPAWAKSTSAASSCSSASCCPTFPWWPRAPRGHS

SEQ ID NO: 10430 - protein, 143 aa, Homo sapiens
  SITE (120): Xaa equals any amino acid
  SITE (142): Xaa equals any amino acid
MAFSKLLEQAGGVGLFQTLQVLTFILPCLMIPSQMLLENFSAAIPGHRCWTHMLDNGSAVSTNMTPKALLTISIPPGPNQGPHQCRRFRQPQWQLLDPNATATSWSEADTEPCVDGWVYXRRSSPPPSWPSGTWCAAPRLEXP

SEQ ID NO: 10431 - protein, 109 aa, Homo sapiens
MKVFKFIGLMILLTSAFSAGSGQSPMTVLCSIDWFMVTVHPFMLNNDVCVHFHELHLGLGCPQTMFSHTPTSSPTVLLNVASGPKLSLRTWLSTALRYTTLLRARHLSL

SEQ ID NO: 10432 - protein, 212 aa, Homo sapiens
  SITE (180): Xaa equals any amino acid
MKVFKFIGLMILLTSAFSAGSGQSPMTVLCSIDWFMVTVHPFMLNNDVCVHFHELHLGLGCPPNHVQPHAYQFTYRVTECGIRAKAVSQDMVIYSTEIHYSSKGTPSKFVIPVSCAAPQKSPWLTKPCSMRVASKSRATARRMRNATRCSACHSPVKGPTAIVHLVSSVKKSIPRSLVTXAGAQEAQPLQPSHFLDISEDWSLHTDDMIGSM

SEQ ID NO: 10433 - protein, 23 aa, Homo sapiens
MFLKAQWLYSLLLNCLLPEGTSS

SEQ ID NO: 10434 - protein, 7 aa, Homo sapiens
EAPWQFS

SEQ ID NO: 10435 - protein, 73 aa, Homo sapiens
  SITE (60): Xaa equals any amino acid
SLLLSCCPLGNRAYGATGAEVASRASLEGSEHSMQRSHREAGNQGPGRAASCASPAFVMXFSFFTHCQICFLP

SEQ ID NO: 10436 - protein, 559 aa, Homo sapiens
MVLLHWCLLWLLFPLSSRTQKLPTRDEELFQMQIRDKAFFHDSSVIPDGAEISSYLFRDTPKRYFFVVEEDNTPLSVTVTPCDAPLEWKLSLQELPEDRSGEGSGDLEPLEQQKQQIINEEGTELFSYKGNDVEYFISSSSPSGLYQLDLLSTEKDTHFKVYATTTPESDQPYPELPYDPRVDVTSLGRTTVTLAWKPSPTASLLKQPIQYCVVINKEHNFKSLCAVEAKLSADDAFMMAPKPGLDFSPFDFAHFGFPSDNSGKERSFQAKPSPKLGRHVYSRPKVDIQKICIGNKNIFTVSDLKPDTQYYFDVFVVNINSNMSTAYVGTFARTKEEAKQKTVELKDGKITDVFVKRKGAKFLRFAPVSSHQKVTFFIHSCLDAVQIQVRRDGKLLLSQNVEGIQQFQLRGKPKAKYLVRLKGNKKGASMLKILATTRPTKQSFPSLPEDTRIKAFDKLRTCSSATVAWLGTQERNKFCIYKKEVDDNYNEDQKKREQNQCLGPDIRKKSEKVLCKYFHSQNLQKAVTTETIKGLQPGKSLPAGCLCHRTWGALCKVSE

SEQ ID NO: 10437 - protein, 108 aa, Homo sapiens [sequence omitted]

SEQ ID NO: 10438 - protein, 120 aa, Homo sapiens
ARAAPRLLLLFLVPLLWAPAAVRAGPDEDLSHRNKEPPAPAQQLQPQPVAVQGPEPARVEDPYGVAVGGTVGHCLCTGLAVIGGRMIAQKISVRTVTIIGGIVFLAFAFSALFISPDSGF

SEQ ID NO: 10439 - protein, 257 aa, Homo sapiens
MDFIQHLGVCCLVALISVGLLSVAACWFLPSIIAAAASWIITCVLLCCSKHARCFILLVFLSCGLREGRNALIAAGTGIVILGHVENIFHNFKGLLDGMTCNLRAKSFSIHFPLLKKYIEAIQWIYGLATPLSVFDDLVSWNQTLAVSLFSPSHVLEAQLNDSKGEVLSVLYQMATTTEVLSSLGQKLLAFAGLSLVLLGTGLFMKRFLGPCGWKYENIYITRQFVQFDERERHQQRPCVLPLNKEERRKFISGFQS

SEQ ID NO: 10440 - protein, 257 aa, Homo sapiens; identical to SEQ ID NO: 10439

SEQ ID NO: 10441 - protein, 291 aa, Homo sapiens
MDFIQHLGVCCLVALISVGLLSVAACWFLPSIIAAAASWIITCVLLCCSKHARCFILLVFLSCGLREGRNALIAAGTGIVILGHVENIFHNFKGLLDGMTCNLRAKSFSIHFPLLKKYIEAIQWIYGLATPLSVFDDLVSWNQTLAVSLFSPSHVLEAQLNDSKGEVLSVLYQMATTTEVLSSLGQKLLAFAGLSLVLLGTGLFMKRFLGPCGWKYENIYITRQFVQFDERERHQQRPCMLPLNKEERRKNKELKILSMILPLIYLCLNPTVSQNQNSFYLRPGFLSVLFF

SEQ ID NO: 10442 - protein, 242 aa, Homo sapiens
  SITE (121): Xaa equals any amino acid
  SITE (125): Xaa equals any amino acid
  SITE (141): Xaa equals any amino acid
  SITE (161): Xaa equals any amino acid
  SITE (186): Xaa equals any amino acid
MGIWTSGTDIFLSLWEIYVSPRSPGWMDFIQHLGVCCLVALISVGLLSVAACWFLPSIIAAAASWIITCVLLCCSKHARCFILLVFLSCGLREGRNALIAAGTGIVILGHVENIFHNFKGXLDGXTCNLRAKSFSIHFPLXKKYIEAIQWIYGLATPLSVXDDLVSWNQTLAVSLFSPSHVLEAQXNDSKGEVLSVLYQMATTTEVLSSPGSEATCLCRAFARPAWHWPLHEAIFGPLWLEV

SEQ ID NO: 10443 - protein, 153 aa, Homo sapiens [sequence omitted]

SEQ ID NO: 10444 - protein, 286 aa, Homo sapiens
MARFGLPALLCTLAVLSAALLAAELKSKSCSEVRRLYVSKGFNKNDAPLHEINGDHLKICPQGSTCCSQEMEEKYSLQSKDDFKSVVSEQCNHLQAVFASRYKKSDEFFKELLENAEKSLNDMFVKTYGHLYMQNFELFKDLFVELKRYYVVGNVNLEEMLNDFWARLLERMFRLVNSQYHFTDEYLECVSKYTEQLKPFGDVPRKLKLQVTRAFVAARTFAQGLAVAGDVREQGLRGKPHSPVYPCPVEDDLLLPLPGSRDCEAMLQLLLKHHERLFGQPRGSRF

SEQ ID NO: 10445 - protein, 75 aa, Homo sapiens
MIGDILLFGTLLMNAGAVLNFKLKKKDTQGFGEESREPSTGDNIREFLLSLRYFRIFIALWNIFMMFCMIVLFGS

SEQ ID NO: 10446 - protein, 39 aa, Homo sapiens [sequence omitted]

SEQ ID NO: 10447 - protein, 52 aa, Homo sapiens
DILNLYCTFYLRGSSFTCVFICVYLSYSKRSRESPCPRSSILRSEDVQNSSR

SEQ ID NO: 10448 - protein, 70 aa, Homo sapiens; identical to SEQ ID NO: 7844

SEQ ID NO: 10449 - protein, 38 aa, Homo sapiens
MTSLPILAFGAVYWPDLASHSFSPSRSLAQTPHMSVSG

SEQ ID NO: 10450 - protein, 46 aa, Homo sapiens
MWIYTLTYILINSSMLALVLSKLYLNKFVARNVLKSYSPFLLEVSK

SEQ ID NO: 10451 - protein, 116 aa, Homo sapiens
  SITE (28): Xaa equals any amino acid
  SITE (90): Xaa equals any amino acid
MRKIHTPLFNLLQVRLGFVYFPCFTFPXVQAVVETGTQGLCVAPCSSCLQEACGALVSLASCPPFLLPPLTLPPTLSLRTSSWKGLARAXVLASLWGGRLCGLKGCRLKLQGVGAW

SEQ ID NO: 10452 - protein, 249 aa, Homo sapiens
  SITE (161): Xaa equals any amino acid
  SITE (212): Xaa equals any amino acid
  SITE (213): Xaa equals any amino acid
  SITE (215): Xaa equals any amino acid
  SITE (216): Xaa equals any amino acid
  SITE (218): Xaa equals any amino acid
  SITE (221): Xaa equals any amino acid
MWRCPLGLLLLLPLAGHLALGAQQGRGRRELAPGLHLRGIRDAGGRYCQEQDLCCRGRADDCALPYLGAICYCDLFCNRTVSDCCPDFWDFCLGVPPPFPPIQGCMHGGRIYPVLGTYWDNCNRCTCQENRQWQCDQEPCLVDPDMIKAINQGNYGWQAGXHSAFWGMTLDEGIRYRLGTIRPSSSVMNMHEIYTVLNPGEVLPTAFEASEXXPXXFXSLXTKATVQAPGPSPQQLWHPIVSQSILWDT

SEQ ID NO: 10453 - protein, 41 aa, Homo sapiens [sequence omitted]

SEQ ID NO: 10454 - protein, 392 aa, Homo sapiens; identical to SEQ ID NO: 7857

SEQ ID NO: 10455 - protein, 234 aa, Homo sapiens; identical to SEQ ID NO: 7861

SEQ ID NO: 10456 - protein, 95 aa, Homo sapiens
MAASRWARKAVVLLCASDLLLLLLLLPPPGSCAAEARPGRPTSLPHLPGRRRRIFAITMMQTWRVFWSNGRKMMTLKKEIFQSTRDLQHLSTSQR

SEQ ID NO: 10457 - protein, 73 aa, Homo sapiens
LESYSSVRELLVSVRFYVVCKVRGSVLFPYLGKSTAGVEGLYVPFNVTVLKDLSRESESFAECDRRLNNLICF

SEQ ID NO: 10458 - protein, 122 aa, Homo sapiens; identical to SEQ ID NO: 7862

SEQ ID NO: 10459 - protein, 96 aa, Homo sapiens
MLMVRLFNSFPHALLILFLWGEQSPLTKPCPTHWAPVWMVPGPQVLWGTHWGLPGNHFCRIRSHTRRAQCPREGPFPTTLPHWGWVTGTYRGWCCL

SEQ ID NO: 10460 - protein, 46 aa, Homo sapiens
MAALLLTLILGTLHQQKGLHVQSPIPSPFWGGEAYLTDGDLEAQGG

SEQ ID NO: 10461 - protein, 117 aa, Homo sapiens
  SITE (114): Xaa equals any amino acid
MGFLFLLGLYISSLASCMGGLYGAPRILQCIAQEKVIPALACLGQGKGPNKTPVAAICLTSLVTMAFVFVGQVNVLAPIVTINFMLTYVAVDYSYFSLSMCSCSLTPVPEPVLXEGA

SEQ ID NO: 10462 - protein, 98 aa, Homo sapiens
  SITE (85): Xaa equals any amino acid
  SITE (90): Xaa equals any amino acid
  SITE (97): Xaa equals any amino acid
QGTPRLCTTRLLVQRATISVCFIFYCIIYSKINNTLTCFHTQKIYRVKSLPPILILHLLSSCLPWPRGNHYSHPYIQHFFMDIQXNGNVXSHISLFXP

SEQ ID NO: 10463 - protein, 365 aa, Homo sapiens
  SITE (313): Xaa equals any amino acid
  SITE (316): Xaa equals any amino acid
  SITE (333): Xaa equals any amino acid
  SITE (335): Xaa equals any amino acid
  SITE (338): Xaa equals any amino acid
  SITE (339): Xaa equals any amino acid
  SITE (352): Xaa equals any amino acid
  SITE (355): Xaa equals any amino acid
MLSGVWFLSVLTVAGILQTESRKTAKDICKIRCLCEEKENVLNINCENKGFTTVSLLQPPQYRIYQLFLNGNLLTRLYPNEFVNYSNAVTLHLGNNGLQEIRTGAFSGLKTLKRLHLNNNKLEILREDTFLGLESLEYLQADYNYISAIEAGAFSKLNKLKVLILNDNLLLSLPSNVFRFVLLTHLDLRGNRLKVMPFAGVLEHIGGIMEIQLEENPWNCTCDLLPLKAWLDTITVFVGEIVCETPFRLHGKDVTQLTRQDLCPRKSASDSSQRGSHADTHVQRLSPTMNPALNPTRAPKASRPPKMRNRPTXRVXVSKDRQSFGPIMVYQTXVXCAXXLSQQLCLHLSELXQWXECKLPRKEVH

SEQ ID NO: 10464 - protein, 191 aa, Homo sapiens
MLSGVWFLSVLTVAGILQTESRKTAKDICKIRCLCEEKENVLNINCENKGFTTVSLLQPPQYRIYQLFLNGNLLTRLYPNEFVNYSNAVTLHLGNNGLQEIRTGAFSGLKTLKRLHLNNNKLEILREDTFLGLESLEYLQADYNYISAIEAGAFSKLNKLKVLILNDNLLLSLPSNVFRFVLLTHLDLRGN

SEQ ID NO: 10465 - protein, 23 aa, Homo sapiens
GYWVSFLLHVDGVLAHLTTGGGI

SEQ ID NO: 10466 - protein, 42 aa, Homo sapiens; identical to SEQ ID NO: 7877

SEQ ID NO: 10467 - protein, 8 aa, Homo sapiens
SHIVTCLG

SEQ ID NO: 10468 - protein, 141 aa, Homo sapiens
  SITE (125): Xaa equals any amino acid
  SITE (131): Xaa equals any amino acid
FCLLHVPASCYCSFSNGITSPCHALGSPSLSISVLLSWLNPSTILNTGSSCPIPRLTLSDLPISLAFHAPLPPPPGFNWVRAVFLPLCSASALRTPRGLGGKVLTIFTLCLPLHHLFITSQPLLXQVFTHXLFLQVFDWRE

SEQ ID NO: 10469 - protein, 71 aa, Homo sapiens [sequence omitted]

SEQ ID NO: 10470 - protein, 14 aa, Homo sapiens
LFILVLHNEDNLYG

SEQ ID NO: 10471 - protein, 26 aa, Homo sapiens
MRHRARRFFFFFFLSGIWAGHGGSCL

SEQ ID NO: 10472 - protein, 207 aa, Homo sapiens
  SITE (105): Xaa equals any amino acid
  SITE (110): Xaa equals any amino acid
  SITE (111): Xaa equals any amino acid
  SITE (116): Xaa equals any amino acid
  SITE (129): Xaa equals any amino acid
  SITE (133): Xaa equals any amino acid
MRPWRFGWPRTLASQLSLIFLISLVCAHGLSFSAQFYERYISARTVMLGNLENDVSTSVAILDRLPANERAIGWRVLRPAELPVLLNAGEAGEPMTSNDVPMAAXFDCGXXGRALXPDLSRYSRHPETXPGAXDPGRWQPDHPRRTPRRPARSLLVAGGAGAATGAAARLHLGRGAPGRAPADTPGPCGRNPRPERSPHTPGRNRPE

SEQ ID NO: 10473 - protein, 18 aa, Homo sapiens
  SITE (15): Xaa equals any amino acid
  SITE (17): Xaa equals any amino acid
GWPRWRRERCANTPXVXL

SEQ ID NO: 10474 - protein, 34 aa, Homo sapiens
ELGRLRHPTQGKPACHIECTALIKFTHDNSAFYN

SEQ ID NO: 10475 - protein, 198 aa, Homo sapiens
  SITE (9): Xaa equals any amino acid
  SITE (12): Xaa equals any amino acid
  SITE (97): Xaa equals any amino acid
  SITE (164): Xaa equals any amino acid
  SITE (196): Xaa equals any amino acid
PDPNARRGXNAXSTRTDHEHRTYRLYRRPSRFRDSPAQRPYPAAGYVETVARAHEAAGFDRALVAFHSNSPDSTLIAAHAASVTQKLQFLIAHRPGXAQPTLAARQFATLDVFNGGRTAVHIITGGDDRELRADGSHIGKDERYARTDEYLSVVRQEWTHEQPXDFKGTYYQVEGAHSTVKSPQQPHIPLYFGGSXRG

SEQ ID NO: 10476 - protein, 40 aa, Homo sapiens
MFPRVEFFFLLRTSVALPALALSGKDSRGDTAVPGCDNVQ

SEQ ID NO: 10477 - protein, 45 aa, Homo sapiens
MPRRSRPCTLCLTLLRRALSSHLPSACQSPRRRVQGQVLKRLKPL

SEQ ID NO: 10478 - protein, 69 aa, Homo sapiens
  SITE (26): Xaa equals any amino acid
  SITE (51): Xaa equals any amino acid
  SITE (68): Xaa equals any amino acid
MYLAVYLLLFLCICFYFIALFSHALXPHCFNYPGFSFNLVHWSSLIPPLPXFFFFNSFSNCSLFFPYXL

SEQ ID NO: 10479 - protein, 90 aa, Homo sapiens; identical to SEQ ID NO: 7901

SEQ ID NO: 10480 - protein, 57 aa, Homo sapiens
MLYFCSSIWFGIYFVALITVFLKTLPPLTVGKGPFSGKFVAFFFFLKESCSLLSIVF

SEQ ID NO: 10481 - protein, 64 aa, Homo sapiens
MTVSLFLLLATSQSQDGCCDSGSCPNSRQQEGHGAAPASRCPCRPSLQAQEPKEESTQMWCSHL

SEQ ID NO: 10482 - protein, 124 aa, Homo sapiens
MYLQVETRTSSRLHLKRAPGIRSWSLLVGILSIGLAAAYYSGDSLGWKLFYVTGCLFVAVQNLEDWEEAIFDKSTGKVVLKTFSLYKKLLTLFRAGHDQVVVLLHDVRSGCQSLVAGQGHHNHK

SEQ ID NO: 10483 - protein, 137 aa, Homo sapiens
  SITE (111): Xaa equals any amino acid
  SITE (116): Xaa equals any amino acid
  SITE (123): Xaa equals any amino acid
MYLQVETRTSSRLHLKRAPGIRSWSLLVGILSIGLAAAYYSGDSLGWKLFYVTGCLFVAVQNLEDWEEAIFDKSTGKVVLKTFSLYKKLLTLFRAGHDQVVVLLHDVRDVXVEEEXVRYFGKXYMVVLRLATGFFHP

SEQ ID NO: 10484 - protein, 286 aa, Homo sapiens
MAPSGPGSSARRRCRRVLYWIPVVFITLLLGWSYYAYAIQLCIVSMENTGEQVVCLMAYHLLFAMFVWSYWKTIFTLPMNPSKEFHLSYAEKDLLEREPRGEAHQEVLRRAAKDLPIYTRTMSGAIRYCDRCQLIKPDRCHHCSVCDKCILKMDHHCPWVNNCVGFSNYKFFLLFLAYSLLYCLFIAATDLQYFIKFWTNGLPDTQAKFHIMFLFFAAAMFSVSLSSLFGYHCWLVSKNKSTLEAFRSPVFRHGTDKNGFSLGFSKNMRQVLVMRRSTGCYPFFQV

SEQ ID NO: 10485 - protein, 298 aa, Homo sapiens
MAPSGPGSSARRRCRRVLYWIPVVFITLLLGWSYYAYAIQLCIVSMENTGEQVVCLMAYHLLFAMFVWSYWKTIFTLPMNPSKEFHLSYAEKDLLEREPRGEAHQEVLRRAAKDLPIYTRTMSGAIRYCDRCQLIKPDRCHHCSVCDKCILKMDHHCPWVNNCVGFSNYKFFLLFLAYSLLYCLFIAATDLQYFIKFWTNGLPDTQAKFHIMFLFFAAAMFSVSLSSLFGYHCWLVSKNKSTLEAFRSPVFRHGTDKNGFSLGFSKNMRQVFGDEKKYWLLPIFSSLGDGCSFPTLPC

SEQ ID NO: 10486 - protein, 15 aa, Homo sapiens
NATKSQPCLSSLLLF

SEQ ID NO: 10487 - protein, 62 aa, Homo sapiens
  SITE (3): Xaa equals any amino acid
KYXKHPSKSFELTLVLRKLSLHNQPPGKTECHLLKSKCCVIITLQTKWRYYLFCKQQTKQNS

SEQ ID NO: 10488 - protein, 42 aa, Homo sapiens; identical to SEQ ID NO: 7916

SEQ ID NO: 10489 - protein, 42 aa, Homo sapiens; identical to SEQ ID NO: 7916

SEQ ID NO: 10490 - protein, 314 aa, Homo sapiens
  SITE (227): Xaa equals any amino acid
MLLAQGLILHFLGRAWTWPDALNIENSDSESWTSHTVKKFTASFEASLSGEREFKTPTISLKETIGKYSDDHEMRNEVYHRKIISWFGDSPLALFGLHQLIEYGKKSGKKAGDWYGPAVVAHILRKAVEEARHPDLQGITIYVAQDCTVPVRLGGERTNTDYLEFVKGILSLEYCVGIIGGKPKQSYYFAGFQDDSLIYMDPHYCQSFVDVSIKDFPLETFHCPSPXKMSFRKMDPSCTIGFYCRNVQDFKRASEEITKMLKFSSKEKYPLFTFVNGHSRDYDFTSTTTNEEDLFSEDEKKQLKRFSTEEFVLL

SEQ ID NO: 10491 - protein, 125 aa, Homo sapiens
MCVWFCLFACLFACLFFETESHSVAQAGVQWLDLSSLQQPPPPGFKCFSCLCLLSSWDYRRACHHTRIIFVFLVEMGFHHVDQADLELLTSSDPPALASRSAGITGVSHHTPPACLVFKFLFLGS

SEQ ID NO: 10492 - protein, 112 aa, Homo sapiens
  SITE (91): Xaa equals any amino acid
  SITE (106): Xaa equals any amino acid
APVLLLPSSCWQFWVLGFFFFRQSLTPSPGWKYSGAVSAHCSLRLPGSNDPLASASQLAGTTGAHHHGQLIFVFLVEMGFHHIAQAGLKLXTSSDLLTSAFQSAGXIYILNK

SEQ ID NO: 10493 - protein, 76 aa, Homo sapiens
  SITE (73): Xaa equals any amino acid
MHLPLSTKGILPRILLLFIKTLFAFLLSDQCKGLAHLWLRRRECGPGGLTCAAEELKSYTSIFAPKLGVVGGXEMK

SEQ ID NO: 10494 - protein, 38 aa, Homo sapiens
  SITE (12): Xaa equals any amino acid
  SITE (14): Xaa equals any amino acid
  SITE (38): Xaa equals any amino acid
PISTKNRKISRXWXCVPVIPATREAEAGESLEPRRWRX

SEQ ID NO: 10495 - protein, 43 aa, Homo sapiens
  SITE (5): Xaa equals any amino acid
  SITE (35): Xaa equals any amino acid
  SITE (36): Xaa equals any amino acid
SGFVXAWSILTPGCISPAGEKCRGGKQSLGTNYFXXVLLATDS

SEQ ID NO: 10496 - protein, 49 aa, Homo sapiens
  SITE (17): Xaa equals any amino acid
  SITE (18): Xaa equals any amino acid
  SITE (25): Xaa equals any amino acid
MCLSRWKIFYTLLILFXXFSITSEXETFYMIIIHHNPTQITASCSFTFL

SEQ ID NO: 10497 - protein, 148 aa, Homo sapiens
  SITE (3): Xaa equals any amino acid
  SITE (37): Xaa equals any amino acid
  SITE (41): Xaa equals any amino acid
  SITE (43): Xaa equals any amino acid
  SITE (99): Xaa equals any amino acid
  SITE (121): Xaa equals any amino acid
GFXAAAAAAAVVAAAAAASVEGRQPPGLGAVGPAGRXAGSXGXRMPAGRVAGAVTGLGVSWLRGKNSGVPGAALPPAAPSVASLVAHSGPAVGPPLSPXSVPQGGYSKSGLPLQDAGSPWXHCRGTDCGSSMLNGVEAGLAAAASCCH

SEQ ID NO: 10498 - protein, 399 aa, Homo sapiens; identical to SEQ ID NO: 6180

SEQ ID NO: 10499 - protein, 7 aa, Homo sapiens
SFCMGTM

SEQ ID NO: 10500 - protein, 96 aa, Homo sapiens
MAASLGQVLALVLVAALWGGTQPLLKRASAGLQRVHEPTWAQQLLQEMKTLFLNTEYLMPFLLNQCGSLLYYLTLASTGWSQTSEFRSSCWNPGKH

SEQ ID NO: 10501 - protein, 103 aa, Homo sapiens
  SITE (51): Xaa equals any amino acid
MCADDLLSVLLYLLVKTEIPNWMANLSYIKNFRFSSLAKDELGILPDLIRXCPLNIRQGSLSAKPPESEGFGDRLFLKQRMSLLSQMTSSPTDCLFKADALLE

SEQ ID NO: 10502 - protein, 151 aa, Homo sapiens
  SITE (130): Xaa equals any amino acid
MVVAAVYILYLLFLIVRACSELRHMPYVDLRLKFLTALTFVVLVISIAILYLRFGAQVLQDNFVAELSTHYQNSAEFLSFYGLLNFYLYTLAFVYSPSKNALYESQLKDNPAFSMLNDSDDDVIYGSDYXEMPLQNGQAIRAKYKEESDSD

SEQ ID NO: 10503 - protein, 31 aa, Homo sapiens
LFLPFSMVLFCDPLNSKGSLICGCFRAVLPR

SEQ ID NO: 10504 - protein, 65 aa, Homo sapiens
IIYLLFVTKWEIRKKVRKYLRGKSFLLSHVFSTCLPWYIINTDILHTPCKILLKLSSTWHVEYVP

SEQ ID NO: 10505 - protein, 5 aa, Homo sapiens
LYLFM

SEQ ID NO: 10506 - protein, 103 aa, Homo sapiens
  SITE (86): Xaa equals any amino acid
  SITE (87): Xaa equals any amino acid
  SITE (93): Xaa equals any amino acid
  SITE (94): Xaa equals any amino acid
  SITE (96): Xaa equals any amino acid
MMASIQSFSAMALLFYTVFMFVIVLSSLKHGLFSGQWLRRVSYVRWEGVFRCIPIFGMSFACQSQVLPTYDSLDEPSVKTMSSIFXXSLNVVXXFXVMVGVFR

SEQ ID NO: 10507 - protein, 384 aa, Homo sapiens
  SITE (96): Xaa equals any amino acid
  SITE (131): Xaa equals any amino acid
QRQEDEEDKPRQVEVHQEPGAAVPRGQEAPEGKARETVENLPPLPLDPVLRAPGGRPAPSQDLNQRSLEHSEGPVGRDPAGPPDGGPDTEPRAAQXKLRDGQKDAAPRAAGTVKELPKGPEQVPVPDPARXAGGPEERLAEEFPGQSQDVTGGSQDRKKPGKEVAATGTSILKEANWLVAGPGAETGDPRMKPKQVSRDLGLAADLPGGAEGAAAQPQAVLRQPELRVISDGEQGGQQGHRLDHGGHLEMRKARGGDHVPVSHEQPRGGEDAAVQEPRQRPEPELGLKRAVPGGQRPDNAKPNRDLKLQAGSDLRRRRRDLGPHAEGQLAPRDGVIIGLNPLPDVQVNDLRGALDAQLRQAAGGALQVVHSRQLRQAPGPPEES

SEQ ID NO: 10508 - protein, 193 aa, Homo sapiens [sequence omitted]

SEQ ID NO: 10509 - protein, 34 aa, Homo sapiens
PCSWLRAVTLCQNLHWACTSCHCNCPCQCPQLLF

SEQ ID NO: 10510 - protein, 184 aa, Homo sapiens
  SITE (153): Xaa equals any amino acid
  SITE (178): Xaa equals any amino acid
  SITE (181): Xaa equals any amino acid
  SITE (182): Xaa equals any amino acid
VRMKYLFFSWLVVFVGSWIIYVQYSTYTELCRGKDCKKIICDKYKTGVIDGPACNSLCVTETLYFGKCLSTKPNNQMYLGIWDNLPGVVKCQMEQALHLDFGTELEPRKEIVLFDKPTRGTTVQKFKEMVYSLFKAKLGDQGNLSELVNLILXVADGDKDGQVSLGEAKSAWALLQLXEFXXHG

SEQ ID NO: 10511 - protein, 3 aa, Homo sapiens
YTV

SEQ ID NO: 10512 - protein, 90 aa, Homo sapiens
MALRHLALLAGLLVGVASKSMENTAQLPECCVDVVGVNASCPGASLCGPGCYRRWNADGSATASAVGTEPSQPTTAPSVEALLARVRHSP

SEQ ID NO: 10513 - protein, 48 aa, Homo sapiens
  SITE (38): Xaa equals any amino acid
  SITE (42): Xaa equals any amino acid
  SITE (44): Xaa equals any amino acid
MGLRQQLELKLKLILLLCVFWFKSCTYILALLFLYSGXMWVXHXGRKI

SEQ ID NO: 10514 - protein, 61 aa, Homo sapiens
FYTNVTYKSDATTLRFPGRCDFSSAWEVDLHQPFQCSAHPGAGITAPHLLGEKPGRPEEVG

SEQ ID NO: 10515 - protein, 261 aa, Homo sapiens
  SITE (90): Xaa equals any amino acid
  SITE (93): Xaa equals any amino acid
  SITE (169): Xaa equals any amino acid
  SITE (237): Xaa equals any amino acid
  SITE (239): Xaa equals any amino acid
  SITE (240): Xaa equals any amino acid
  SITE (253): Xaa equals any amino acid
TVADVRRPFAQVNVLAEEVLIYRIVLNDIVGDVVQDHQVRLRRKDDAVIRQLEATMLVGRKHRHGDVLVRETTVSDARPEDRVHFRHVCXPQXKRVSLLDVVIAAHRLIHTKGTHKANYCRRHTVTRVRVDVVRTEARFKQLGRGITFPDSPLTRTEHTDRFRPFFFQXGFEFLFHHIEGLIPGDWGKFAFFVIFTVFHTQQRLRQTVFTVHDFGQEIALNAVQATVNRCVRVALTXQXXVPAAFRPERRNQXRRTTQFAI

SEQ ID NO: 10516 - protein, 48 aa, Homo sapiens [sequence omitted]

SEQ ID NO: 10517 - protein, 17 aa, Homo sapiens
FLSLLFFFLAFSFFTEA

SEQ ID NO: 10518 - protein, 24 aa, Homo sapiens
MKIKQRFSLLLFHCPFPPCCLSLG

SEQ ID NO: 10519 - protein, 51 aa, Homo sapiens [sequence omitted]

SEQ ID NO: 10520 - protein, 110 aa, Homo sapiens
  SITE (97): Xaa equals any amino acid
MDNRFATAFVIACVLSLISTIYMAASIGTDFWYEYRSPVQENSSDLNKSIWDEFISDEADEKTYNDALFRYNGTVGLWRRCITIPKNMHWYSPPERXESFDVVTKCVSSH

SEQ ID NO: 10521 - protein, 177 aa, Homo sapiens
LVLWTRFYRGDMSLHSSPTLPTSLYQSCDLSVGGPSLLTWVWRRERRCCKVFSVSHCLEAGPAKAWAHSCTGSPRGRTGWGSRACEALGKGMGLWGRGGMGFRSICTIRKVLRSFFLEGTLSSLSLFLDLGLELRMGRCAQGGTHQSTREGGYLGVSQGLCQCLQPTSRSLEFGEWG

SEQ ID NO: 10522 - protein, 165 aa, Homo sapiens
  SITE (2): Xaa equals any amino acid
  SITE (4): Xaa equals any amino acid
  SITE (5): Xaa equals any amino acid
  SITE (148): Xaa equals any amino acid
RXTXXHFARTYPGIHLRIGSDWKNACAMLKDGTAGSHFMASPQCVGYSRSTAAPLTMTMCLPDLKEIQRAVKLWVRSLDAQSVYVATDSESYVPELQQLFKGKVKVVSLKPEVAQVDLYILGQADHFIGNCVSSFTAFVKRERDLQGXPSSFFGMDRPPKLRDEF

SEQ ID NO: 10523 - protein, 53 aa, Homo sapiens
  SITE (41): Xaa equals any amino acid
SCFLALKSILAVCGGSHLPPALWEASGGGLVPNSCSPGDPXVLERPPPRWSSS

SEQ ID NO: 10524 - protein, 511 aa, Homo sapiens
  SITE (171): Xaa equals any amino acid
  SITE (358): Xaa equals any amino acid
  SITE (388): Xaa equals any amino acid
MAGLRRPQPGCYCRTAAAVNLLLGVFQVLLPCCRPGGAQGQAIEPLPNVVELWQAEEGELLLPTQGDSEEGLEEPSQEQSFSDKLFSGKGLHFQPSVLDFGIQFLGHPVAKILHAYNPSRDSEVVVNSVFAAAGHFHVPPVPCRVIPAMGKTSFRIIFLPTEEGSIESSLXINTSSYGVLSYHVSGIGTRRISTEGSAKQLPNAYFLLPKVQSIQLSQMQAETTNTSLLQVQLECSLHNKVCQQLKGCYLESDDVLRLQMSIMVTMENFSKEFEENTQHLLDHLSIVYVATDESETSDDSAVNMYILHSGNSLIWIQDIRHFSQRDALSLQFEPVLLPTSTTNFTKIASFTCKAATSXDSGIIEDVKKTTHTPTLKACLFSSVAQGYXRMDSSATQFHIETHENTSGLWSIWYRNHFDRSVVLNDVFLSKETKHMLKILNFTGPLFLPPGCWNIFSLKLAVKDIAINLFTNVFLTTNIGAIFAIPLQISHCLETRVTVGMCENNWIFKQCE

SEQ ID NO: 10525 - protein, 19 aa, Homo sapiens
IPCTRPLGFPCGSNVPWWG

SEQ ID NO: 10526 - protein, 166 aa, Homo sapiens
MAGLRRPQPGCYCRTAAAVNLLLGVFQVLLPCCRPGGAQGQAIEPLPNVVELWQAEEGELLLPTQGDSEEGLEEPSQEQSFSDKLFSGKGLHFQPSVLDFGIQFLGHPVAKILHAYNPSRDSEVVVNSVFAAAGHFHVPPVPCRVIPAMGKTSSELFSYLTEEGSI

SEQ ID NO: 10527 - protein, 221 aa, Homo sapiens
  SITE (25): Xaa equals any amino acid
  SITE (26): Xaa equals any amino acid
  SITE (34): Xaa equals any amino acid
KGTPAGTGPEFPGRPTRPGDLWPTXXVCVTSSLXCTLENGVPCVIQESAPVHNSFIDWSATCEGQFSSAYCPLELNDYNAFPEENMNYANGFPCPADVQTDFIDHNSQSTWNTPPNMPAAWGHASFISSPPYLTSTRSLSPMSGLFGSIWAPQSDVYENCCPINPTTEHSTHMENQAVVCKEYYPGFNPFRAYMNLDIWTTTANRNANFPLSRDSSYCGNV

SEQ ID NO: 10528 - protein, 127 aa, Homo sapiens
QGYFRMDSSATQFHIETHENTSGLWSIWYRNHFDRSVVLNDVFLSKETKHMLKILNFTGPLFLPPGCWNIFSLKLAVKDIAINLFTNVFLTTNIGAIFAIPLQISHCLETRVTVGMCENNWIFKQCE

SEQ ID NO: 10529 - protein, 39 aa, Homo sapiens
MPLTLPSRLAGGNVFLIIFTPGFCPGRVNVEIPQRMLDE

SEQ ID NO: 10530 - protein, 23 aa, Homo sapiens
MFPFPFFHLVILGFLLLHSFLPP

SEQ ID NO: 10531 - protein, 107 aa, Homo sapiens
  SITE (7): Xaa equals any amino acid
  SITE (13): Xaa equals any amino acid
  SITE (17): Xaa equals any amino acid
LGKVGNXCRYRSXIPGXTHASGLESTFELPEEFRFLLVSFVFQTHEMATDDKTSPTLDSANDLPRSPTSSSHLTHFKPLTPDQDEPPFKSAYSSFVNLFRFNKGKTY

SEQ ID NO: 10532 - protein, 49 aa, Homo sapiens [sequence omitted]

SEQ ID NO: 10533 - protein, 47 aa, Homo sapiens
  SITE (25): Xaa equals any amino acid
MLIFSFLSFWFFQSCQGFIYFMSIXEEPVADFVHLYCVFYFQGCSYL

SEQ ID NO: 10534 - protein, 128 aa, Homo sapiens
FSNTWSFPKDAFYTDFYLKSIVVREYCVFCSNPLKYIETCLICKYRFSYFSICDWKNINLTIWGYSIHTIHTNIYVFSVLQNFYIFPGICLLASLITERCTILSCTFFCCSLIFLSYPYGNCIKCIPI

SEQ ID NO: 10535 - protein, 158 aa, Homo sapiens
MAAASAGATRLLLLLLMAVAAPSRARGSGCRAGTGARGAGAEGREGEACGTVGLLLEHSFEIDDSANFRKRGSLLWNQQDGTLSLSQRQLSEEERGRLRDVAASYLDCGATRACGPLLCATLPVSLFKNIDDTLKCVNVLKSYSFQQPKATVVLARRS

SEQ ID NO: 10536 - protein, 303 aa, Homo sapiens
  SITE (224): Xaa equals any amino acid
  SITE (245): Xaa equals any amino acid
  SITE (250): Xaa equals any amino acid
  SITE (252): Xaa equals any amino acid
  SITE (255): Xaa equals any amino acid
  SITE (256): Xaa equals any amino acid
  SITE (257): Xaa equals any amino acid
  SITE (287): Xaa equals any amino acid
  SITE (301): Xaa equals any amino acid
MAAASAGATRLLLLLLMAVAAPSRARGSGCRAGTGARGAGAEGREGEACGTVGLLLEHSFEIDDSANFRKRGSLLWNQQDGTLSLSQRQLSEEERGRLRDVAALNGLYRVRIPRRPGALDGLEAGGYVSSFVPACSLVESHLSDQLTLHVDVAGNVVGVSVVTHPGGCRGHEVEDVDLELFNTSVQLQPPTTAPGPETAAFIERLEMEQAQKAKNPQEQKSFFXKYWMYIIPVVLFLMMSGAPDXGGQGXGXGGXXXGVVAGEGPSLSAFPSCKTQGGFPFCLEFPXCSSSPSPKKGFCLXPL

SEQ ID NO: 10537 - protein, 158 aa, Homo sapiens; identical to SEQ ID NO: 10535

SEQ ID NO: 10538 - protein, 173 aa, Homo sapiens
  SITE (99): Xaa equals any amino acid
  SITE (118): Xaa equals any amino acid
  SITE (141): Xaa equals any amino acid
  SITE (164): Xaa equals any amino acid
  SITE (170): Xaa equals any amino acid
  SITE (172): Xaa equals any amino acid
  SITE (173): Xaa equals any amino acid
MAAASAGATRLLLLLLMAVAAPSRARGSGCRAGTGARGAGAEGREGEACGTVGLLLEHSFEIDDSANFRKRGSLLWNQQDGTLSLSQRQLSEEERGRLXDVAALNGLYRVRIPRRPGXLDGLEAGGYVSSFVPACSLVESXLSDQLTLHVDVAGNVVGRVGGDXPWGCRXHXX

SEQ ID NO: 10539 - protein, 24 aa, Homo sapiens
MTPGLFLYFVCVCVSHCAGLGQLS

SEQ ID NO: 10540 - protein, 143 aa, Homo sapiens
MRGLGLWLLGAMMLPAIAPSRPWALMEQYEVVLPWRLPGPRVRRALPSHLGLHPERVSYVLGATGHNFTLHLRKNRDLLGSGYTETYTAANGSEVTEQPRGQDHCFYQGHLEGTGLSRQPQHLCRPQGFLPGGVRPAPDRAPG

SEQ ID NO: 10541 - protein, 80 aa, Homo sapiens
  SITE (61): Xaa equals any amino acid
  SITE (69): Xaa equals any amino acid
  SITE (75): Xaa equals any amino acid
MHHHTRLVFVFLVEMGFHHVGQAGLELLTSSDLPALASQSAGITGVSHCAQLPFLPLKSKXGWELSPWXFMVAKXLNPVA

SEQ ID NO: 10542 - protein, 88 aa, Homo sapiens
  SITE (7): Xaa equals any amino acid
  SITE (30): Xaa equals any amino acid
  SITE (43): Xaa equals any amino acid
  SITE (46): Xaa equals any amino acid
ADPSPSXWLQTHRGPRLLWPHHQQLLLSFXEPRKPLILLLPVXAPXSLKPHSCIPFSLDITPPTPWLNFLPVVAWSFGHCPGLFLSPS

SEQ ID NO: 10543 - protein, 26 aa, Homo sapiens
MPVVLFQLWLFILKTDNAFAWLKIRR

SEQ ID NO: 10544 - protein, 19 aa, Homo sapiens
QIWPFLPPSQPSGPLQRAV

SEQ ID NO: 10545 - protein, 136 aa, Homo sapiens
  SITE (3): Xaa equals any amino acid
  SITE (67): Xaa equals any amino acid
PSXMLLLWASSLPTRCDCSFPVTPLVPLVHVICVWVMFPSAATAACHPGAGAFFSQGPSPFSRTWPXLGHREIPAEGAGETVALGLQPKRHTLAVGVHGMLALSTVTVGGFGGFPWTSGPGCPPLSWTCFIFPILT

SEQ ID NO: 10546 - protein, 126 aa, Homo sapiens
ATTSVPKYVFNLNFILMCLRDESKYMLVTSHSNVEVGRWLPGLPSPGRICGEQSDVHPSGLFSINDSLLDLLLLGFRSKRGIVVENALLGEGEPEIHKRRLPCSFAYLAAPRLGVRIPGFPSLLCH

SEQ ID NO: 10547 - protein, 465 aa, Homo sapiens
  SITE (16): Xaa equals any amino acid
  SITE (27): Xaa equals any amino acid
  SITE (44): Xaa equals any amino acid
NRRNGASQITWCSGQXKSSKWAREIGXYQTGVYQPGWGPQRHAXGEIATRAISMLAILTGNVGINGGNSGAREGSYSLPFVRMPTLENPIQTSISMFMWTDAIERGPEMTALRDGVRGKDKLDVPIKMIWNYAGNCLINQHSEINRTHEILQDDKKCELIVVIDCHMTSSAKYADILLPDCTASEQMDFALDASCGNMSYVIFNDQVIKPRFECKTIYEMTSELAKRLGVEQQFTEGRTQEEWMRHLYAQSREAIPELPTFEEFRKQGIFKKRDPQGHHVAYKAFREDPQANPLTTPSGKIEIYSQALADIAATWELPEGDVIDPLPIYTPGFESYQDPLNKQYPLQLTGFHYKSRVHSTYGNVDVLKAACRQEMWINPLDAQKRGIHNGDKVRIFNDRGEVHIEAKVTPRMMPGVVALGEGAWYDPDAKRVDKGGCINVLTTQRPSPLAKGNPSHTNLVQVEKV

SEQ ID NO: 10548 - protein, 62 aa, Homo sapiens
MSISLSSLILLPIWINMAQIQQGGPDEKEKTTALKDLLSRIDLDELMKKDEPPLDFLIPWKV

SEQ ID NO: 10549 - protein, 141 aa, Homo sapiens
MKSTLSIFSLWVMIFVLCLQIYCQTRFSSSLSTSFTVLNCMYRSVILSELTFVKDKRSVLDRLFFLLHVVVQHHEDSSFSTELSLYFCQRSDLPLKSLSNLSTSHHLHFQSLRTRGRTRGSTREFRTGTCRRTSFPYSESY

SEQ ID NO: 10550 - protein, 58 aa, Homo sapiens
VLCLQIYCQTRFSSSLSTSFTVLNCMYRSVILSELTFVKDKRSVLDRYFPFACGCPAP

SEQ ID NO: 10551 - protein, 57 aa, Homo sapiens
RPVSTKKKKVSWAWWCTSIAPATLEAKVRGLLEPGRSVSAVSCDPANALSLGSVRPC

SEQ ID NO: 10552 - protein, 18 aa, Homo sapiens
MLTLVSFVFLLLLLESMI

SEQ ID NO: 10553 - protein, 41 aa, Homo sapiens
MSQTLVALPERNENAQPHPCTLCSFLFNTEEPEWRGPAGLQ

SEQ ID NO: 10554 - protein, 30 aa, Homo sapiens
MSTNYLTDVCSLFSYLNYLYFHHHLPVPNT

SEQ ID NO: 10555 - protein, 56 aa, Homo sapiens; identical to SEQ ID NO: 8038

SEQ ID NO: 10556 - protein, 48 aa, Homo sapiens
MQPCLFMFVLMGIMWATGILPKIMPSRKRCLSIDIPAAPQAGMCLLIL

SEQ ID NO: 10557 - protein, 31 aa, Homo sapiens
MPPPECLSDCSKVALVMVLFLFLHQSSCWAA

SEQ ID NO: 10558 - protein, 88 aa, Homo sapiens
  SITE (40): Xaa equals any amino acid
MELSFVRRLLLFTFFFSTFSPPPPTPCLEGLMSCLPSPLXKNTAGSQTKSLREIGTGISDTHVSPSPAQAPLCSRSPTWDSSDPNSMD

SEQ ID NO: 10559 - protein, 10 aa, Homo sapiens
MSRRENKFLL

SEQ ID NO: 10560 - protein, 98 aa, Homo sapiens; identical to SEQ ID NO: 8074

SEQ ID NO: 10561 - protein, 79 aa, Homo sapiens
  SITE (67): Xaa equals any amino acid
MVFFQIQSLLSFLASSLSIIFLLPRCLIPPANGTAGSSCSEFQTLHTFHPQASCAHAGPSNLYTFLXLFDLSAKVSPLM

SEQ ID NO: 10562 - protein, 110 aa, Homo sapiens [sequence omitted]

SEQ ID NO: 10563 - protein, 69 aa, Homo sapiens
  SITE (1): Xaa equals any amino acid
XSGDLPTSAFPKCWDYRPEPPCPAQAQTSVLCVTSWSRLTVSTLTSTSQAEGVRALPIWPSSQVCSIQP

SEQ ID NO: 10564 - protein, 25 aa, Homo sapiens
MSPSIRILLVLQQLGSLMAPLPSAH

SEQ ID NO: 10565 - protein, 44 aa, Homo sapiens
MLSSILSQLMVSKPWGVFISFSFISLSFYHAISISSVPSGRQVV

SEQ ID NO: 10566 - protein, 150 aa, Homo sapiens
  SITE (12): Xaa equals any amino acid
  SITE (38): Xaa equals any amino acid
  SITE (43): Xaa equals any amino acid
  SITE (145): Xaa equals any amino acid
CPPPPKRGGIEXELGKLWPTFETFRANRRTMLLEPLGXPGGGXRPFWKRARGVTSEAIVTGRCNHCPDCGKAWREQGESTPSTCPFDPLTCWWLALAKPETGGQEPLSVAAYGGQPSEVKAGQKVEKGLGGTHGEQSTKFTPFVXWHWKI

SEQ ID NO: 10567 - protein, 67 aa, Homo sapiens [sequence omitted]

SEQ ID NO: 10568 - protein, 70 aa, Homo sapiens
  SITE (27): Xaa equals any amino acid
  SITE (49): Xaa equals any amino acid
MWGCSGLGHRTVSFLLLLPCSFPRPCXLFGLIPISRPCKVEAPRLSVPXLSCASHPYCNCPMSTSCPLPR

SEQ ID NO: 10569 - protein, 92 aa, Homo sapiens; identical to SEQ ID NO: 8103

SEQ ID NO: 10570 - protein, 110 aa, Homo sapiens
  SITE (98): Xaa equals any amino acid
  SITE (100): Xaa equals any amino acid
MAAPALGLVCGRCPELGLVLLLLLLSLLCGAAGSQEAGTGAGAGSLAGSCGCGTPQRPGAHGSSAAAHRYSREANAPGPVPGERQLAHSKVLHRFLRXGXGLLGSWTGLE

SEQ ID NO: 10571 - protein, 374 aa, Homo sapiens
MAAPALGLVCGRCPELGLVLLLLLLSLLCGAAGSQEAGTGAGAGSLAGSCGCGTPQRPGAHGSSAAAHRYSREANAPGPVPGERQLAHSKMVPIPAGVFTMGTDDPQIKQDGEAPARRVTIDAFYMDAYEVSNTEFEKFVNSTGYLTEAEKFGDSFVFEGMLSEQVKTNIQQAVAAAPWWLPVKGANWRHPEGPDSTILHRPDHPVLHVSWNDAVAYCTWAGKRLPTEAEWEYSCRGGLHNRLFPWGNKLQPKGQHYANIWQGEFPVTNTGEDGFQGTAPVDAFPPNGYGLYNIVGNAWEWTSDWWTVHHSVEETLNPKGPPSGKDRVKKGGSYMCHRSYCYRYRCAARSQNTPDSSASNLGFRCAADRLPTMD

SEQ ID NO: 10572 - protein, 100 aa, Homo sapiens
MFAFSPLSRLAMLGVCCGCCLGLFLESDTGINFLNFNYLASYSWSSRSSNFNNLGIFSFFFFETESRSVAQAGVQWHYLSSLQALPPGFTPFSCLSLPSS

SEQ ID NO: 10573 - protein, 47 aa, Homo sapiens
MLLLLSLSSPPHPSRPSLNPYFLTEAFPDSSTLSHFPLLQALLTHQL

SEQ ID NO: 10574 - protein, 106 aa, Homo sapiens; identical to SEQ ID NO: 8126

SEQ ID NO: 10575 - protein, 107 aa, Homo sapiens
  SITE (63): Xaa equals any amino acid
  SITE (64): Xaa equals any amino acid
  SITE (82): Xaa equals any amino acid
SMKAKRNKGRWVAAGPTAATAWIVLTVQAACPEGKCPLPGVCAPITWAPSYLTAGKAKLAGPXXYKPGPVLKAAHLPMGQHXHTTPWWQPLFIISVSRYPPRTPKQH

SEQ ID NO: 10576 - protein, 90 aa, Homo sapiens
  SITE (39): Xaa equals any amino acid
  SITE (45): Xaa equals any amino acid
  SITE (49): Xaa equals any amino acid
  SITE (51): Xaa equals any amino acid
  SITE (62): Xaa equals any amino acid
  SITE (64): Xaa equals any amino acid
MGIWVLALWVGCLCFLYRPACGTDQCGAWSKVRRTAMAXATGAAXSTPXAXWLLSVSHTTLXLXAMEKGEAQRANCQHSCVDTLGPQHQP

SEQ ID NO: 10577 - protein, 12 aa, Homo sapiens
  SITE (8): Xaa equals any amino acid
LFSGWLVXLCGV

SEQ ID NO: 10578 - protein, 86 aa, Homo sapiens
  SITE (4): Xaa equals any amino acid
  SITE (11): Xaa equals any amino acid
NLWXAHFFLNXSSIQIEYPPLSKMLETPKGKGWFFGEFFFWVFLFFLGFAFGFWNSLFVLYLFVGHPKSEICSKIQNVKCSSEHFL

SEQ ID NO: 10579 - protein, 108 aa, Homo sapiens; identical to SEQ ID NO: 8130

SEQ ID NO: 10580 - protein, 81 aa, Homo sapiens
  SITE (29): Xaa equals any amino acid
SFLFFFFFFFETGFRSVFQAGVQWCDLGXLPPRFKKFSCLSLPSSWDYRHALPHPVTFFCVFLVEMAFAMLAMAGLKLLAS

SEQ ID NO: 10581 - protein, 108 aa, Homo sapiens; identical to SEQ ID NO: 8130

SEQ ID NO: 10582 - protein, 93 aa, Homo sapiens
MYALYITVHGYFLITFLFGMVVLALVVWKIFTLSRATAVKERGKNRKKVLTLLGLSSLVGVTWGLAIFTPLGLSTVYIFALFNSLQAQRGITV

SEQ ID NO: 10583 - protein, 93 aa, Homo sapiens
  SITE (34): Xaa equals any amino acid
  SITE (76): Xaa equals any amino acid
MYALYITVHGYFLITFLFGMVVLALVVWKIFTLXRATAVKERGKNRKKVLTLLGLSSLVGVTWGLAIFTPLGLSTXYIFALFNSLQAQRGITV

SEQ ID NO: 10584 - protein, 58 aa, Homo sapiens
  SITE (38): Xaa equals any amino acid
  SITE (58): Xaa equals any amino acid
DYILMRQLRPANFCIFSRDRFHPVSQAGLELLTSSDLXAFGLPKYWYYRHEPPCLASX

SEQ ID NO: 10585 - protein, 167 aa, Homo sapiens
  SITE (165): Xaa equals any amino acid
MSLYLCVSLLISLSLSLNVSVSVSLRLCLYFSPPLSDAISLCLSLSLSVSPFLSPSLALCFLCLCLFLAQSRALGMRTRVSQGWLQLDTSGIPASPGPSKGERYVTFGVVGGAGSNLAVHSARPLIGNLLSVGPTSTLTPTRGLSWQSIAASPSSTGHAKFRETXKN

SEQ ID NO: 10586 - protein, 71 aa, Homo sapiens
  SITE (4): Xaa equals any amino acid
  SITE (60): Xaa equals any amino acid
QLRXLRDSIPEQFCNRLKAPGNRTHISGCLGGGQDLGGPERVFWDDGIFCILTVWCLHRXQHLSEINGLSL

SEQ ID NO: 10587 - protein, 80 aa, Homo sapiens
  SITE (25): Xaa equals any amino acid
  SITE (80): Xaa equals any amino acid
MASWPFLSPMGPIALALLTQALSSXVGLCLALTCSRRPSPDSVCASCRFPLVPLCCQPSLPALLRPVSHCRYPGTSWVSX

SEQ ID NO: 10588 - protein, 56 aa, Homo sapiens
  SITE (46): Xaa equals any amino acid
VDLVSVNVGSEFLVTLLFFLGPVTGHLDRLNAILELDSYVFICTPXSHLPVASSDA

SEQ ID NO: 10589 - protein, 136 aa, Homo sapiens
MYQPHTQSWFPWCLILSSSQAGTRGLSWHLANAPVKPGMGLAFALIRLDSLLTCYLPCLHVRLVRAHTCTSPTRPLLSYQSVPAASMICPPCEIPHGEGSFEVAGRSTEMSHLPVEIPRLPGQCQQSQKTHPLAWS

SEQ ID NO: 10590 - protein, 25 aa, Homo sapiens
  SITE (13): Xaa equals any amino acid
MVGRCSILSSTPXRHPSLSWEGLGG

SEQ ID NO: 10591 - protein, 2 aa, Homo sapiens
MS

SEQ ID NO: 10592 - protein, 29 aa, Homo sapiens
  SITE (19): Xaa equals any amino acid
MHCLISFLALSLFLFVLFXPFSLPIKNIC

SEQ ID NO: 10593 - protein, 41 aa, Homo sapiens
  SITE (15): Xaa equals any amino acid
MWLMLILSLTSGETXALRGCCSSSWTYGESAAGPADQAPCL

SEQ ID NO: 10594 - protein, 59 aa, Homo sapiens
  SITE (57): Xaa equals any amino acid
MCHLCVHVGLLVSLFPSQAAGFVWMRMAPFLFTDRYSVPSTVPGTQEVLVGGVPVPXRP

SEQ ID NO: 10595 - protein, 42 aa, Homo sapiens
MKALRLSASALFCLLLINGLGAAPPGRPEAQLLLSALSIKSR

SEQ ID NO: 10596 - protein, 85 aa, Homo sapiens; identical to SEQ ID NO: 8182

SEQ ID NO: 10597 - protein, 110 aa, Homo sapiens
  SITE (20): Xaa equals any amino acid
LLGCTKIGGRSDLAGPWVRXRSLEPTCVGMNPGSAGCPLVSGSTSLCFRVLIYKMGMMMMILWGCNMVQSHWKSLAVPQKVKHKSYHMIQVWQHIPVVPATQEDHLSPGV

SEQ ID NO: 10598 - protein, 120 aa, Homo sapiens
MLPALRGLLFVTWVFPLEDQEAAAFPGEVDPPSPFGPCTAEGPAALPARVWSVKQGLRPFSCSDAPQGDSRELAKPPGLPPVRGALVTWPPPQPTGLSRLRCHPHGTGGNHSIRCRRCRP

SEQ ID NO: 10599 - protein, 29 aa, Homo sapiens
FLWFLYKSSNTSIFLLLLILQNVEQFAEY

SEQ ID NO: 10600 - protein, 18 aa, Homo sapiens
MVRTLSLAVLSWLPAAVC

SEQ ID NO: 10601 - protein, 38 aa, Homo sapiens
EKKKKKKKRPGAVAHALIPALWETEAGGSPEVGSSRPA

SEQ ID NO: 10602 - protein, 81 aa, Homo sapiens
  SITE (76): Xaa equals any amino acid
  SITE (81): Xaa equals any amino acid
MFCFSSIFCSHEHTHLPGTFWLFLFLFLILPPSCPCFLPFSLAIETVRWPCWHHPTSFELCYPGTSIYYASRGGPXPNSEX

SEQ ID NO: 10603 - protein, 331 aa, Homo sapiens
  SITE (249): Xaa equals any amino acid
  SITE (257): Xaa equals any amino acid
  SITE (298): Xaa equals any amino acid
  SITE (300): Xaa equals any amino acid
  SITE (301): Xaa equals any amino acid
MDRLKSHLTVCFLPSVPFLILVSTLATAKSVTNSTLNGTNVVLGSVPVIIARTDHIIVKEGNSALINCSVYGIPDPQFKWYNSIGKLLKEEEDEKERGGGKWQMHDSGLLNITKVSFSDRGKYTCVASNIYGTVNNTVTLRVIFTSGDMGVYYMVVCLVAFTIVMVLNITRLCMMSSHLKKTEKAINEFFRTEGAEKLQKAFEIAKRIPIITSAKTLELAKVTQFKTMEFARYIEELARSVPLPPLIMXCRTIMEEXMEVVGLEEQGQNFVRHTPEGQEAADRDEVYTIPNSLKRSDXPXXVLGRLIAARATSANCHQGVSSPAVQKRACR

SEQ ID NO: 10604 - protein, 80 aa, Homo sapiens
  SITE (65): Xaa equals any amino acid
MDSGGWMDGDTRQAFPCPWGLVSLPLAGVTLALHVFTASALPRELRSEKDWPGQSPGPIVSVPGXQEGILEGGPGTQFAL

SEQ ID NO: 10605 - protein, 58 aa, Homo sapiens; identical to SEQ ID NO: 8218

SEQ ID NO: 10606 - protein, 2 aa, Homo sapiens
LE

SEQ ID NO: 10607 - protein, 91 aa, Homo sapiens [sequence omitted]

SEQ ID NO: 10608 - protein, 77 aa, Homo sapiens
VGSLLGSSLVALLSLPGGWLHCPKDFGNINNCRMDLYFFLLAGIQAVTALLFVWIAGRYERASQGPASHSRFSRDRG

SEQ ID NO: 10609 - protein, 142 aa, Homo sapiens
MVYSAMWWMATCLLSHLPSDCWTDSLALSWCSPREAQSHSPRAQPSSPMASQAWSHEMLPSTWQNGPSRTRQPSLIGDLGAHGRTPRQAHPGAVTDMVPFPPARTVLELGSGASLTGLAICKMCRLQAYIFSDCHSQVLEKL

SEQ ID NO: 10610 - protein, 109 aa, Homo sapiens; identical to SEQ ID NO: 8225

SEQ ID NO: 10611 - protein, 71 aa, Homo sapiens
  SITE (32): Xaa equals any amino acid
GVRIDASGSLAAVLPLNHYTITEFNFLQFQGXTELSSDSKIRISNREWIHLRIGETDIHDLKQKSETKLIN

SEQ ID NO: 10612 - protein, 66 aa, Homo sapiens
MHRPEAMLLLLTLALLGGPTWAGKMYGPGGGKYFSTTEDYDHEITGLRVSVGLLLVKRFLEGVIYE

SEQ ID NO: 10613 - protein, 18 aa, Homo sapiens
MRFSEAWTSPWCMTLLTC

SEQ ID NO: 10614 - protein, 53 aa, Homo sapiens
  SITE (52): Xaa equals any amino acid
MVFLSHLFGTKRLFLLLALIWASWHFSYMPADAWVDPGIPDRYLQAYLSIVXP

SEQ ID NO: 10615 - protein, 184 aa, Homo sapiens; identical to SEQ ID NO: 8230

SEQ ID NO: 10616 - protein, 184 aa, Homo sapiens; identical to SEQ ID NO: 8230

SEQ ID NO: 10617 - protein, 185 aa, Homo sapiens; identical to SEQ ID NO: 8231

SEQ ID NO: 10618 - protein, 208 aa, Homo sapiens; identical to SEQ ID NO: 8232

SEQ ID NO: 10619 - protein, 208 aa, Homo sapiens; identical to SEQ ID NO: 8232

SEQ ID NO: 10620 - protein, 208 aa, Homo sapiens; identical to SEQ ID NO: 8232

SEQ ID NO: 10621 - protein, 21 aa, Homo sapiens
HHHLMGVLCVDVSKGWVVDVP

SEQ ID NO: 10622 - protein, 123 aa, Homo sapiens
MAWPNVFQRGSLLSQFSHHHVVVFLLTFFSYSLLHASRKTFSNVKVSISEQWTPSAFNTSVELPLEIWSSNHLFPSAEKATLFLGTLDTIFLFSYAVGLFISGIVGDRLNLRWVLLLACALLH

SEQ ID NO: 10623 - protein, 160 aa, Homo sapiens
  SITE (7): Xaa equals any amino acid
LPNCYLXDTIEGTPAGTGPEFAAASTSLKECRAVIIASRGQPVWPALLDVHAVDDFVVSCNLAHRRATIPEEDCSKLLPSFPDHGDPLTVFSPSNVFDLPSERLVLILQQVLLLRGIPDPQLPRHISGGNVESAGRILGHHHLMGVLCVDVSKGWVVDVP

SEQ ID NO: 10624 - protein, 101 aa, Homo sapiens
  SITE (69): Xaa equals any amino acid
VIFFFFFSCRERVCVAQAGLNFMASSYSASASRSAGNIGMSHHTQPLCLLSFSIIINLFMFIHSPVDEXLGCFQFWAVTNKAPGNICVQKKKKKKKKKKKK

SEQ ID NO: 10625 - protein, 173 aa, Homo sapiens [sequence omitted]

SEQ ID NO: 10626 - protein, 102 aa, Homo sapiens
  SITE (13): Xaa equals any amino acid
  SITE (14): Xaa equals any amino acid
MRVSCSRSCCSLXXISLSLRLVASCLPCCLCLSAAPRMQEEPGHLRPSRARPLEGPSWDSPSLAPPASAQRPLPPPVSRILPATSGRAGRWCGWAPCPKTAA

SEQ ID NO: 10627 - protein, 53 aa, Homo sapiens
  SITE (31): Xaa equals any amino acid
VWARWPMLSIPAAQGGRLLEPKHSRLAWETXQDPVSTKTFKMSQVAGCGGSCL

SEQ ID NO: 10628 - protein, 153 aa, Homo sapiens; identical to SEQ ID NO: 8238

SEQ ID NO: 10629 - protein, 135 aa, Homo sapiens
  SITE (134): Xaa equals any amino acid
MSALRPLLLLLLPLCPGPGPGPGSEAKVTRSCAETRQVLGARGYSLNLIPPALISGEHLRVCPQEYTCCSSETEQRLIRETEATFRGLVEDSGSFLVHTLAARHRKFDDNPDPGGCPSLLCKAWRLEEMWSSEXA

SEQ ID NO: 10630 - protein, 116 aa, Homo sapiens; identical to SEQ ID NO: 8241

SEQ ID NO: 10631 - protein, 116 aa, Homo sapiens; identical to SEQ ID NO: 8241

SEQ ID NO: 10632 - protein, 293 aa, Homo sapiens [sequence omitted]

SEQ ID NO: 10633 - protein, 249 aa, Homo sapiens
  SITE (242): Xaa equals any amino acid
  SITE (247): Xaa equals any amino acid
  SITE (248): Xaa equals any amino acid
MEFSWLETRWARPFYLAFVFCLALGLLQAIKLYLRRQRLLRDLRPFPAPPTHWFLGHQKFIQDDNMEKLEEIIEKYPRAFPFWIGPFQAFFCIYDPDYAKTLLSRTDPKSQYLQKFSPPLLGKGLAALDGPKWFQHRRLLTPGFHFNILKAYIEVMAHSVKMMLDKWEKICSTQDTSVEVYEHINSMSLDIIMKCAFSKETNCQTNSTHDPYAKAIFELSKIIFHRLYSCCITVTYFSNSAXRVTVXXS

SEQ ID NO: 10634 - protein, 249 aa, Homo sapiens
  SITE (221): Xaa equals any amino acid
  SITE (241): Xaa equals any amino acid
  SITE (246): Xaa equals any amino acid
MEFSWLETRWARPFYLAFVFCLALGLLQAIKLYLRRQRLLRDLRPFPAPPTHWFLGHQKFIQDDNMEKLEEIIEKYPRAFPFWIGPFQAFFCIYDPDYAKTLLSRTDPKSQYLQKFSPPLLGKGLAALDGPKWFQHRRLLTPGFHFNILKAYIEVMAHSVKMMLDKWEKICSTQDTSVEVYEHINSMSLDIIMKCAFSKETNCQTNSTHDPYAKAILNSAXSYFTVVQLLYHSDIFFKFSXQGYRXPEL

SEQ ID NO: 10635 - protein, 96 aa, Homo sapiens
  SITE (74): Xaa equals any amino acid
  SITE (88): Xaa equals any amino acid
  SITE (89): Xaa equals any amino acid
  SITE (91): Xaa equals any amino acid
AQGHPWSVRTQLPRIPRPSPMTLGPQILICHSGSAAGSRNCIGQEFAMIELKVTIALILLHFRVTPDPTRPLTXPNHFILKPKNGMYXXLXKLSEC

SEQ ID NO: 10636 - protein, 109 aa, Homo sapiens [sequence omitted]

SEQ ID NO: 10637 - protein, 109 aa, Homo sapiens; identical to SEQ ID NO: 8246
  SITE (40): Xaa equals any amino acid

SEQ ID NO: 10638 - protein, 72 aa, Homo sapiens
MPWKRAVVLLMLWFIGQAMWLAPAYVLEFQGKNTFLFIWLAGLFFLLINCSILIQIISHYKEEPLTERIKYD

SEQ ID NO: 10639 - protein, 40 aa, Homo sapiens; identical to SEQ ID NO: 8249

SEQ ID NO: 10640 - protein, 417 aa, Homo sapiens
MATAGGGSGADPGSRGLLRLLSFCVLLAGLCRGNSVERKIYIPLNKTAPCVRLLNATHQIGCQSSISGDTGVIHVVEKEEDLQWVLTDGPNPPYMVLLESKHFTRDLMEKLKGRTSRIAGLAVSLTKPSPASGFSPSVQCPNDGFGVYSNSYGPEFAHCREIQWNSLGNGLAYEDFSFPIFLLEDENETKVIKQCYQDHNLSQNGSAPTFPLCAMQLFSHMHAVISTATCMRRSSIQSTFSINPEIVCDPLSDYNVWSMLKPINTTGTLKPDDRVVVAATRLDSRSFFWNVAPGAESAVASFVTQLAAAEALQKAPDVTTLPRNVMFVFFQGETFDYIGSSRMVYDMEKGKFPVQLENVDSFVELGQVALRTSLELWMHTDPVSQKNESVRNQVEDLLATLETVSYAHLNLQGGEVL

SEQ ID NO: 10641 - protein, 426 aa, Homo sapiens
VVPFSGMLPPGAEKAVASFVTQLAAAEALQKAPDVTTLPRNVMFVFFQGETFDYIGSSRMVYDMEKGKFPVQLENVDSFVELGQVALRTSLELWMHTDPVSQKNESVRNQVEDLLATLEKSGAGVPAVILRRPNQSQPLPPSSLQRFLRARNISGVVLADHSGAFHNKYYQSIYDTAENINVSYPEWLSPEEDLNFVTDTAKALADVATVLGRALYELAGGTNFSDTVQADPQTVTRLLYGFLIKANNSWFQSILRQDLRSYLGDGPLQHYIAVSSPTNTTYVVQYALANLTGTVVNLTREQCQDPSKVPSENKDLYEYSWVQGPLHSNETDRLPRCVRSTARLARALSPAFELSQWSSTEYSTWTESRWKDIRARIFLIASKELELITLTVGFGILIFSLIVTYCINAKADVLFIAPREPGAVSY

SEQ ID NO: 10642 - protein, 94 aa, Homo sapiens
  SITE (6): Xaa equals any amino acid
PYPFCXPSPFPSSAAPHSQSDAAGTTITRSGQVNRDTSNSRAGLPPAFWEGKRCSPELIPSDSAARLVGLLFPTFCFFFFLCKSQMLLSIAFCD

SEQ ID NO: 10643 - protein, 204 aa, Homo sapiens
MFQFLSQGFYCGVGLFTRFLKLLGALLLLALALFLGFLQLGWRFLVGLGDRLGWRDKATWLFSWLDSPALQRCLTLLRDSRPWQRLVRIVQWGWLELPWVKQNINRQGNAPVASGRYCQPEEEVARLLTMAGVPEDELNPFHVLGVEATASDVELKKAYRQLAVMVHPDKNHHPRAEEAFKVFASSLGTLSAMLKKRKGVWRLK

SEQ ID NO: 10644 - protein, 15 aa, Homo sapiens
MPPRAAWAWLLCGAS

SEQ ID NO: 10645 - protein, 201 aa, Homo sapiens
RQAVIVCRRRFVMGPVRLGILLFLFLAVHEAWAGMLKEEDDDTERLPSKCEVCKLLSTELQAELSRTGRSREVLELGQVLDTGKRKRHVPYSVSETRLEEALENLCERILDYSVHAERKGSLRYAKGQSQTMATLKGLVQKGVKVDLGIPLELWDEPSVEVTYLKKQCETMLEEEEEEEEEEGGDKMTKTGSHPKLDREDL

SEQ ID NO: 10646 - protein, 68 aa, Homo sapiens
  SITE (14): Xaa equals any amino acid
WPTVASPRTASRPXGPCQNCACWTTSGAGCRPGQTSMPPWTTGPRCCTSQPPTGSARRLPCCWNTEPA

SEQ ID NO: 10647 - protein, 195 aa, Homo sapiens [sequence omitted]

SEQ ID NO: 10648 - protein, 104 aa, Homo sapiens
  SITE (104): Xaa equals any amino acid
MGFSGPALLFPIFLLHSASSMLSHTSTIVQTNKQTEERKDGEFCNRAAKSQSKQEEVEGTKTNKQRCLDYSTVDMPSILACAPLSITGHNSEEVQIKWCLFVCX

SEQ ID NO: 10649 - protein, 104 aa, Homo sapiens; identical to SEQ ID NO: 10648
  SITE (104): Xaa equals any amino acid

SEQ ID NO: 10650 - protein, 51 aa, Homo sapiens [sequence omitted]

SEQ ID NO: 10651 - protein, 116 aa, Homo sapiens
  SITE (7): Xaa equals any amino acid
  SITE (16): Xaa equals any amino acid
SQLLRRXRQEDCLSPXGGSCSEPRLRHCTPAWVTERDSVSKKKKKTSEVGAVPYFCPTPIKRIPKTTCGNLIILSNLLFGQDWHLPCFSLLLAVKHGFKEECFSEFTLYISDLEVI

SEQ ID NO: 10652 - protein, 490 aa, Homo sapiens
MGSAPWAPVLLLALGLRGLQAGARSGPRLPGALLPAASGPLQLRALRQQDLPSALPGVGQVLGPGRGAHLLLHWERGRRVGLRQQLGLRRGLAAERGALLVFAEHRYYGKSLPFGAQSTQRGHTELLTVEQALADFAELLRALRRDLGAQDAPAIAFGGSYGGMLSAYLRMKYPHLVAGALAASAPVLSVAGLGDSNQFFRDVTADFEGQSPKCTQGVREAFRQIKDLFLQGAYDTVRWEFGTCQPLSDEKDLTQLFMFARNAFTVLAMMDYPYPTDFLGPLPANPVKVGCDRLLSEAQRITGLRALAGLVYNASGSEHCYDIYRLYHSCADPTGCGTGPDARAWDYQACTEINLTFASNNVTDMFPDLPFTDELRQRYCLDTWGVWPRPDWLLTSFWGGDLRAASNIIFSNGNLDPWAGGGIRRNLSASVIAVTIQGGAHHLDLRASHPEDPASVVEARKLEATIIGEWVKAARREQQPALRGGPRLSL

SEQ ID NO: 10653 - protein, 31 aa, Homo sapiens
  SITE (18): Xaa equals any amino acid
MDSYWHSRCLKCSCCQAXWATSARPVTPKVA

SEQ ID NO: 10654 - protein, 293 aa, Homo sapiens
  SITE (134): Xaa equals any amino acid
MLALTFMFMVLEVVVSRVTSSLAMLSDSFHMLSDVLALVVALVAERFARRTHATQKNTFGWIRAEVMGALVNAIFLTGLCFAILLEAIERFIEPHEMQQPLVVLGVGVAGLLVNVLGLCLFHHHSGFSQDSGHXHSHGGHGHGHGLPKGPRVKSTRPGSSDINVAPGEQGPDQEETNTLVANTSNSNGLKLDPADPENPRSGDTVEVQVNGNLVREPDHMELEEDRAGQLNMRGVFLHVLGDALGSVIVVVNALVFYFSWKGCSEGDFCVNPCFPDPCKAFVEILIVLMHQFM

SEQ ID NO: 10655 - protein, 113 aa, Homo sapiens [sequence omitted]

SEQ ID NO: 10656 - protein, 112 aa, Homo sapiens
  SITE (93): Xaa equals any amino acid
  SITE (98): Xaa equals any amino acid
  SITE (104): Xaa equals any amino acid
  SITE (106): Xaa equals any amino acid
MDLWTTSFFFFAVMHNAAMNINVQVSESGFSFWGRYLGVELLGCVVNLYLFKKWPNCFLNGCIILHPHQQYIRVSCFSTSYLLMAFKNYRHSXKCEVXPHCSLXCXFLITMM

SEQ ID NO: 10657 - protein, 104 aa, Homo sapiens
  SITE (63): Xaa equals any amino acid
  SITE (74): Xaa equals any amino acid
  SITE (103): Xaa equals any amino acid
MSLLLLLSVLMSPGARPSDPVEVIASGPTVASSHNVQDCLHILNRYGLRAALPRSVKTVLSRXDSDPHGPHTCXHVLNVIIGSNVLALAEAQRQAEALGYKLXC

SEQ ID NO: 10658 - protein, 81 aa, Homo sapiens
QVPMSWTPTSCSCGLGDGIGHILGVQRRPTRARSDGRASQTGRWGLPPTPEDEDKPLGQFSVPVLLPWAASLLSPSPCFFL

SEQ ID NO: 10659 - protein, 86 aa, Homo sapiens; identical to SEQ ID NO: 8271
  SITE (71): Xaa equals any amino acid

SEQ ID NO: 10660 - protein, 124 aa, Homo sapiens
  SITE (74): Xaa equals any amino acid
  SITE (88): Xaa equals any amino acid
  SITE (92): Xaa equals any amino acid
  SITE (95): Xaa equals any amino acid
MHPAAFPLPVVVAAVLWGAAPTRGLIRATSDHNASMDFADLPALFGATLSQEGLQGFLVEAHPDNACSPIAPPXPAPVNGSVFIALLXRFDXNFXLKVLNAQKAGYGAAVVHNVNSNELLNMVL

SEQ ID NO: 10661 - protein, 48 aa, Homo sapiens
MSSAAADHWAWLLVLSFVFGCNVLRILLPSFSSFMSRVLQKDADRSHR

SEQ ID NO: 10662 - protein, 105 aa, Homo sapiens; identical to SEQ ID NO: 8288

SEQ ID NO: 10663 - protein, 37 aa, Homo sapiens
FCLIWSAYLLMCLFLFCLFYFYFSVNARTDLHVKSGL

SEQ ID NO: 10664 - protein, 36 aa, Homo sapiens
MNNSIAAQASKFVILYLFILSFPKQCICHILSEMVW

SEQ ID NO: 10665 - protein, 178 aa, Homo sapiens
HLLEVTPCRLPVPEFPGRTPRGSRTPDMRRLLLVTSLVVVLLWEAGAVPAPKVPIKMQVKHWPSEQDPEKAWGARVVEPPEKDDQLVVLFPVQKPKLLTTEEKPRGQGRGPILPGTKAWMETEDTLGRVLSPEPDHDSLYHPPPEEDQGEERPRLWVMPNHQVLLGPEEDQDHIYHPQ

SEQ ID NO: 10666 - protein, 101 aa, Homo sapiens [sequence omitted]

SEQ ID NO: 10667 - protein, 283 aa, Homo sapiens; identical to SEQ ID NO: 8292

SEQ ID NO: 10668 - protein, 283 aa, Homo sapiens
  SITE (174): Xaa equals any amino acid
  SITE (189): Xaa equals any amino acid
  SITE (205): Xaa equals any amino acid
MKIVPLTAAVLALVLAPAAHAQPANKATTVSPTAAAFLAQFATEGNDSVSWAQFEAFRKQRYADTDRNQDGHVDEQEYVDEYLQRFDVRLADARAGHLRQTDTRFKALDRDGNGAISRAEYDAAGERTWAGYERSQNATQETAAASSRDPLKMPTSHTANGMLDLYDRNKDGAXDREEFDAVRAASFAXTDTDGNGTLSLAEYTXEFEGRLDQQRQRVRADAERQARVRFASLDKDTDGRMTFAEYQLSGKRMFDRADSNGDGVVDARDPEPVAGAHSANGNR

SEQ ID NO: 10669 - protein, 124 aa, Homo sapiens
  SITE (89): Xaa equals any amino acid
  SITE (103): Xaa equals any amino acid
  SITE (104): Xaa equals any amino acid
  SITE (113): Xaa equals any amino acid
  SITE (121): Xaa equals any amino acid
VAQVQVPGGHIGLGYLARIDFHRRDGTGGIPARIDGGEIDVALLPGQAVDHIMARACGGEHLAEVGRGTVQGLLGRAVLAAQARRAPPXQPLPATMGFWGWKXXPNRGLWFKXWKPPFGAXGVP

SEQ ID NO: 10670 - protein, 29 aa, Homo sapiens
  SITE (3): Xaa equals any amino acid
  SITE (13): Xaa equals any amino acid
  SITE (17): Xaa equals any amino acid
  SITE (19): Xaa equals any amino acid
  SITE (23): Xaa equals any amino acid
MLXSNSFSPSLSXYLCXLXFSLXSSKSSK

SEQ ID NO: 10671 - protein, 152 aa, Homo sapiens
MELPAVNLKVILLGHWLLTTWGCIVFSGSYAWANFTILALGVWAVAQRDSIDAISMFLGGLLATIFLDIVHISIFYPRVSLTDTGRFGVGMAILSLLLKPLSCCFVYHMYRERGGFLGSSQDRSAYQTIDSAEAPADPFAVPEGRSQDARGY

SEQ ID NO: 10672 - protein, 159 aa, Homo sapiens; identical to SEQ ID NO: 8297

SEQ ID NO: 10673 - protein, 99 aa, Homo sapiens [sequence omitted]

SEQ ID NO: 10674 - protein, 151 aa, Homo sapiens
  SITE (54): Xaa equals any amino acid
  SITE (92): Xaa equals any amino acid
  SITE (95): Xaa equals any amino acid
  SITE (117): Xaa equals any amino acid
  SITE (122): Xaa equals any amino acid
  SITE (128): Xaa equals any amino acid
  SITE (132): Xaa equals any amino acid
  SITE (139): Xaa equals any amino acid
MPLFFTRFHPALGPLALSLLAGFAAGSLQAIGRTEEKGVRVLTSQAPPYRVMGXLHSSTKGFSFCQGVCPRALSLWVTTPLFLPPSPRLAMXPTXSCPGYCHHVSLYPVYALQLVLXQILLXWPNLMXYWYXHLMTGPXSDQKRKSVVTLV

SEQ ID NO: 10675 - protein, 79 aa, Homo sapiens
  SITE (57): Xaa equals any amino acid
RVDNFLCQFIRIYLILLSSHIIFHNTNVSCYPMESHLLFSYNNTAVSILVHRFFNIXISKFLKVISWDRNRNGIGISKS

SEQ ID NO: 10676 - protein, 25 aa, Homo sapiens
MVLLMVWVVMAVVVEAVEVTMGKAA

SEQ ID NO: 10677 - protein, 33 aa, Homo sapiens
KEFFVFLFVCLFWLLSNTPLTFISIILQRKETN

SEQ ID NO: 10678 - protein, 188 aa, Homo sapiens; identical to SEQ ID NO: 7349

SEQ ID NO: 10679 - protein, 127 aa, Homo sapiens; identical to SEQ ID NO: 10307

SEQ ID NO: 10680 - protein, 81 aa, Homo sapiens
MRPGTALQAVLLAVLLVGLRAATGRLLSGQPVCRGGTQRPCYKVIYFHDTSRRLNFEEAKEACRRGWRPASQHRVLKMNRN

SEQ ID NO: 10681 - protein, 37 aa, Homo sapiens; identical to SEQ ID NO: 8310

SEQ ID NO: 10682 - protein, 122 aa, Homo sapiens
  SITE (119): Xaa equals any amino acid
MALFRCVWSVLSALGKSGSDLCAGCGSRLRSPFSFAYVPRCFSSTANSYPKKPLTSYVRFSKEQLPIFKAQNPDAKNSELIRKIAQLWRELPDSEKKIYEDAYRADLAGHTKKEINRIXEPG

SEQ ID NO: 10683 - protein, 92 aa, Homo sapiens
  SITE (44): Xaa equals any amino acid
MGPFAPTLLMLLPPLLMLVLYGCWQARGWAGHQYEHHRGPGEQXAAYFQAMRFNANMSFHAQMVINEGEAFREGQRTIPAVERPGNALRQRS

SEQ ID NO: 10684 - protein, 32 aa, Homo sapiens
MWWALLACRFCCPRRCASAWQGLPRRGALFSG

SEQ ID NO: 10685 - protein, 53 aa, Homo sapiens
  SITE (26): Xaa equals any amino acid
MWWALLALPFLLPTALRLCLAGLPHXFRHTNRMVPQWHQSGDRPLHSHPHSRF

SEQ ID NO: 10686 - protein, 84 aa, Homo sapiens
  SITE (56): Xaa equals any amino acid
GRPTRPLSAQNASVNFWEASTLAAQRELAMQFLCPGNHCFPCHLLCAQKRYNSHQXTPVVTAHLVCCVFQQSVLLGVQLNRLGV

SEQ ID NO: 10687 - protein, 35 aa, Homo sapiens
MIVITSILSSLASLLLLAFLAASTARLSPQSLPET

SEQ ID NO: 10688 - protein, 79 aa, Homo sapiens
  SITE (25): Xaa equals any amino acid
  SITE (74): Xaa equals any amino acid
MIVITSILSSLASLLLLAFLAASTXRFSSLWWPEEAPEQLRIGSFMGKRYMTHHIPPSEAATLPVGCEPGLDPXPSLSP

SEQ ID NO: 10689 - protein, 17 aa, Homo sapiens
MGLLIFMLLIGIHSQCS

SEQ ID NO: 10690 - protein, 46 aa, Homo sapiens
MRMKMRKRKWQLGGCPPDGVSWELPSGLVLPALLIEKPAPSAAAEP

SEQ ID NO: 10691 - protein, 99 aa, Homo sapiens
GVSWEGTPMSPFPFMGLGSGVRGSHSEFAVTQLLVDLPTKFGHVLLGEAEWLRQGQMLAVLQHKSTTVTVIILPGHIHFEVTFPALVEIQSVFLYRLCL

SEQ ID NO: 10692 - protein, 153 aa, Homo sapiens
AIHFTQQDMPQIRRQIYKELCHANSLCERRIPGLKPMVKGMGTWGTLPSRETPVPLLPLPLPVPYGFSYLNVLIDFCIFFSLREYLLIFDVQGVAMEQPLLPLLGRSLALWPGWGGHPPSRVQGRGQEHLCWGGGRAKGVCLPDIQTLFYTYI

SEQ ID NO: 10693 - protein, 550 aa, Homo sapiens
ALPQQAAVAGIVQRSGKPLLPFATGPPTECMRDENESPIPCFLAGDHRANEQLGLTSMHTLWFREHNRIATELLKLNPHWDGDTIYYETRKIVGAEIQHITYQHWLPKILGEVGMRTLGEYHGYDPGINAGIFNAFATAAFRFGHTLVNPLLYRLDENFQPIAQDHLPLHKAFFSPFRIVNEGGIDPLLRGLFGVAGKMRVPSQLLNTELTERLFSMAHTVALDLAAINIQRGRDHGIPPYHDYRVYCNLSAAHTFEDLKNEIKNPEIREKLKRLYGSTLNIDLFPALVVEDLVPGSRLGPTLMCLLSTQFKRLRDGDRLWYENPGVFSPAQLTQIKQTSLARILCDNADNITRVQSDVFRVAEFPHGYGSCDEIPRVDLRVWQDCCEDCRTRGQFNAFSYHFRGRRSLEFSYQEDKPTKKTRPRKIPSVGRQGEHLSNSTSAFSTRSDASGTNDFREFVLEMQKTITDLRTQIKKLESRLSTTECVDAGGESHANNTKWKKDACTICECKDGQVTCFVEACPPATCAVPVNIPGACCPVCLQKRAEEKP

SEQ ID NO: 10694 - protein, 934 aa, Homo sapiens
  SITE (225): Xaa equals any amino acid
  SITE (596): Xaa equals any amino acid
  SITE (852): Xaa equals any amino acid
MLAGCFLLILGQIVLLPAEARERSRGRSISRGRHARTHPQTALLESSCENKRADLVFIIDSSRSVNTHDYAKVKEFIVDILQFLDIGPDVTRVGLLQYGSTVKNEFSLKTFKRKSEVERAVKRMRHLSTGTMTGLAIQYALNIAFSEAEGARPLRENVPRVIMIVTDGRPQDSVAEVAAKARDTGILIFAIGVGQVDFNTLKSIGSEPHEDHVFLVANFSQIETXTSVFQKKLCTAHMCSTLEHNCAHFCINIPGSYVCRCKQGYILNSDQTTCRIQDLCAMEDHNCEQLCVNVPGSFVCQCYSGYALAEDGKRCVAVDYCASENHGCEHECVNADGSYLCQCHEGFALNPDEKTCTKIDYCASSNHGCQHECVNTDDSYSCHCLKGFTLNPDKKTCRRINYCALNKPGCEHECVNMEESYYCRCHRGYTLDPNGKTCSRVDHCAQQDHGCEQLCLNTEDSFVCQCSEGFLINEDLKTCSRVDYCLLSDHGCEYSCVNMDRSFACQCPEGHVLRSDGKTCAKLDSCALGDHGCEHSCVSSEDSFVCQCFEGYILREDGKTCRRKDVCQAIDHGCEHICVNSDDSYTCECLEGFRLXEDGKRCRRKDVCKSTHHGCEHICVNNGNSYICKCSEGFVLAEDGRRCKKCTEGPIDLVFVIDGSKSLGEENFEVVKQFVTGIIDSLTISPKAARVGLLQYSTQVHTEFTLRNFNSAKDMKKAVAHMKYMGKGSMTGLALKHMFERSFTQGEGARPLSTRVPRAAIVFTDGRAQDDVSEWASKAKANGITMYAVGVGKAIEEELQEIASEPTNKHLFYAEDFSTMDEISEKLKKGICEALEDSDGRQDSPAGELPKXVQQPTVQHRYLFEEDNLLRSTQKLSHSTKPSGSPLEEKHDQCKCENLIMFQNLANEEVRKLTQRLEEMTQRMEALENRLRYR

SEQ ID NO: 10695 - protein, 61 aa, Homo sapiens
  SITE (13): Xaa equals any amino acid
MWYVCACVCVCVXVCSYNRRTGKVRTQNNEDLLKCGGGVCVCVFIEQEDRKGNDHPWKMKG

SEQ ID NO: 10696 - protein, 11 aa, Homo sapiens
VCCCLHLNAFV

SEQ ID NO: 10697 - protein, 66 aa, Homo sapiens
  SITE (9): Xaa equals any amino acid
SWVDFDCVXEVSYLNSGSYSLVLHLEGLHPLELSGKLAIDFGKKREFCVDGVGGATLVICPGFQDF

SEQ ID NO: 10698 - protein, 63 aa, Homo sapiens
  SITE (12): Xaa equals any amino acid
  SITE (16): Xaa equals any amino acid
  SITE (20): Xaa equals any amino acid
  SITE (23): Xaa equals any amino acid
  SITE (25): Xaa equals any amino acid
  SITE (35): Xaa equals any amino acid
  SITE (38): Xaa equals any amino acid
  SITE (48): Xaa equals any amino acid
  SITE (49): Xaa equals any amino acid
MHLLPWRAAAAXPLLXAVPXRAXRXPVQAPSLGAXNPXRGTQVATVSXXSGKLLGLKAPRPKP

SEQ ID NO: 10699 - protein, 9 aa, Homo sapiens
PSAAASATP

SEQ ID NO: 10700 - protein, 94 aa, Homo sapiens
LAVIMARPAAEPLCFLNPKLLALAVGVLELLGRGFLDSSPLLRPASDGERFTWEALGESLPFSDTFASSVFPVPGVFSAPAGAEAFVLGMVMPT

SEQ ID NO: 10701 - protein, 1034 aa, Homo sapiens
MDLPRGLVVAWALSLWPGFTDTFNMDTRKPRVIPGSRTAFFGYTVQQHDISGNKWLVVGAPLETNGYQKTGDVYKCPVIHGNCTKLNLGRVTLSNVSERKDNMRLGLSLATNPKDNSFLACSPLWSHECGSSYYTTGMCSRVNSNFRFSKTVAPALQRCQTYMDIVIVLDGSNSIYPWVEVQHFLINILKKFYIGPGQIQVGVVQYGEDVVHEFHLNDYRSVKDVVEAASHIEQRGGTETRTAFGIEFARSEAFQKGGRKGAKKVMIVITDGESHDSPDLEKVIQQSERDNVTRYAVAVLGYYNRRGINPETFLNEIKYIASDPDDKHFFNVTDEAALKDIVDALGDRIFSLEGTNKNETSFGLEMSQTGFSSHVVEDGVLLGAVGAYDWNGAVLKETSAGKVIPLRESYLKEFPEELKNHGAYLGYTVTSVVSSRQGRVYVAGAPRFNHTGKVILFTMHNNRSLTIHQAMRGQQIGSYFGSEITSVDIDGDGVTDVLLVGAPMYFNEGRERGKVYVYELRQNRFVYNGTLKDSHSYQNARFGSSIASVRDLNQDSYNDVVVGAPLEDNHAGAIYIFHGFRGSILKTPKQRITASELATGLQYFGCSIHGQLDLNEDGLIDLAVGALGNAVILWSRPVVQINASLHFEPSKINIFHRDCKRSGRDATCLAAFLCFTPIFLAPHFQTTTVGIRYNATMDEKRYTPRAHLDEGGDRFTNRAVLLSSGQELCERINFHVLDTADYVKPVTFSVEYSLEDPDHGPMLDDGWPTTLRVSVPFWNGCNEDEHCVPDLVLDARSDLPTAMEYCQRVLRKPAQDCSAYTLSFDTTVFIIESTRQRVAVEATLENRGENAYSTVLNISQSANLQFASLIQKEDSDGSIECVNEERRLQKQVCNVSYPFFRAKAKVAFRLDFEFSKSIFLHHLEIELAAGSDSNERDSTKEDNVAPLRFHLKYEADVLFTRSSSLSHYEVKLNSSLERYDGIGPPFSCIFRIQNLGLFPIHGIMMKITIPIATRSGNRLLKLRDFLTDEGEHVL

SEQ ID NO: 10702 - protein, 164 aa, Homo sapiens
  SITE (3): Xaa equals any amino acid
  SITE (95): Xaa equals any amino acid
RMXCSQPPRCHFQSDFQKCAPCPRAQTHWLEPPGRVQTISSMRNAQKGFADSIRLWRLPASGVGWVVSPPIQTQEVAPEGMYLVGSSSGTLGGCXALTQYFSLSPLWGACVRARVLAYAFLCGHIRMPLGEHVHVSPPERACVCAPLRPRFGRLGFGVPVFCPP

SEQ ID NO: 10703 - protein, 102 aa, Homo sapiens [sequence omitted]

SEQ ID NO: 10704 - protein, 33 aa, Homo sapiens
MNHLSISIALFLLCCVHLSLGLSVFPFQEDRSV

SEQ ID NO: 10705 - protein, 132 aa, Homo sapiens
  SITE (70): Xaa equals any amino acid
SFRTAPRGPHVKESHASGLLSNQINLQSFDFKRMLLCRLNITGLCWGPKRTRCALGGQTGLQHHPSNEKXRHSGKEDLFLSICLGWGTTVNMACNNQRGRGYQTQRNSSPVYQEELLFFCTSLFSRLFSLKG

SEQ ID NO: 10706 - protein, 778 aa, Homo sapiens
MLSSLGCLLLCGSITLALGNAQKLPKGKRPNLKVHINTTSDSILLKFLRPSPNVKLEGLLLGYGSNVSPNQYFPLPAEGKFTEAIVDAEPKYLIVVRPAPPPSQKKSCSGKTRSRKPLQLVVGTLTPSSVFLSWGFLINPHHDWTLPSHCPNDRFYTIRYREKDKEKKWIFQICPATETIVENLKPNTVYEFGVKDNVEGGIWSKIFNHKTVVGSKKVNGKIQSTYDQDHTVPAYVPRKLIPITIIKQVIQNVTHKDSAKSPEKAPLGGVILVHLIIPGLNETTVKLPASLMFEISDALKTQLAKNETLALPAESKTPEVEKISARPTTVTPETVPRSTKPTTSSALDVSETTLVLSKRTPETLQTILIPQFELPLSTLAPKSLPEFPEAKTPFPFEKPRGTLASSEKPWIVPTAKISEDSKVLQPQTATYDVFSSPTTSDEPEISDSYTATSDRILDSIPPKTSRTLEQPRATLAPSETPFVPQKLEIFTSPEMQPTTPAPQQTTSIPSTPKRRPRPKPPRTKPERTTSAGTITPKISKSPEPTWTTPAPGKTQFISLKPKIPLSPEVTHTKPAPKQTPRAPPKPKTSPRPRIPQTQPVPKVPQRVTAKPKTSPSPEVSYTTPAPKDVLLPHKPYPEVSQSEPAPLETRGIPFIPMISPSPSQEELQTTLEETDQSTQEPFTTKIPRTTELAKTTQAPHRFYTTVRPRTSDKPHIRPVLNRTTTRPTRPKPSGMPSGNGVGTGVKQAPRPSGADRNVSVDSTHPTKKPGTRRPPLPP

SEQ ID NO: 10707 - protein, 161 aa, Homo sapiens
MLSSLGCLLLCGSITLALGNAQKLPKGKRPNLKVHINTTSDSILLKFLRPSPNVKLEGLLLGYGSNVSPNQYFPLPAEGKFTEAIVDAEPKYLIVVRPAPPPSQKKSCSGKTRSRKPLQLVVGTLTPSSVFLSWGFLINPHHDWTLPSHCPNDRFYTIRYR

SEQ ID NO: 10708 - protein, 181 aa, Homo sapiens
  SITE (80): Xaa equals any amino acid
  SITE (151): Xaa equals any amino acid
  SITE (162): Xaa equals any amino acid
PKTSPSPEVSYTTPAPKDVLLPHKPYPEVSQSEPAPLETRGIPFIPMISPSPSQEELQTTLEETDQSTQEPFTTKIPRTXELAKTTQAPHRFYTTVRPRTSDKPHIRPVLNRTTTRPTRPKPSGMPSGNGVGTGVKQAPRPSGADRNVSVXSTHPTKKPGTXRPPLPPSRRGREFPGRRAH

SEQ ID NO: 10709 - protein, 211 aa, Homo sapiens
  SITE (45): Xaa equals any amino acid
  SITE (195): Xaa equals any amino acid
MRLFLWNAVLTLFVTSLIGALIPEPEVKIEVLQKPFICHRKTKGXDLMLVHYEGYLEKDGSLFHSTHKHNNGQPIWFTLGILEALKGWDQGLKGMCVGEKRKLIIPPALGYGKEGKGKIPPESTLIFNIDLLEIRNGPRSHESFQEMDLNDDWKLSKDEVKAYLKKEFEKHGAVVNESHHDALVEDIFDKEDEDXYGFISAREFTYKHDEL

SEQ ID NO: 10710 - protein, 58 aa, Homo sapiens
DFVPVLVFVLIKANPPCLLSTVQYISSFYASCLSGEESYWWMQFTAAVEFIKTIDDRK

SEQ ID NO: 10711 - protein, 468 aa, Homo sapiens
  SITE (19): Xaa equals any amino acid
  SITE (125): Xaa equals any amino acid
MNSQNSGFTQRRRMALGIXILLLVDVIWVASSELTSYVFTQYNKPFFSTFAKTSMFVLYLLGFIIWKPWRQQCTRGLRGKHAAFFADAEGYFAACTTDTTMNSSLSEPLYVPVKFHDLPSEKPEXTNIDTEKTPKKSRVRFSNIMEIRQLPSSHALEAKLSRMSYPVKEQESILKTVGKLTATQVAKISFFFCFVWFLANLSYQEALSDTQVAIVNILSSTSGLFTLILAAVFPSNSGDRFTLSKLLAVILSIGGVVLVNLAGSEKPAGRDTVGSIWSLAGAMLYAVYIVMIKRKVDREDKLDIPMFFGFVGLFNLLLLWPGFFLLHYTGFEDFEFPNKVVLMCIIINGLIGTVLSEFLWLWGCFLTSSLIGTLALSLTIPLSIIADMCMQKVQFSWLFFAGAIPVFFSFFIVTLLCHYNNWDPVMVGIRRIFAFICRKHRIQRVPEDSEQCESLISMHSVSQEDGAS

SEQ ID NO: 10712 - protein, 178 aa, Homo sapiens [sequence omitted]

SEQ ID NO: 10713 - protein, 28 aa, Homo sapiens
GKPTGKSLPLMWMILMQPIIMISMMSNG

SEQ ID NO: 10714 - protein, 222 aa, Homo sapiens
MCALQNLAPNIFFILFLMEATICSLLLCNRNDTAWDELKLTCQTALHVLQLTLKEPWALLGGGCTETHLAAYIRHKTHNDPESILKDDECTQTELQLIAEAFCSALESVVGSLEHDGGEILTDMKYGHLWSVQADSPCVANWPDLLSQCGCGLYNSQEELNWSFLRSTRRPFVPQSCLPHEAVGSASNLTLDCLTAKLSGLQVAVETANLILDLSYVIEDKN

SEQ ID NO: 10715 - protein, 19 aa, Homo sapiens
MVSILYLGLFFLNSSVLYA

SEQ ID NO: 10716 - protein, 282 aa, Homo sapiens
VNRPSWIMGNFRGHALPGTFFFIIGLWWCTKSILKYICKKQKRTCYLGSKTLFYRLEILEGITIVGMALTGMAGEQFIPGGPHLMLYDYKQGHWNQLLGWHHFTMYFFFGLLGVADILCFTISSLPVSLTKLMLSNALFVEAFIFYNHTHGREMLDIFVHQLLVLVVFLTGLVAFLEFLVRNNVLLELLRSSLILLQGSWFFQIGFVLYPPSGGPAWDLMDHENILFLTICFCWHYAVTIVIVGMNYAFITWLVKSRLKRLCSSEVGLLKNAEREQESEEEM

SEQ ID NO: 10717 - protein, 24 aa, Homo sapiens
  SITE (2): Xaa equals any amino acid
LXKLKMFYKFAFKFSYEAICKLHT

SEQ ID NO: 10718 - protein, 318 aa, Homo sapiens
EAKAQFWLLHSYLFCHSSNVPDLLRPRMTNDSEGKMGFKHPKIMGNFRGHALPGTFFFIIGLWWCTKSILKYICKKQKRTCYLGSKTLFYRLEILEGITIVGMALTGMAGEQFIPGGPHLMLYDYKQGHWNQLLGWHHFTMYFFFGLLGVADILCFTISSLPVSLTKLMLSNALFVEAFIFYNHTHGREMLDIFVHQLLVLVVFLTGLVAFLEFLVRNNVLLELLRSSLILLQGSWFFQIGFVLYPPSGGPAWDLMDHENILFLTICFCWHYAVTIVIVGMNYAFITWLVKSRLKRLCSSEVGLLKNAEREQESEEEM

SEQ ID NO: 10719 - protein, 90 aa, Homo sapiens [sequence omitted]

SEQ ID NO: 10720 - protein, 112 aa, Homo sapiens; identical to SEQ ID NO: 8352

SEQ ID NO: 10721 - protein, 364 aa, Homo sapiens
MASVVLPSGSQCAAAAAAAAPPGLRLRLLLLLFSAAALIPTGDGQNLFTKDVTVIEGEVATISCQVNKSDDSVIQLLNPNRQTIYFRDFRPLKDSRFQLLNFSSSELKVSLTNVSISDEGRYFCQLYTDPPQESYTTITVLVPPRNLMIDIQKDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLTREGDALELTCEAIGKPQPVMVTWVRVDDEMPQHAVLSGPNLFINNLNKTDNGTYRCEASNIVGKAHSDYMLYVYDPPTTIPPPTTTTTTTTTTTTTILTIITDSRAR

SEQ ID NO: 10722 - protein, 229 aa, Homo sapiens
MIDIQKDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLTREGDALELTCEAIGKPQPVMVTWVRVDDEMPQHAVLSGPNLFINNLNKTDNGTYRCEASNIVGKAHSDYMLYVYDPPTTIPPPTTTTTTTTTTTTTILTIITDSPSQVKKARSGQWIMP

SEQ ID NO: 10723 - protein, 587 aa, Homo sapiens; identical to SEQ ID NO: 7145

SEQ ID NO: 10724 - protein, 162 aa, Homo sapiens
  SITE (138): Xaa equals any amino acid
  SITE (152): Xaa equals any amino acid
MRPRGLPPLLVVLLGCWASVSAQTDATPAVTTEGLNSTEAALATFGTFPSTRPPGTPRAPGPSSGPRPTPVTDVAVLCVCDLSPAQCDINCCCDPDCSSVDFSVFSACSVPVVTGDSQFCSQKAVIYSLNFTANPPQXVFELVDQINPSIFXIHITNCRCSV

SEQ ID NO: 10725 - protein, 254 aa, Homo sapiens
  SITE (5): Xaa equals any amino acid
  SITE (15): Xaa equals any amino acid
  SITE (17): Xaa equals any amino acid
  SITE (24): Xaa equals any amino acid
THLFXCNSYYKPLTXHXPFIIQKXPDENNFDTLMKTSDGFTLNAESYVSFTTKLDIPTAAKYEYGVPLQTSDSFLRFPSSLTSSLCTDNNPAAFLVNQAVKCTRKINLEQCEEIEALSMAFYSSPEILRVPDSRKKVPITVQSIVIQSLNKTLTRREDTDVLQPTLVNAGHFSLCVNVVLEDSCQLPGALVIEVKWTKYGSLLNPQAKIVNVTANLISSSFPENAQMHQFLNIHVKFENCTFGEIKFYIQLAKK

SEQ ID NO: 10726 - protein, 274 aa, Homo sapiens
  SITE (56): Xaa equals any amino acid
PFYSSPEILRVPDSRKKVPITVQSIVIQSLNKTLTRREDTDVLQPTLVNAGHFSLXVNVVLEVKYSLTYTDAGEVTKADLSFVLGTVSSVVVPLQQKFEIHFLQENTQPVPLSGNPGYVVGLPLAAGFQPHKGGALPCQLVAQKVKSLLWGQGFPDYVAPFGNSQAQDMLDWVPIHFITQSFNRKDSCQLPGALVIEVKWTKYGSLLNPQAKIVNVTANLISSSFPEANSGNERTILISTAVTFVDVSAPAEAGFRAPPAINARLPFNFFFPFV

SEQ ID NO: 10727 - protein, 88 aa, Homo sapiens
  SITE (1): Xaa equals any amino acid
  SITE (2): Xaa equals any amino acid
  SITE (19): Xaa equals any amino acid
XXEDRLPGPILPRGFQLWXSLGGEFPRLQIRPMCHAPNCLSVRPSVRPSVHPSIHPSIPVTISTPMCQMPYISNLMQVPPPPCPLLIQ

SEQ ID NO: 10728 - protein, 37 aa, Homo sapiens
  SITE (5): Xaa equals any amino acid
MGKLXLTLLLCLLQLLPPEVYYSRWGANMMAQTPLNP

SEQ ID NO: 10729 - protein, 21 aa, Homo sapiens
CFFQLSPEEVSWCPNVGSSFD

SEQ ID NO: 10730 - protein, 58 aa, Homo sapiens
DLSGGEWNVTTRTRLWEIQPHLCFVMILKLDFSCRDFLSILPGVLTYSLPVKRFKKKN

SEQ ID NO: 10731 - protein, 211 aa, Homo sapiens
MWGFRLLRSPPLLLLLPQLGIGNASSCSQARTMNPGGSGGARCSLSAEVRRRQCLQLSTVPGADPQRSNELLLLAAAGEGLERQDLPGDPAKEEPQPPPQHHVLYFPGDVQNYHEIMTRHPENYQWENWSLENVATILAHRFPNSYIWVIKCSRMHLHKFSCYDNFVKSNMFGAPEHNTDFGAFKHLYMLLVNAFNLSQNSLSKKKFECLE

SEQ ID NO: 10732 - protein, 385 aa, Homo sapiens
  SITE (64): Xaa equals any amino acid
  SITE (68): Xaa equals any amino acid
  SITE (159): Xaa equals any amino acid
  SITE (269): Xaa equals any amino acid
  SITE (348): Xaa equals any amino acid
MWGFRLLRSPPLLLLLPQLGIGNASSCSQARTMNPGGSGGARCSLSAEVRRRQCLQLSTVPGAXPQRXNELLLLAAAGEGLERQDLPGDPAKEEPQPPPQHHVLYFPGDVQNYHEIMTRHPENYQWENWSLENVATILAHRFPNSYIWVIKCSRMHLHXFSCYDNFVKSNMFGAPEHNTDFGAFKHLYMLLVNAFNLSQNSLSKKSLNVWNKDSIASNCRSSPSHTTNGCQGEKVRTCEKSDESAMSFYPPSLNDASFTLIGFSKGCVXLNQLLFELKEAKKDKNIDAFIKSIRTMYWLDGGHSGGSNTWVTYPEVLKEFAQTGIIVHTHVTPYQVRDPMRSWIGKEXKKFVQILGDLGMQVTSQIHFTKEAPSIENHFRVHEVF

SEQ ID NO: 10733 - protein, 385 aa, Homo sapiens
MWGFRLLRSPPLLLLLPQLGIGNASSCSQARTMNPGGSGGARCSLSAEVRRRQCLQLSTVPGAEPQRSNELLLLAAAGEGLERQDLPGDPAKEEPQPPPQHHVLYFPGDVQNYHEIMTRHPENYQWENWSLENVATILAHRFPNSYIWVIKCSRMHLHKFSCYDNFVKSNTFGAPEHNTDFGAFKHLYMLLVNAFNLSQNSLSKKSLNVWNKDSIASNCRSSPSHTTNGCQGEKVRTCEKSDESAMSFYPPSLNDASFTLIGFSKGCVVLNQLLFELKEAKKDKNIDAFIKSIRTMYWLDGGHSGGSNTWVTYPEVLKEFAQTGIIVHTHVTPYQVRDPMRSWIGKEHKKFVQILGDLGMQVTSQIHFTKEAPSIENHFRVHEVF

SEQ ID NO: 10734 - protein, 161 aa, Homo sapiens [sequence omitted]

SEQ ID NO: 10735 - protein, 43 aa, Homo sapiens; identical to SEQ ID NO: 8364

SEQ ID NO: 10736 - protein, 84 aa, Homo sapiens
  SITE (36): Xaa equals any amino acid
  SITE (37): Xaa equals any amino acid
FSIFKNHISLCWLIIINFKHSFLQSGFSEFFFFKQXXHSFFLVTSKGGTGVGGKECLKMKSLDIEGPRRTGYAKIISNSSTILE

SEQ ID NO: 10737 - protein, 79 aa, Homo sapiens
  SITE (15): Xaa equals any amino acid
  SITE (21): Xaa equals any amino acid
  SITE (49): Xaa equals any amino acid
  SITE (65): Xaa equals any amino acid
  SITE (66): Xaa equals any amino acid
MRLASSLSVFPLLPXTCGHSXALLPSSIGQHSETFTRCRPLTFPVFRTXKPMNPYEITQFCGILXXATQTGLKTGTLHG

SEQ ID NO: 10738 - protein, 244 aa, Homo sapiens
LVPLVFSLLVQSCKQVYRSIAMKFVPCLLLVTLSCLGTLGQAPRQKQGSTGEEFHFQTGGRDSCTMRPSSLGQGAGEVWLRVDCRNTDQTYWCEYRGQPSMCQAFAADPKSYWNQALQELRRLHHACQGAPVLRPSVCREAGPQAHMQQVTSSLKGSPEPNQQPEAGTPSLRPKATVKLTEATQLGKDSMEELGKAKPTTRPTAKPTQPGPRPGGNEEAKKKAWEHCWKPFQALCAFLISFFRG

SEQ ID NO: 10739 - protein, 20 aa, Homo sapiens
REKSSLSVPVLVCLCCYNRI

SEQ ID NO: 10740 - protein, 491 aa, Homo sapiens; identical to SEQ ID NO: 10068
  SITE (42): Xaa equals any amino acid
  SITE (43): Xaa equals any amino acid
  SITE (44): Xaa equals any amino acid

SEQ ID NO: 10741 - protein, 31 aa, Homo sapiens
MTIWERKYIWMLQICVFLEPRAKPSLGDLDW

SEQ ID NO: 10742 - protein, 102 aa, Homo sapiens [sequence omitted]

SEQ ID NO: 10743 - protein, 99 aa, Homo sapiens
  SITE (78): Xaa equals any amino acid
MTWGTWLVHTFLCSVASAKTLKSVRKYLSLCSPIGSSFVVSEGSYLDISDWLNPAKLSLYYQINATSPWVRDLCGQRXTDACEQLCDPETGEPWEPGWG

SEQ ID NO: 10744 - protein, 84 aa, Homo sapiens
  SITE (77): Xaa equals any amino acid
MGHGRRLGRHLLALPVTLSERCLGSPVENETHSRDGTELPDGSREPSSPRRVSESRVTPARTEEPPAEPSLTPDLRXDNSRGSL

SEQ ID NO: 10745 - protein, 167 aa, Homo sapiens
  SITE (25): Xaa equals any amino acid
  SITE (150): Xaa equals any amino acid
MIGPHGYISASDWPLMIFYMVMCIXYILYGILWLTWSACYWKDILRIQFWIAAVIFLGMLEKAVFYSEYQNISNTGLSTQGLLIFAELISAIKRTLARLLVIIVSLGYGIVKPRLGTVMHRVIGLGLLYLIFAAVEGVMRVIGGSNHLAXGLDDIILAVIDSIFVWV

SEQ ID NO: 10746 - protein, 265 aa, Homo sapiens; identical to SEQ ID NO: 8373

SEQ ID NO: 10747 - protein, 265 aa, Homo sapiens
  SITE (215): Xaa equals any amino acid
MFLLFLLTCELAAEVAAEVEKSSDGPGAAQEPTWLTDVPAAMEFIAATEVAVIGFFQDLEIPAVPILHSMVQKFPGVSFGISTDSEVLTHYNITGNTICLFRLVDNEQLNLEDEDIESIDATKLSRFIEINSLHMVTEYNPVTVIGLFNSVIQIHLLLIMNKASPEYEENMHRYQKAAKLFQGKILFILVDSGMKENGKVISFFKLKESQLPALXIYQTLDDEWDTLPTAEVSVEHVQNFCDGFLSGKLLKENRESEGKTPKVEL

SEQ ID NO: 10748 - protein, 83 aa, Homo sapiens
MTCSVALLLILGLRCSGVRPGLVGEGHNPSLLVCLLLKDSRTNQGSCPGGPWSERDIESVTSDNCEATLGYRNHSLPSNYYNS

SEQ ID NO: 10749 - protein, 26 aa, Homo sapiens
MLTFLLFIPVAPTETSQKNRSVFLPP

SEQ ID NO: 10750 - protein, 130 aa, Homo sapiens
  SITE (67): Xaa equals any amino acid
MLQTTLPSSQTVSLCLWVGASQPPPSFLCCQLQVFLCLLHTTRRCPSALPALVRVVPVSHCQTSWLXCGDLFLCLRSFLRSVHSSGVSPCLEQIASPFSTCLLKLWSTCDCKFSAATPEPSSSHSFTFMD

SEQ ID NO: 10751 - protein, 64 aa, Homo sapiens
  SITE (49): Xaa equals any amino acid
MWYFMSLISMVLLLSPSCSDLLVISVLNLEQRRQSKVGFEPFTSPLCGXWHHLSPDRLPQDGTF

SEQ ID NO: 10752 - protein, 46 aa, Homo sapiens
MFSRTSNFWTFFFQFLIFKVFLVLKNLFTSQKIYKIYSEKPKKKKK

SEQ ID NO: 10753 - protein, 59 aa, Homo sapiens
  SITE (27): Xaa equals any amino acid
  SITE (34): Xaa equals any amino acid
  SITE (35): Xaa equals any amino acid
  SITE (37): Xaa equals any amino acid
  SITE (38): Xaa equals any amino acid
  SITE (46): Xaa equals any amino acid
  SITE (59): Xaa equals any amino acid
MFSRTSNFWTFFFQFLIFKVFLVLKNXFTSQKIXXIXXEKPKKKKXRGGRAPSPQGGPX

SEQ ID NO: 10754 - protein, 12 aa, Homo sapiens
  SITE (10): Xaa equals any amino acid
MIALFFVTTXLT

SEQ ID NO: 10755 - protein, 35 aa, Homo sapiens
  SITE (15): Xaa equals any amino acid
  SITE (20): Xaa equals any amino acid
LTSFGLRAILIFQMXSDVNXIGKHQRNGCKVSGTE

SEQ ID NO: 10756 - protein, 45 aa, Homo sapiens
  SITE (39): Xaa equals any amino acid
LGSARHRPHALVLGMSSPFLKKTCSAVTTTKKHGEDWAXDMMFSS

SEQ ID NO: 10757 - protein, 90 aa, Homo sapiens
  SITE (5): Xaa equals any amino acid
MYRGXRVKHPFVFRKLQVTQDDWIVRYRGLKGNAEVVHREQVNLPRTMGLRHALLTRRATRSMGAICVAGCGIPAQVSLSKRGILLVPKT

SEQ ID NO: 10758 - protein, 101 aa, Homo sapiens
LRDPENCVECGDGECACGCTHIGYLCVCTVYMQGCVYVCMCIRVWVWVWGVFRECAYTHGCLGMCTCLCVRGVCVCVCMVCVHMYALVCVHTWGVCAYVEV

SEQ ID NO: 10759 - protein, 60 aa, Homo sapiens; identical to SEQ ID NO: 8405

SEQ ID NO: 10760 - protein, 75 aa, Homo sapiens
SPIIFPLNHYTRISHLCPPDILGWIILGLGGCPVRCRTFSSILGLFLLDASSTPFLSYDRLKCPPGKRWWQNYPW

SEQ ID NO: 10761 - protein, 139 aa, Homo sapiens; identical to SEQ ID NO: 8406

SEQ ID NO: 10762 - protein, 91 aa, Homo sapiens
  SITE (69): Xaa equals any amino acid
MRACVCVYACAHMCVCLAFSYLIGCIKCRPKDEGEDYTQSLAVTASVQKSCVWAQNYSLHSCNTYASRXQRALSPGLHNRREKQLCGELVT

SEQ ID NO: 10763 - protein, 85 aa, Homo sapiens
  SITE (32): Xaa equals any amino acid
LWRYLGFCILCHIWQKTFYLCCHEKGCTMTQXPPQASGPAEAKSEHREKRRKREDRWGKQERRDRDVHILGCQVWHSCSARVALS

SEQ ID NO: 10764 - protein, 133 aa, Homo sapiens; identical to SEQ ID NO: 8409

SEQ ID NO: 10765 - protein, 86 aa, Homo sapiens
  SITE (72): Xaa equals any amino acid
PCCFHKPHASHIMNFLIRIQCIYLPKIVCAYSKYEQFLNNGSIIFVQNAKNWGQAWWHTPVIPALWEAKVGXSPEVRSLRPAWPAW

SEQ ID NO: 10766 - protein, 33 aa, Homo sapiens; identical to SEQ ID NO: 8410

SEQ ID NO: 10767 - protein, 17 aa, Homo sapiens [sequence omitted]

SEQ ID NO: 10768 - protein, 15 aa, Homo sapiens
  SITE (10): Xaa equals any amino acid
  SITE (12): Xaa equals any amino acid
AWYVVMALTXMXWDF

SEQ ID NO: 10769 - protein, 12 aa, Homo sapiens
AWYVIITLVFDG

SEQ ID NO: 10770 - protein, 147 aa, Homo sapiens
  SITE (25): Xaa equals any amino acid
  SITE (30): Xaa equals any amino acid
  SITE (31): Xaa equals any amino acid
RLLHFNCHSGFLTQSPYCRQARHRXLHQGXXPAAARLWCDCQRPAPRVARTELGRHTGIHGSTFSSTTLGPIFWLLVKSPELAAQPSTYLAVAEELADVSGKYFDGLKQKAPAPEAEDEEVARRLWAESARLVGLEAPSVREQPLPR

SEQ ID NO: 10771 - protein, 75 aa, Homo sapiens
MRGIYTAPSGLESTCLVVAYGLDIYQTRVYPSKQFDVLKDDYDYVLISSVLFGLVFATMITKRLAQVKLLNRAWR

SEQ ID NO: 10772 - protein, 360 aa, Homo sapiens
MAAEWASRFWLWATLLIPAAAVYEDQVGKFDWRQQYVGKVKFASLEFSPGSKKLVVATEKNVIAALNSRTGEILWRHVDKGTAEGAVDAMLLHGQDVITVSNGGRIMRSWETNIGGLNWEITLDSGSFQALGLVGLQESVRYIAVLKKTTLALHHLSSGHLKWVEHLPESDSIHYQMVYSYGSGVVWALGVVPFSHVNIVKFNVEDGEIVQQVRVSTPWLQHLSGACGVVDEAVLVCPDPSSRSLQTLALETEWELRQIPLQSLDLEFGSGFQPRVLPTQPNPVDASRAQFFLHLSPSHYALLQYHYGTLSLLKNFPQTALVSFATTGEKTVAAVMACRNEVQKTSSSEDGSMGELFGEV

SEQ ID NO: 10773 - protein, 485 aa, Homo sapiens
ARKPRSQIKNEINIDTLARDEFNLQKMMVMVTASGKLFGIESSSGTILWKQYLPNVKPDSSFKLMVQRTTAHFPHPPQCTLLVKDKESGMSSLYVFNPIFGKWSQVAPPVLKRPILQSLLLPVMDQDYAKVLLLIDDEYKVTAFPATRNVLRQLHELAPSIFFYLVDAEQGRLCGYRLRKDLTTELSWELTIPPEVQRIVKVKGKRSSEHVHSQGRVMGDRSVLYKSLNPNLLAVVTESTDAHHERTFIGIFLIDGVTGRIIHSSVQKKAKGPVHIVHSENWVVYQYWNTKARRNEFTVLELYEGTEQYNATAFSSLDRPQLPQVLQQSYIFPSSISAMEATITERGITSRHLLIGLPSGAILSLPKALLDPRRPEIPTEQSREENLIPYSPDVQIHAERFINYNQTVSRMRGIYTAPSGLESTCLVVAYGLDIYQTRVYPSKQFDVLKDDYDYVLISSVLFGLVFATMITKRLAQVKLLNRAWR

SEQ ID NO: 10774 - protein, 96 aa, Homo sapiens
MHHHAHLSCYDFLMLLFLLLHPLLPPPPTASLPPSPLICLFLHTVPWNLSLASSHSTHSLRALPFTSAIVYTFTLDHSSEISQLLHPDGCSAPPPG

SEQ ID NO: 10775 - protein, 22 aa, Homo sapiens
HSDLGLSCPELLLPCIILITFS

SEQ ID NO: 10776 - protein, 49 aa, Homo sapiens
  SITE (1): Xaa equals any amino acid
  SITE (2): Xaa equals any amino acid
XXYDEKLIFIQILQTKATDKYSEQVSQVGPGAVLTPVIPALWEAEAGGS

SEQ ID NO: 10777 - protein, 74 aa, Homo sapiens
  SITE (69): Xaa equals any amino acid
KTPHSWVIHAGEASCHVERTLKQSYGAAHMRGTEAPSHQPCEPPWKWSLQHQSSFQMIAAPNTILTSIXRTSAS

SEQ ID NO: 10778 - protein, 44 aa, Homo sapiens
LMPVIPAIWETEAGGLLEARSLRQPGQHSETPSLQETFKNKNSS

SEQ ID NO: 10779 - protein, 141 aa, Homo sapiens
  SITE (140): Xaa equals any amino acid
MGPRGCALAHSLLPLLCQHVWTSPRYCRQCTREPRHCCPAPASAGVQYMCAYGCHHPTFAGVYTPSHTTVATSICTQTPPHQCCWSEHTHVVSTTPLLPAYMHMSMDPAATTQMKCFCRHPIRAFLPVEWEHLSPFNTAXA

SEQ ID NO: 10780 - protein, 93 aa, Homo sapiens; identical to SEQ ID NO: 8419

SEQ ID NO: 10781 - protein, 59 aa, Homo sapiens
EEHGITSVIFLPQVHNLNLIIRKHQTNPNQETLYKIMTCDPQNLQGHEQQGKTEDKCTV

SEQ ID NO: 10782 - protein, 133 aa, Homo sapiens
MAKFRRRTCIILALFILFIFSLMMGLKMLRPNTATFGAPFGLDLLPELHQRTIHLGKNFDFQKSDRINSETNTKNLKSVEITMKPSKASELNLDELPPLNNYLHVFYYSWYGNPQFDGKYIHWNHPVLEHWDP

SEQ ID NO: 10783 - protein, 209 aa, Homo sapiens
  SITE (15): Xaa equals any amino acid
  SITE (18): Xaa equals any amino acid
  SITE (128): Xaa equals any amino acid
  SITE (147): Xaa equals any amino acid
  SITE (152): Xaa equals any amino acid
MAKFRRRTCIILALXILXIFSLMMGLKMLRPNTATFGAPFGLDLLPELHQRTIHLGKNFDFQKSDRINSETNTKNLKSVEITMKPSKASELNLDELPPLNNYLHVFYYSWYGNPQFDGKYIHWNHPVXEHWDPRIAKNYPQGRHNPXDDIGXSFYPELGSYSSRDPSVIETHMRQMRSASIGNYCIYIYMCVFVSVYMHINDFLCNFNS

SEQ ID NO: 10784 - protein, 81 aa, Homo sapiens [sequence omitted]

SEQ ID NO: 10785 - protein, 121 aa, Homo sapiens
  SITE (67): Xaa equals any amino acid
  SITE (89): Xaa equals any amino acid
MRIMLLFTAILAFSLAQSFGAVCKEPQEEVVPGGGRSKRDPDLYQLLQRLFKSHSSLEGLLKALSQXSTDPKESTSPEKRDMHDFFVGXMGKRSVQPDSPTDVNQENVPSFGILKYPPRAE

SEQ ID NO: 10786 - protein, 15 aa, Homo sapiens
MALGARELPGSLSRW

SEQ ID NO: 10787 - protein, 322 aa, Homo sapiens
MKYIFSLLFFLLLEGGKTEQVKHSETYCMFQDKKYRVGERWHPYLEPYGLVYCVNCICSENGNVLCSRVRCPNVHCLSPVHIPHLCCPRCPEDSLPPVNNKVTSKSCEYNGTTYQHGELFVAEGLFQNRQPNQCTQCSCSEGNVYCGLKTCPKLTCAFPVSVPDSCCRVCRGDGELSWEHSDGDIFRQPANREARHSYHHSHYDPPPSRQAGGLSRFPGARSHRGALMDSQQASGTIVQIVINNKHKHGQVCVSNGKTYSHGESWHPNLRAFGIVECVLCTCNVTKQECKKIHCPNRYPCKYPQKIDGKCCKVCPGKKKKKK

SEQ ID NO: 10788 - protein, 66 aa, Homo sapiens
MLLLLLLLLLLLWTCQKALVRRQFCLFNLIARNSSLMLQKDEKKGKKRDNSQAQRKKKRWGKRAPG

SEQ ID NO: 10789 - protein, 75 aa, Homo sapiens [sequence omitted]

SEQ ID NO: 10790 - protein, 234 aa, Homo sapiens; identical to SEQ ID NO: 7861

SEQ ID NO: 10791 - protein, 95 aa, Homo sapiens; identical to SEQ ID NO: 10456

SEQ ID NO: 10792 - protein, 18 aa, Homo sapiens
TKSSDFGGGCRNASSSCC

SEQ ID NO: 10793 - protein, 18 aa, Homo sapiens
TKSSDFGGGCRNASSSCC

SEQ ID NO: 10794 - protein, 26 aa, Homo sapiens
GCFKIVLFFKLVIFAKLFVFVVSINM

SEQ ID NO: 10795 - protein, 101 aa, Homo sapiens
  SITE (91): Xaa equals any amino acid
  SITE (93): Xaa equals any amino acid
  SITE (99): Xaa equals any amino acid
WESLGLMFLCGPHLTRLLLFLFTLGFCAFINIVLSFPLVCIPFCLGRLYFLLLTEKPHQEACPGDELGTGHLHIGLGAVRLQGPDNMRNEXSXIVVGDXGL

SEQ ID NO: 10796 - protein, 108 aa, Homo sapiens
  SITE (34): Xaa equals any amino acid
  SITE (48): Xaa equals any amino acid
MTVSGTVVLVAGTLCFAWWSEGDATAQPGQLAPXTEYPVPEGPSPLLXSVSFVCCGAGGLLLLIGLLWSVKASIPGPPSMGPLSPLQRPVLPHCGVLREGELQDPQSG

SEQ ID NO: 10797 - protein, 101 aa, Homo sapiens
MKQRLRGQQGFQLDVCVACTLLFLLLTVNSGVTSREQLGCSRPSPAQGEGRGTCSSEQPEGGGRSEVVEWFVYLTGLKGPSVFVVCFVSCFSDRSITTDLL

SEQ ID NO: 10798 - protein, 65 aa, Homo sapiens
  SITE (15): Xaa equals any amino acid
MFLTTWFLLLSVAWXALTRSGRSCLPLVGRPREQSPRTHCAASSTKERNSDPQPSPPEVVGPLWS

SEQ ID NO: 10799 - protein, 40 aa, Homo sapiens; identical to SEQ ID NO: 8466
  SITE (15): Xaa equals any amino acid

SEQ ID NO: 10800 - protein, 160 aa, Homo sapiens
  SITE (55): Xaa equals any amino acid
FFDSIGALVPQFLANDDELSSHTYGLLVNKNNHLGHLAVCISQCIWGLLSPCELXGISLGSIILFCPTPCSMQTPSPACWSPSGNPGLAHTLCWRACTLMPLLRLGPYLVTLFALPSETEQLAPSALVVPCEALLLSGFLHRDPCRLPADMQDALLSVDV

SEQ ID NO: 10801 - protein, 5 aa, Homo sapiens
YSPLC

SEQ ID NO: 10802 - protein, 315 aa, Homo sapiens
  SITE (103): Xaa equals any amino acid
  SITE (302): Xaa equals any amino acid
  SITE (305): Xaa equals any amino acid
MSTKKLCIVGGILLVFQIIAFLVGGLIAPGPTTAVSYMSVKCVDARKNHHKTKWFVPWGPNHCDKIRDIEEAIPREIEANDIVFSVHIPLPHMEMSPWFQFMXFILQLDIAFKLNNQIRENAEVSMDVSLAYRDDAFAEWTEMAHERVPRKLKCTFTSPKTPEHGGPVTMNVMSFLSWKLGLWPMKFYLLNIRLPVNEKKKINVGIGEIKDIRLVGIHQNGGFTKVWFAMKTFLTPSIFIIMVWYWRRITMMSRPPVLLEKVIFALGISMTFINIPVEWFSIGFDWTWMLLFGDIRQASSMXCFXPSGSSSVAST

SEQ ID NO: 10803 - protein, 505 aa, Homo sapiens
  SITE (358): Xaa equals any amino acid
  SITE (494): Xaa equals any amino acid
  SITE (504): Xaa equals any amino acid
  SITE (505): Xaa equals any amino acid
MFRTAVMMAASLALTGAVVAHAYYLKHQFYPTVVYLTKSSPSMAVLYIQAFVLVFLLGKVMGKVFFGQLRAAEMEHLLERSWYAVTETCLAFTVFRDDFSPRFVALFTLLLFLKCFHWLAEDRVDFMERSPNISWLFHCRIVSLMFLLGILDFLFVSHAYHSILTRGASVQLVFGFEYAILMTMVLTIFIKYVLHSVDLQSENPWDNKAVYMLYTELFTGFIKVLLYMAFMTIMIKVHTFPLFAIRPMYLAMRQFKKAVTDAIMSRRAIRNMNTLYPDATPEELQAMDNVCIICREEMVTGAKRLPCNHIFHTSCLRSWFQRQQTCPTCRMDVLRASLPAQSPPPPEPADQGPPPAPXPPPLLPQPPNFPQGLLPPFPPGMFPLWPPMGPFPPVPPPPSSGEAVAPPSTSAAALSRPSGAATTTAAGTSATAASATASGPGSGSAPEAGPAPGFPFPPPWMGMPLPPPFAFPPMPVPPAGFAGLTPEEYELWRXMSGRTGGPVXX

SEQ ID NO: 10804 - protein, 191 aa, Homo sapiens
  SITE (18): Xaa equals any amino acid
  SITE (21): Xaa equals any amino acid
MFRTAVMMAASIWPRLWXCPXGWPCPWFPLPSSLDGYAPASTLCLPPNACAPCGFAGLTPEELRALEGHERQHLEARLQSLRNIHTLLDAAMLQINQYLTVLASLGPPRPATSVNSTEETATTVVAAASSTSIPSSEATTPTPGASPPAPEMERPPAPESVGTEEMPEDGEPDAAELRRRRLQKLESPVAH

SEQ ID NO: 10805 - protein, 33 aa, Homo sapiens; identical to SEQ ID NO: 8480

SEQ ID NO: 10806 - protein, 85 aa, Homo sapiens
IKTVFLGQRYTDPNFIAVVFIHLPIDILKAPARPGTVAHACNLSTLVGRGGRITRSRDQDHPGQRGETLSLLKIQKLAGHGGARL

SEQ ID NO: 10807 - protein, 60 aa, Homo sapiens
MRKWGLMKLIASMMQPVLLELLSVWRKEGRDSRNIHDSHSMYVLRKRLSGSWLQQVCTLL

SEQ ID NO: 10808 - protein, 101 aa, Homo sapiens [sequence omitted]

SEQ ID NO: 10809 - protein, 245 aa, Homo sapiens
MADVSAKDSSQETLVNLAGLLVSLLMLPLVSGCPGFSLGCFFFLTALHIYANYRAVRALVMETLNEGRLRLVLKHYLQRGEVLDPTAANRMEPLWTGFWPAPSLSLGVPLHRLVSSVFELQQLVEGHQESYLLCWDQSQNQVQVVLNQKAGPKTILRAATHGLMLGALQGDGPLPAELEELRNRVRAGPKKESWVVVKETHEVLDMLFPKFLKGLQDAGWKTEKHQLEVDEWRATWLLSPEKKVL

SEQ ID NO: 10810 - protein, 75 aa, Homo sapiens
  SITE (62): Xaa equals any amino acid
  SITE (63): Xaa equals any amino acid
LPVQNGCPESAMEMNGRAPCWEVGLEELSSRKLTAGPQFPSEPQAPAPSLFRQCLLWFCGMXXGGVGSPPPLTQE

SEQ ID NO: 10811 - protein, 38 aa, Homo sapiens
MSLTLLMLILLTHDLRNKFSLKCIFCRHTLNNIISSEV

SEQ ID NO: 10812 - protein, 36 aa, Homo sapiens
  SITE (19): Xaa equals any amino acid
  SITE (28): Xaa equals any amino acid
  SITE (31): Xaa equals any amino acid
MAIRCCSSTSNALILILFXWTVLLSSSXIQXLPALL

SEQ ID NO: 10813 - protein, 36 aa, Homo sapiens
MPSLPIRVTKFSEIGNWQLKAVSTTRFLLPLKKNHF

SEQ ID NO: 10814 - protein, 156 aa, Homo sapiens
MQIQVAGLLQFAVPLFSTAEEDLLAIQLLLNSSESSLHQLTAMVDCRGLHKDYLDALAGICYDGLQGLLYLGLFSFLAALAFSTMICAGPRAWKHFTTRNRDYDDIDDDDPFNPQAWRMAAHSPPRGQLHSFCSYSSGLGSQTSLQPPAQTISNAP

SEQ ID NO: 10815 - protein, 40 aa, Homo sapiens
MQHLPGLSLHLVLVFLESLGSCATPHPRAAPAAKKKKKKK

SEQ ID NO: 10816 - protein, 86 aa, Homo sapiens
  SITE (68): Xaa equals any amino acid
  SITE (72): Xaa equals any amino acid
MPVSWGCPSKTPQTRAYTRCVYFLMVLEAGVGGHSVSRVGSLEVPPWLVAANNFPHLMWSSFCVGPHXVFLXDPSLPDPGPPNNLT

SEQ ID NO: 10817 - protein, 41 aa, Homo sapiens
  SITE (32): Xaa equals any amino acid
  SITE (33): Xaa equals any amino acid
  SITE (41): Xaa equals any amino acid
MNILVCVFWLWGGVAGSWGRHIFIFTSVKNVXXASHCAWPX

SEQ ID NO: 10818 - protein, 60 aa, Homo sapiens; identical to SEQ ID NO: 8509

SEQ ID NO: 10819 - protein, 235 aa, Homo sapiens
MPWVLLLLTLLTHSAVSVVQAGLTQPPSVSKDLRQTATLTCTGNNNNVGDQGAAWLQQHQGHPPKLLSYRNNNRPSGISERLSASRSGATSSLTITGLQPEDEADYYCAAYDSSLAVWMFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 10820 - protein, 4 aa, Homo sapiens
SLHA

SEQ ID NO: 10821 - protein, 235 aa, Homo sapiens
MPWVLLLLTLLTHSAVSVVQAGLTQPPSVSKDLRQTATLTCTGNNNNVGDQGAAWLQQHQGHPPKLLSYRNNNRPSGISERLSASRSGATSSLTITGLQPEDEADYYCAAYDSSLAVWMFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 10822 - protein, 9 aa, Homo sapiens
CHLQHSCRE

SEQ ID NO: 10823 - protein, 426 aa, Homo sapiens
MIVFGWAVFLASRSLGQGLLLTLEEHIAHFLGTGGAATTMGNSCICRDDSGTDDSVDTQQQQAENSAVPTADTRSQPRDPVRPPRRGRGPHEPRRKKQNVDGLVLDTLAVIRTLVDNDQEPYSMITLHEMAETDEGWLDVVQSLIRVIPLEDPLGPAVITLLLDECPLPTKDALQKLTEILNLNGEVACQDSSHPAKHRNTSAVLGCLAEKLAGPASIGLLSPGILEYLLQCLKLQSHPTVMLFALIALEKFAQTSENKLTISESSISDRLVTLESWANDPDYLKRQVGFCAQWSLDNLFLKEGRQLTYEKVNLSSIRAMLNSNDVSEYLKISPHGLEARCDASSFESVRCTFCVDAGVWYYEVTVVTSGVMQIGWVTRDSKFLNHEGYGIGDDEYSCAYDGCRQLIWYNARSSLTYTHAGKKEIQ

SEQ ID NO: 10824 - protein, 576 aa, Homo sapiens; identical to SEQ ID NO: 8516

SEQ ID NO: 10825 - protein, 435 aa, Homo sapiens
MIVFGWAVFLASRSLGQGLLLTLEEHIAHFLGTGGAATTMGNSCICRDDSGTDDSVDTQQQQAENSAVPTADTRSQPRDPVRPPRRGRGPHEPRRKKQNVDGLVLDTLAVIRTLVDNDQEPPYSMITLHEMAETDEGWLDVVQSLIRVIPLEDPLGPAVITLLLDECPLPTKDALQKLTEILNLNGEVACQDSSHPAKHRNTSAVLGCLAEKLAGPASIGLLSPGILEYLLQCLKLQSHPTVMLFALIALEKFAQTSENKLTISESSISDRLVTLESWANDPDYLKRQVGFCAQWSLDNLFLKEGRQLTYEKVNLSSIRAMLNSNDVSEYLKISPHGLEARCDASSFESVRCTFCVDAGVWYYEVTVVTSGVMQIGWATRDSKFLNHEGYGIGDDEYSCAYDGCRQLIWYNARSKPHIHPCWERRRYSRISVRLE

SEQ ID NO: 10826 - protein, 426 aa, Homo sapiens; identical to SEQ ID NO: 10823

SEQ ID NO: 10827 - protein, 191 aa, Homo sapiens [sequence omitted]

SEQ ID NO: 10828 - protein, 67 aa, Homo sapiens; identical to SEQ ID NO: 8521

SEQ ID NO: 10829 - protein, 29 aa, Homo sapiens
MMERSMMILLMAASMTMTSTQLWSFCCVH

SEQ ID NO: 10830 - protein, 156 aa, Homo sapiens
MKAIGIEPSLATYHHIIRLFDQPGDPLKRSSFIIYDIMNELMGKRFSPKDPDDDKFFQSAMSICSSLRDLELAYQVHGLLKTGDNWKFIGPDQHRNFYYSKFFDLICLMEQIDVTLKWYEDLIPSAYFPHSQTMIHLLQALDVANRLEVIPKIWER

SEQ ID NO: 10831 - protein, 74 aa, Homo sapiens
MLHLFCSQPLGLLFLLIFLGLDSLPRCLTATRLQSPIIIFSTLSCICSTSWLELCSVYFLTLNYLHVVPPCFLI

SEQ ID NO: 10832 - protein, 183 aa, Homo sapiens [sequence omitted]

SEQ ID NO: 10833 - protein, 6 aa, Homo sapiens
NLSKII

SEQ ID NO: 10834 - protein, 56 aa, Homo sapiens; identical to SEQ ID NO: 8553

SEQ ID NO: 10835 - protein, 10 aa, Homo sapiens
VLLFLSLLTS

SEQ ID NO: 10836 - protein, 61 aa, Homo sapiens
  SITE (21): Xaa equals any amino acid
  SITE (27): Xaa equals any amino acid
  SITE (31): Xaa equals any amino acid
FNFKFAHRPSNPLVNLTVSPXRNSSLXTRKXPCRESKKFNTHSRPKSSHQLRKRSSSTPTT

SEQ ID NO: 10837 - protein, 189 aa, Homo sapiens
FRALEVNTVTCQLNCSDHGHCDSFTKRCICDPFWMENFIKVQLRDGDSNCEWSVLYVIIATFVIVVALGILSWTVICCCKRQKGKPKRKSKYKILDATDQESLELKPTSRAGKEKRMSLSGLNQSSWILEMKNQQETPGIKQKGLLLSSSLMHSESELDSDDAIFTWPDREKGKLLHGQNGSVPNGRPL

SEQ ID NO: 10838 - protein, 87 aa, Homo sapiens
  SITE (11): Xaa equals any amino acid
  SITE (86): Xaa equals any amino acid
MSLNVLLALFXLLLAKESSCRIPAARGDPLVLERPPPRWELQLLVPFSEGLISSLAVIMGHSLFPGVEIGYPAHKFHNNNTSRKHXV

SEQ ID NO: 10839 - protein, 318 aa, Homo sapiens
  SITE (131): Xaa equals any amino acid
MLSESSSFLKGVMLGSIFCALITMLGHIRIGHGNRMHHHEHHHLQAPNKEDILKISEDERMELSKSFRVYCIILVKPKDVSLWAAVKETWTKHCDKAEFFSSENVKVFESINMDTNDMWLMMRKAYKYAFXKYRDQYNWFFLARPTTFAIIENLKYFLLKKDPSQPFYLGHTIKSGDLEYVGMEGGIVLSVESMKRLNSLLNIPEKCPEQGGMIWKISEDKQLAVCLKYAGVFAENAEDADGKDVFNTKSVGLSIKEAMTYHPNQVVEGCCSDMAVTFNGLTPNQMHVMMYGVYRLRAFGHIFNDALVFLPPNGSDND

SEQ ID NO: 10840 - protein, 60 aa, Homo sapiens
MTYHPNQVVEGCCSDMAVTFNGLTPNQMHVMMYGVYRLRAFGHIFNDALVFLPPNGSDND

SEQ ID NO: 10841 - protein, 66 aa, Homo sapiens
MLFMGFVPWATSSIAVMFVLLFLCGWFQGMGWPPCGRTMVHWWSQKERGGIVSVWNCAHNVGGWVF

SEQ ID NO: 10842 - protein, 85 aa, Homo sapiens
  SITE (14): Xaa equals any amino acid
  SITE (59): Xaa equals any amino acid
  SITE (68): Xaa equals any amino acid
LLFLLGMAWFNDWXAALYMPAFCAILVALFAFAMMRDTPQSCGLPPIEEYKNDYPDDYXEKAEQELTXKQPGGRRLWLHPAYTAA

SEQ ID NO: 10843 - protein, 219 aa, Homo sapiens [sequence omitted]

SEQ ID NO: 10844 - protein, 219 aa, Homo sapiens
  SITE (104): Xaa equals any amino acid
  SITE (197): Xaa equals any amino acid
MEMASKMKDTGFIVFAVLLLVSCLILIFVIAPRYGQRNILIYIIICSVIGAFSVAAVKGLGITIKNFFQGLPVVRHPLPYILSLILALSLSTQVNFLNRALDIXNTSLVFPIYYVFFTTVVVTSSIILFKEWYSMSAVDIAGTLSGFVTIILGVFMLHAFKDLDISCASLPHMHKNPPPSPAPEPTVIRLEDKNVLXDNIELASTSSPEEKPKVFIIHS

SEQ ID NO: 10845 - protein, 158 aa, Homo sapiens [sequence omitted]

SEQ ID NO: 10846 - protein, 58 aa, Homo sapiens
MVISIFFSLPFSTSAYTLIAPNINRRNEIQRIADRSWPTWRSGRSRTELNRFTWCPDG

SEQ ID NO: 10847 - protein, 43 aa, Homo sapiens
MLTRSLKTLPSACTAFLLLFFLFSSGDPELSCSCTLRTQSSWS

SEQ ID NO: 10848 - protein, 45 aa, Homo sapiens
MQNSHKNLSLFLSLIICLIHPKRKGEGHQFTYTPVAPSPLKIFIK

SEQ ID NO: 10849 - protein, 26 aa, Homo sapiens
LWIVAVTSSRLSYLQENMYMVKGHRV

SEQ ID NO: 10850 - protein, 265 aa, Homo sapiens
  SITE (15): Xaa equals any amino acid
  SITE (96): Xaa equals any amino acid
  SITE (98): Xaa equals any amino acid
  SITE (119): Xaa equals any amino acid
  SITE (161): Xaa equals any amino acid
  SITE (170): Xaa equals any amino acid
  SITE (189): Xaa equals any amino acid
  SITE (197): Xaa equals any amino acid
  SITE (200): Xaa equals any amino acid
  SITE (230): Xaa equals any amino acid
  SITE (235): Xaa equals any amino acid
  SITE (244): Xaa equals any amino acid
  SITE (245): Xaa equals any amino acid
  SITE (247): Xaa equals any amino acid
MSMAVETFGFFMATXGLLMLGVTLPNSYWRVSTVHGNVITTNTIFENLWFSCATDSLGVYNCWEFPSMLALSGYIQACRALMITAILLGFLGLLLXIXGLRCTNIGGLELSRKAKLAAXAGALHILAGICGMVAISWYASTSPGTSSTPCTPEPSTSWAPXSTWGGAPHXSPSWVASASAPPAAAALTXTSRQRPAXLPXSRVRDARRHLGPRRRQQLWQIRQKRLRVAXLARGXRCLPTAPRXXDXAGAHSPIVTSGAGHAPLP

SEQ ID NO: 10851 - protein, 62 aa, Homo sapiens
VYQRKSTVVLGGFLLWDIDFLFFFRNIVCCNLNKNYDILRYFIDKPNKNICFYFKVNVFLFS

SEQ ID NO: 10852 - protein, 36 aa, Homo sapiens
MEKREAYISSHLLSMSLLRTCLILRMVVWLSSLGRR

SEQ ID NO: 10853 - protein, 613 aa, Homo sapiens; identical to SEQ ID NO: 8604

SEQ ID NO: 10854 - protein, 36 aa, Homo sapiens; identical to SEQ ID NO: 10852

SEQ ID NO: 10855 - protein, 63 aa, Homo sapiens; identical to SEQ ID NO: 8606

SEQ ID NO: 10856 - protein, 103 aa, Homo sapiens; identical to SEQ ID NO: 8608

SEQ ID NO: 10857 - protein, 98 aa, Homo sapiens
ILFSFLIPSNLSFSPVIFFLCGPFKVVIICTELQNVSRSPQTTLATVYCNKITSYICRNSFGVILFFPLNIYNWTNAGKKKKMVSKKPKIKFRGHQAF

SEQ ID NO: 10858 - protein, 171 aa, Homo sapiens
  SITE (151): Xaa equals any amino acid
MYSLHSWVGLIAVICYLLQLLSGFSVFLLPWAPLSLRAFLMPIHVYSGIVIFGTVIATALMGLTEKLIFSLRDPAYSTFPPEGVFVNTLGLLILVFGALIFWIVTRPQWKRPKEPNSTILHPNGGTEQGARGSMPAYSGNNMDKSDSELNXEVAARKRNLALDEAGQRSTM

SEQ ID NO: 10859 - protein, 184 aa, Homo sapiens; identical to SEQ ID NO: 9245

SEQ ID NO: 10860 - protein, 18 aa, Homo sapiens
MWYQLAKEEPGVGACALD

SEQ ID NO: 10861 - protein, 315 aa, Homo sapiens
MDLRQFLMCLSLCTAFALSKPTEKKDRVHHEPQLSDKVHNDAQSFDYDHDAFLGAEEAKTFDQLTPEESKERLGKIVSKIDGDKDGFVTVDELKDWIKFAQKRWIYEDVERQWKGHDLNEDGLVSWEEYKNATYGYVLDDPDPDDGFNYKQMMVRDERRFKMADKDGDLIATKEEFTAFLHPEEYDYMKDIVVQETMEDIDKNADGFIDLEEYIGDMYSHDGNTDEPEWVKTEREQFVEFRDKNRDGKMDKEETKDWILPSDYDHAEAEARHLVYESDQNKDGKLTKEEIVDKYDLFVGSQATDFGEALVRHDEF

SEQ ID NO: 10862 - protein, 231 aa, Homo sapiens
MLPGMPRFQWLSFFIFLDTLSLGIHLEKKTMTTVAGEKSWEKCQGVVDIPFRSKGMSRLGEEVNGEATESQQKPRNKKSKMDGMVPGNHQGRDPRKHKRKPLGVGYSARKSPLYDNCFLHAPDGQPLCTCDRRKAQWYLDKGIGELVSEEPFVVKLRFEPAGRPESPGDYYLMVKENLCVVCGKRDSYIRKNVIPHEYRKHFPIEMKDHNSHDVLLLCTSAMPFPTTMTTI

SEQ ID NO: 10863 - protein, 78 aa, Homo sapiens [sequence omitted]

SEQ ID NO: 10864 - protein, 72 aa, Homo sapiens [sequence omitted]

SEQ ID NO: 10865 - protein, 111 aa, Homo sapiens
MLWLPLLAALSPSPPGVSSEEEQHWSQAEALPCWDPGSESSPRIPGCRELQSCPPPTAPSAHTQSPGGLGAKAGAALVPFPGPSFPTSKPKKGEAGAPVPQPHSALTVPSS

SEQ ID NO: 10866 - protein, 683 aa, Homo sapiens
MAALLLLPLLLLLPLLLLKLHLWPQLRWLPADLAFAVRALCCKRALRARALAAAAADPEGPEGGCSLAWRLAELAQQRAAHTFLIHGSRRFSYSEAERESNRAARAFLRALGWDWGPDGGDSGEGSAGEGERAAPGAGDAAAGSGAEFAGGDGAARGGGAAAPLSPGATVALLLPAGPEFLWLWFGLAKAGLRTAFVPTALRRGPLLHCLRSCGARALVLAPEFLESLEPDLPALRAMGLHLWAAGPGTHPAGISDLLAEVSAEVDGPVPGYLSSPQSITDTCLYIFTSGTTGLPKAARISHLKILQCQGFYQLCGVHQEDVIYLALPLYHMSGSLLGIVGCMGIGATVVLKSKFSAGQFWEDCQQHRVTVFQYIGELCRYLVNQPPSKAERGHKVRLAVGSGLRPDTWERFVRRFGPLQVLETYGLTEGNVATINYTGQRGAVGRASWLYKHIFPFSLIRYDVTTGEPIRDPQGHCMATSPGEPGLLVAPVSQQSPFLGYAGGPELAQGKLLKDVFRPGDVFFNTGDLLVCDDQGFLRFHDRTGDTFRWKGENVATTEVAEVFEALDFLQEVNVYGVTVPGHEGRAGMAALVLRPPHALDLMQLYTHVSENLPPYARPRFLRLQESLATTETFKQQKVRMANEGFDPSTLSDPLYVLDQAVGAYLPLTTARYSALLAGNLRI

SEQ ID NO: 10867 - protein, 234 aa, Homo sapiens
MAALLLLPLLLLLPLLLLKLHLWPQLRWLPADLAFAVRALCCKRALRARALAAAAADPEGPEGGCSLAWRLAELAQQRAAHTFLIHGSRRFSYSEAERESNRAARAFLRALGWDWGPDGGDSGEGSAGEGERAAPGAGDAAAGSGAEFAGGDGAARGGGAAALCHLEQLWRCSSPLAQSFCGSGSGWPRPACALPLCPPPCAGAPCCTASAAAARARWCWRQSFWSPWSRTCPP

SEQ ID NO: 10868 - protein, 174 aa, Homo sapiens
  SITE (151): Xaa equals any amino acid
  SITE (161): Xaa equals any amino acid
  SITE (164): Xaa equals any amino acid
MAALLLLPLLLLLPLLLLKLHLWPQLRWLPADLAFAVRALCCKRALRARALAAAAADPEGPEGGCSLAWRLAELAQQRAAHTFLIHGSRRFSYSEAERESNRAARAFLRALGWDWGPDGGDSGEGSAGEGERAAPGAGDASGRKRRGVCRXGTVPPEGGRXPPXPFVTLEANCG

SEQ ID NO: 10869 - protein, 119 aa, Homo sapiens
  SITE (14): Xaa equals any amino acid
  SITE (78): Xaa equals any amino acid
QWGGGQLMELVPLXCAFPGVGSWGWEQGKAASSLGFLLCLPRVAANPVPAGGAGMASCPGLWQETLFPLPVGLPRLSXPFSHKKIWGQARWLTPVIPALWEAEAGSHKVRRSGPSWLIR

SEQ ID NO: 10870 - protein, 146 aa, Homo sapiens
  SITE (7): Xaa equals any amino acid
MAALLLXPLLLLLPLLLLKLHLWPQLRWLPAATAARGALEKASGQRREPEMQRPEAARSLPEGTVPPEVEEPPPLCHLEQLWRCSSPLAQSFCGSGSGWPRPACALPLCPPPCAGAPCCTASAAAARARWCWRQSFWSPWSRTCPP

SEQ ID NO: 10871 - protein, 42 aa, Homo sapiens
LPARLLQRSPRRCRRRRVPSPSLAHVGRRVQPCYSRAPPLSS

SEQ ID NO: 10872 - protein, 191 aa, Homo sapiens
MGPLSPARTLRLWGPRSLGVALGVFMTIGFALQLLGGPFQRRLPGLQLRQPSAPSLRPALPSCPPRQRLVFLKTHKSGSSSVLSLLHRYGDQHGLRFALPARYQFGYPKLFQASRVKGYRPQGGGTQLPFHILCHHMRFNLKEVLQVMPSDSFFFSIVRDPAGLARSAFSYYKSTSSTFRKSPSLAAFLAN

SEQ ID NO: 10873 - protein, 461 aa, Homo sapiens
  SITE (28): Xaa equals any amino acid
  SITE (168): Xaa equals any amino acid
  SITE (169): Xaa equals any amino acid
  SITE (171): Xaa equals any amino acid
  SITE (178): Xaa equals any amino acid
  SITE (442): Xaa equals any amino acid
MTIGFALQLLGGPFQRRLPGLQLRQPSXPSLRPALPSCPPRQRLVFLKTHKSGSSSVLSLLHRYGDQHGLRFALPARYQFGYPKLFQASRVKGYRPQGGGTQLPFHILCHHMRFNLKEVLQVMPSDSFFFSIVRDPAALARSAFSYYKSTSSAFRKSPSLAAFLANPXXFXRPGARGXHYARNLLWFDFGLPFPPEKRAKRGNIHPPRDPNPPQLQVLPSGAGPRAQTLNPNALIHPVSTVTDHRSQISSPASFDLGSSSFIQWGLAWLDSVFDLVMVAEYFDESLVLLADALCWGLDDVVGFMHNAQAGHKQGLSTVSNSGLTAEDRQLTARARAWNNLDWALYVHFNRSLWARIEKYGQGRLQTAVAELRARREALAKHCLVGGEASDPKYITDRRFRPFQFGSAKVLGYILRSGLSPQDQEECERLATPELQYKDKLDXKQFPPTVSLPLKTSRPLSP

SEQ ID NO: 10874 - protein, 193 aa, Homo sapiens
  SITE (53): Xaa equals any amino acid
MGPLSPARTLRLWGPRSLGVALGVFMTIGFALQLLGGPFQRRLPGLQLRQPSXPSLRPALPSCPPRQRLVFLKTHKSGSSSVLSLLHRYGDQHGLRFALPARYQFGYPKLFQASRVKGYRPQGGGTQLPFHILCHHMRFNLKEVLQVMPSDSFFFSIVRDPAALARSAFSYYKSTSSAFRKSPSLAAFLANPR

SEQ ID NO: 10875 - protein, 509 aa, Homo sapiens; identical to SEQ ID NO: 9429

SEQ ID NO: 10876 - protein, 509 aa, Homo sapiens; identical to SEQ ID NO: 9429

SEQ ID NO: 10877 - protein, 162 aa, Homo sapiens
  SITE (157): Xaa equals any amino acid
MGPRFTMLLAMWLVCGSEPHPHATIRGSHGGRKVPLVSPDSSRPARFLRHTGRSRGIERSTLEEPNLQPLQRRRSVPVLRLARPTEPPARSDINGAAVRPEQRPAARGSPREMIRDEGSSARSRMLRFPSGSSSPNILASFAGKNRVWVISSPHASXGYYRL

SEQ ID NO: 10878 - protein, 239 aa, Homo sapiens
MGSCARLLLLWGCTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGRKVIFKALSPPYDTENPYSAKVQEQLKITNLPRAAAETTVLSLSEK

SEQ ID NO: 10879 - protein, 49 aa, Homo sapiens
  SITE (45): Xaa equals any amino acid
MLGSIPKLWSVLSFSINFCFCCFILSLLCLSVLSNYLFKTPRTWXTLHR

SEQ ID NO: 10880 - protein, 124 aa, Homo sapiens
MGEPNRHPSMFLLLLVLERLYASPMDGTSSALSMGPFVPFIMRCGHSPVYHSREMAARALVPFVMIDHIPNTIRTLLSTLPSCTDQCFRAKPHSWGHFSRFFHLLQAYSDSKTRNEFRLPARAD

SEQ ID NO: 10881 - protein, 96 aa, Homo sapiens
MSIPMVSVLLCQAPLLIQVALPRTVAIRKKRLCLVDSILQTWHLFNFFLVGFIFQSIFRFTAKLSESTEISHLFFAPTQAKPHLLPISPTREVHLL

SEQ ID NO: 10882 - protein, 59 aa, Homo sapiens
  SITE (54): Xaa equals any amino acid
  SITE (56): Xaa equals any amino acid
MENQMLTCVAIFVLFCFVLFLRQGLALSPRLECSGMIRAYCSLTLDFLGSSNPXTXAPK

SEQ ID NO: 10883 - protein, 253 aa, Homo sapiens; identical to SEQ ID NO: 8646

SEQ ID NO: 10884 - protein, 323 aa, Homo sapiens
  SITE (283): Xaa equals any amino acid
  SITE (296): Xaa equals any amino acid
  SITE (298): Xaa equals any amino acid
MELGCWTQLGLTFLQLLLISSLPREYTVINEACPGAEWNIMCRECCEYDQIECVCPGKREVVGYTIPCCRNEENECDSCLIHPGCTIFENCKSCRNGSWGGTLDDFYVKGFYCAECRAGWYGGDCMRCGQVLRAPKGQILLESYPLNAHCEWTIHAKPGFVIQLRFVMLSLEFDYMCQYDYVEVRDGDNRDGQIIKRVCGNERPAPIQSIGSSLHVLFHSDGSKNFDGFHAIYEEITACSSSPCFHDGTCVLDKAGSYKCACLAGYTGQRCENLLEAGKSKIXASEDSLSVLEERXCXDPGGPVNGYQKITGGPGLINGRHAK

SEQ ID NO: 10885 - protein, 79 aa, Homo sapiens [sequence omitted]

SEQ ID NO: 10886 - protein, 455 aa, Homo sapiens
  SITE (1): Xaa equals any amino acid
  SITE (17): Xaa equals any amino acid
  SITE (103): Xaa equals any amino acid
  SITE (178): Xaa equals any amino acid
XTGQRCENLLEERNCSXPGGPVNGYQKITGGPGLINGRHAKIGTVVSFFCNNSYVLSGNEKRTCQQNGEWSGKQPICIKACREPKISDLVRRRVLPMQVQSRXTPLHQLYSAAFSKQKLQSAPTKKPALPFGDLPMGYQHLHTQLQYECISPFYRRLGSSRRTCLRTGKWSGRAPSCXPICGKIENITAPKTQGLRWPWQAAIYRRTSGVHDGSLHKGAWFLVCSGALVNERTVVVAAHCVTDLGKVTMIKTADLKVVLGKFYRDDDRDEKTIQSLQISAIILHPNYDPILLDADIAILKLLDKARISTRVQPICLAASRDLSTSFQESHITVAGWNVLADVRSPGFKNDTLRSGVVSVVDSLLCEEQHEDHGIPVSVTDNMFCASWEPTAPSDICTAETGGIAAVSFPGRASPEPRWHLMGLVSWSYDKTCSHRLSTAFTKVLPFKDWIERNMK

SEQ ID NO: 10887 - protein, 552 aa, Homo sapiens
  SITE (142): Xaa equals any amino acid
MLILGSMFSLVEPVLTIAAALSVQSPFTRSAQSSPECAAARRPLESDQGDPFTLFNVFNAWVQVKSERSRNSRKWCRRRGIEEHRLYEMANLRRQFKELLEDHGLLAGAQAAQVGDSYSRLQQRRERRALHQLKRQHEEGAXCRRKVLRLQEEQDGGSSDEDRAGPAPPGASDGVDIQDVKFKLRHDLAQLQAAASSAQDLSREQLALLKLVLGRGLYPQLAVPDAFNSSRKDSDQIFHTQAKQGAVLHPTCVFAGSPEVLHAQELEASNCDGSRDDKDKMSSKHQLLSFVSLLETNKPYLVNCVRIPALQSLLLFSRSLDTNGDCSRLVADGWLELQLADSESAIRLLAASLRLRARWESALDRQLAHQAQQQLEEEEEDTPVSPKEVATLSKELLQFTASKIPYSLRRLTGLEVQNMYVGPQTIPATPHLPGLFGSSTLSPHPTKGGYAVTDFLTYNCLTNDTDLYSDCLRTFWTCPHCGLHAPLTPLERIAHENTCPQAPQDGPPGAEEAALETLQKTSVLQRPYHCEACGKDFLFTPTEVLRHRKQHV

SEQ ID NO: 10888 - protein, 99 aa, Homo sapiens
MLILGSMFSLVEPVLTIAAALSVQSPFTRSAQSSPECAAARRPLESDQGDPFTLFNVFNAWVQVKSERSRNSRKWCRRRGIEEHRLYEMANFGASSRTV

SEQ ID NO: 10889 - protein, 163 aa, Homo sapiens [sequence omitted]

SEQ ID NO: 10890 - protein, 100 aa, Homo sapiens
GSFLSPWGPILWGLGAGVLMGDALQGREGRMQATVGAGPEGSETVAVQVCVIREAVVGEEVSDCVAPLCGVGGQGGAAKEARKMGGGWDGLGSHIHVLDF

SEQ ID NO: 10891 - protein, 30 aa, Homo sapiens
LNPWPLIVYLCWDPKELYSPCPPRPAQLSR

SEQ ID NO: 10892 - protein, 130 aa, Homo sapiens
  SITE (31): Xaa equals any amino acid
  SITE (115): Xaa equals any amino acid
  SITE (116): Xaa equals any amino acid
  SITE (122): Xaa equals any amino acid
  SITE (126): Xaa equals any amino acid
  SITE (127): Xaa equals any amino acid
MRWRWWQRLLPWRLLQARGFPQNSAPSLGLXARTYSQGDCSYSRTALYDLLGVPSTATQAQIKAAYYRQCFLYHPDRNSGSAEAAERFTRISQAYVVLGSAPSVASMIAAYSATXXCADLAXGLQXXRHP

SEQ ID NO: 10893 - protein, 50 aa, Homo sapiens
  SITE (33): Xaa equals any amino acid
AAMRWRWWQRLLPWRLLQARGFPQNSAPSLGLXARTYSQGDCSYSRTALL

SEQ ID NO: 10894 - protein, 107 aa, Homo sapiens
MPIIVLILVSLLSQLMVSNPPYSLYPRSGTGQTIKMQTENLGVVYYVNKDFKNEYKGMLLQKVEKSVEEDYVTNIRNNCWKERQQKTDMQYAAKVYRDDRLRRRQMP

SEQ ID NO: 10895 - protein, 24 aa, Homo sapiens
MVFLWISYAVKAFLVWTLQLAAEF

SEQ ID NO: 10896 - protein, 47 aa, Homo sapiens
MLPIHLQWACAFRSFLLGIDSSMFVLFQHPRLKDTKSSRVIEPTLTN

SEQ ID NO: 10897 - protein, 30 aa, Homo sapiens
MNDNSPNHSSSYLPLPLTIVILQTGHKGTL

SEQ ID NO: 10898 - protein, 100 aa, Homo sapiens
MSPNLGLKWISMILITYWALNLAPVVASINLFTSTIVLKEGEGNEDESVPGANERPQTTGASFFFPGLKPHGVLWERAGTLGARSTWVPSSAQWMTDSWV

SEQ ID NO: 10899 - protein, 35 aa, Homo sapiens [sequence omitted]

SEQ ID NO: 10900 - protein, 93 aa, Homo sapiens
  SITE (13): Xaa equals any amino acid
  SITE (39): Xaa equals any amino acid
WFQTVDRHCFVLXTDKVKLTWRDRFPAYLTNLVSIIFMXSSRRLRPDEVRGNRKEVIGFSRAWWFTTVIPALWEAEAGRSLEVRSSRPAWPIW

SEQ ID NO: 10901 - protein, 110 aa, Homo sapiens; identical to SEQ ID NO: 8672

SEQ ID NO: 10902 - protein, 21 aa, Homo sapiens
GAAGISGEPGASRCCSGDSCT

SEQ ID NO: 10903 - protein, 218 aa, Homo sapiens; identical to SEQ ID NO: 8678

SEQ ID NO: 10904 - protein, 56 aa, Homo sapiens
MHFLFRFIVFFYLWGLFTAQRQKKEESTEEVKIEVLHRPENCSKTSKKGDLLKCPL

SEQ ID NO: 10905 - protein, 492 aa, Homo sapiens
MKAFHTFCVVLLVFGSVSEAKFDDFEDEEDIVEYDDNDFAEFEDVMEDSVTESPQRVIITEDDEDETTVELEGQDENQEGDFEDADTQEGDTESEPYDDEEFEGYEDKPDTSSSKNKDPITIVDVPAHLQNSWESYYLEILMVTGLLAYIMNYIIGKNKNSRLAQAWFNTHRELLESNFTLVGDDGTNKEATSTGKLNQENEHIYNLWCSGRVCCEGMLIQLRFLKRQDLLNVLARMMRPVSDQVQIKVTMNDEDMDTYVFAVGTRKALVRLQKEMQDLSEFCSDKPKSGAKYGLPDSLAILSEMGEVTDGMMDTKMVHFLTHYADKIESVHFSDQFSGPKIMQEEGQPLKLPDTKRTLLFTFNVPGSGNTYPKDMEALLPLMNMVIYSIDKAKKFRLNREGKQKADKNRARVEENFLKLTHVQRQEAAQSRREEKKRAEKERIMNEEDPEKQRRLEEAALRREQKKLEKKQMKMKQIKVKAHVKPSQRFEF

SEQ ID NO: 10906 - protein, 106 aa, Homo sapiens
  SITE (22): Xaa equals any amino acid
MALHGFHFDLFHFHLLLFQLLXLTPQCSLLQPALFLRIFLIHDSLLLCSFFLLPPRLCCFLSLHMCQFQEVLFYSGTVLICFLFAFSVESELFGFINRINHHVHQG

SEQ ID NO: 10907 - protein, 85 aa, Homo sapiens; identical to SEQ ID NO: 8680

SEQ ID NO: 10908 - protein, 140 aa, Homo sapiens
  SITE (117): Xaa equals any amino acid
MAFKLLILLIGTWALFFRKRRADMPRVFVFRALLLVLIFLFCGFPIGFFTGSAFWTLGNRNYQGIVQYAVSPCGMPSSFHPLLAIRPCWSSGSLQPNVPRCRLVPLPTEWGNPRFQXGTPEYPASSIGGPRKLLQRFHHL

SEQ ID NO: 10909 - protein, 20 aa, Homo sapiens
MLCVLLAVAFQSSPIPGAAA

SEQ ID NO: 10910 - protein, 218 aa, Homo sapiens
MESRMWPALLLSHLLPLWPLLLLPLPPPAQGSSSPPRTPPPPARPPCARGGPSAPRHVCVWERAPPPSRSPRVPRSRRQVLPGTAPPATPSGFEEGPPSSQYPWAIVWGPTVSREDGGDPNSANPGFLDYGFAAPHGLATPHPNSDSMRGDGMGLSLERHLPPCGHSCSGAVGKVWTPSSMSQLPSPSSLFSWPLASSSSSAGTAARSDADPQGSKVP

SEQ ID NO: 10911 - protein, 276 aa, Homo sapiens
MESRMWPALLLSHLLPLWPLLLLPLPPPAQGSSSSPRTPPGPARPPCARGGPSAPRHVCVWERAPPPSRSPRVPRSRRQVLPGTAPPATPSGFEEGPPSSQYPWAIVWGPTVSREDGGDPNSANPGFLDYGFAAPHGLATPHPNSDSMRGDGDGLILGEAPATLRSFLFGGRGEGVDPQLYVTITISIIIVLVATGIIFKFCWDRSQKRRRPSGQQGALRQEESQQPLTDLSPAGVTVLGAFGDSPTPTPDHDEPRGGPRPGMPHPKGAPAFQLNR

SEQ ID NO: 10912 - protein, 43 aa, Homo sapiens; identical to SEQ ID NO: 8692

SEQ ID NO: 10913 - protein, 281 aa, Homo sapiens
MGSRGQGLLLAYCLLLAFASGLVLSRVPHVQGEQQEWEGTEELPSPPDHAERAEEQHEKYRPSQDQGLPASRCLRCCDPGTSMYPATAVPQINITILKGEKGDRGDRGLQGKYGKTGSAGARGHTGPKGQKGSMGAPGERCKSHYAAFSVGRKKPMHSNHYYQTVIFDTEFVNLYDHFNMFTGKFYCYVPGLYFFSLNVHTWNQKETYLHIMKNEEEVAILFAQVGDRSIMQSQSLMLELREQDQVWVRLYKGERENAIFSEELDTYITFSGYLVKHATEP

SEQ ID NO: 10914 - protein, 273 aa, Homo sapiens; identical to SEQ ID NO: 8698

SEQ ID NO: 10915 - protein, 96 aa, Homo sapiens
  SITE (81): Xaa equals any amino acid
  SITE (83): Xaa equals any amino acid
  SITE (84): Xaa equals any amino acid
  SITE (96): Xaa equals any amino acid
MKVAVSPAVGPGPWGSGVGGGGTVRLLLILSGCLVYGTAETDVNVVMLQESQVCEKRASQQFCYTNVLIPKWHDIWTRIQXRXXSSRLVRVTQVEX

SEQ ID NO: 10916 - protein, 273 aa, Homo sapiens; identical to SEQ ID NO: 8698

SEQ ID NO: 10917 - protein, 57 aa, Homo sapiens
MWWEDLMKGLFCLWPLVRSVSSLMTSSTSCPSPPTLPPWRPCLPRLRMRVLVLLIWS

SEQ ID NO: 10918 - protein, 57 aa, Homo sapiens; identical to SEQ ID NO: 10917

SEQ ID NO: 10919 - protein, 183 aa, Homo sapiens
MSKEPLILWLMIEFWWLYLTPVTSETVVTEVLGHRVTLPCLYSSWSHNSNSMCWGKDQCPYSGCKEALIRTDGMRVTSRKSAKYRLQGTIPRGDVSLTILNPSESDSGVYCCRIEVPGWFNDVKINVRLNLQRASTTTHRTATTTTRRTTTTSPTTTRQMTTTPAALPTTKKKKKKKKKKKKK

SEQ ID NO: 10920 - protein, 22 aa, Homo sapiens
MILLAFFILLYLTSFSLARSLP

SEQ ID NO: 10921 - protein, 178 aa, Homo sapiens
MAKVAKDLNPGVKKMSLGQLQSARGVACLGCKGTCSGFEPHSWRKICKSCKCSQEDHCLTSDLEDDRKIGRLLMDSKYSTLTARVKGGDGIRIYKRNRMIMTNPIATGKDPTFDTITYEWAPPGVTQKLGLQYMELIPKEKQPVTGTEGAFTAAASSCTSSPSMTRIPRAAVDFWRMS

SEQ ID NO: 10922 - protein, 47 aa, Homo sapiens
MHGHTSSLPPSLLSSLPSGLLALFVFPFLILLLHAEDLPYYYFGNIE

SEQ ID NO: 10923 - protein, 175 aa, Homo sapiens
  SITE (163): Xaa equals any amino acid
MGSAALEILGLVLCLVGWGGLILACGLPMWQVTAFLDHNIVTAQTTWKGLWMSCVVQSTGHMQCKVYDSVLALSTEVQAARALTVSAVLLAFVALFVTLAGAQCTTCVAPGPAKARVALTGGVLYLFCGLLALVPLCWFANIVVREFYDPSVPVSQKYELGAXCTSAGRPPRCSW

SEQ ID NO: 10924 - protein, 104 aa, Homo sapiens
MPRHSLYIIIGALCVAFILMLIILIVGICRISRIEYQGSSRPAYEEFYNCRSIDSEFSNAIASIRHARFGKKSRPAMYDVSPIAYEDYSPDDKPLVTLIKTKDL

SEQ ID NO: 10925 - protein, 154 aa, Homo sapiens
MATVRASLRGALLLLLAVAGVAEVAGGLAPGSAGALCCNHSKDNQMCRDVCEQIFSSKSESRLKHLLQRAPDYCPETMVEIWNCMNSSLPGVFKKSDGWVGLGCCELAIALECRQACKQASSKNDISKVCRKEYEPVLRYFSVLPSLVWISALP

SEQ ID NO: 10926 - protein, 161 aa, Homo sapiens
MATVRASLRGALLLLLAVAGVAEVAGGLAPGSAGALCCNHSKDNQMCRDVCEQIFSSKSESRLKHLLQRAPDYCPETMVEIWNCMNSSLPGVFKKSDGWVGLGCCELAIALECRQACSRHLQRMIFPKFAEKNMSLSSVILVCFLLLSGFLHCPRKSASMC

SEQ ID NO: 10927 - protein, 209 aa, Homo sapiens
  SITE (136): Xaa equals any amino acid
  SITE (161): Xaa equals any amino acid
  SITE (169): Xaa equals any amino acid
  SITE (197): Xaa equals any amino acid
MAMGLFRVCLVVVTAIINHPLLFPRENATVPENEEEIIRKMQAHQEKLQLEQLRLEEEVARLAAEKEALEQVAEEGRQQNETRVAWDLWSTLCMILFLMIEVWRQDHQEGPSPECLGGEEDELPGWGAPPCRASPXPTRHACHFYERCIRGATADAARTRXFLEGFVDXLLEALRSLCNRDTDMEVEDFIGVDSMYXNWQVDRPLLCHL

SEQ ID NO: 10928 - protein, 578 aa, Homo sapiens
  SITE (64): Xaa equals any amino acid
  SITE (574): Xaa equals any amino acid
MRAARAAPLLQLLLLLGPWLEAAGVAESPLPAVVLAILARNAEHSLPHYLGALERLDYPRARMXLWCATDHNVDNTTEMLQEWLAAVGDDYAAVVWRPEGEPRFYPDEEGPKHWTKERHQFLMELKQEALTFARNWGADYILFADTDNILTNNQTLRLLMGQGLPVVAPMLDSQTYYSNFWCGITPQGYYRRTAEYFPTKNRQRRGCFRVPMVHSTFLASLRAEGADQLAFYPPHPNYTWPFDDIIVFAYACQAAGVSVHVCNEHRYGYMNVPVKSHQGLEDERVNFIHLILEALVDGPRMQASAHVTRPSKRPSKIGFDEVFVISLARRPDRRERMLASLWEMEISGRVVDAVDGWMLNSSAIRNLGVDLLPGYQDPYSGRTLTKGEVGCFLSHYSIWEEVVARGLARVLVFEDDVRFESNFRGRLERLMEDVEAEKLSWDLIYLGRKQVNPEKETAVEGLPGLVVAGYSYWTLAYALRLAGARKLLASQPLRRMLPVDEFLPIMFDQHPNEQYKAHFWPRDLVAFSAQPLLAAPTHYAGDAEWLSDTETSSPWDDDSGRLISWSGSQKTLRXPAWT

SEQ ID NO: 10929 - protein, 424 aa, Homo sapiens
  SITE (138): Xaa equals any amino acid
  SITE (183): Xaa equals any amino acid
MLDKIISIFIIFLLVIGTLLLALLLTAKVHQESVHMIEVTSNLINETLANHPEWANWLPEAQVVQRALNSAANNVYQYGREWITHKLHKILGDKVNNTAVIEKQVLELWDRLYHSWFVKNVTHSGRHKGQKLHVSRQXSWLGDILDWQDIVSFVHENIETFLSILESLWIVMSRNVSLLFTTXTTLLTILFYSGTALLNFVLSLIIFLTTLFYLLSSSDEYYKPVKWVISLTPLSQPGPSSNIIGQSVEEAIRGVFDASLKMAGFYGLYTWLTHTMFGINIVFIPSALAAILGAVPFLGTYWAAVPAVLDLWLTQGLGCKAILLLIFHLLPTYFVDTAIYSDISGGGHPYLTGLAVAGGAYYLGLEGAIIGPILLCILVVASNIYSAMLVSPTNSVPTPNQTPWPAQPQRTFRDISEDLKSSVG

SEQ ID NO: 10930 - protein, 186 aa, Homo sapiens
  SITE (138): Xaa equals any amino acid
  SITE (166): Xaa equals any amino acid
MLDKIISIFIIFLLVIGTLLLALLLTAKVHQESVHMIEVTSNLINETLANHPEWANWLPEAQVVQRALNSAANNVYQYGREWITHKLHKILGDKVNNTAVIEKQVLELWDRLYHSWFVKNVTHSGRHKGQKLHVSRQXSWLGDILDWQDIVSFVHENIETFLSILXSLWIVMSLNVSLLLPLALHS

SEQ ID NO: 10931 - protein, 224 aa, Homo sapiens
VLSLIIFLTTLFYLLSSSDEYYKPVKWVISLTPLSQPGPSSNIIGQSVEEAIRGVFDASLKMAGFYGLYTWLTHTMFGINIVFIPSALAAILGAVPFLGTYWAAVPAVLDLWLTQGLGCKAILLLIFHLLPTYFVDTAIYSDISGGGHPYLTGLAVAGGAYYLGLEGAIIGPILLCILVVASNIYSAMLVSPTNSVPTPNQTPWPAQPQRTFRDISEDLKSSVG

SEQ ID NO: 10932 - protein, 89 aa, Homo sapiens
MAGSPTCLTLIYILWQLTGSAASGPVKELVGSVGGAVTFPLKSKVKQVDSIVWTFNTTPLVTIQPEGGTIIVTQNRNRERVDFPDGATP

SEQ ID NO: 10933 - protein, 110 aa, Homo sapiens; identical to SEQ ID NO: 5664

SEQ ID NO: 10934 - protein, 199 aa, Homo sapiens; identical to SEQ ID NO: 8746

SEQ ID NO: 10935 - protein, 74 aa, Homo sapiens
LALHRCSLSCLQVSVCGVGYGEENLHGGPPGLVVQAVPRHILIPSMGHLKMNNNSQNFCEIKSSFKRSHLSKRF

SEQ ID NO: 10936 - protein, 70 aa, Homo sapiens
MSSSSLHWKEFKYAPGSLHYFALSFVLILTEICLVSSGMGFPQEGKHFSVLGSPDCSLWGRDEHVPREFA

SEQ ID NO: 10937 - protein, 9 aa, Homo sapiens
MHLRFPFLC

SEQ ID NO: 10938 - protein, 70 aa, Homo sapiens [sequence omitted]

SEQ ID NO: 10939 - protein, 70 aa, Homo sapiens
  SITE (20): Xaa equals any amino acid
  SITE (60): Xaa equals any amino acid
GRKRDGGWRKGQKAQVEVPXLLARRILWPLGGWSGCVNQSLSQWRAGLVVCVFITGPHPXHTHTRTHCGV

SEQ ID NO: 10940 - protein, 174 aa, Homo sapiens
  SITE (142): Xaa equals any amino acid
  SITE (160): Xaa equals any amino acid
  SITE (162): Xaa equals any amino acid
MAVARLAAVAAWVPCRSWGWAAVPFGPHRGLSVLLARIPQRAPRWLPACRQKTSLSFLNRPDLPNLAYKKLKGKSPGIIFIPGYLSYMNGTKALAIEEFCKSLGHACIRFDYSGVGSSDGNSEESTLGKWRKDVLSIIDDLXDGPQILVGSSLGGWLMLXAXNCTTREGLALIG

SEQ ID NO: 10941 - protein, 160 aa, Homo sapiens
ILVGSSLGGWLMLHAAIARPEKVVALIGVATAADTLVTKFNQLPVELKKEVEMKGVWSMPSKYSEEGVYNVQYSFIKEAEHHCLLHSPIPVNCPIRLLHGMKDDIVPWHTSMQVADRVLSTDVDVILRKHSDHRMREKADIQLLVYTIDDLIDKLSTIVN

SEQ ID NO: 10942 - protein, 43 aa, Homo sapiens; identical to SEQ ID NO: 8753

SEQ ID NO: 10943 - protein, 55 aa, Homo sapiens
MLLLMLVNTSAVACTHGGRGPWGNSAAQACAALARGPGRTLPRPPSGSHRCWLVC

SEQ ID NO: 10944 - protein, 442 aa, Homo sapiens
  SITE (164): Xaa equals any amino acid
  SITE (247): Xaa equals any amino acid
MWRLPGLLGRALPRTLGPSLWRVTPKSTSPDGPQTTSSTLLVPVPNLDRSGPHGPGTSGGPRSHGWKDAFQWMSSRVSPNTLWDAISWGTLAVLALQLARQIHFQASLPAGPQRVEHCSWHSPLDRFFSSPLWHPCSSLRQHILPSPDGPAPRHTGLREPRLGXEEASAQPRNFSHNSLRGARPQDPSEEGPGDFGFLHASSSIESEAKPAQPQPTGEKEQDKSKTLSLEEAVTSIQQLFQLSVSIXFNFLGTENMKSGDHTAAFSYFQKAAARGYSKAQYNAGLCHEHGRGTPRDISKAVLYYQLAASQGHSLAQYRYARCLLRDPASSWNPERQRAVSLLKQAADSGLREAQAFLGVLFTKEPYLDEQRAVKYLWLAANNGDSQSRYHLGICYEKGLGVQRNLGEALRCYQQSAALGNEAAQERLRALFSMGAAAGGPAT

SEQ ID NO: 10945 - protein, 20 aa, Homo sapiens
MKFIMLLLLPSIFPTTVEMI

SEQ ID NO: 10946 - protein, 210 aa, Homo sapiens; identical to SEQ ID NO: 8761

SEQ ID NO: 10947 - protein, 91 aa, Homo sapiens
  SITE (54): Xaa equals any amino acid
  SITE (71): Xaa equals any amino acid
  SITE (89): Xaa equals any amino acid
MAVMCVAGLFFIPVAGLTGFHVVLVARGRTTNEQVTGKFRGGVNPFTNGCCNNXSRVLCSSPAPRYLGRPXKEKTIVIRPPFLRPRSFXWA

SEQ ID NO: 10948 - protein, 672 aa, Homo sapiens
MAARGRGLLLLTLSVLLAAGPSAAAAKLNIPKVLLPFTRATRVNFTLEASEGCYRWLSTRPEVASIEPLGLDEQQCSQKAVVQARLTQPARLTSIIFAEDITTGQVLRCDAIVDLIHDIQIVSTTRELYLEDSPLELKIQALDSEGNTFSTLAGLVFEWTIVKDSEADRFSDSHNALRILTFLESTYIPPSYISEMEKAAKQGDTILVSGMKTGSSKLKARIQEAVYKNVRPAEVRLLILENILLNPAYDVYLMVGTSIHYKVQKIRQGKITELSMPSDQYELQLQNSIPGPEGDPTRPVAVLAQDTSMVTALQLGQSSLVLGHRSIRMQGASRLPNSTIYVVEPGYLGFTVHPGDRWVLETGRLYEITIEVFDKFSNKVYVSDNIRIETVLPAEFFEVLSSSQNGSYHRIRALKRGQTAIDAALTSVVDQDGGVHILQVPVWNQQEVEIHIPITLYPSILTFPWQPKTGAYQYTIRAHGGSGNFSWSSSSHLVATVTVKGVMTTGSDIGFSVIQAHDVQNPLHFGEMKVYVIEPHSMEFAPCQVEARVGQALELPLRISGLMPGGASEVVTLSDCSHFDLAVEVENQGVFQPLPGRLPPGSEHCSGVRVKAEAQGSTTLLVSYRHGHVHLSAKITIAAYLPLKAVDPSSVALVTLGSSKEMLFEGGPRPWI

SEQ ID NO: 10949 - protein, 831 aa, Homo sapiens
MAARGRGLLLLTLSVLLAAGPSAAAAKLNIPKVLLPFTRATRVNFTLEASEGCYRWLSTRPEVASIEPLGLDEQQCSQKAVVQARLTQPARLTSIIFAEDITTGQVLRCDAIVDLIHDIQIVSTTRELYLEDSPLELKIQALDSEGNTFSTLAGLVFEWTIVKDSEADRFSDSHNALRILTFLESTYIPPSYISEMEKAAKQGDTILVSGMKTGSSKLKARIQEAVYKNVRPAEVRLLILENILLNPAYDVYLMVGTSIHYKVQKIRQGKITELSMPSDQYELQLQNSIPGPEGDPTRPVAVLAQDTSMVTALQLGQSSLVLGHRSIRMQGASRLPNSTIYVVEPGYLGFTVHPGDRWVLETGRLYEITIEVFDKFSNKVYVSDNIRIETVLPAEFFEVLSSSQNGSYHRIRALKRGQTAIDAALTSVVDQDGGVHILQVPVWNQQEVEIHIPITLYPSILTFPWQPKTGAYQYTIRAHGGSGNFSWSSSSHLVATVTVKGVMTTGSDIGFSVIQAHDVQNPLHFGEMKVYVIEPHSMEFAPCQVEARVGQALELPLRISGLMPGGASEVVTLSDCSHFDLAVEVENQGVFQPLPGRLPPGSEHCSGVRVKAEAQGSTTLLVSYRHGHVHLSAKITIAAYLPLKAVDPSSVALVTLGSSKEMLFEGGPRPWILEPSKFFQNVTAEDTDSIGLALFAPHSSRNYQQHWILVTCQALGEQVIALSVGNKPSLTNPFPAVEPAVVKFVCAPPSRLTLVPVYTSPQLDMSCPLLQQNKQVVPVSSHRNPLLDLAAYDQEGRRFDNFSSLSIQWESTRPVLAASSLSCHAAGVPGR

SEQ ID NO: 10950 - protein, 886 aa, Homo sapiens; identical to SEQ ID NO: 9497
  SITE (26): Xaa equals any amino acid
  SITE (216): Xaa equals any amino acid
  SITE (234): Xaa equals any amino acid
  SITE (275): Xaa equals any amino acid
  SITE (871): Xaa equals any amino acid

SEQ ID NO: 10951 - protein, 18 aa, Homo sapiens
MLKIPTHLEGKIKITKVY

SEQ ID NO: 10952 - protein, 42 aa, Homo sapiens
MRLSKSNQVQLFLYFLLQWSLGSVNAETSLQILLACSFTTDS

SEQ ID NO: 10953 - protein, 338 aa, Homo sapiens [sequence omitted]

SEQ ID NO: 10954 - protein, 18 aa, Homo sapiens
SLDAFRLIRAMGATGLSF

SEQ ID NO: 10955 - protein, 194 aa, Homo sapiens [sequence omitted]

SEQ ID NO: 10956 - protein, 59 aa, Homo sapiens
MYAKCQKKLAPAWLIFFIGGMTRKIILAPCLSMVAARGNNNNFQSKANCLNTCKNKRFP

SEQ ID NO: 10957 - protein, 161 aa, Homo sapiens; identical to SEQ ID NO: 8784

SEQ ID NO: 10958 - protein, 113 aa, Homo sapiens
  SITE (31): Xaa equals any amino acid
  SITE (79): Xaa equals any amino acid
  SITE (102): Xaa equals any amino acid
  SITE (111): Xaa equals any amino acid
CGVFWLLSLLCCIKEQQFEQVVALLLQSIRXCQDRALLVNNAYQGLASLVKVSELAAFKVVVQEEGGSGLSLIKETYQXHRGRTRRWWENVGMLLVPPGFLXRRSCRSWCXVV

SEQ ID NO: 10959 - protein, 2 aa, Homo sapiens
IL

SEQ ID NO: 10960 - protein, 75 aa, Homo sapiens
  SITE (9): Xaa equals any amino acid
ADNNFTQEXAMTMITPSSKLTLTKGNKSWSSTAVAAALELVDPPGCRNSARDNQFILLNWHILNHDSQQLGNIFF

SEQ ID NO: 10961 - protein, 80 aa, Homo sapiens
  SITE (73): Xaa equals any amino acid
  SITE (78): Xaa equals any amino acid
MFLTIIVCGMVAALSAIRANCHQEPSVCLQAACPESWIGFQRKCFYFSDDTKNWTSSQRFCDSQDADLAQVEXFQELXRK

SEQ ID NO: 10962 - protein, 20 aa, Homo sapiens
SSSCMPRKLDWFSKKVFLFF

SEQ ID NO: 10963 - protein, 75 aa, Homo sapiens
MLNPLRQLFKLMASLFLSVFTLGLPFALFQYYAYTQFCLPGSARPIPEPLVQLAVDKGYRIAEGNEPLGASGMFH

SEQ ID NO: 10964 - protein, 28 aa, Homo sapiens
  SITE (3): Xaa equals any amino acid
ECXRKPTPRAEFLQPGGSTSSRAAATAV

SEQ ID NO: 10965 - protein, 209 aa, Homo sapiens; identical to SEQ ID NO: 8794

SEQ ID NO: 10966 - protein, 134 aa, Homo sapiens; identical to SEQ ID NO: 8797

SEQ ID NO: 10967 - protein, 146 aa, Homo sapiens
  SITE (70): Xaa equals any amino acid
MKASVVLSLLGYLVVPSGAYILGRCTVAKKLHDGGLDYFEGYSLENWVCLAYFESKFNPMAIYENTREGXTGFGLFQMRGSDWCGDHGRNRCHMSCSALLNPNLEKTIKCAKTIVKGKEGMGAWPTWSRYCQYSDTLARWLDGCKL

SEQ ID NO: 10968 - protein, 238 aa, Homo sapiens
  SITE (52): Xaa equals any amino acid
  SITE (55): Xaa equals any amino acid
  SITE (88): Xaa equals any amino acid
  SITE (92): Xaa equals any amino acid
  SITE (122): Xaa equals any amino acid
  SITE (127): Xaa equals any amino acid
  SITE (142): Xaa equals any amino acid
  SITE (145): Xaa equals any amino acid
  SITE (152): Xaa equals any amino acid
  SITE (167): Xaa equals any amino acid
  SITE (192): Xaa equals any amino acid
  SITE (212): Xaa equals any amino acid
  SITE (233): Xaa equals any amino acid
MRLRFWLLIWLLLGFISHQPTPVSFLKTIFWSRNGHDRSRDVQQRARRSNRXRQXGIKIGLEDICTLWKQAETKVQAKIRKMKVTKKXNHHXKINGKRKTAKNRKCFNVRKSCGGGQRTTTXAKSPXLQESLFATGSEWRQXSMXHSSGLPXWPYLTAETLKNRMGXQPPPPTQQHSITDNSLSLKTPPECXLHPLPPSVDDNIKECPLAPXPPSVDDNLKECLPGPSSTLSXSTLSG

SEQ ID NO: 10969 - protein, 76 aa, Homo sapiens; identical to SEQ ID NO: 8800

SEQ ID NO: 10970 - protein, 142 aa, Homo sapiens
  SITE (85): Xaa equals any amino acid
  SITE (131): Xaa equals any amino acid
MTKALLIYLVSSFLALNQASLISRCDLAQVLQLEDLDGFEGYSLSDWLCLAFVESKFNISKINENADGSFDYGLFQINSHYWCNXYKSYSENLCHVDCQDLLNPNLLAGIHCAKRIVSGARGMNNWVRMEXCTVQAGHSSTG

SEQ ID NO: 10971 - protein, 81 aa, Homo sapiens; identical to SEQ ID NO: 8808

SEQ ID NO: 10972 - protein, 47 aa, Homo sapiens
  SITE (47): Xaa equals any amino acid
MRLRFWLLIWLLLGFISHQPTPVINSLAVYRHRETDFGVRVRDHPWX

SEQ ID NO: 10973 - protein, 394 aa, Homo sapiens
  SITE (73): Xaa equals any amino acid
  SITE (194): Xaa equals any amino acid
  SITE (200): Xaa equals any amino acid
  SITE (210): Xaa equals any amino acid
  SITE (225): Xaa equals any amino acid
  SITE (237): Xaa equals any amino acid
  SITE (389): Xaa equals any amino acid
EVINTLADHRHRGTDFGGSPWLLIITVFLRSYKFAISLCTSYLCVSFLKTIFPSQNGHDGSTDVQQRARRSNXRRQEGIKIVLEDIFTLWRQVETKVRAKIRKMKVTTKVNRHDKINGKRKTAKEHLRKLSMKEREHGEKERQVSEAEENGKLDMKEIHTYMEMFQRAQALRRRAEDYYRCKITPSARKPLCNXVRMAAXEHRHSSGLPXWPYLTAETLKNRMGXQPPPPTQQHSIXDNSLSLKTPPECLLHPLPPSVDDNIKECPLAPLPPSVDDNLKECLLVPLPPSPLPPSVDDNLKDCLFVPLPPSPLPPSVDDNLKTPPLATQEAEAEKPPKPKRWRVDEVEQSPKPKRRRADEVEQSPKPKRQREAEAQQLPKPKRRRLSKLXTRHCT

SEQ ID NO: 10974 - protein, 384 aa, Homo sapiens; identical to SEQ ID NO: 8811

SEQ ID NO: 10975 - protein, 90 aa, Homo sapiens; identical to SEQ ID NO: 8812

SEQ ID NO: 10976 - protein, 90 aa, Homo sapiens
  SITE (6): Xaa equals any amino acid
MAVTWXQALLRALCISGVCSQGKWKRFFQSSTAHPSMRWRGRPLARTLSVWTKDAKLCCGHSTDGALRAGRTPVPSSEEAHGLLQPCPGR

SEQ ID NO: 10977 - protein, 92 aa, Homo sapiens; identical to SEQ ID NO: 8813

SEQ ID NO: 10978 - protein, 92 aa, Homo sapiens; identical to SEQ ID NO: 8813

SEQ ID NO: 10979 - protein, 223 aa, Homo sapiens
  SITE (159): Xaa equals any amino acid
  SITE (208): Xaa equals any amino acid
  SITE (218): Xaa equals any amino acid
  SITE (221): Xaa equals any amino acid
MLHVTRGVWGSRVRVWPLLPALLGPPRALSSLAAKMGEYRKMWNPREPRDWAQQYRERFIPFSKEQLLRLLIQALYDPINPDRETLDQPSLTDPQRLSNEQEVLRALEPLLAQANFSPLSEDTLAYALVVHHPQDEVQVTVNLDQYVYIHFWALGQPSXADAPEVQRGLQACLLSPKLPLRERRYFKRVVLASPDQNGDTWDLKKFSXTPPLGKAWEXLLXGT

SEQ ID NO: 10980 - protein, 169 aa, Homo sapiens
  SITE (4): Xaa equals any amino acid
  SITE (18): Xaa equals any amino acid
  SITE (24): Xaa equals any amino acid
  SITE (108): Xaa equals any amino acid
SPKXPPAERRYFKRVVLXARTKRXHLVLKSFKDTPLEGLEQLLPELKVRTPTLQRALLNLMLVVSGVAIFVNVGMVVLTDLKVATSLLLLLFAIFMGLRASKCRAALXSCTGCSPSKDSWPRGQVEADTQLVSACQNACPVSRLSQPRGELPFTDSSQGWHRPQECRLV

SEQ ID NO: 10981 - protein, 215 aa, Homo sapiens
  SITE (116): Xaa equals any amino acid
MELSCPGSRCPVQEQRARWERKRACTARELLETERRYQEQLGLVATYFLGILKAKGTLRPPERQALFGSWELIYGASQELLPYLEGGCWGQGLEGFCRHLELYNQFAANSERSQTXLQEQLKKNKGFRKFVRLQEGRPEFGGLQLQDLLPLPLQRLQQYENLVVALAENTGPNSPDHQQLTRRFLLLGNAGWRLPLLYSFLILTSNNVWYDPIFH

SEQ ID NO: 10982 - protein, 69 aa, Homo sapiens
EILLKKKNQETKSNPTKPQMNQPLTQMRGFGTDKLCAVSMARHLSRLQLCKCGYFYVVYSFYHLFFHWI

SEQ ID NO: 10983 - protein, 119 aa, Homo sapiens
MSPHPTALLGLVLCLAQTIHTQEEDLPRPSISAEPGTVIPLGSHVTFVCRGPVGVQTFRLERESRSTYNDTEDVSQASPSESEARFRIDSVSEGNAGPYRCIYYKPPKWSEQSDYWSCW

SEQ ID NO: 10984 - protein, 30 aa, Homo sapiens
  SITE (2): Xaa equals any amino acid
  SITE (13): Xaa equals any amino acid
  SITE (16): Xaa equals any amino acid
MXASQYILFFLQXLGXKLQFQGISSQQQVE

SEQ ID NO: 10985 - protein, 5 aa, Homo sapiens
QYLLI

SEQ ID NO: 10986 - protein, 56 aa, Homo sapiens
MCISGCLFHCSICLFFMLVPYCFDYCLVMYFEIKTCGYLLLCSPCQDYSRSFVASS

SEQ ID NO: 10987 - protein, 219 aa, Homo sapiens
  SITE (56): Xaa equals any amino acid
  SITE (58): Xaa equals any amino acid
  SITE (204): Xaa equals any amino acid
  SITE (209): Xaa equals any amino acid
MPCLEAVALILLILLVPDPPRGAAETQGEGAVGGFRSSWCEDVRYLGKNWSFVWSXLXVTAMAFVTGALGFWAPKFLLEARVVHGLQPPCFQEPCSNPDSLIFGALTIMTGVIGVILGAEAARRYKKVIPGAEPLICASSLLATAPCLYLALVLAPTTLLASYVFLGLGELLLSCNWAVVADILLSVVVPRCRGTAEALQITVXHILGXLAALSHRTYL

SEQ ID NO: 10988 - protein, 92 aa, Homo sapiens
  SITE (10): Xaa equals any amino acid
  SITE (49): Xaa equals any amino acid
IGPLLVYVSXTHESLKLWQLKETLIQSFPALVRSLGPGLLFGPPIATGXTQAGDMADKSQAGPRGSVSSVAWGPFPGGSGALAFCPLILRSH

SEQ ID NO: 10989 - protein, 126 aa, Homo sapiens
  SITE (119): Xaa equals any amino acid
MSPWLLLLLVVGSWLLARILAWTYAFYNNCRRLQCFPQPPKRNWFWGHLGLITPTEEGLKDSTQMSATYSQGFTVWLGPIIPFIVLCHPDTIRSITNASAAIAPKDNLFIRFLKPWLGXRDTAEWR

SEQ ID NO: 10990 - protein, 13 aa, Homo sapiens
LVIGGWGQRRLYR

SEQ ID NO: 10991 - protein, 80 aa, Homo sapiens; identical to SEQ ID NO: 6586

SEQ ID NO: 10992 - protein, 54 aa, Homo sapiens
MPWILMLLFTMGQGVVILAFRSCLEAEVRGVPGRGNRSGVKTVVEAPAVFAKRP

SEQ ID NO: 10993 - protein, 254 aa, Homo sapiens
  SITE (176): Xaa equals any amino acid
  SITE (210): Xaa equals any amino acid
  SITE (214): Xaa equals any amino acid
  SITE (237): Xaa equals any amino acid
  SITE (246): Xaa equals any amino acid
EFGTSLKVRGFILEVSETTNPPEGTNSGHSGMVSALCGLCLLGSNDSPASASQVAGTTGLSKSLGLIEGYGGRGKGGLPATLSPAEEEKAKGPHEKYGYNSYLSEKISLDRSIPDYRPTKCKELKYSKDLPQISIIFIFVNEALSVILRSVHSAVNHTPTHLLKEIILVDDNSDEXELKVPLEEYVHKRYPGLVKVVRNQKRESLIRARXEGWXVATGQVTGFFDAPRGIHRLLGLXRVYPDPGKXRKRGNLPL

SEQ ID NO: 10994 - protein, 74 aa, Homo sapiens [sequence omitted]

SEQ ID NO: 10995 - protein, 238 aa, Homo sapiens
MQQGPKEFIECVSHIRLLSWLLLGSLTHNAVCPNASSPCLPIPLDAGSHVADHLIVILIGFPEQSKTSVLHMCSLFHAFIFAQLWTVYCEQSAVATNLQNQNEFSFTAILTALEFWSRVTPSILQLMAHNKVMVEMVCLHVISLMEALQECNSTIFVKLIPMWLPMIQSNIKHLSAGLQLRLQAIQNHVNHHSLRTLPGSGQSSAGLAALRKWLQCTQFKMAQVEIQSSEAASQFYPL

SEQ ID NO: 10996 - protein, 211 aa, Homo sapiens
  SITE (100): Xaa equals any amino acid
  SITE (103): Xaa equals any amino acid
MGEASPPAPARRHLLVLLLLLSTLVIPSAAAPIHDADAQESSLGLTGLQSLLQGFSRLFLKGNLLRGIDSLFSAPMDFRGLPGNYHKEENQEHQLGNNTXSSXLQIDKVPRMEEKEALVPIQKATDSFHTELHPRVAFWIIKLPRRRSHQDALEGGHWLSEKRHRLQAIRDGLRKGTHKDVLEEGTESSSHSRLSPRKTHLLYILRPSRQL

SEQ ID NO: 10997 - protein, 67 aa, Homo sapiens
MGEASPPAPARRHLLVLLLLLSTLVIPSAAAPIHDADAQESSLGLTGLQSLLQGFSRLFLKVTCFGA

SEQ ID NO: 10998 - protein, 241 aa, Homo sapiens
APGQTPSLCSWLLPLPSTWATTGHVCFSDILQTPDGGQLLLDWAKQPDSSQDPDPTTQPIVLLLPGITGSSQETYVLHLVNQALRDGYQAVVFNNRGCRGEELRTHRAFCASNTEDLETVVNHIKHRYPQAPLLAVGISFGGILVLNHLAQARQAAGLVAALTLSACWDSFETTRSLETPLNSLLFNQPLTAGLCQLVERLSYGKTCRPVQSASLMSATHLWPLDIKTVLPTTKQQALEPR

SEQ ID NO: 10999 - protein, 202 aa, Homo sapiens
MVPAAGALLWVLLLNLGPRAAGAQGLTQTPTEMQRVSLRFGGPMTRSYRSTARTGLPRKTRIILEDENDAMADADRLAGPAAAELLAATVSTGFSRSSAINEEDGSSEEGVVINAGKDSTSRELPSATPNTAGSSSTRFIANSQEPEIRLTSSLPRSPGRSTEDLPGSQATLSQWSTPGSTPSRWPSPSPTAMPLLRICGWC

SEQ ID NO: 11000 - protein, 341 aa, Homo sapiens
  SITE (51): Xaa equals any amino acid
  SITE (67): Xaa equals any amino acid
MVPAAGALLWVLLLNLGPRAAGAQGLTQTPTEMQRVSLRFGGPMTRSYRSXARTGLPRKTRIILEDXNDAMADADRLAGPAAAELLAATVSTGFSRSSAINEEDGSSEEGVVINAGKDSTSRELPSATPNTAGSSSTRFIANSQEPEIRLTSSLPRSPGRSTEDLPGSQATLSQWSTPGSTPSRWPSPSPTAMPSPEDLRLVLMPWGPWHCHCKSGTMSRSRSGKLHGLSGRLRVGALSQLRTEHKPCTYQQCPCNRLREECPLDTSLCTDTNCASQSTTSTRTTTTPFPTIHLRSSPSLPPASPCPALAFWKRVRIGLEDIWNSLSSVFTEMQPIDRNQR

SEQ ID NO: 11001 - protein, 91 aa, Homo sapiens
  SITE (19): Xaa equals any amino acid
MGPVSELSIFILLFVFCFXFSLMPDIRRTLHFWLHSLLYPHETDQCLQSSAIPFQVFYVQQKKRASLSSSSHIIKGIAPLLNQSVNHSGPI

SEQ ID NO: 11002 - protein, 66 aa, Homo sapiens
  SITE (4): Xaa equals any amino acid
  SITE (13): Xaa equals any amino acid
STLXVTFICSSRXLLRERGAVLKTNPIPILLKKPLLCPSFIHNLVPHPHLPQLLLFSNFLCRCPYH

SEQ ID NO: 11003 - protein, 130 aa, Homo sapiens
MFLELSQALLLLGLPRAPTLFPALPEGPTSLGEQWPPQLPPHLGAPPAAEGAVAMVGCGEGRGGKPLCCSPAQSPAQRVRSGGDKEPITTTEVSLILLHSRCFNLTKLKKTAFAMKKKKKKKKKKKKKKK

SEQ ID NO: 11004 - protein, 184 aa, Homo sapiens [sequence omitted]

SEQ ID NO: 11005 - protein, 180 aa, Homo sapiens
  SITE (143): Xaa equals any amino acid
MGWPRPGRALVAVKALLVLSLLQVPAQAVVRAVLEDNSSSVDFADLPALFGVPLAPEGIRGYLMEVKPANACHPIEAPRLGNRSLGAIVLIRRYDCTFDLKVLNAQRAGFEAAIVHNVHSDDLVSMTHVYEDLRGQIAIPSVXVSEAARRTCGSSWAATSRPTRCPADDPPCHDLAVTPC

SEQ ID NO: 11006 - protein, 225 aa, Homo sapiens
  SITE (21): Xaa equals any amino acid
  SITE (45): Xaa equals any amino acid
TQPCQRPGIVTPVLTVSWVLXCTLALVVSAFFVLNHLWLWAQACXSHRRPVKTSTCQKAQVRTFTWHNDLCAICLDEYEEGDQLKILPCSHTYHCKCIDPWFSQAPRRSCPVCKQSVAATEDSFDSTTYSFRDEDPSLPGHRPPIWAIQVQYAPGGWSCWAAPVPTATAAPRPWRQSIPLSPQPLLRPLVSKDLGQGGGCNEECFWSEKNKVGLKAEKKKKKKTR

SEQ ID NO: 11007 - protein, 42 aa, Homo sapiens
  SITE (18): Xaa equals any amino acid
  SITE (37): Xaa equals any amino acid
MAGCLGSYLLVMILILCXAHFFICGNEDNRVLRYNLXTMSVT

SEQ ID NO: 11008 - protein, 43 aa, Homo sapiens
  SITE (14): Xaa equals any amino acid
MKFLSILLDDNNFXLMLMLAPFGCLAFERSMKMRNGALGLEEV

SEQ ID NO: 11009 - protein, 63 aa, Homo sapiens
  SITE (37): Xaa equals any amino acid
MRLCQRPGLVLALPPQLSFSTARGGDSRMLGLPLGRXTSGKVQGDSTTVKLRFGLQLGVLGQR

SEQ ID NO: 11010 - protein, 157 aa, Homo sapiens
GQRGRPAATSHRILSSHSLASGCPVFRGGEGTGARSTPLALLLDPKARPDPFIPWGAPASAIGMRSLKSLHKQVRDPPTCRSWATPRAIPRGCGRTQPPTDRRPESSEGAIPIPTSGEARTAIVASGKTQLEPNGPCPHCNCAENVSQMTQIGSYFF

SEQ ID NO: 11011 - protein, 70 aa, Homo sapiens
MTAPLPPLSGLALFLIVFFSLGVFCICHSHWYHTLQQMAGTEPKALLLSPPAATTFVTVTHEVWKEQALA

SEQ ID NO: 11012 - protein, 54 aa, Homo sapiens
MDSMPEPASRCLLLLPLLLLLLLLLPAPELGPSQAGAEENDWVRLPSKCEGTCG

SEQ ID NO: 11013 - protein, 27 aa, Homo sapiens
MHSFTQRGMYIFLSSSQAIFLMSCFLF

SEQ ID NO: 11014 - protein, 51 aa, Homo sapiens
MGLIAADVNLDLLVQVVPASCLHCGVTIFPFPHFIHQKPVTKRGQTPGQGN

SEQ ID NO: 11015 - protein, 11 aa, Homo sapiens
SSLKNQVSVSQ

SEQ ID NO: 11016 - protein, 132 aa, Homo sapiens
  SITE (104): Xaa equals any amino acid
  SITE (120): Xaa equals any amino acid
MPDVQGPWHPAHPPIPSAALCLLWPHCLAAPKYARPRCLLVFVLCDRSAWNILLYSVGSKVSGLCSNCSLVPGVVAHTCNPKVPLGLQGCELPCPAEHLIFSKXLSSCATWAHCFLGLSXCWCLHPHPHPSW

SEQ ID NO: 11017 - protein, 139 aa, Homo sapiens
TFRLVSAHLKTRKLINPEAAERRWRDWDSRQGWLSVKMQRVSGLLSWTLSRVLWLSGLSEPGAARQPRIMEEKALEVYDLIRTIRDPEKPNTLEELEVVSESCVEVQEINEEEYLVIIRFTPTVPHCSLATLIVGNLHF

SEQ ID NO: 11018 - protein, 92 aa, Homo sapiens
SGLAWALLLSLPGGLRSSSARLPPEPFHGQGLSSVGAIRRRVCRSVRLGDPWGMEGTTRPFPSVPCQAVLTAASSQGRKPGQRQRLLVPSIP

SEQ ID NO: 11019 - protein, 68 aa, Homo sapiens
  SITE (5): Xaa equals any amino acid
PPHLXSFEFLKNVQLRPDTVAHTCDPGTLGGRGWWITGSGDRDILANTVKRRLYRKCRRLAGHGGGRL

SEQ ID NO: 11020 - protein, 54 aa, Homo sapiens; identical to SEQ ID NO: 8897

SEQ ID NO: 11021 - protein, 204 aa, Homo sapiens
  SITE (1): Xaa equals any amino acid
  SITE (5): Xaa equals any amino acid
  SITE (8): Xaa equals any amino acid
XPSLXGTXAGGSTAVAAALELVDPPGCRNSARAAAELSLLEKSLGLSKGNKYSAQGERQIPVLQTNNGPSLTGLTTIAAHLVKQANKEYLLGSTAEEKAIVQQWLEYRVTQVDGHSSKNDIHTLLKDLNSYLEDKVYLTGYNFTLADILLYYGLHRFIVDLTVQEKEKYLNVSRWFCHIQHYPGIRQHLSSVVFIKNRLYTNSH

SEQ ID NO: 11022 - protein, 71 aa, Homo sapiens
  SITE (71): Xaa equals any amino acid
TMGPGDRHRLPVYLGHCLGCLESGLLAQILPLLGQGRPFMDSLIRVAAERRAGQVLKGTLKRFSERQGRRX

SEQ ID NO: 11023 - protein, 48 aa, Homo sapiens; identical to SEQ ID NO: 8898

SEQ ID NO: 11024 - protein, 70 aa, Homo sapiens
LLDLTNRLVTCIDQSKPNILASLSLAEQTRVGIWVGAFSIKDNLSLCSQGEHLCFVLKAGSPWFANCLQE

SEQ ID NO: 11025 - protein, 277 aa, Homo sapiens
MSFNLQSSKKLFIFLGKSLFSLLEAMIFALLPKPRKNVAGEIVLITGAGSGLGRLLALQFARLGSVLVLWDINKEGNEETCKMAREAGATRVHAYTCDCSQKEGVYRVADQVKKEVGDVSILINNAGIVTGKKFLDCPDELMEKSFDVNFKAHLWTYKAFLPAMIANDHGHLVCISSSAGLSGVNGLADYCASKFAAFGFAESVFVETFVQKQKGIKTTIVCPFFIKTGMFEGCTTGCPSLLPILEPKYAVEKIVEAILQEKMYLYMPKVVILHDVS

SEQ ID NO: 11026 - protein, 32 aa, Homo sapiens
MEVPARASSLNSSDIFLLVTASVCYLWFGKGL

SEQ ID NO: 11027 - protein, 257 aa, Homo sapiens
MAALTTVVVAAAATAVAGAVAGAGAATGTGVGATPAPQQSDGCFSTSGGIRPFHLQNWKQKVNQTKKAEFVRTAEKFKNQVINMEKDKHSHFYNQKSDFRIEHSMLEELENKLIHSRKTERAKIQQQLAKIHNNVKKLQHQLKDVKPTPDFVEKLREMMEEIENAINTFKEEQRLIYEELIKEEKTTNNELSAISRKIDTWALGNSETEKAFRAISSKVPVDKVTPSTLPEEVLDFEKFLQQTGGRQGAWDVITRTL

SEQ ID NO: 11028 - protein, 257 aa, Homo sapiens
MAALTTVVVAAAATAVAGAVAGAGAATGTGVGATPAPQQSDGCFSTSGGIRPFHLQNWKQKVNQTKKAEFVRTAEKFKNQVINMEKDKHSHFYNQKSDFRFEHSMLEELENKLIHSRKTERAKFQQQLAKIHNNVKKLQHQLKDVKPTPDFVEKLREMMEEIENAINTFKEEQRLIYEELIKEEKTTNNELSAISRKIDTWALGNSETEKAFRAISSKVPVDKVTPSTLPEEVLDFEKFLQQTGGRQGAWDVITRTL

SEQ ID NO: 11029 - protein, 60 aa, Homo sapiens
  SITE (10): Xaa equals any amino acid
  SITE (42): Xaa equals any amino acid
MFFPCLPTLXLRILHSGWVGLFLLISSRAPSSSLAWKHGPGXLWWPRRPLRSCTGLASCG

SEQ ID NO: 11030 - protein, 261 aa, Homo sapiens
  SITE (125): Xaa equals any amino acid
  SITE (127): Xaa equals any amino acid
MAVTACQGLGFVVSLIGIAGIIAATCMDQWSTQDLYNNPVTAVFNYQGLWRSCVRESSGFTECRGYFTLLGLPAMLQAVRALMIVGIVLGAIGLLVSIFALKCIRIGSMEDSAKANMTLTSGIMXIXSGLCAIAGVSVFANMLVTNFWMSTANMYTGMGGMVQTVQTRYTFGAALFVGWVAGGLTLIGGVMMCIACRGLAPEETNYKAVSYHASGHSVAYKPGGFKASTGFGSNTKNKKRYDGGARTEDEVQSYPSKHDYV

SEQ ID NO: 11031 - protein, 125 aa, Homo sapiens; identical to SEQ ID NO: 8909

SEQ ID NO: 11032 - protein, 52 aa, Homo sapiens
  SITE (46): Xaa equals any amino acid
MVPIFLLKCLLLHVPLCMSSNLSFHSSHHLHIFLPSFSSHLPRPLXIPPLSP

SEQ ID NO: 11033 - protein, 1134 aa, Homo sapiens
VLFRPQAQRPPSCVGGSAVRRWQGQPQPQRPGEEKAAAAILGGPGGGEEEKEEGGGRAWLRLLEELAAARPGEPALMSSSPLSKKRRVSGPDPKPGSNCSPAQSVLSEVPSVPTNGMAKNGSEADIDEGLYSRQLYVLGHEAMKRLQTSSVLVSGLRGLGVEIAKNIILGGVKAVTLHDQGTAQWADLSSQFYLREEDIGKNRAEVSQPRLAELNSYVPVTAYTGPLVEDFLSGFQVVVLTNTPLEDQLRVGEFCHNRGIKLVVADTRGLFGQLFCDFGEEMILTDSNGEQPLSAMVSMVTKDNPGVVTCLDEARHGFESGDFVSFSEVQGMVELNGNQPMEIKVLGPYTFSICDTSNFSDYIRGGIVSQVKVPKKISFKSLVASLAEPDFVVTDFAKFSRPAQLHIGFQALHQFCAQHGRPPRPRNEEDAAELVALAQAVNARALPAVQQNNLDEDLIRKLAYVAAGDLAPINAFIGGLAAQEVMKACSGKFMPIMQWLYFDALECLPEDKEVLTEDKCLQRQNRYDGQVAVFGSDLQEKLGKQKYFLVGAGAIGCELLKNFAMIGLGCGEGGEIIVTDMDTIEKSNLNRQFLFRPWDVTKLKSDTAAAAVRQMNPHIRVTSHQNRVGPDTERIYDDDFFQNLDGVANALDNVDARMYMDRRCVYYRKPLLESGTLGTKGNVQVVIPFLTESYSSSQDPPEKSIPICTLKNFPNAIEHTLQWARDEFEGLFKQPAENVNQYLTDPKFVERTLRLAGTQPLEVLEAVQRSLVLQRPQTWADCVTWACHHWHTQYSNNIRQLLHNFPPDQLTSSGAPFWSGPKRCPHPLTFDVNNPLHLDYVMAAANLFAQTYGLTGSQDRAAVATFLQSVQVPEFTPKSGVKIHVSDQELQSANASVDDSRLEELKATLPSPDKLPGFKMYPIDFEKDDDSNFHMDFIVAASNLRAENYDIPSADRHKSKLIAGKIIPAIATTTAAVVGLVCLELYKVVQGHRQLDSYKNGFLNLALPFFGFSEPLAAPRHQYYNQEWTLWDRFEVQGLQPNGEEMTLKQFLDYFKTEHKLEITMLSQGVSMLYSFFMPAAKLKERLDQPMTEIVSRVSKRKLGRHVRALVLELCCNDESGEDVEVPYVRYTIR

SEQ ID NO: 11034 - protein, 447 aa, Homo sapiens
MTSVSQASLDVSMIIIISLGAICAVLLVIMVLFATRCNREKKDTRSYNCRVAESTYQHHPKRPSRQIHKGDITLVPTINGTLPIRSHHRSSPSSSPTLERGQMGSRQSHNSHQSLNSLVTISSNHVPENFSLELTHATPAVEVSQLLSMLHQGQYQPRPSFRGNKYSRSYRYALQDMDKFSLKDSGRGDSEAGDSDYDLGRDSPIDRLLGEGFSDLFLTDGRIPAAMRLCTEECRVLGHSDQCWMPPLPSPSSDYRSNMFIPGEEFPTQPQQQHPHQSLEDDAQPADSGEKKKSFSTFGKDSPNDEDTGDTSTSSLLSEMSSVFQRLLPPSLDTYSECSEVDRSNSLERRKGPLPAKTVGYPQGVAAWAASTHFQNPTTNCGPPLGTHSSVQPSSKWLPAMEEIPENYEEDDFDNVLNHLNDGKHELMDASELVAEINKLLQDVRQS

SEQ ID NO: 11035 - protein, 240 aa, Homo sapiens
MTSVSQASLDVSMIIIISLGAICAVLLVIMVLFATRCNREKKDTRSYNCRVAESTYQHHPKRPSRQIHKGDITLVPTINGTLPIRSHHRSSPSSSPTLERGQMGSRQSHNSHQSLNSLVTISSNHVPENFSLELTHATPAVEVSQLLSMLHQGQYQPRPSFRGNKYSRSYRYALQDMDKFSLKDSGRGDSEAGDSDYDLGRDSPIDRLLGEGFSDLFLTDGRIPASYETLHGGVQGPGTL

SEQ ID NO: 11036 - protein, 180 aa, Homo sapiens
MTSVSQASLDVSMIIIISLGAICAVLLVIMVLFATRCNREKKDTRSYNCRVAESTYQHHPKRPSRQIHKGDITLVPTINGTLPIRSHHRSSPSSSPTLERGQMGSRQSHNSHQSLNSLVTISSNHVPENFSLELTHATPAVERLSASFNASPGAISAKTKFSRKQIFQELQICPSRHGQI

SEQ ID NO: 11037 - protein, 305 aa, Homo sapiens
MPANFTEGSFDSSGTGQTLDSSPVACTETVTFTEVVEGKEWGSFYYSFKTEQLITLWVLFVFTIVGNSVVLFSTWRRKKKSRMTFFVTQLAITEKQARVLIVIAWSLSFLFSIPTLIIFGKRTLSNGEVQCWALWPDDSYWTPYMTIVAFLVYFIPLTIISIMYGIVIRTIWIKSKTYETVISNCSDGKLCSSYNRGLISKAKIKAIKYSIIIILAFICCWSPYFLFDILDNFNLLPDTQERFYASVIIQNLPALNSAINPLIYCVFSSSISFPCREQRSQDSRMTFRERTERHEMQILSKPEFI

SEQ ID NO: 11038 - protein, 43 aa, Homo sapiens
  SITE (8): Xaa equals any amino acid
MSMAMGSXTLLLGWGPGPGWDCGVMRVVLCWLPGGNCQGESST

SEQ ID NO: 11039 - protein, 79 aa, Homo sapiens [sequence omitted]

SEQ ID NO: 11040 - protein, 144 aa, Homo sapiens
MRVPAQLLGLLLLWLSGAKCDTQMTQSPSSLSASVGDTVTITCQASDDISKDLNWFQQKPGTAPKLLIFDASNLETGVPSRFSGSGSGTDFTFTISSLQPEDFATYYCQQYDNPPSLSAEGPKWRSNELWLHHLSSSSRHLMSS

SEQ ID NO: 11041 - protein, 236 aa, Homo sapiens
  SITE (3): Xaa equals any amino acid
  SITE (29): Xaa equals any amino acid
  SITE (70): Xaa equals any amino acid
  SITE (73): Xaa equals any amino acid
  SITE (80): Xaa equals any amino acid
  SITE (97): Xaa equals any amino acid
  SITE (112): Xaa equals any amino acid
  SITE (117): Xaa equals any amino acid
  SITE (122): Xaa equals any amino acid
MEXPAQLLFLLLLWLPDTTGEIVLTQSPXTLSLSPGERATLSCRASQSVSSYLAWYQQKPGQAPRLLIYXASXRATGIPXRFSGSGSGTDFTLTISXLEPEDFAVYYCQQRXNWPPXYTFGXGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 11042 - protein, 10 aa, Homo sapiens
MHVFVLEIFL

SEQ ID NO: 11043 - protein, 84 aa, Homo sapiens
  SITE (36): Xaa equals any amino acid
  SITE (44): Xaa equals any amino acid
YVMIFKKEFAPSDEELDSYRRGEEWDPQKAEEKRNXKELAQRQXGGGSPAGACGGEPCQRLQGQVQPPHRQGSSQRRSPHATGQ

SEQ ID NO: 11044 - protein, 62 aa, Homo sapiens; identical to SEQ ID NO: 8919

SEQ ID NO: 11045 - protein, 149 aa, Homo sapiens
MHPQLIPSVIAVVFILLLGVCFIASCLVTHHNFSRCKRGTGVHKLEHHAKLKCIKEKSELKSAEGSTWNCCPIDWRAFQSNCYFPLTDNKTWAESERNCSGMGAHLMTISTEAEQNFIIQFLDRRLSYFLGLRDENAKGQWRWVGPDAI

SEQ ID NO: 11046 - protein, 63 aa, Homo sapiens
MHPQLIPSVIAVVFILLLGVCFIASCLVTHHNFSRCKRGTGVHKLEHHAKLKCIKEKSELKSC

SEQ ID NO: 11047 - protein, 138 aa, Homo sapiens
  SITE (126): Xaa equals any amino acid
MSLYDDLGVETSDSKTEGWSKNFKLLQSQLQVKKAALTQAKSQRTKQSTVLAPVIDLKRGGSSDDRQIVDTPPHVAAGLKDPVPSGFSAGEVLIPLADEYDPMFPNDYEKVVKRAKRGTTETAGVXKTKGNRRKGKKA

SEQ ID NO: 11048 - protein, 49 aa, Homo sapiens [sequence omitted]

SEQ ID NO: 11049 - protein, 215 aa, Homo sapiens
  SITE (102): Xaa equals any amino acid
  SITE (105): Xaa equals any amino acid
MQILGVVLTLLGWVNGLVSCALPMWKVTAFIGNSIVVAQVVWEGLWMSCVVQSTGQMQCKVYDSLLALPQDLQAARALCVIALLVALFGLLVYLAGAKCTTXFYXKDSKARLVLTSGIVFVISGVLTLIPVCWTAHAIIRDFYNPLVAEAQKRELGASLYLGWAASGLLLLGGGLLCCTCPSGGSQGPSHYMARYSTSAPAISRGPSEYPTKNYV

SEQ ID NO: 11050 - protein, 166 aa, Homo sapiens
MGVPLGLGAAWLLAWPGLALPLVAMAAGGRWVRQQGPRVRRGISRLWLRVLLRLSPMAFRALQGCGAVGDRGLFALYPKTNKDGFRSRLPVPGPRRRNPRTTQHPLALLARVWVLCKGWNWRLARASQGLASHLPPWAIHTLASWGLLRGERPPESPGYYHAASAS

SEQ ID NO: 11051 - protein, 94 aa, Homo sapiens; identical to SEQ ID NO: 8931

SEQ ID NO: 11052 - protein, 89 aa, Homo sapiens; identical to SEQ ID NO: 8932

SEQ ID NO: 11053 - protein, 87 aa, Homo sapiens
  SITE (71): Xaa equals any amino acid
  SITE (86): Xaa equals any amino acid
MVVMASLQVEPAVGKEQLRERQGPELLGWVAGLAFVCLFACVGVGVAPCHSFDSEAASFLLLYSWCTPRLXSWLRDTPSPLASGTXP

SEQ ID NO: 11054 - protein, 49 aa, Homo sapiens
VRAMFGFLACVSSLRVMASSSSHVTSEDMILFLISCGIYVPHFLYPVDR

SEQ ID NO: 11055 - protein, 231 aa, Homo sapiens
MATLWGGLLRLGSLLSLSCLALSVLLLAHCQTPPRISRMSDVNVSALPIKKNSGHIYNKNISQKDCDCLHVVEPMPVRGPDVEAYCLRCECKYEERSSVTIKVTIIIYLSILGLLLLYMVYLTLVEPILKRRLFGHAQLIQSDDDIGDHQPFANAHDVLARSRSRANVLNKVEYGTAALEASSPRAAKSLSLTGMLSSANWGIEFKVTRKKQADNWKGTDWVLLGFILIPC

SEQ ID NO: 11056 - protein, 37 aa, Homo sapiens; identical to SEQ ID NO: 8951

SEQ ID NO: 11057 - protein, 27 aa, Homo sapiens
PHCRWPGLYRQLGRRRRSTALLRCHNV

SEQ ID NO: 11058 - protein, 12 aa, Homo sapiens
AKILVFIFLFEL

SEQ ID NO: 11059 - protein, 34 aa, Homo sapiens
MRAAFIIHYMCFLPVCQLSFAFLVILPGTYVNLH

SEQ ID NO: 11060 - protein, 56 aa, Homo sapiens
MARACVFQLSLWRKLPVGINLSPAILSLSLGCLGLGFLLLLERMTTDSGIRQRRQT

SEQ ID NO: 11061 - protein, 12 aa, Homo sapiens
LVLWIVMLTYAT

SEQ ID NO: 11062 - protein, 22 aa, Homo sapiens
MLTFLIFLFPEVVLGLLRDYSS

SEQ ID NO: 11063 - protein, 63 aa, Homo sapiens
MPCIRGVFHCFILIILILLASHAFSGSGNQRLKEALTLIVSVNVDIARHRPFLERIHVKKGNT

SEQ ID NO: 11064 - protein, 101 aa, Homo sapiens
MEEAILVPCVLGLLLLPILAMLMALCVHCHRLPGSYDSTSSDSLYPKGHPVQTASHGCPLATCLPTCHLLPTPEPARPAPHPKIPAAPWGLPPDAIFPAGF

SEQ ID NO: 11065 - protein, 258 aa, Homo sapiens [sequence omitted]

SEQ ID NO: 11066 - protein, 314 aa, Homo sapiens
GSGRQAGWPRGLLSGPAPSERSAVARLAPTESLARMEAVVNLYQEVMKHADPRIQGYPLMGSPLLMTSILLTYVYFVLSLGPRIMANRKPFQLRGFMIVYNFSLVALSLYIVYEFLMSGWLSTYTWRCDPVDYSNSPEALRMVRVAWLFLFSKFIELMDTVIFILRKKDGQVTFLHVFHHSVLPWSWWWGVKIAPGGMGSFHAMINSSVHVIMYLYYGLSAFGPVAQPYLWWKKHMTAIQLIQFVLVSLHISQYYFMSSCNYQYPVIIHLIWMYGTIFFMLFSNFWYHSYTKGKRLPRALQQNGAPGIAKVKAN

SEQ ID NO: 11067 - protein, 153 aa, Homo sapiens; identical to SEQ ID NO: 8982

SEQ ID NO: 11068 - protein, 178 aa, Homo sapiens [sequence omitted]

SEQ ID NO: 11069 - protein, 178 aa, Homo sapiens [sequence omitted]

SEQ ID NO: 11070 - protein, 178 aa, Homo sapiens [sequence omitted]

SEQ ID NO: 11071 - protein, 273 aa, Homo sapiens
  SITE (153): Xaa equals any amino acid
  SITE (156): Xaa equals any amino acid
  SITE (175): Xaa equals any amino acid
  SITE (190): Xaa equals any amino acid
  SITE (200): Xaa equals any amino acid
  SITE (205): Xaa equals any amino acid
  SITE (244): Xaa equals any amino acid
MSPSGRLCLLTIVGLILPTRGQTLKDTTSSSSADSTIMDIQVPTRAPDAVYTELQPTSPTPTWPADETPQPQTQTQQLEGTDGPLVTDPETHKSTKAAHPTDDTTTLSERPSPSTDVQTDPQTLKPSGFHEDDPFFYDEHTLRKRGLLVAAVXFHXRHHHPHQWQVQAAVPVMPXSLQVSPSETGADNLXGTRRPSPLPXHRAQXPASPRRAWPEREDTDDEAGARAAGPSLLPPPTLPAPEGXLAPWGLSLKLSPLLRQKVKHCGLCKKKKK

SEQ ID NO: 11072 - protein, 178 aa, Homo sapiens [sequence omitted]

SEQ ID NO: 11073 - protein, 93 aa, Homo sapiens [sequence omitted]

SEQ ID NO: 11074 - protein, 65 aa, Homo sapiens
KLSNCNCFQLLSEVGIMVDLISSVLFLQLYYQVLNFGMIVSSALMIWKGLMVITGSESPIVVVLR

SEQ ID NO: 11075 - protein, 56 aa, Homo sapiens; identical to SEQ ID NO: 6901

SEQ ID NO: 11076 - protein, 91 aa, Homo sapiens; identical to SEQ ID NO: 8986

SEQ ID NO: 11077 - protein, 64 aa, Homo sapiens
SATHQQALVCDVLLPVSMCSHENLYILCSGVSYFIFFFSCVTSVTSGLGIPSYPEVRKYSSIFF

SEQ ID NO: 11078 - protein, 249 aa, Homo sapiens; identical to SEQ ID NO: 8987

SEQ ID NO: 11079 - protein, 201 aa, Homo sapiens [sequence omitted]

SEQ ID NO: 11080 - protein, 78 aa, Homo sapiens; identical to SEQ ID NO: 8991

SEQ ID NO: 11081 - protein, 219 aa, Homo sapiens
  SITE (205): Xaa equals any amino acid
  SITE (212): Xaa equals any amino acid
YFSVGQRQCWISFTLTAQNSICCLPCNLRTNTHLLYNPRRGDIKLTQLAMLLAEISSVAHQKDGSFCPIVMCGDFNSVPGSPLYSFIKEGKLNYEGLPIGKVSGQEQSSRGQRILSIPIWPPNLGISQNCVYEVQQVPKVEKTDSDLTQTQLKQTEVLVTAEKLSSNLQHHFSLSSVYSHYFPDTGIPEVTTCHSRSAITVDYIXLLCRKGXCCWAPRS

SEQ ID NO: 11082 - protein, 274 aa, Homo sapiens [sequence omitted]

SEQ ID NO: 11083 - protein, 113 aa, Homo sapiens
  SITE (93): Xaa equals any amino acid
MRPGLSFLLALLFFLGQAAGDLGDVGPPIPSPGFSSFPGVDSSSSFSSSSRSGSSSSRSLGSGGSVSQLFSNFTGSVDDRGTCQCSVSLPDTXFPVDRVERLGIHSSCSFSEV

SEQ ID NO: 11084 - protein, 459 aa, Homo sapiens
  SITE (321): Xaa equals any amino acid
  SITE (345): Xaa equals any amino acid
MGGPRAWALLCLGLLLPGGGAAWSIGAAPFSGRRNWCSYVVTRTISCHVQNGTYLQRVLQNCPWPMSCPGSSYRTVVRPTYKVMYKIVTAREWRCCPGHSGVSCEEVAASSASLEPMWSGSTMRRMALRPTAFSGCLNCSKVSELTERLKVLEAKMTMLTVIEQPVPPTPATPEDPAPLWGPPPAQGSPGDGGLQDQVGAWGLPGPTGPKGDAGSRGPMGMRGPPGPQGPPGSPGRAGAVGTPGERGPPGPPGPPGPPGPPAPVGPPHARISQHGDPLLSNTFTETNNHWPQGPTGPPGPPGPMGPPGPPGPTGVPGSPGXIGPPGPTGPKGISGHPGEKGEKKXLRGEPGPQGSAGQRGEPGPKGDPGEKSHWNQSWGLGGPCRHRHPQPPSGQEGGHATNYRDRGPQEPGRERLRVVAAPEADQARLPLLPGLGQLPPGTARPYLLMSSGSLLPSRP

SEQ ID NO: 11085 - protein, 197 aa, Homo sapiens; identical to SEQ ID NO: 9002

SEQ ID NO: 11086 - protein, 197 aa, Homo sapiens
  SITE (169): Xaa equals any amino acid
  SITE (187): Xaa equals any amino acid
  SITE (194): Xaa equals any amino acid
MWGLLLALAAFAPAVGPALGAPRNSVLGLAQPGTTKVPGSTPALHSSPAQPPAETANGTSEQHVRIRVIKKKKVIMKKRKKLTLTRPTPLVTAGPLVTPTPAGTLDPAEKQETGCPPLGLESLRVSDSRLEASSSQSFGLGPHRGRLNIQSGLEDGDLYDGAWCAEEQXADPWFQVDAGHPTRFSGXITQGRNXVWR

SEQ ID NO: 11087 - protein, 235 aa, Homo sapiens
  SITE (171): Xaa equals any amino acid
  SITE (205): Xaa equals any amino acid
  SITE (210): Xaa equals any amino acid
  SITE (221): Xaa equals any amino acid
MWGLLLALAAFAPAVGPALGAPRNSVLGLAQPGTTKVPGSTPALHSSPAQPPAETANGTSEQHVRIRVIKKKKVIMKKRKKLTLTRPTPLVTAGPLVTPTPAGTLDPAEKQETGCPPLGLESLRVSDSRLEASSSQSFGLGPHRGRLNIQSGLEDGDLYDGAWCAEEQDAXPWFQVDAGHPTRFLGGITQGKELLSGGEGRLTLXQEVQXGLGLGSPGGTXDLSSPFLAGMMGSH

SEQ ID NO: 11088 - protein, 96 aa, Homo sapiens
MYLPCQMACSLFVLFVIWLLLKIFQAGPQLMSLAHGSATLVLDGMNIFGPSGYGQECRVACNYFRKCRVPSWARCLMPVIPALWEAEAADQLRLGV

SEQ ID NO: 11089 - protein, 57 aa, Homo sapiens
LYQEKPLMWPRTSLLYVVPRWLLPCSSLPCPLPEIKNSLTEKKKKKKKNKKKKKGRP

SEQ ID NO: 11090 - protein, 72 aa, Homo sapiens; identical to SEQ ID NO: 9007

SEQ ID NO: 11091 - protein, 79 aa, Homo sapiens
APLAASTILAVASARILAALKSLREFSRSLSPSASALMALTRSDVAWARMRACRTISPASPMELKMFSVTVRMVSVAWS

SEQ ID NO: 11092 - protein, 122 aa, Homo sapiens [sequence omitted]

SEQ ID NO: 11093 - protein, 221 aa, Homo sapiens
  SITE (4): Xaa equals any amino acid
SPLXFCVVLLLQAARGYVVRKPAQSRLDDDPPPSTLLKDYQNVPGIEKVDDVVKRLLSLEMANKKEMLKIKQEQFMKKIVANPEDTRSLEARIIALSVKIRSYEEHLEKHRKDKAHKRYLLMSIDQRKKMLKNLRNTNYDVFEKICWGLGIEYTFPPLYYRRAHRRFVTKKALCIRVFQETQKLKKRRRALKAAAAAQKQAKRRNPDSPAKAIPKTLKDSQ

SEQ ID NO: 11094 - protein, 375 aa, Homo sapiens
MAGIPGLLFLLFFLLCAVGQVSPYSAPWKPTWPAYRLPVVLPQSTLNLAKPDFGAEAKLEVSSSCGPQCHKGTPLPTYEEAKQYLSYETLYANGSRTETQVGIYILSSSGDGAQHRDSGSSGKSRRKRQIYGYDSRFSIFGKDFLLNYPFSTSVKLSTGCTGTLVAEKHVLTAAHCIHDGKTYVKGTQKLRVGFLKPKFKDGGRGANDSTSAMPEQMKFQWIRVKRTHVPKGWIKGNANDIGMDYDYALLELKKPHKRKFMKIGVSPPAKQLPGGRIHFSGYDNDRPGNLVYRFCDVKDETYDLLYQQCDSQPGASGSGVYVRMWKRQHQKWERKIIGMISGHQWVDMDGSPQEFTRGCSEITPLQYIPDISIGV

SEQ ID NO: 11095 - protein, 139 aa, Homo sapiens
  SITE (14): Xaa equals any amino acid
  SITE (116): Xaa equals any amino acid
  SITE (139): Xaa equals any amino acid
MALYELFSHPVERXYRAGLCSKAALFLLLAAALTYIPPLLVAFRSHGFWLKRTATRSSRPCASNTRCCSWPCSDPKATGSSPGARSPPSTGCKGIACASRSFRGGDNACCVKQDSXSLCIYRSDVDSSQNSLVTKGAGX

SEQ ID NO: 11096 - protein, 242 aa, Homo sapiens
  SITE (172): Xaa equals any amino acid
  SITE (197): Xaa equals any amino acid
  SITE (198): Xaa equals any amino acid
  SITE (205): Xaa equals any amino acid
  SITE (214): Xaa equals any amino acid
  SITE (228): Xaa equals any amino acid
  SITE (233): Xaa equals any amino acid
  SITE (236): Xaa equals any amino acid
MHRLAPHCSFARWLLCNGSLFRYKHPSEEELRALAGKPRPRGRKERWANGLSEEKPLSVPRDAPFQLETCPLTTVDALVLRFFLEYQWFVDFAVYSGGVYLFTEAYYYMLGPAKETNIAVFWCLLTVTFSIKMFLTVTRLYFSAEEGGERSVCLTFAFLFLLLAMLVQVVRXETLELGLDLAGSMTQNLEPLLKKQXXDWALPVXKLLSRDCMXLGWCFYFSWVATRXCIEKXYLXKSVCTG

SEQ ID NO: 11097 - protein, 65 aa, Homo sapiens
MPRSSWRPAPSRPWMPWSCASSWSTSGLWTLLCTRAACTSSQRPTTTCWDQPRRLTLLCSGACSR

SEQ ID NO: 11098 - protein, 66 aa, Homo sapiens
  SITE (14): Xaa equals any amino acid
  SITE (28): Xaa equals any amino acid
SQLLGRLRQENRLXPGGGGWSERRSCHXTPAWVTERQTVSKKKKKKKNVRKEVESYFHLYFSHCLA

SEQ ID NO: 11099 - protein, 13 aa, Homo sapiens
MKSLHGRLLWQSA

SEQ ID NO: 11100 - protein, 132 aa, Homo sapiens
  SITE (122): Xaa equals any amino acid
MAAAVAAALARLLAAFLLLAAQVACEYGMVHVVSQAGGPEGKDYCILYNPQWAHLPHDLSKASFLQLRNWTASLLCSAADLPARGFSNQIPLVARGNCTFYEKVRLAQGSGHAGCSSSAGRXWSPRGVIRRI

SEQ ID NO: 11101 - protein, 207 aa, Homo sapiens
  SITE (148): Xaa equals any amino acid
  SITE (186): Xaa equals any amino acid
MADSSYTSEVQAILAFLSLQRTGSGGPGNHPHGPDASAEGLNPYGLVAPRFQRKFKAKQLTPRILEAHQNVAQLSLAEAQLRFIQAWQSLPDFGISYVMVRFKGSRKDEILGIANNRLIRIDLAVGDVVKTWRFSNMRQWNVNWDIRXVAIEFDEHINVAFSCVSASCRIVHEYIGGYIFLSTREXARGEELDEDLFLQLTGGHEAF

SEQ ID NO: 11102 - protein, 82 aa, Homo sapiens; identical to SEQ ID NO: 9033

SEQ ID NO: 11103 - protein, 115 aa, Homo sapiens [sequence omitted]

SEQ ID NO: 11104 - protein, 39 aa, Homo sapiens [sequence omitted]

SEQ ID NO: 11105 - protein, 54 aa, Homo sapiens
GTLQRGFLLCSLVPGWGWGTPAALTDGSPFSLSGHPSPTLTCTKFSPQLLCVAP

SEQ ID NO: 11106 - protein, 336 aa, Homo sapiens
  SITE (224): Xaa equals any amino acid
MALARPVRLFSLVTRLLLAPRRGLTVRSPDEPLPVVRIPVALQRQLEQRQSRRRNLPRPVLVRPGPLLVSARRPELNQPARLTLGRWERAPLASQGWKSRRARRDHFSIERAQQEAPAVRKLSSKGSFADLGLEPRVLHALQEAAPEVVQPTTVQSSTIPSLLRGRHVVCAAETGSGKTLSYLLPLLQRLLGQPSLDSLPIPAPRGLVLVPSRELAQQVRAVAXPLGRSLGLLVRDLEGGHGMRRIRLQLSRQPSADVLVATPGALWKALKSRLISLEQLSFLVLDEADTLLDESFLELVDYILEKSHIAEGPADLEDPFNPKAQLVLVGATFPEV

SEQ ID NO: 11107 - protein, 336 aa, Homo sapiens
MALARPVRLFSLVTRLLLAPRRGLTVRSPDEPLPVVRIPVALQRQLEQRQSRRRNLPRPVLVRPGPLLVSARRPELNQPARLTLGRWERAPLASQGWKSRRARRDHFSIERAQQEAPAVRKLSSKGSFADLGLEPRVLHALQEAAPEVVQPTTVQSSTIPSLLRGRHVVCAAETGSGKTLSYLLPLLQRLLGQPSLDSLPIPAPRGLVLVPSRELAQQVRAVAQPLGRSLGLLVRDLEGGHGMRRIRLQLSRQPSADVLVATPGALWKALKSRLISLEQLSFLVLDEADTLLDESFLELVDYILEKSHIAEGPADLEDPFNPKAQLVLVGATFPEV

SEQ ID NO: 11108 - protein, 115 aa, Homo sapiens; identical to SEQ ID NO: 9040

SEQ ID NO: 11109 - protein, 146 aa, Homo sapiens
  SITE (96): Xaa equals any amino acid
  SITE (107): Xaa equals any amino acid
  SITE (111): Xaa equals any amino acid
  SITE (115): Xaa equals any amino acid
  SITE (122): Xaa equals any amino acid
  SITE (132): Xaa equals any amino acid
MEPQLGPEAAALRPGWLALLLWVSALSCSFSLPASSLSSLVPQVRTSYNFGRTFLGLDKCNACIGTSICKKFFKEEIRSDNWLASHLGTASRFPLXSYPCKLLQMIXKIWXPCGXLLTGQQXSNEISKQEIXCLLHPPPKNLHIDV

SEQ ID NO: 11110 - protein, 182 aa, Homo sapiens
MEPQLGPEAAALRPGWLALLLWVSALSCSFSLPASSLSSLVPQVRTSYNFGRTFLGLDKCNACIGTSICKKFFKEEIRSDNWLASHLGLPPDSLLSYPANYSDDSKIWRPVEIFRLVSKYQNEISDRKICASASAPKTCSIERVLRKTERFQKWLQAKRLTPDLVQDCHQGQRELKFLCMLR

SEQ ID NO: 11111 - protein, 79 aa, Homo sapiens
MEPQLGPEAAALRPGWLALLLWVSALSCSFSLPASSLSSLVPQVRTSYNFGRTFLGLDKCNACIGTSICKKFFKERNKI

SEQ ID NO: 11112 - protein, 146 aa, Homo sapiens; identical to SEQ ID NO: 11109
  SITE (96): Xaa equals any amino acid
  SITE (107): Xaa equals any amino acid
  SITE (111): Xaa equals any amino acid
  SITE (115): Xaa equals any amino acid
  SITE (122): Xaa equals any amino acid
  SITE (132): Xaa equals any amino acid

SEQ ID NO: 11113 - protein, 363 aa, Homo sapiens; identical to SEQ ID NO: 9043

SEQ ID NO: 11114 - protein, 52 aa, Homo sapiens
MALLLLQALPSPLSARAEPPQDKEACVGTNNQSYICDTGHCCGQSQCCKLLL

SEQ ID NO: 11115 - protein, 118 aa, Homo sapiens
LLLLQALPSPLSARAEPPQDKEACVGTNNQSYICDTGHCCGQSQCCNYYYELWWFWLVWTIIIILSCCCVCHHRRAKHRLQAQQRQHEINLIAYREAHNYSALPFYFRFLPNYLLPPL

SEQ ID NO: 11116 - protein, 201 aa, Homo sapiens
  SITE (10): Xaa equals any amino acid
  SITE (19): Xaa equals any amino acid
LSSLLPQRLXEPSSSSPGXRTWQLSQKSRGPSRASSMSVLNSLRSSSWWPRLHTHTSMPESPVKRRCLPGVFSLLSGAPCSELSSFSSSSLHSASLSRKAPGSSSPRPATEPLGSIPGALVAARSTGRSEGSGSAMLGGLVLLLLGSDKGLLCAPWDPLVGSMPGGLPPAGPHCGGSSCCCCSWKALYGGGGVGGRFTTSS

SEQ ID NO: 11117 - protein, 106 aa, Homo sapiens
  SITE (36): Xaa equals any amino acid
GSDGPRERAPVAWLSHSILSLILNKYFLWGFFFFLXAVVCFKLTTWKKHLGYLWFSCLVPASTPTPFESGDSFFCVETRWPRQEVKAAIRKALGTLVPVARLQVTS

SEQ ID NO: 11118 - protein, 123 aa, Homo sapiens
  SITE (5): Xaa equals any amino acid
MAALXTVLFTGVRRLHCSAAAWAGGQWRLQQGLAANPSGYGPLTELPDWSYADGRPAPPMKGQLRRKAERETFARRVVLLSQEMDAGLQAWQLRQQKLQEEQRKQENALKPKGASLKSPLPSQ

SEQ ID NO: 11119 - protein, 181 aa, Homo sapiens
  SITE (132): Xaa equals any amino acid
  SITE (139): Xaa equals any amino acid
  SITE (168): Xaa equals any amino acid
  SITE (170): Xaa equals any amino acid
  SITE (181): Xaa equals any amino acid
MNLSTALLFLNLLFLLDGWITSFNVDGLCIAVAVLLHFFLLATFTWMGLEAIHMYIALVKVFNTYIRRYILKFCIIGWGLPALVVSVVLASRNNNEVYGKESYGKEKGDEFCWIQDPVIFYVTCAGYFGVMXFLNIAMXIVVMVQICGRNGKRSNRTLREEVVRNLRXVXSLTFLVGMTWX

SEQ ID NO: 11120 - protein, 118 aa, Homo sapiens
CRGDIQIRDKGEAMLRKTLDRAHFTPPNRYIWIYPFSASSFSTIKNVTILNAHKSHSSVTFCECSTIFSFSMTFQPQAEKTVYSLTQRLKRIFYYFKYYTFRTITCLRKLSQNVDLVK

SEQ ID NO: 11121 - protein, 359 aa, Homo sapiens
MAVRALKLLTTLLAVVAAASQAEVESEAGWGMVTPDLLFAEGTAAYARGDWPGVVLSMERALRSRAALRALRLRCRTQCAADFPWELDPDWSPSPAQASGAAALRDLSFFGGLLRRAACLRRCLGPPAAHSLSEEMELEFRKRSPYNYLQVAYFKINKLEKAVAAAHTFFVGNPEHMEMQQNLDYYQTMSGVKEADFKDLETQPHMQEFRLGVRLYSEEQPQEAVPHLEAALQEYFVAYEECRALCEGPYDYDGYNYLEYNADLFQAITDHYIQVLNCKQNCVTELASHPSREKPFEDFLPSHYNYLQFAYYNIGNYTQAVECAKTYLLFFPNDEVMNQNLALLCSYAWRRTHQIHRPP

SEQ ID NO: 11122 - protein, 173 aa, Homo sapiens
MAVRALKLLTTLLAVVAAASQAEVESEAGWGMVTPDLLFAEGTAAYARGDWPGVVLSMERALRSRAALRALRLRCRTQCAADFPWELDPDWSPSPAQASGAAALRDLSFFGGLLRRAACLRRCLGPPAATRSAKRWSWSSASGPLQLPAGRLLQDQQVGESCCCSTHLLRGQS

SEQ ID NO: 11123 - protein, 497 aa, Homo sapiens
  SITE (183): Xaa equals any amino acid
MFLDRPQQWLQLVLLPPALFIPSTENEEQRLASARAVPRNVQPYVVYEEVTNVWINVHDIFYPFPQSEGEDELCFLRANECKTGFCHLYKVTAVLKSQGYDWSEPFSPGEDEFKCPIKEEIALTSGEWEVLARHGSKIWVNEETKLVYFQGTKDTPLEHHLYVVSYEAAGEIVRLTTPGFSHXCSMSQNFDMFVSHYSSVSTPPCVHVYKLSGPDDDPLHKQPRFWASMMEAASCPPDYVPPEIFHFHTRSDVRLYGMIYKPHALQPGKKHPTVLFVYGGPQVQLVNNSFKGIKYLRLNTLASLGYAVVVIDGRGSCQRGLRFEGALKNQMGQVEIEDQVEGLQFVAEKYGFIDLSRVAIHGWSYGGFLSLMGLIHKPQVFKVAIAGAPVTVWMAYDTGYTERYMDVPENNQHGYEAGSVALHVEKLPNEPNRLLILHGFLDENVHFFHTNFLVSQLIRAGKPYQLQIYPNERHSIRCPESGEHYEVTLLHFLQEYL

SEQ ID NO: 11124 - protein, 349 aa, Homo sapiens
  SITE (183): Xaa equals any amino acid
  SITE (191): Xaa equals any amino acid
  SITE (192): Xaa equals any amino acid
  SITE (334): Xaa equals any amino acid
  SITE (344): Xaa equals any amino acid
  SITE (345): Xaa equals any amino acid
  SITE (348): Xaa equals any amino acid
MFLDRPQQWLQLVLLPPALFIPSTENEEQRLASARAVPRNVQPYVVYEEVTNVWINVHDIFYPFPQSEGEDELCFLRANECKTGFCHLYKVTAVLKSQGYDWSEPFSPGEDEFKCPIKEEIALTSGEWEVLARHGSKIWVNEETKLVYFQGTKDTPLEHHLYVVSYEAAGEIVRLTTPGFSHXCSMSQNFXXFVSHITAQVAAASAGNQAGGTEWPAGPSEALCPAQRWPAPRSRCLHRPDAFYPFLNALGFYVRCFLVAETERWWSRASPSSPRLLGGGGHTLMGTGEARRDSEERAAFRLGLPVTSQSPGPASHRPQHPSMQLPVPPGQPPXLDVCVLFGGXXFIXI

SEQ ID NO: 11125 - protein, 144 aa, Homo sapiens
APFLPKPEQRVMRAPQEKRPGPAGGTTCGQPSCPQAFRQALKRTELPRSAGQWRLSPPQPSRPATCVCLTRTHQGFRGWELNHPHLRVIFPSPLPSPPRALPGAGKKKSKKKRKKKKRNKPPLHIMERKYFCRFLFFYNYAWKK

SEQ ID NO: 11126 - protein, 164 aa, Homo sapiens
  SITE (76): Xaa equals any amino acid
  SITE (112): Xaa equals any amino acid
  SITE (146): Xaa equals any amino acid
MRTLVELGPWAGDFGPDLLLTLLFLLFLAHGVTLDGASANPTVSLQEFLMAEQSLPGTLLKLAAQGLGMQAACTLXRLCWAWELSDLHLLQSLMAQSCSSALRTSVPHGALXEAACTFCFHLTLLHLRHSPPAYSGPAVALLVTVXAYTAGPYVCFFNPALAAL

SEQ ID NO: 11127 - protein, 95 aa, Homo sapiens; identical to SEQ ID NO: 9051

SEQ ID NO: 11128 - protein, 189 aa, Homo sapiens
  SITE (81): Xaa equals any amino acid
  SITE (163): Xaa equals any amino acid
VQLSVPAGMLHSLCVQLFITAGSLCATHSQCLSKADGARPSILYLTCPLHSPIKNGPQIRVEEADVSSSETALPRSRRDGXAKPGCETGCCMWLQALNIVTWRLPQHIVRSKPQEPEQQNSCHPQKPAPGTAVQIGRRSSQQWLLRTPLTQQRSPDACRSPEXALSALDMAGDTQVWPSQSLFAKLKVK

SEQ ID NO: 11129 - protein, 82 aa, Homo sapiens
  SITE (45): Xaa equals any amino acid
  SITE (76): Xaa equals any amino acid
MGLQSRLSQPCHCRHLGLGNSVVGTVLFLVGCLVASLPPPTRCQXHCSPQPPAPVVTIVSKHCQMVQGKGKIAPVXKSTAVK

SEQ ID NO: 11130 - protein, 86 aa, Homo sapiens
  SITE (3): Xaa equals any amino acid
  SITE (5): Xaa equals any amino acid
  SITE (6): Xaa equals any amino acid
KKXPXXLSGSKAIASKTKEIEQVYRQDCETFGMVVKMLIEKDPSLEKSIQFALRQNLHEIGERCVEELKHFIAEYDTSTQDFGEPF

SEQ ID NO: 11131 - protein, 53 aa, Homo sapiens
  SITE (4): Xaa equals any amino acid
  SITE (10): Xaa equals any amino acid
  SITE (27): Xaa equals any amino acid
IGPXGPRNSXTGGAFLDFSAQAKKKKXQFLKIFFPGLCKSLIYGIFVMQRNTL

SEQ ID NO: 11132 - protein, 193 aa, Homo sapiens; identical to SEQ ID NO: 9056

SEQ ID NO: 11133 - protein, 22 aa, Homo sapiens
MVCDSLPRHDFHPARLHPTRFL

SEQ ID NO: 11134 - protein, 130 aa, Homo sapiens
  SITE (37): Xaa equals any amino acid
MKKFSYAFLYFPSLNFTVSTWLCTALFLLHSHHLLAXCGSTFAQVCLVSESMSPFLGRLCRTSVPCAGATAFPADSDRHCNGFPAGAEVTNRPSPWRPLVLLIPLRLGLTDINEAYVETLKVGPAVRRLP

SEQ ID NO: 11135 - protein, 16 aa, Homo sapiens
PASQKAVSAWRCPAHV

SEQ ID NO: 11136 - protein, 108 aa, Homo sapiens
  SITE (29): Xaa equals any amino acid
  SITE (37): Xaa equals any amino acid
  SITE (99): Xaa equals any amino acid
GACRGSSEPGATPRPDGEPRPLPGLHCAXGMPTPLPXSPLGLRSLRRVGWPVRKGRVGRAWGWAGLCEELQPQAPPCHESKRGRGAVAHDCNPSTLGGXSGQITRSGV

SEQ ID NO: 11137 - protein, 17 aa, Homo sapiens
MRVVSGTLFIHFLVLIF

SEQ ID NO: 11138 - protein, 52 aa, Homo sapiens
  SITE (4): Xaa equals any amino acid
  SITE (25): Xaa equals any amino acid
CALXFEFFFFFFFLRWSLGNKARLXQKKKKKKKTSVGKNMENWNPDTLLVGL

SEQ ID NO: 11139 - protein, 81 aa, Homo sapiens [sequence omitted]

SEQ ID NO: 11140 - protein, 202 aa, Homo sapiens
  SITE (176): Xaa equals any amino acid
  SITE (181): Xaa equals any amino acid
  SITE (195): Xaa equals any amino acid
  SITE (200): Xaa equals any amino acid
MALSGGLRCCRRVLSWVPVLVIVLVVLWSYYAYVFELCLVTVLSPAEKVIYLILYHAIFVFFTWTYWKSIFTLPQQPNQKFHLSYTDKERYENEERPEVQKQMLVDMAKKLPVYTRTGSGAVRFCDRCHLIKPDRCHHCSVCAMCVLKMDHHCPWVNNCIGFSNYKFFLQFLAYSXLYCLXIATTVFSYFIKYWXGELPXVA

SEQ ID NO: 11141 - protein, 96 aa, Homo sapiens [sequence omitted]

SEQ ID NO: 11142 - protein, 77 aa, Homo sapiens
FVLLHCLNSHLHLALQFPLNTLSSPLVCCQSAALPIKACINYICPMFTFIKHFPCTPVPTSQQTRERAVQLMSLPSF

SEQ ID NO: 11143 - protein, 87 aa, Homo sapiens
  SITE (1): Xaa equals any amino acid
  SITE (26): Xaa equals any amino acid
XHSHWEGLKLCCLNPVLGPARKRKRXLRNRGARGGCRCHSRAALHPHPHASCFTAHSVTELVALGTGGHPHTLMPTAEGRATHPSRD

SEQ ID NO: 11144 - protein, 101 aa, Homo sapiens
  SITE (101): Xaa equals any amino acid
MTLCLVTFLTSLPTSVPACTSCWPGFMRSSKNAYDTHHWGGQRSMNLESLTCGQLAIRWTRGWMTRPRQVWAMPGQTVDVYLGRMLQGVVLRGQTLRGRAX

SEQ ID NO: 11145 - protein, 50 aa, Homo sapiens
KAVTGWAHWLTPIIPALWEAKAGRSLEVRISRPAWSTWQNLVSTKNTKIR

SEQ ID NO: 11146 - protein, 56 aa, Homo sapiens; identical to SEQ ID NO: 9067

SEQ ID NO: 11147 - protein, 148 aa, Homo sapiens
  SITE (71): Xaa equals any amino acid
  SITE (125): Xaa equals any amino acid
MRSSCVLLTALVALAAYYVYIPLPGSVSDPWKLMLLDATFRGAQQVSNLIHYLGLSHHLLALNFIIVSFGXKSAWSSAQVKVTDTDFDGVEVRVFEGPPKPEEPLKRSVVYIHGGGWALASAKIXYYDELCTAMAEELNAALFPLNTG

SEQ ID NO: 11148 - protein, 148 aa, Homo sapiens; identical to SEQ ID NO: 11147
  SITE (71): Xaa equals any amino acid
  SITE (125): Xaa equals any amino acid

SEQ ID NO: 11149 - protein, 5 aa, Homo sapiens
SFATC

SEQ ID NO: 11150 - protein, 10 aa, Homo sapiens
WASMSSVFGL

SEQ ID NO: 11151 - protein, 57 aa, Homo sapiens
ISYHHVKASHLKIKIQISLKPEVLVPLHCLPLSPTPREESGGFLFSIAIAAVGFLVQ

SEQ ID NO: 11152 - protein, 63 aa, Homo sapiens
MITFLPIIFSILVVVTFVIGNFANGFIALVNSTEWVKRQKISFADQIVTALAVSRVGLLWVLL

SEQ ID NO: 11153 - protein, 7 aa, Homo sapiens
TYIHFLD

SEQ ID NO: 11154 - protein, 8 aa, Homo sapiens
LTMLFNVI

SEQ ID NO: 11155 - protein, 352 aa, Homo sapiens
VSLLLWGISIRGADACADAHLFCKECLIRYAQEAVFGSGKLELSCMEGSCTCSFPTSELEKVLPQTILYKYYERKAEEEVAAAYADELVRCPSCSFPALLDSDVKRFSCPNPHCRKETCRKCQGLWKEHNGLTCEELAEKDDIKYRTSIEEKMTAARIRKCHKCGTGLIKSEGCNRMSCRCGAQMCYLCRVSINGYDHFCQHPRSPGAPCQECSRCSLWTDPTEDDEKLIEEIQKEAEEEQKRKNGENTFKRIGPPLEKPVEKVQRVEALPRPVPQNLPQPQMPPYAFAHPPFPLPPVRPVFNNFPLNMGPIPAPYVPPLPNVRVNYDFGPIHMPLEHNLPMHFGPQPRHRF

SEQ ID NO: 11156 - protein, 157 aa, Homo sapiens
MYCYPGSHLARALTRALALALVLALLVGPFLSGLAGAIPAPGGRWARDGPVPPASRSRSVLLDVSAGQLLMVDGRHPDAVAWANLTNAIRETGWAFLELGTSGQYNDSLQDPEPAGGQRSHVGPGAPVQWSTSPFSGLLHMGQPDLWKFAPVKVSWD

SEQ ID NO: 11157 - protein, 2 aa, Homo sapiens
GC

SEQ ID NO: 11158 - protein, 22 aa, Homo sapiens
LVLFITLLPGKLAHSWHTVNVQ

SEQ ID NO: 11159 - protein, 53 aa, Homo sapiens
  SITE (35): Xaa equals any amino acid
TEEFKYAVSCNCGTAAWVRVRERERKREKKKKKRXAALEDPSRGPSLRVHATS

SEQ ID NO: 11160 - protein, 96 aa, Homo sapiens
  SITE (75): Xaa equals any amino acid
MTLPTSQCLICLLQALCGIGHGALAWGSNQVLFPGGQQEDGGCQRIPDPSFLSTPCGKQGGHAEQELQQCWGAFXQLPGCVLHFHPGVLHKAHSEW

SEQ ID NO: 11161 - protein, 79 aa, Homo sapiens [sequence omitted]

SEQ ID NO: 11162 - protein, 46 aa, Homo sapiens
MRIPVFPKQLMFTGLVFLLLLSKDEGIHNRLSLENTNDGQLFGVIK

SEQ ID NO: 11163 - protein, 53 aa, Homo sapiens [sequence omitted]

SEQ ID NO: 11164 - protein, 129 aa, Homo sapiens
  SITE (99): Xaa equals any amino acid
  SITE (106): Xaa equals any amino acid
  SITE (121): Xaa equals any amino acid
  SITE (123): Xaa equals any amino acid
  SITE (127): Xaa equals any amino acid
MQAGKGLAQVWGVATFVQLCAHTVFLSMYLCMHICFAAISSKVRVRVNAPFCVSVPLKVHAPLSLGIKVGLQGQKHGRATGEAGMPQGEMLGKQEPQTXSSPKPTXRREVSRNELNPVIPXAXNPFXKK

SEQ ID NO: 11165 - protein, 467 aa, Homo sapiens
  SITE (151): Xaa equals any amino acid
  SITE (160): Xaa equals any amino acid
LGPAGLRRRTKRRKRGDNSTDTTQGDPLSIHHYFHGYLAGFSVRSGRLESREVIECLYACREGLDYRDFESLGKGMKVHVNPSQSLLTLEGDDVETFNHALQHVAYMNTLRFATPGVRPLRLTTAVKCFSEESCVSIPEVEGYVVVLQPDXPQILLSGTXHFARPAVDFEGTNGVPLFPDLQITCSISHQVEAKKDESWQGTVTDTRMSDEIVHNLDGCEISLVGDDLDPERESLLLDTTSLQQRGLELTNTSAYLTIAGVESITVYEEILRQARYRLRHGAALYTRKFRLSCSEMNGRYSSNEFIVEVNVLHSMNRVAHPSHVLSSQQFLHRGHQPPPEMAGHSLASSHRNSMIPSAATLIIVVCVGFLVLMVVLGLVRIHSLHRRVSGAGGPPGASSDPKDPDLFWDDSALTIIVNPMESYQNRQSCVTGAVGGQQEDEDSSDSEVADSPSSDERRIIETPPHRY

SEQ ID NO: 11166 - protein, 19 aa, Homo sapiens
  SITE (7): Xaa equals any amino acid
  SITE (11): Xaa equals any amino acid
MPFTLGXTRRXRGLAKKPK

SEQ ID NO: 11167 - protein, 230 aa, Homo sapiens
MTGLYELVWRVLHALLCLHRTLTSWLRVRFGTWNWIWRRCCRAASAAVLAPLGFTLRKPPAVGRNRRHHRHPRGGSCLAAAHHRMRWRADGRSLEKLPVHMGLVITEVEQEPSFSDIASLVVWCMAVGISYISVYDHQGIFKRNNSRLMDEILKQQQELLGLDCSKYSPEFANSNDKDDQVLNCHLAVKVLSAGRWKSRYCKSCSGLLPVSSPEAKETHRFGCRYVSQFT

SEQ ID NO: 11168 - protein, 17 aa, Homo sapiens
MLSGSLGSAVCMSSQPR

SEQ ID NO: 11169 - protein, 125 aa, Homo sapiens
  SITE (46): Xaa equals any amino acid
AQRNPGAVPAVWRQAGVTFTSAKGRSSPYWSLHPQIILLRKLSSSXQKPRSSSAQCGRNAAAGLPHCLRASWSRLLKIEWQVGLAWAGADVLCGHPVPKRPPTLGPQTSGADWHLRGHSPTHLLQ

SEQ ID NO: 11170 - protein, 39 aa, Homo sapiens
MRRPAAVPLLLLLCFGSQRAKAATACGRPRMLNRMVGGQ

SEQ ID NO: 11171 - protein, 69 aa, Homo sapiens; identical to SEQ ID NO: 9089

SEQ ID NO: 11172 - protein, 241 aa, Homo sapiens
  SITE (229): Xaa equals any amino acid
  SITE (230): Xaa equals any amino acid
  SITE (236): Xaa equals any amino acid
MALRLLRRAARGAAAAALLRLKASLAADIPRLGYSSSSHHKYIPRRAVLYVPGNDEKKIKKIPSLNVDCAVLDCEDGVAANKKNEARLRIVKTLEDIDLGPTEKCVRVNSVSSGLAEEDLETLLQSRVLPSSLMLPKVESPEEIQWFADKFSFHLKGRKLEQPMNLIPFVETAMGLLNFKAVCEETLKVGPQVGLFLDAVVFGGEDFRASIGATSSKETLGYSLRPAKXXCHSETXWVSKP

SEQ ID NO: 11173 - protein, 267 aa, Homo sapiens
MTGQIPRLSKVNLFTLLSLWMELFPAEAQRQKSQKNEEGKHGPLGDNEERTRVSTDKRQVKRTGLVVVKNMKIVGLHCSSEDLHAGQIALIKHGSRLKNCDLYFSRKPCSACLKMIVNAGVNRISYWPADPEISLLTEASSSEDAKLDAKAVERLKSNSRAHVCVLLQPLVCYMVQFVEETSYKCDFIQKITKTLPDANTDFYYECKQERIKEYEMLFLVSNEEMHKQILMTIGLENLCENPYFSNLRQNMKDLILLLATVASMCRL

SEQ ID NO: 11174 - protein, 222 aa, Homo sapiens
MTGQIPRLSKVNLFTLLSLWMELFPAEAQRQKSQKNEEGKHGPLGDNEERTRVSTDKRQVKRTGLVVVKNMKIVGLHCSSEDLHAGQIALIKHGSRLKNCDLYFSRKPCSACLKMIVNAGVNRISYWPADPEISLLTEASSSEDAKLDAKAVERLKSNSRAHVCVLLQPLVCYMVQFVEETSYKCDFIQKITKTLPDANTDFYYECKQERIKEYEMLKKKKK

SEQ ID NO: 11175 - protein, 105 aa, Homo sapiens
  SITE (71): Xaa equals any amino acid
  SITE (104): Xaa equals any amino acid
ILKVLKVWSFQLFQIAVCDFSHFYLLRNIHKIIPKMKVHFLFSPRLERGGLGCFMRNVFLDLRWSGLPLLXFPAFPPHHTASLGFLPVSQNYTHDHPNIGSMPXL

SEQ ID NO: 11176 - protein, 196 aa, Homo sapiens
  SITE (157): Xaa equals any amino acid
  SITE (169): Xaa equals any amino acid
  SITE (171): Xaa equals any amino acid
  SITE (172): Xaa equals any amino acid
  SITE (174): Xaa equals any amino acid
  SITE (179): Xaa equals any amino acid
  SITE (191): Xaa equals any amino acid
MYLLEQIDMHGFGGTAATSPLTAVFSLSRSLLAAALLYGFCLGAIKTPWPEQHVPVLFSVFCGLLVALSYHLSRQSSDPTVLWSLIRSKLFPELEERSLETARAEPPDPLPDKMRQSVREVLHSDLVMCVVIAVLTFAISASTVFIALKSVLGFVLXALAGGRGLLHTXPXXTXPQNSXPGSACHSRAETXGIQPG

SEQ ID NO: 11177 - protein, 62 aa, Homo sapiens
  SITE (22): Xaa equals any amino acid
  SITE (52): Xaa equals any amino acid
HIISAHVSFTRKLILYSNTWQXAGSRALRVTLADQSPIPPFWVVGSLFCPRXAEASESLSVP

SEQ ID NO: 11178 - protein, 99 aa, Homo sapiens [sequence omitted]

SEQ ID NO: 11179 - protein, 177 aa, Homo sapiens
  SITE (145): Xaa equals any amino acid
  SITE (175): Xaa equals any amino acid
MKLLLLHPAFQSCLLLTLLGLWRTTPEAHASSPGAPAISAASFLQDLIHRYGEGDSLTLQQLKALLNHLDVGVGRGNVTQHVQGHRNLSTCFSSGDLFTAHNFSEQSRIGSSELQEFCPTILQQLDSRACTSENQENEENEQTEXGRPSAVEVWGYGLLCVTVSPSAPSWGPAWXPS

SEQ ID NO: 11180 - protein, 171 aa, Homo sapiens
GPWPLCKAQRCAPDQPSGLPWARLGVRVAHWGGGGLARHSTLAGGPSQREPCRLRWSWPLAGCPGSAPPLQGPSRNLLLNGKSYPTKVRLIRGGSLPPVKRRRMNWIDAPDDVFYMATEETRKIRKLLSSSETKRAARRPYKPIALRQSQALPPRPPPPAPVNDEPIVIED

SEQ ID NO: 11181 - protein, 147 aa, Homo sapiens; identical to SEQ ID NO: 9096

SEQ ID NO: 11182 - protein, 147 aa, Homo sapiens
  SITE (119): Xaa equals any amino acid
MWLWVWLIHTLHSGLQKPRERSLPEATFQNLLHPPTDLPSPCPLFESRCQVLPADTWLLEGRCSFHLTMQACFAVGRAVLSSSQLHTGITWRVQKLPASVKEHQCISTANIPNARLDSXQLPGPPGFSSFQELSDPGSSLNVGYKLT

SEQ ID NO: 11183 - protein, 149 aa, Homo sapiens
  SITE (140): Xaa equals any amino acid
MVLLWASVLFPAPEDWAELQGAVYRLLVVLLCCLATRKLPHFLHPQRNLLQGSGLDLGAIYQRVEGFASQPEAALRIHATHLGRSPPPRIGSGLKALLQLPASDPTYWATAYFDVLLDKFQVFNIQDKDRISAMQSIFQXTRTLGGEES

SEQ ID NO: 11184 - protein, 305 aa, Homo sapiens
MGRPRPRAAKTWMFLLLLGGAWAACGSLDLLTKLYAENLPCVHLNPQWPSQPSHCPRGWRSNPLPPAAGHSRAQEDKVLGGHECQPHSQPWQAALFQGQQLLCGGVLVGGNWVLTAAHCKKPKYTVRLGDHSLQNKDGPEQEIPVVQSIPHPCYNSSDVEDHNHDLMLLQLRDQASLGSKVKPISLADHCTQPGQKCTVSGWGTVTSPRENFPDTLNCAEVKIFPQKKCEDAYPGQITDGMVCAGSSKGADTCQGDSGGPLVCDGALQGITSWGSDPCGRSDKPGVYTNICRYLDWIKKIIGSKG

SEQ ID NO: 11185 - protein, 44 aa, Homo sapiens; identical to SEQ ID NO: 9100

SEQ ID NO: 11186 - protein, 86 aa, Homo sapiens
  SITE (6): Xaa equals any amino acid
  SITE (21): Xaa equals any amino acid
  SITE (31): Xaa equals any amino acid
  SITE (76): Xaa equals any amino acid
LGSPEXAQKVDITSAHFIGQXSRPSDFAQVXSLEGSRPVIWSLNGWTLKETPRADGVFTETAGQGLGTAQGHLLWXAAATGSPDCS

SEQ ID NO: 11187 - protein, 264 aa, Homo sapiens; identical to SEQ ID NO: 9101

SEQ ID NO: 11188 - protein, 205 aa, Homo sapiens
  SITE (40): Xaa equals any amino acid
  SITE (189): Xaa equals any amino acid
MGSWALLWPPLLFTGLLVRPPGTMAQAQYCSVNKDIFEVXENTNVTEPLVDIHVPEGQEVTLGALSTPFAFRIQGNQLFLNVTPDYEEKSLLEAQLLCQSGGTLVTQLRVFVSVLDVNDNAPEFPFKTKEIRVEEDTKVNSTVIPETQLQAEDRDKDDILVYTLQEMTAGASGLLLLVSVNRPPELDRXLTSTSGEHDLLLAGAD

SEQ ID NO: 11189 - protein, 447 aa, Homo sapiens
  SITE (260): Xaa equals any amino acid
FPAGAASTVLAHNKMLKVSAVLCVCAAAWCSQSLAAAAAVAAAGGRSDGGNFLDDKQWLTTISQYDKEVGQWNKFRDDDYFRTWSPGKPFDQALDPAKDPCLKMKCSRHKVCIAQDSQTAVCISHRRLTHRMKEAGVDHRQWRGPILSTCKQCPVVYPSPVCGSDGHTYSFQCKLEYQACVLGKQISVKCEGHCPCPSDKPTSTSRNVKRACSDLEFREVANRLRDWFKALHESGSQNKKTKTLLRPERSRFDTSILPIXKDSLGWMFNRLDTNYDLLLDQSELRSIYLDKNEQCTKAFFNSCDTYKDSLISNNEWCYCFQRQQDPPCQTELSNIQKRQGVKKLLGQYIPLCDEDGYYKPTQCHGSVGQCWCVDRYGNEVMGSRINGVADCAIDFEISGDFASGDFHEWTDDEDDEDDIMNDEDEIEDDDEDEGDDDDGGDDHDVYI

SEQ ID NO: 11190 - protein, 124 aa, Homo sapiens
PQGQLGARPQPHARPQARGGTDARRARTPRPCLPRRCPEPPAAARAGGSPTAVRSILTKERRPEGGYKAVWFGEDIGTEADVVVLNAPTLDVDGASDSGSGDEGEGAGRGGGPYDAPGGDDSYI

SEQ ID NO: 11191 - protein, 414 aa, Homo sapiens
  SITE (174): Xaa equals any amino acid
  SITE (410): Xaa equals any amino acid
MERAVRVESGVLVGVVCLLLACPATATGPEVAQPEVDTTLGRVRGRQVGVKGTDRLVNVFLGIPFAQPPLGPDRFSAPHPAQPWEGVRDASTAPPMCLQDVESMNSSRFVLNGKQQIFSVSEDCLVLNVYSPAEVPAGSGRPVMVWVHGGALITGAATSYDGSALAAYGDVVVXTVQYRLGVLGFFSTGDEHAPGNQGFLDVVAALRWVQENIAPFGGDLNCVTVFGGSAGGSIISGLVLSPVAAGLFHRAITQSGVITTPGIIDSHPWPLAQKIANTLACSSSSPAEMVQCLQQKEGEELVLSKKLKNTIYPLTVDGTVFPKSPKELLKEKPFHSVPFLMGVNNHEFSWLIPRGWGLLDTMEQMSREDMLAISTPVLTSLDVPPEMMPTVIDEYLGSNSDAQAKCQAFXGIHG

SEQ ID NO: 11192 - protein, 177 aa, Homo sapiens
  SITE (90): Xaa equals any amino acid
  SITE (173): Xaa equals any amino acid
LDIKVLQVPTRLRSPAGFTQWIQHWGSRWSCLPVPRCAPALLSPWVVDGTGRCGAGGGAPWGGSGRTGAHGGWGEGQAWRAAGPEPCPAXRQLRPSEKSSTAAAGPGAKALTAWGRPAALSGAPPSPRPPGTHSGPQALRAAPVPARPSPSAPPRKLRELAPALASPERGSYXAAAG

SEQ ID NO: 11193 - protein, 439 aa, Homo sapiens; identical to SEQ ID NO: 9105

SEQ ID NO: 11194 - protein, 439 aa, Homo sapiens
  SITE (358): Xaa equals any amino acid
MVPSSPRALFLLLLILACPEPRASQNCLSKQQLLSAIRQLQQLLKGQETRFAEGIRHMKSRLAALQNSVGRVGPDALPVSCPALNTPADGRKFGSKYLVDHEVHFTCNPGFRLVGPSSVVCLPNGTWTGEQPHCRGISECSSQPCQNGGTCVEGVNQYRCICPPGRTGNRCQHQAQTAAPEGSVAGDSAFSRAPRCAQVERAQHCSCEAGFHLSGAAGDSVCQDVNECELYGQEGRPRLCMHACVNTPGSYRCTCPGGYRTLADGKSCEDVDECVGLQPVCPQGTTCINTGGSFQCVSPECPEGSGNVSYVKTSPFQCERNPCPMDSRPCRHLPKTISFHYLSLPSNLKTPITLFRMXTASAPGRAGPNSLRFGIVGGNSRGHFVMQRSDRQTGDLILVQNLEGPQTLEVDVDMSEYLDRSFQANHVSKVTIFVSPYDF

SEQ ID NO: 11195 - protein, 42 aa, Homo sapiens; identical to SEQ ID NO: 9106

SEQ ID NO: 11196 - protein, 403 aa, Homo sapiens
  SITE (175): Xaa equals any amino acid
  SITE (320): Xaa equals any amino acid
  SITE (331): Xaa equals any amino acid
  SITE (368): Xaa equals any amino acid
MATAERRALGIGFQWLSLATLVLICAGQGGRREDGGPACYGGFDLYFILDKSGSVLHHWNEIYYFVEQLAHKFISPQLRMSFIVFSTRGTTLMKLTEDREQIRQGLEELQKVLPGGDTYMHEGFERASEQIYYENRQGYRTASVIIALTDGELHEDLFFYSEREANRSRDLGAIXYCVGVKDFNETQLARIADSKDHVFPVNDGFQALQGIIHSILKKSCIEILAAEPSTICAGESFQVVVRGNGFRHARNVDRVLCSFKINDSVTLNEKPFSVEDTYLLCPAPILKEVGMKAALQVSMNDGLSFISSSVIITTTHCSDXSILAIALLILXLLLALALLWWFWPLCCTVIIKEVPPPPAEESEVSDHXRMAVGGQGGRVGWRAGWAAGHLAPCRAELSQAQRI

SEQ ID NO: 11197 - protein, 93 aa, Homo sapiens [sequence omitted]

SEQ ID NO: 11198 - protein, 164 aa, Homo sapiens
  SITE (154): Xaa equals any amino acid
MRLLRRRHMPLRLAMVGCAFVLFLFLLHRDVSSREEATEKPWLKSLVSRKDHVLDLMLEAMNNLRDSMPKLQIRAPEAQQTLFSINQSCLPGFYTPAELKPFWERPPQDPNAPGADGKAFQKSKWTPLETQEKEEGYKKHCFNAFASDRISLQXSLGPDTRPPE

SEQ ID NO: 11199 - protein, 190 aa, Homo sapiens
  SITE (155): Xaa equals any amino acid
  SITE (180): Xaa equals any amino acid
MLVLATLAALFILTTAVLAERLFRRALRPDPSHRAPTLVWRPGGELWIEPMGTARKRSEDWYGSAVPLLTDRAPEPPTQVGTLEARATAPPAPSAPNSAPSNLGPQTVLEVPARSTFWGPQPWEGRPPATGLVSWAEPEQRPEASVQFGSPQARXQRPGSPDPEWGLQPRVTLEQISAFXKREGRTSVGF

SEQ ID NO: 11200 - protein, 647 aa, Homo sapiens
MASLVSLELGLLLAVLVVTATASPPAGLLSLLTSGQGALDQEALGGLLNTLADRVHCANGPCGKCLSVEDALGLGEPEGSGLPPGPVLEARYVARLSAAAVLYLSNPEGTCEDARAGLWASHADHLLALLESPKALTPGLSWLLQRMQARAAGQTPKTACVDIPQLLEEAVGAGAPGSAGGVLAALLDHVRSGSCFHALPSPQYFVDFVFQQHSSEVPMTLAELSALMQRLGVGREAHSDHSHRHRGASSRDPVPLISSSNSSSVWDTVCLSARDVMAAYGLSEQAGVTPEAWAQLSPALLQQQLSGACTSQSRPPVQDQLSQSERYLYGSLATLLICLCAVFGLLLLTCTGCRGVTHYILQTFLSLAVGALTGDAVLHLTPKVLGLHTHSEEGLSPQPTWRLLAMLAGLYAFFLFENLFNLLLPRDPEDLEDGPCGHSSHSHGGHSHGVSLQLAPSELRQPKPPHEGSRADLVAEESPELLNPEPRRLSPELRLLPYMITLGDAVHNFADGLAVGAAFASSWKTGLATSLAVFCHELPHELGDFAALLHAGLSVRQALLLNLASALTAFAGLYVALAVGVSEESEAWILAVATGLFLYVALCDMLPAMLKVRDPRPWLLFLLHNVGLLGGWTVLLLLSLYEDDITF

SEQ ID NO: 11201 - protein, 440 aa, Homo sapiens
  SITE (168): Xaa equals any amino acid
  SITE (169): Xaa equals any amino acid
  SITE (173): Xaa equals any amino acid
  SITE (180): Xaa equals any amino acid
  SITE (191): Xaa equals any amino acid
MASLVSLELGLLLAVLVVTATASPPAGLLSLLTSGQGALDQEALGGLLNTLADRVHCANGPCGKCLSVEDALGLGEPEGSGLPPGPVLEARYVARLSAAAVLYLSNPEGTCEDARAGLWASHADHLLALLESPKALTPGLSWLLQRMQARAAGQTPKTACVDIPQLLXXAVGXGAPGSAXGVLAALLDHVXSGSCFHALPSPQYFVDFVFQQHSSEVPMTLAELSALMQRLGVGREAHSDHSHRHRGASSRDPVPLISSSNSSSVWDTVCLSARDVMAAYGLSEQAGVTPEAWAQLSPALLQQQLSGACTSQSRPPVQDQLSQSERYLYGSLATLLICLCAVFGLLLLTCTGCRGVTHYILQTFLSLAVGALTGDAVLHLTPKVLGLHTHSEEGLSPQPTWRLLAMLAGLYAFFLFENLFNLLLPRDPEDLEDGPAATAA

SEQ ID NO: 11202 - protein, 206 aa, Homo sapiens
  SITE (2): Xaa equals any amino acid
  SITE (3): Xaa equals any amino acid
  SITE (41): Xaa equals any amino acid
DXXPGAYAGFRPNANRISFPVFRNNVCPWPEALRSAPKLLXLDEPMGALDKKLRDRMQLEVVDILERVGVTCVMVTHDQEEAMTMAGRIAIMNRGKFVQIGEPEEIYEHPTTRYSAEFIGSVNVFEGVLKERQEDGLVLDSPGLVHPLKVDADASVVDNVPVHVALRPEKIMLCEEPPANGCNFAVGEVIHIAYLGDLSVYHVRLK

SEQ ID NO: 11203 - protein, 10 aa, Homo sapiens
SLLELGLGPL

SEQ ID NO: 11204 - protein, 173 aa, Homo sapiens
  SITE (85): Xaa equals any amino acid
  SITE (128): Xaa equals any amino acid
  SITE (146): Xaa equals any amino acid
  SITE (160): Xaa equals any amino acid
  SITE (168): Xaa equals any amino acid
  SITE (172): Xaa equals any amino acid
MVEEPGRFLPLWLHILLITVLLVLSGIFSGLNLGLMALDPMELRIVQNCGTEKERRYARKIEPIRRKGNYLLCSLLLGNVLVNTXLTILLDNLIGSGLMAVASSTIGIVIFGEILPQALCSRHGLAVXANTILLTKFFMLLTFPLXFPISKLLDFFLGQXIRTVYNRXKLMXM

SEQ ID NO: 11205 - protein, 314 aa, Homo sapiens
  SITE (93): Xaa equals any amino acid
EKAAGAGKSHLAIVQKVNNEGEGDPFYEVLGLVTLEDVIEEIIKSEILDESDMYTDNRSRKRVSEKNKRDFSAFKDADNELKVKISPQLLLAXHRFLATEVSQFSPSLISEKILLRLLKYPDVIQELKFDEHNKYYARHYLYTRNKPADYFILILQGKVEVEAGKENMKFETGAFSYYGTMALTSVPSDRSPAHPTPLSRSASLSYPDRTDVSTAATLAGSSNQFGSSVLGQYISDFSVRALVDLQYIKITRQQYQNGLLASRMENSPQFPIDGCTTHMENLAEKSELPVVDETTTLLNERNSLLHKASHENAI

SEQ ID NO: 11206 - protein, 173 aa, Homo sapiens
  SITE (146): Xaa equals any amino acid
  SITE (160): Xaa equals any amino acid
  SITE (168): Xaa equals any amino acid
  SITE (172): Xaa equals any amino acid
MVEEPGRFLPLWLHILLITVLLVLSGIFSGLNLGLMALDPMELRIVQNCGTEKERRYARKIEPIRRKGNYLLCSLLLGNVLVNTSLTILLDNLIGSGLMAVASSTIGIVIFGEILPQALCSRHGLAVGANTILLTKFFMLLTFPLXFPISKLLDFFLGQXIRTVYNRXKLMXM

SEQ ID NO: 11207 - protein, 241 aa, Homo sapiens
MAAASAGATRLLLLLLMAVAAPSRARGSGCRAGTGARGAGAEGREGEACGTVGLLLEHSFEIDDSANFRKRGSLLWNQQDGTLSLSQRQLSEEERGRLRDVAALNGLYRVRIPRRPGALDGLEAGGYVSSFVPACSLVESHLSDQLTLHVDVAGNVVGVSVVTHPMAPCSPRGFPPAHGVEPEILATMPVLTSHPPTPSPCSLGTCRLLSSLCAFVPGGLTLLSLAGLGGPVQAPAAPPSL

SEQ ID NO: 11208 - protein, 241 aa, Homo sapiens; identical to SEQ ID NO: 11207

SEQ ID NO: 11209 - protein, 189 aa, Homo sapiens
  SITE (169): Xaa equals any amino acid
  SITE (172): Xaa equals any amino acid
  SITE (180): Xaa equals any amino acid
MAAASAGATRLLLLLLMAVAAPSRARGSGCRAGTGARGAGAEGREGEACGTVGLLLEHSFEIDDSANFRKRGSLLWNQQDGTLSLSQRQLSEEERGRLRDVAALNGLYRVRIPRRPGALDGLEAGGYVSSFVPACSLVESHLSDQLTLHVDVAGNVVGVSVVTHPMAPXSPXGFPLPWSXAEILATIQF

SEQ ID NO: 11210 - protein, 117 aa, Homo sapiens
AASAGATRLLLLLLMAVAAPSRARGSGCRAGTGARGAGAEGREGEACGTVGLLLEHSFEILATMPVLTSHPPTPSPCSLGTCRLLSSLCAFVPGGLTLLSLAGLGGPVQAPAAPPSL

SEQ ID NO: 11211 - protein, 203 aa, Homo sapiens
  SITE (31): Xaa equals any amino acid
  SITE (93): Xaa equals any amino acid
  SITE (99): Xaa equals any amino acid
  SITE (115): Xaa equals any amino acid
  SITE (151): Xaa equals any amino acid
MVGLMHIGFGIVLCLISFSFREVLGFASTAXIGGYPFWGGLSFIISGSLSVSASKELSRCLVKGSLGMNIGRSILAFIGVILLLVDMCINGVXGQDYWXVLSGKGISATLMIFSXLEFFVACATAHFANQANTTTNMSVLVIPNMYESNPXTPASSSAPPRCNNYSANAPKRKRGISLISWRKTTCKNFLRRCLLLSTMISSL

SEQ ID NO: 11212 - protein, 42 aa, Homo sapiens; identical to SEQ ID NO: 9114

SEQ ID NO: 11213 - protein, 7 aa, Homo sapiens
FIGFILC

SEQ ID NO: 11214 - protein, 150 aa, Homo sapiens [sequence omitted]

SEQ ID NO: 11215 - protein, 150 aa, Homo sapiens [sequence omitted]

SEQ ID NO: 11216 - protein, 1 aa, Homo sapiens
M

SEQ ID NO: 11217 - protein, 303 aa, Homo sapiens
  SITE (176): Xaa equals any amino acid
  SITE (177): Xaa equals any amino acid
  SITE (179): Xaa equals any amino acid
  SITE (192): Xaa equals any amino acid
  SITE (294): Xaa equals any amino acid
  SITE (297): Xaa equals any amino acid
  SITE (302): Xaa equals any amino acid
MSSNTMLQKTLLILISFSVVTWMIFIISQNFTKLWSALNLSISVHYWNNSAKSLFPKTSLIPLKPLTETELRIKEIIEKLDQQIPPRPFTHVNTTTSATHSTATILNPRDTYCRGDQLDILLEVRDHLGQRKQYGGDFLRARMSSPALTAGASGKVMDFNNGTYLVSFTLFWEGQXXLXLLLIHPSEGASAXWRARNQGYDKIIFKGKFVNGTSHVFTECGLTLNSNAELCEYLDDRDQEAFYCMKPQHMPCEALTYMTTRNREVSYLTDKENSLFHRSKVGVEMMKDRKHIDXTNXNKREXI

SEQ ID NO: 11218 - protein, 191 aa, Homo sapiens
  SITE (180): Xaa equals any amino acid
  SITE (181): Xaa equals any amino acid
  SITE (190): Xaa equals any amino acid
MSSNTMLQKTLLILISFSVVTWMIFIISQNFTKLWSALNLSISVHYWNNSAKSLFPKTSLIPLKPLTETELRIKEIIEKLDQQIPPRPFTHVNTTTSATHSTATILNPRDTYCRGDQLDILLEVRDHLGQRKQYGGDFLRARMSFPALTAGASGKVMDFTMAPTWQLHSGLGGPGLPGSXXYSPQVEGAXG

SEQ ID NO: 11219 - protein, 165 aa, Homo sapiens
  SITE (2): Xaa equals any amino acid
  SITE (5): Xaa equals any amino acid
  SITE (7): Xaa equals any amino acid
  SITE (28): Xaa equals any amino acid
  SITE (33): Xaa equals any amino acid
NXFAXWXQKDTLRIQWKKHSYPFVTFQXYSLIXHDYIPREIDRLSGDKNTAIVITFGQHFRPFPIDIFIRRAIGVQKAIERLFLRSPATKVIIKTENIREMHIETERFGDFHGYIHYLIMKDIFKDLNVGIIDAWDMTIAYGTDTIHPPDHVIGNQINMFLNYIC

SEQ ID NO: 11220 - protein, 246 aa, Homo sapiens
  SITE (30): Xaa equals any amino acid
  SITE (212): Xaa equals any amino acid
  SITE (220): Xaa equals any amino acid
  SITE (243): Xaa equals any amino acid
MASAVRGSRPWPRLGLQLQFAALLLGTLSXQVHTLRPENLLLVSTLDGSLHALSKQTGDLKWTLRDDPVIEGPMYVTEMAFLSDPADGSLYILGTQKQQGLMKLPFTIPELVHASPCRSSDGVFYTGRKQDAWFVVDPESGETQMTLTTEGPSTPRLYIGRTQYTVTMHDPRAPALRWNTTYRRYSTPPMDGSTGKYMSQLGVLREGPAAHXGTPGSGTXLLDTRNLGRALGNGPATPLGTKXRAW

SEQ ID NO: 11221 - protein, 86 aa, Homo sapiens; identical to SEQ ID NO: 9119

SEQ ID NO: 11222 - protein, 116 aa, Homo sapiens
MWWALCSMLPLLGCACSSGCWGSGPTPLLAEPTFLCVSSRPHNPLSFLSVLPCSRGPGPSGLQGDGAGLPAHLGPLSCICLPSLLCDLGERQCPLWAVRSTQCLIAGKKVLQRLCP

SEQ ID NO: 11223 - protein, 116 aa, Homo sapiens; identical to SEQ ID NO: 11222

SEQ ID NO: 11224 - protein, 116 aa, Homo sapiens; identical to SEQ ID NO: 11222

SEQ ID NO: 11225 - protein, 122 aa, Homo sapiens
  SITE (116): Xaa equals any amino acid
MGLLAFLKTQFVLHLLVGFVFVVSGLVINFVQLCTLALWPVSKQLYRRLNCRLAYSLWSQLVMLLEWWSCTECTLFTDQATVERFGKEHAIIILNHNFEIDFLCGWTMCERFGMLXSSKGPR

SEQ ID NO: 11226 - protein, 121 aa, Homo sapiens
GDFLWKTSRVDEKEAAQWLHKLYQEKDALQEIYNQKGMFPGEQFKPARRPWTLLNFLSWATILLSPLFSFVLGVFASGSPLLILTFLGFVGAASFGVRRLIGVTEIEKGSSYGNQEFKKKE

SEQ ID NO: 11227 - protein, 64 aa, Homo sapiens
  SITE (56): Xaa equals any amino acid
MAPGPLSATQAVVIHTTHCLQLPVWCLSLVSELLGRAPPHNKDALRPSKKKKKKLXGGPVPIPP

SEQ ID NO: 11228 - protein, 98 aa, Homo sapiens; identical to SEQ ID NO: 9131

SEQ ID NO: 11229 - protein, 58 aa, Homo sapiens
MVSFGFWFLCLFFGVWKNMHFYRARKLVSRKGSPEKAADGPCPCWVFLFFGTVRGNGF

SEQ ID NO: 11230 - protein, 18 aa, Homo sapiens
  SITE (13): Xaa equals any amino acid
MGTQGCPHPSWLXLLGLS

SEQ ID NO: 11231 - DNA, 839 bp, Homo sapiens
cccacacgtttctgcagatgcccgcatcatggtcctgaggggatgggggctggcctggagcctttcccccgtggtgtgtggctatagcggggacatgaagggggtgtgttggggacgtagtgaccactcccttctaccgtcagagatcctgcttccccctgccccctgcccctcctcggctgcccttcataaccccccacccactccccacctgccctctcctgtgcttgtgcggatccaggaagcacctacctgggcacagagatcatcgctcggtgcctcgcccctacacaagggcgattaacttctctgttatgaactcctacttagtaattctgacatgaaactcccactaggataaaacttggcgcagaacagcaattactgaaaacacatttttaaaaaggttgatgttttgtaagagttcatcctcctccactcctcagcctccctcaaggagacacatatttagatcttctctgtgtgagtctaacttggagactgtgagttgcagtttaaaaggggctctggggccaggtgcggtggcacacacttgtggtctcagctactcaagaggctgagatgtgaggaacgcttgagcccaggagttcaagaccagcctgagcaacatagggagatgggatctacccaaaacacttaacaataaggctggcatggtggcatatgcctgtggtcccagctacttggaggctgaggcaggagaatcatttaagcctgggagatcgaggctgcagtgaggtatggtttcaactgctgtgctccagcctgggagacagggcaatactgtgtctctaaaaaataaaaaataaaaataaaaa

SEQ ID NO: 11232 - DNA, 839 bp, Homo sapiens
cccacccgtttctgcagatgcccgcatcatggtcctgaggggatgggggctggcctgtagcctttcccccgtggtgtgtggctatagcggggacatgaagggggtgtgttggggacgtagtgaccactcccttctaccatcagagatcctgcttccccctgccccctgcccctcctcggctgcccttcataaccccccacccactccccacctgccatctcctgtgcttgtgtggatccaggaagcacctacctgggtacagagatcattgctcggtgcctcgcccctacacaagggcgattaacttgtctgttatgaactcctacttagtaattccgacatgaaactcccactaggataaaacttggcgcagaacagcaattactgaaaacacatttttaaaaaggttgacgttttgtaagagttcatcctcctccactcctcagcctccctcaaggagacacatatttagatcttctctctgtgagtctaacttggagactgtgagttgcagtttaaaaggggctctggggccaggtgcggtggcacacacttgtggtctcagctactcaagaggccgagatgtgaggaacgcttgagcccaggagttcaagaccagcctgagcaacatagggagatgggatctaccaaaaacatttaacaataaggctggcatggtggcatatgcctgtggtcccagctacttggaggctgaggcaggagaatcatttaagcctgggagatcgaggctgcagtgaggtatggtttcaactgctgtgctccagcctgggagacagggcaatactctgtctctaaaaaataaaaaataaaaataaaaa

SEQ ID NO: 11233 - DNA, 837 bp, Homo sapiens
cccacccgtttctgcagatgcccgcatcatggtcctgaggggatgggggccggcctggagcctttcccccgtggtgtgtggctatagcggggacatgaagggggtgtgttggggacgtagtgaccactcccttctaccgtcagagatcctgcttccccctgccccctgcccctcctcggctgcccttcataaccccccacccactccccacctgccatctcctgtgcttgtgcggatccaggaagcacctacctgggcacagagatcatcgctcggtgcctcgcccctacacaagggcgattaacttctctgttatgaactcctacttagtaattctgacatgaaactcccactaggataaaacttggcgcagaacagcaattactgaaaacacatttttaaaaaggttgatgttttgtaagagttcatcctcctccactcctcagcctccctcaaggagacacatatttagatcttctctgtgtgagtctaacttggagactgtgagttgcagtttaaaaggggctctggggccaggtgcggtggcacacacttgtggtctcagctactcaagaggctgagatgtgaggaacgcttgagcccaggagttcaagaccagcctgagcaacatagggagatgggatctacccaaaacatttaacaataaggctggcatggtggcatatgcctgtggtcccagctacttggaggctgaggcaggagaatcatttaagcctgggagatcgaggctgcagtgaggtatggtttcaactgctgtgctccagcctgggagacagggcaatactgtgtctctaaaaaataaaataaataaataaa

SEQ ID NO: 11234 - DNA, 836 bp, Homo sapiens
cccacccgtttctgcagatgccgcatcatggtcctgaggggatgggggctggcctgtagccttcccccgtggtgtgtggctatagcggggacatgaagggggtgtgttggggatgtagtgaccactcccttctaccgtcagagatcctgcttccccctgccccctgcccctcctcggctgcccttcataaccccccacccactccccacctgccatctcctgtgcttgtgtggatccaggaagcacctacctgggtacagagatcattgctcggtgcctcgcccctacacaagggcgattaacttgtctgttatgactcctacttagtaattccgacatgaaactcccactaggataaaacttggcgcagaacagcaattactgaaaacacatttttaaaaaggttgacgttttgtaagagttcatcctcctccactcctcagcctccctcaaggagacacatatttagatcttctctctgtgagtctaacttggagactgtgagttgcagtttaaaaggggctctggggccaggtgcggtggcacacacttgtggtctcagctactcaagaggccgagatgtgaggaacgcttgagcccaggagttcaagaccagcctgagcaacatagggagatgggatctaccaaaaacatttaacaataaggctggcatggtggcatatgcctgtggtcccagctacttggaggctgaggcaggagaatcatttaagcctgggagatcgaggctgcagtgaggtatggtttcaactgctgtgctccagcctgagagacagggcaatactctgtctctaaaaaataaaaaataaaaataaaaa

SEQ ID NO: 11235 - DNA, 4269 bp, Homo sapiens
agcgtcctgtgagggaggggctgcactgccactttactgatgaggaagttaaggttcagagagatgaggtcatttgttagaggccagacagcctcctcagcccatttctaaggttgtttctgtggtatttgccataaagccataggttcattgatttgttcttaagtagttctgagcccttcctgcatatcaggcagggacaaacaggaaagtccctgcctttggcaagtgcgggggaaatgaaatgattctgctcagcctcatccattggtctgaacaatcacgtctcatgaccgcagggacacggcttcccctgaacgcggatcctagaggccaggcagaagcagcatgggtttccactcacacggtaggcggctgtgcaatttcgtctggagtccccagacccctcctcatccttcccagggttgctctgaggccattccttgtcatctaggaggggtctacataaaagcatttataaacacctccaaatgggagccaggcgtgcccacctttggagcacttttctctactgcaaatttatctactgctcgtgaaatctctggatttaactctgatgaaagactggaggctgaaggagaacttcaatatcatatattttaaaggttgattcacagtttggagcaagaattaaagaaccacgaacttcaaggtaaaacgggcaacggcgttggggcaagcctctctgcatctgcgtgtccagcctctcctgcgtgccagaagttcccaggcaggagtgtggtgggacatccggctggggtaaggacaggcaccctcccactgtgtcagggcccagagagtgggtggagaagctctgcaagagacctgtgcaagggcgccttgcaggagcctgcagtccccacaggtgtgtttgtggataacacttggggagccctggccttttggggtcacggagggcttggcctctcacctcagagctgcagagaagccgcttctacatcaggacatcagaagctggaacaggatggccggcgaggggcctcttgttggggtcacagagatgggtcgcagagatggcccgtgtggaaggttggattctcaccccacctctgcccctagatgtcctggtgaccctcccctctgtagtcttggttttttgcaaaacagttatgacctcctgccatactgggtactttgcttatgtattgtgtttactctttactgtgtgtctctcctgctaaggtctacgaagaagggtctttgtgggtggggttcttagaggcatcccaagtaccagaagcagtccttggactaaggggctcaataaatattttttatttattattttttctttttgagatggagtctcgctctcttgaccaggctggagtacagtggcacaatcttggctcactgcagccttcgcctcctgggttcaagtgatttccggctaatttttgtatttttagtagtgacggggtatcaccatgttggccaggctggtcacaaactcctgacctcaagtgatccacccgcctcagcctcccaacatgctgggattatagacatgagccaccatgcctggccaaatatttgtcaaattgaatttgtatttccatacaaattttagtctggataaagtgcttcatgcctgtaatccaagcactttgagaggctgaggcgggtggatggcttgagcccaggagtttgagaccagcatggaaaacatagagaaaccccatctcaatataagaagaagaagaaaaagaaaaaaaaaatcaaaaacgaaaacaacacaaattttagagtaagtattttaagttccacaaaaacctggttaggatttggatagcaatttctttagttctacaaatcaatttggaaaaaattaattaatttgggaagaattcattttgagtcttctaatccatgaacatggtatctccatttgtttagaccatctttaatgcctactaataacatttctgtatagtgaccttgcacattattcttagattcttgatattttgtgctattatgtctttttataaattttatttttccaacattgttgctaatatatagtaagaaaatggaatcttgcctatagattttgaacccaacaactttgctaaactcctctgaatcctcagaatttccctgtggattatgtaggctcttctgcatacacaaccatatcatctgtgaataaagacagttttgttttcttcttcacaaactttacccgactcactgtgcagtctgccacatccaggctgatattgaatagcagtggcactaataggattctttgcccccttgccaatcttgtaaagaaagctttcaacattttcctgttagctctgttggcagctctgactttttccatagatggccttcatcagcttaacaatgggtcttttcttcccagagggctgagcttttccttaagaacagacagtgagtgtcatcaaacactaggctgcatctgttgagatggtcatacgacttgtgtcttttcctgtgtttgtgtgtgaactctctgggtgtctgagggttcttgtgactttcacagaagaacacaatttaccctccggtgtgggaaggggaaggaggcagaggaagaaagaccccaagtccccctcatccccactgaccttcctgctggcttcgtccttgatctgtgcctccttagatcctgcgtttgagtacttgcggtcatgatgacagggccaacctcctgaccagggctgttagcacctcccctgctgcccagagtccctgctccaaaccacttccttcatcttccgtacccccagccaatatttccctgcccagtgtcaacccaggcccagaaccagaccacaagggacagccccgaaacccagaatcagacaaatcagcccgtcccaagctgtctcccctgctctgcccggctttcacagggaagccaacacaggctgtggcttggcctttccctagctcctttctgcctcctggtctgcctgcggcttccccctgccgccctgcggggcctgccacgtctctcatttctagcgaatgtttcaagagcgatgttagactttcctttcaatagagttgacctctgttaggcacctttatggattaagacctgggcatagatggtttcttcggcatcacgacctgaaggtgcttgggagagacggtgaggaggagaatgcaccctgccatgctctgcaccgcacatggatgcggatttcaccatgttggccaggctggtctgaaacacacggagcccaagcgcccggtggactctctgacggtcctcgggcgtgtgcctttgtaagcagagtattcagctctcatcagggcctcgccagagcagaaatggtctgttgataaatgcatcgtatacaattataaatgtgcacccagcattgctgcttcctcttttttttttgatatagggacttgctctgtcgcccaggctgcagtgcagtagggcagtcacagctcactgcggcctcaacctcccaggctcaagcaatccttccgcctcagcctcctaagtagctggaactacacatccagcttttttttttttttttttgtagacacaggatctcaccatgttggccaggctggtcttaaactcctgggctcaagtgatccgcccaccttgggctcccaaagtactggcattacaggtgggagccactatgcctggcctgcttccttttgcaaacagaaaatcttggtaaatagaattgatcagaacttgttgtttaacgtacacgacctctagctgtactgcaaagctgtgtgcacatgtgttaagtcatctgttctatgtgttctaattataaataagaaaaaacaaatttcaatcaaccatgctggaggaagagcaattatgtttctattccttctatcataggtgatgtaaaattctcaaacaatgagatagataaaaagtacgcagccaaaaagttcaagaagaagtgttatggagatggagcaggcccttcgtaaaaacacgatgttggttttctggattttgtatgtttgcttttttttttcctcatcctaaagaaatattcactgtcatacctaattttgtttttgtaagtttgtattctttctttatagggaggcctcacaaaacccggatcagactcgcccactgccctgtgtctgccctcccgaccgcctctcctgcccagcagggatgagggtggcagtggtgctgtgtggagggtggcgggaggacctggaagactgcgaccagtgagccgggaggccttg

SEQ ID NO: 11236 - DNA, 4273 bp, Homo sapiens
agcgtcctgtgagggaggggctgcactgccactttactgatgaggaaattaaggttcagagagatgaggtcatttgttagaggccagacagcctcctcagcccatttctaaggttgtttctgtgtatttgccataaagccataggttcattgatttgttcttaagtagttctgagtccttcctgcatatcaggcagggacaaacgggaaagtccctgccttggcaagtgcgggggaaatgaaatgattctgctcagcctcatccattggtctgaacaatcacgtctcatgaccccagggacacggcttcccctgaacgcggatcctagaggccaggcagaagcagcatgcggtttccactcacacggtaggtggctgtgcgatttcgtctggagtccccggacccctcctcatccttcccagggttgctctgaggccattcctcgtcatctaggaggggtctacataaaagcatttataaacagctccaaatgggagcctggcgcgcccacctttggagcacttttctctactgcagatttatctactgctcgtgaaatctctggatttaactgtgatgaaagaccggaggctgaaggagaacttcaatatcatatattttaaaggttgactcacagtttggaacaagaattaaagaaccacgaacttcaaggtaaaacgggcaatggcgttggggcaagcctctctgcatctgtgtgtccagcctctcctgcgtgccagaagtccccaggcaggagtgtggtgggacatccggctggggtaaggacaggcaccctcccactgtgtcagggcccagagagtgggtggagaagctctgcaagagacctgtgcaagggcgccttgtaggagcctgccgtccccacaggggtgtttgtggataacacttggggagccctggccttttggggtcacggagggcttggcctctcacctcagagctgcagaggagacgcttctacatcaggacatcagaagctggaacggggatggccggcgaggggcctcttgttggggtcacagagatgggtcgcagagatggcctgtgtggaaggttggattctcaccccacctctgcccctagatgtcctggtgaccctcccctctgtagtcttggttttttgcaaaacacttatgacctcctgccatactgggtactttgcttatgtattgtgtttactctttactgtgtgtctctcctgctaaggtctacgaagaagggtctttgtgggtggggttcttagaggcatcccaagtaccagaagcagtccctggactaaggggctcaagaaatattttttatttattattttttctttttgagatgcagtctctctctcttgcccaggctggagtacagtggcacaatcttggctcactgcagccttcgcctcctgggttcaagtgatttcaggctaatttttgtatttttagtagagacggggtttcaccatgttggccaggctggtcacgaactcctgacctcaagtgatccacccgcctcagcctcccagcgtgctgggattatagacatgagccaccatgcctggccaaatatttgtcaaattgaatttgtatttccatacaaattttagtctggatgaagtgcttcatgcctgtaatccaagcactttgagaggctgaggcgggcagatggcttgagcccaggagtttgagaccagcctggaaaacatagagaaaccccgtctcaatataagaagaagaagaaaaagaaaaaaaaaaaatcaaaaacgaaaacaacacaaattttagagtaagtattttaagttccacaaaaacctggttaggatttggatagcaatttctttagttctacaaatcaatttggaaaaaattaattaatttgggaagaattcattttgagtcttctaatccatgaacatggtatctccatttgtttagaccatctttaatgcctgctaataacatttctgtatagtgaccttgtacattattcttagattcttgatattttgtgctattatgtctttttataaattttatttttccaacattgttgctaatatatagtaagaaaatggaatgttgcctatggattttgaacccaacaactttgctaaactcctctgaatcctcagaatttccctgtggattatgtagactcttctgcatacacaaccatatcatctgtgaataaagacagttttgttttcttcttcacaaactttacccaactcactgtgcagtctgccacatccaggctgatattgaatagcagcggcaccaataggtgtctttgtccccttgccaatcttgtaaagaaagctttcaacattttcctgttagctgtgttggcagctctgactttttccatagatggccttcatcagcttaacaacgggtcttttcttcccagagggctgagcttttccttaagaacagacagtgagtgtcatcaaacactcggctgcatctgttgagatggtcatacgacttgtgtcttttcctgtgtttgtgtatgaactctctctgggtgtctgagagttcttgtgactttcacagaagaacacaatttaccctcccgtgtgggaaggggaaggaggcagaggaagaaagaccccaagtccccctcatccccactgaccttcctgctggcttcgtccttgatttgtgcctccttagatcctgcgtttgactacttgcggtcatgatgacagggccaacctcctgaccagggctgttggcacctcccctcctgcccagagcccctgctccaaaccacttcattcatcttctgtacccccagccaatatttccctgcccagtgtcaacccaggcccagaaccagaccacaagggacagccccggaacccagaatcagacaaatcagcccgtcccaagctgtctcccctgctctgcccggctttcccaggaagccaacagaggctgtggcttggcctttccctcgctcctttctgcctcctggtctgcctgcggcttccccctgccgccctgcggggcctgccatgtctctcatttctagcgaatgtttccagagcgatgttagactttcctttcaatagcgctgacctctgttaggcacctttatggattaagacctgggcatagatggtttcttcggcatcacgacctgaaggtgcttgggagagacggtgaggaggagaatgcaccctgccatgctctgcactgcacatggatgcagattttaccatgttggccaggctggtctgaaacacacggagcccaagcgcccggtggactctctgacggtcctcgggcgtgtgccattgtaagcagagtattcagctctcatcagggcctcgccagagcagaaatggtctgttgataaatgcatcgtatacaattataaatgtgcacccagcattgctgcttcctctttttttttgatatagggacttgctctgtcgcccaggctgcagcgcagtagggcagtcacagctcactgcagcctcaacctcccaggctcaagcaatccttccacctcagcctcctgagtagctggaactacacatccagctattttttttttttttttggtagacacaggatctcaccatgttggccaggctggtcttaaactcctgcgctcaagtgatccgcccaccttgggctcccaaagtactggcattacaggtgggagccactatgcctggcctgcttcctttcgcaaacaggaatcttgtaaatagaattgatcagaacttgttgtttaatgtacacagacctctagctgtactgcaaagctgtgtgcacatgtgttaagtcatctgttctatgtgttctaattataaataagaaaaaacaaatttcaatcagccatgctggaggaagagcaattatgtttctattccttctatcgtaggtgatgtaaaattctcaaacaatgagatagataaaaagtacgcagccaaaaagtgcaggaagaagtgttatggagatggagcaggcccttcgtaaaaacacgatgttggttttctggattttgtatgtttgctttttttttttcctcatcctaaagaaatattcactgtcatacctaattttgtttttgtaagtttgtattcttttctttatagggaggcctcacaaaacctggatcagactcgcccactgccctgtgtctgccctcccgaccccctctcctgcccagcagggatgtgggtggcagtggtgctgtgtggagggtggcgggaggaccgggaagactgcgaccagtgagccgggaggccttg

SEQ ID NO: 11237 - DNA, 4082 bp, Homo sapiens
agtgtcctgtgagggaggggctgcactgccactttactgatgaggaaattaaggttcagagagatcatgtcatttgttagaggccagacagcctcctcagcccattttaaggttgtttctgtggtatttgccataaagccataggttcattgatttgttcttaagtagttatgagcccttcctgcatatcaggcagggacaaacaggaaagtccctgcctttggtaagtgcgggggaaatgaaatgattctgctcagcctcatccattggtctgaacaatcacgtctcatgaccgcagggacacggcttcccctgaacgcggatcctagaggccaggcagaagcagcatgggtttccactcacatggtaggtggctgtgcaatttcgtctggagtccccagacccctcctcatccttcccagggttgctctgaggccattcctcgtcatctaggaggggtctacataaaagcatttataaacacctccaaatgggagccaggcgtgcccacctttggagcacttttctctactgcaaatttatctactgctcgtgaaatctctggatttaactctgatgaaagactggaggctgaaggagaacttcaatatcatatattttaaaggttgattcacagtttggagcaagaattaaagaaccacgaacttcaaggtaaaacgggcaacggcgttggggcaagcctctctgcatctgcgtgtccagcctctcctgcgtgccagaagtccccaggcaggagtgtggtgggacatccggctggggtaaggacaggcaccctcccactgtgtcagggcccagagagtgggtggagaagctctgcaagagacctgtgcaagggcgccttgtaggagcctgcagtccccacaggtgtgtttgtggataacatttggggagccctggccttttggggtcacggagggcttggcctctcacctcagagctgcggaggagccgcttctacatcaggacatcagaagctggaacaggatggccggcgaggggcctcttgttggggtcacagagatgggtcgcagagatggcccgtctggaaggttggattctcaccccacctctgcccctagatgtcctggtgaccctcccctctgtagtcttggttttttgcaaaacagttatgacctcctgccatactgggtactttgcttatgtattgtgtttactctttactgtgtgtctctcctgctaaggtctacgaagaagggtctttgtgggtggggttcttagaggcatcccaagtaccagaagcagtccctggactaaggggctcaaaaaatattttttatttattattttttctttttgagatggagtctcgctctcttgaccaggctggagtacagtggcacaatcttggctcactgcagccttcgcctcctgggttcaagtgatttccggctaatttttgtatttttagtagagacggggtttcaccatgttggccaggctggtcacaaactcctgacctcaagtgatccacccgcctcagcctcccaacatgctgggattatagacatcagccaccatgcctggccaaatatttgtcaaattgaatttgtatttccatacaaattttagtctggatgaagtgcttcatgcctgtaatggaagctctttgagaggctgaggtgggtggatggcttgagcccaggagtttgagaccagcatggaaaacatagagaaaccccatctcaatataagaagaagaagaaaaagaaaaaaaaaatcaaaaacgaaaacaacacaaattttagagtaagtattttaagttccacaaaaacctggttaggatttggatagcaatttctttagttctacaaatcaatttggaaaaaattaattaatctgggaagaattcattttgagtcttctaatccatgaacatggtatctccatttgtttagaccatctttaatgcctactaataacatttctgtatagtgaccttgcacattattcttagattcttgatattttgtgctattatgtctttttataaattttatatttccaacattgttgctaatatatagtaagaaaatggaatcttgcctatggattttgaacccaacaactttgctaaactcctctgaatcctcagaatttccctgtggattatgtaggctcttctgcatacacaaccatatcatctgtgaataaagacagttttgttttcttcttcacaaactttacccgactcactgtgcagtctgccacatccaggctgatattgaatagcagtggcactaataggattctttgcccccttgccaatcttgtaaagaaagctttcaacattttcctgttagctctgttggcagctctgactttttccatagatggccttcatcagcttaacaatgggtcttttcttcccagagggctgagcttttccttaagaacagacagtgagtgtcatcaaacactaggctgcatctgttgagatggtcatacaacttgtgtcttttcctgtgtttgtgtgtgaactctctgggtgtctgagagttcttgtgactttcacagaagaacacaatttaccctccggtgtgggaaggggaaggaagcagaggaagaaagaccccaagtccccctcatccccactgaccttcctgctggcttcgtccttgatctgtgcctccttagatcctgcgtttgagtacttgcggtcatgatgacagggccaacctcctgaccagggctgttagcatctcccctgctgcccagagtccctgctccaaaccacttccttcatcttctgtacccccagccaatatttccctgcccagtgtcaacccaggcccagaaccagaccacaagggacagccccggaacccagaatcagacaaatcagcccgtcccaagctgtctcccctgctctgcccggctttcacagggaagccaacacaggctgtggcttggcctttccctagctcctttctgcctcctggtctgcctgcggcttccccctgccgccctgcggggcctgccacgtctctcatttctagtgaatgtttcaagagcgatgttagactttcctttcaatagcgttgacctctgttaggcacctttatggattaagacctgggcatagatggtttcttcggcatcacgacctgaaggtgcttgggagagacggtgaggaggagaatgcaccctgccatgctctgcaccgcacatggatgcggatttcaccatgttggccaggctggtctgaaacacacggagcccaagcgcccggtggaccctctgacggtcctcgggcgtgtgcctttgtaagcagagtattcagctctcatcagggcctcgccagagcagaaatggtctgttgataaatgcatcgtatacaattataaatgtgcacccagcattgctgcttcctcttttttttttttgatatagggacttgctctgtcgcccaggctgcagtgcagtagggcagtcacagctcactggggcctcaacctcccaggctcaagcaatccttccgcctcagcctcctaagtagctggaactacacatccagctttttttttttttttttttttgtagacacaggatctcaccatgttggccaggctggtcttaaactcctgggctcaagtgatccgcccaccttgggctcccagagtactggcattacaggtgggagccactatgcctggcctgcttccttttgcaaacaggaatcttgtaaatagaattgatcagaacttgttgtttaacgtacacagacctctagctgtactgcaaagctgtgtgcacatgtgttaagtcatctgttctatgtgttctaattataaataagaaaaaacaaatttcaatcagccatgctggaggaagagcaattatgtttctattccttctatcacaggtgatgtaaaattctcaaacaatgagatagataaaaagtacgcagccaaaaagttcaagaagaagtgttatggagatggagcaggcccttcgtaaaaacacgatgttggttttctggattttgtatgtttgctttttttttttcctcatcctaaataaatattcactgtcatacctaa

SEQ ID NO: 11238 - DNA, 4262 bp, Homo sapiens
agcgtcctgtgagggaggggctgcactgccactttactgatgaggaaattaaggttcagagagatgaggtcatttgttagaggccagacagcctcctcagcccatttctaaggttgtttctgtggtatttgccataaagccataggttcattgatttgttcttaagtagttctgagtccttcctgcatatcaggcagggacaaacgggaaagtccctgcccttggcaagtgcgggggaaatgaaatgattctgctcagcctcatccattggtctgaacaatcacgtctcatgaccccagggacacggcttcccctgaacgcggatcctagaggccaggcagaagcagcatgggtttccactcacacggtaggtggctgtgcgatttcgtctggagtccccggacccctcctcatccttcccagggttgctctgaggccattcctcgtcatctaggaggggtctacataaaagcatttataaacagctccaaatgggagcctggcgcgcccacctttggagcacttttctctactgcagatttatctactgctcgtgaaatctctggatttaactgtgatgaaagaccggaggctgaaggagaacttcaatatcatatattttaaaggttgactcacagtttggaacaagaattaaagaaccacgaacttcaaggtaaaacgggcaatggcgttgggcaagcctctctgcatctgtgtgtccagcctctcctgcgtgccagaagtccccaggcaggagtgtggtgggacatccggctggggtaaggacaggcaccctcccactgtgtcagggcccagagagtgggtggagaactctgcaagagacctgtgcaagggcgccttgtaggagcctgccgtccccacagggtgtttgtggataacacttggggagccctggccttttggggtcacggagggcttggcctctcacctcagagctgcagaggagacgcttctacatcaggacatcagaagctggaacggggatggccggcgaggggcctcttgttggggtcacagagatgggtcgcagagatggcccgtgtggaaggttggattctcaccccacctctgcccctagatgtcctggtgaccctcccctctgtagtcttggttttttgcaaaacacttatgacctcctgccatactgggtactttgcttatgtattgtgtttactctttactgtgtgtctctcctgctaaggtctacgaagaagggtctttgtgggtggggttcttagaggcatcccaagtaccagaagcagtccctggactaaggggctcaagaaatattttttatttattattttttctttttgagatgcagtctctctctcttgcccaggctggagtacagtggcacaatcttggctcactgcagccttcgcctcctgggttcaagtgatttcaggctaatttttgtatttttagtagagacggggtttcaccatgttggccaggctggtcacgaactcctgacctcaagtgatccacccgcctcagcctcccagcgtgctgggattatagacatgagccaccatgcctggccaaatatttgtcaaattgaatttgtatttccatacaaattttagtctggatgaagtgcttcatgcctgtaatccaagcactttgagaggctgaggcgggcagatggcttgagcccaggagtttgagaccagcctggaaaacacagagaaaccccgtctcaatataagaagaagaagaaaaagaaaaaaaaaaaatcaaaaacgaaaacaacacaaattttagagtaagtattttaagttccacaaaaacctggttaggatttggatagcaatttctttagttctacaaatcaatttggaaaaaattaattaatttgggaagaattcattttgagtcttctaatccatgaacatggtatctccatttgtttagaccatctttaatgcctgctaataacatttctgtatagtgaccttgtacattattcttagattcttgatattttgtgctattatgtctttttataaatttatttttccaacattgttgctaatatatagtaagaaaatggaatgttgcctatggattttgaacccaacaactttgctaaactcctctgaatcctcagaatttccctgtggattatgtagactcttctgcatacacaaccatatcatctgtgaataaagacagttttgttttcttcttcacaaactttacccaactcactgtgcagtctgccacatccaggctgatattgaatagcagcggcaccaataggtgtctttgtccccttgccaatcttgtaaagaaagctttcaacattttcctgttagctgtgttggcagctctgactttttccatagatggccttcatcagcttaacaacgggtcttttcttcccagagggctgagcttttccttaagaacagacagtgagtgtcatcaaacactcggctgcatctgttgagatggtcatacgacttgtgtcttttcctgtgtttgtgtatgaactctctctgggtgtctgagagttcttgtgactttcacagaagaacacaatttaccctccggtgtgggaaggggaaggaggcagaggaagaaagaccccaagtccccctcatccccactgaccttcctgctggcttcgtccttgatttgtgcctccttagatcctgcgtttgactacttgcggtcatgatgacagggccaacctcctgaccagggctgttggcacctcccctcctgcccagagcccctgctccaaaccacttcattcatcttctgtacccccagccaatatttccctgcccagtgtcaacccaggcccagaaccagaccacaagggacagccccggaacccagaatcagacaaatcagcccatcccaagctgtctcccctgctctgcccggctttcccaggaagccaacagaggctgtggcttggcctttccctcgctcctttctgcctcctggttgtgcggcttccccctgccctgcggggcctgccatgtctctcatttctagcgaatgtttccagagcgatgttagacttccctttcaatagcgttgacctctgttaggcacctttatggattaagacctgggcatagatggtttcttcggcatcacgacctgaaggtgcttgggagagacggtgaggaggagaatgcaccctgccatgctctgcactgcacatggatgcagattttccatgttggccaggctggtctgaaacacacggagcccaagcgcccggtggactctctgacggtcctcgggcgtgtgccattgtaagcagagtattcagctctcatcagggcctcgccagagcagaaatggtctgttgataaatgcatcgtatacaattataaatgtgcacccagcattgctgcttcctctttttttttgatatagggacttgctctgtcgcccaggctgcagcgcagtagggcagtcacagctcactgcagcctcaacctcccagctcaagcaatccttccacctcagcctcctgagtagctggaactacacatccagctatttttttttttttttggtagacacaggatctcaccatgttggccaggctggtcttaaactcctgcgctcaagtgatccgcccaccttgggctcccaaagtactggcattacaggtgggagccactatgcctggcctgcttcctttcgcaaacaggaatcttgtaaatagaattgatcagaacttgttgtttaatgtacacagacctctagctgtactgcaaagctgtgtgcacatgtgttaagtcatctgttctatgtgttctaattataaataagaaaaaacaaatttcaatcagccatgctggaggaagagcaattatgtttctattccttctatcgtaggtgatgtaaaattctcaaacaatgagatagataaaaagtacgcagccaaaaagtgcaggaagaagtgttatggagatggagcaggcccttcgtaaaaacacgatgttggttttctggattttgtatgtttgctttttttttttcctcatcctaaagaaatattcactgtcatacctaattttgtttttgtaagtttgtattcttttctttatagggaggcctcacaaaacctggatcagactcgcccactgccctgtgtctgccctcccgaccccctctccctgcccagcagggatgtgggtggcagtggtgctgtgtggagggtggcgggaggaccgggaagactgcgaccagtgagccgggaggccttg

SEQ ID NO: 11239 - DNA, 3471 bp, Homo sapiens
aggaagcttttataggaaaaggtctttctggctcaccccatcccctcccaattcccagcttctgatggaattgagcaaggggtggggcttagtcagactgctggagccagcctctcgcttgtcctaggattctctgcctaagcttaaggacctggcatttctcaagaaccagctggaaagcctgcagcggcgtgtagaagacgaagtcaacagtggagtgggccaggtaaggactgtcccaccccacccctgccttaggctttattgcccaacatgctcttgagagtgttaaatggatggtagagatttcttcagcaagtgattattgagggcctattctcagtcaccctaaggacaatttttctgaatggcacatgaactaatatcttaagtagtggttaagtaggtgaagaggggaggaaagaacattccaggcagaacagcatatgtaaaggccttgtggtaggaagtagcattataaacatgaggggtgaaaggaggtccatttggctacagtagttggggagcatgctaggaaatgaggctggagaaaccggcagggctaggggcatctctgaccttgtgtggcggtggagttctatggttggagctttctgaccccagggttctgagattgtgtgatcagaactgcttggttctttttctggccccagaaccttgggaaaaatctggagaaaataccacggttgtccagggtgaggaggagctggtggtggaatgctctaatcccagcttgagtagcccctggacagtcaggaaggagcctagctaagtttccttctgcatttttctctgcaggatggctcgctgttgtcctccccgttcctcaagggattcctggctggctatgtggtggccaaactgagggcatcagcagtattgggctttgctgtgggcacctgcactggcatctatgcggctcaggcatatgctgtgcccaacgtggagaagacattaagggactatttgcagttgctacgcaaggggcccgactagctctaggtgccatggaagaggcaggatgagcagctcagccttcaggtggagacactttatctggattccccagctgtcatccatttgctatctccaactttcctgccaccttcatccttgcctcccttcctgcagattgtggacagtagttcctcagcctgcaccctggattccttcttccccttcctagctccatgggactcgccccaagactgtggcttcaaggaccaccagccccttactcttcaagccctgactgtggagttggtagatgcctctgatcctcagtattctctctggcaatgttccacggcttctccttcctgggagctggctccataacttgattttccccaaacgtgttgcaatccctgctgccccttagccacccagggtcttgtgtgggtatgagtgtagaggatgggggtatgccaggcctgggccgtcccaggcaggcccgctggaccctgatgctactcctatccactgccatgtacggtgcccatgccccattgctggcactgtgccatgtggacggccgagtgcccttccggccctcctcagccgtgctgctgactgagctgaccaagctactgttatgcgccttctcccttctggtaggctggcaagcatggccccaggggcccccaccctggcgccaggctgctcccttcgcactatcagccctgctctatggcgctaacaacaacctggtgatctatcttcagcgttacatggaccccagcacctaccaggtgctgagtaatctcaagattggaagcacagctgtgctctactgcctctgcctccggcaccgcctctctgtgcgtcaggggttagcgctgctgctgctgatggctgcgggagcctgctatgcagcagggggccttcaagttcccgggaacacccttcccagtccccctccagcagctgctgccagccccatgcccctgcatatcactccgctaggcctgctgctcctcattctgtactgcctcatctcaggcttgtcgtcagtgtacacagagctgctcatgaagcgacagcggctgcccctggcacttcagaacctcttcctctacacttttggtgtgcttctgaatctaggtctgcatgctggcggcggctctggcccaggcctcctggaaggtttctcaggatgggcagcactcgtggtgctgagccaggcactaaatggactgctcatgtctgctgtcatgaagcatggcagcagcatcacacgcctctttgtggtgtcctgctcgctggtggtcaacgccgtgctctcagcagtcctgctacggctgcagctcacagccgccttcttcctggccacattgctcattggcctggccatgcgcctgtactatggcagccgctagtccctgacaacttccaccctgattccggaccctgtagattgggcgccaccaccagatccccctcccaggccttcctccctctcccatcagcagccctgtaacaagtgccttgtgagaaaagctggagaagtgagggcagccaggttattctctggaggttggtggatgaaggggtacccctaggagatgtgaagtgtgggtttggttaaggaaatgcttaccatcccccacccccaaccaagttcttccagactaaagaattaaggtaacatcaatacctaggcctgagaaataaccccatccttgttgggcagctccctgctttgtcctgcatgaacagagttgatgaaagtggggtgtgggcaacaagtggctttccttgcctactttagtcacccagcagagccactggagctggctagtccagcccagccatggtgcatgactcttccataagggatcctcacccttccactttcatgcaagaaggcccagttgccacagattatacaaccattacccaaaccactctgacagtctcctccagttccagcaatgcctagagacatgctccctgccctctccacagtgctgctccccacacctagcctttgttctggaaaccccagagagggctgggcttgactcatctcagggaatgtagcccctgggccctggcttaagccgacactcctgacctctctgttcaccctgagggctgtcttgaagcccgctacccactctgaggctcctaggaggtaccatgcttcccactctggggcctgcccctgcctagcagtctcccagctcccaacagcctggggaagctctgcacagagtgacctgagaccaggtacaggaaacctgtagctcaatcagtgtctctttaactgcataagcaataagatcttaataaagtcttctaggctgtagggtggttcctacaaccacagccatgattgtcttgtgtcttctgtctgcgcaactcccctcaaacaattttgttcctctggggtcctgagtatcttaattctgggataacttttagactaagaaaaaattgttttctcca

SEQ ID NO: 11240 - DNA, 539 bp, Homo sapiens
ggcggatgacaaggtgagtggccgtgggggtgatctgcagccgggcgtggtcttcactctccttgacctttttagttccggggagaagcgactctggagcggctcaggagtgaggatgtcccttgtttcttctgcggctcctgtcaactgcctcaacagtgtggagtggtgtggggagagcattcggcgaggcgggaggagccgtggatcccccagatgtcccctcctgggaaccatcacgaacccgttactagcacagactcaaaaacattcacccttaaacactcctcactttaccccattccctagctcccgaaattttcttcccagtgacacgatgtttccaatcacacggacactcacaccaccctcattcaaacactcctttgcatacactctgaatttcatacttatatgcgatcaaaatcactcagtccatttacttacacacttgccgacagtcttttttgtcattctcagtcacatccagtcactcacattcagtttgggatgtccttgggaagaaagaggtaaagccc

SEQ ID NO: 11241 - DNA, 2303 bp, Homo sapiens
aaagtattccctgtgttctctccagtaatttcagctggttcctttttatgccctcttgacacagtcacattctacagtgtacagaaaataacctgctgtctgtagaagtggtgaatggtttcatgattcccttctttttagtgtgggtgagttttcttcactctttttctgttgcctgcatccttggccatcatgaatgttttgctttctctcttgcagatgacacaattggtactgcctggcatggtggaaaggtgagtcacaagctcacatacaaacactgtggaagcagagctcatgattatttagagggagaatccttgctttgaaaaaatcactgaagtgactaatgaaccaagcctccatgtcttagccacagagtgatgtaccaggcgagtcacagtagagcatgagtcatcggtggtggaggccttttccactcgattccctttttatttctctctctagggttgtagtggttcctttagatcaggatgaaaaagcctgcctgagtcaccatcactaactcaattgcctactattctgagggggcggatagagttcctgggatattcccgggaataccttcttaaagctgtattctctcaaagccaaaatcagtggagttggatgaagcaagacctcttcctctggtttttcactttttactgggagaatggctgttatataaagtgattataagatgtcaaaccaacccttggaggaaaaggcaatgtccactcgccccatctttgttccagtttgaattggttctgctagtacatgccgaatgtcttcattttgattgagaaatatgttgtagatttctgttatctgaaatagcatgaagtgtagaattgtaattaagctgtttcttccttggaaaaatctgaatgatgtctaggccttcaaagaaaagctgctaaaaagatttgggcttgcatcctgagctagctcgatcatttgctgaatttagggcatcgtagtcatctttttttctgcaaaataactatgagtttggaagagacccagaggaatcacagctttgaaaagggaagacccaaggaccctacttctgttaggaaacctctatgacctactccaggcagggattacagcttatgtttattgagtatatagtaagtgccaggaacttagtaagtgttaactcatttaactttgatagcctcccaccattgtacagatgaggaaactgaggttaggaatccatttgttgagcatctacagggactagttaagaaacagtttctcagcaaagctccttgtaatcccattttatatacactattttgtgtattttaattgttttattttagtaacacttccctttaaaatcttcaaactgcctattgttaggtgccagtgggagtggacccctgatggtcagatatataaatggcagtggttagaccagaccagaaccctagaagatggtagagttggggcaaagtagaacccaggagggattaaatttgggccatcaccttaatcctagttttgacatctgcaggtaacatggtattggttcagaatagtaaatctatccattaaaaaagaaacacttataaaccacagaggtattgtaaaaggaatttttaattatgttgatgaaaaccatatcaaaagagataatggttgcaaaatcattttacagcataaagtcttagagtcaaagagtcacagaaatccagtgcattaaattaattgacagtaacttccctcctttgacagatgaaaaaatagaggcccaaagagatggagtgctatgaagctatacagttagtaaataatacaaaaccaagaagctgggaacttcactgctatctctgtagacctgacagccatgatcacagctggagcattacataaaggcaatgcaaaaaaggagagtccatccattcaataggcattcatttagtcaagcgtctcaaggatgagttggatccttgccttttaagaaatcaagttgaagctgggcgcagtggttcacgcctataatcccagcactttgggaggctgaggtgggtgaatcacttgaggccaggaattcaagaccagcctggtcaacatggcaagacctcatctctactaaaagtacaaaaacattagctgggcgtggtggcacacagctataatcccagctactcaggtggcttaggcacaagaatcacttgaaccctgggaggcattggtcgcagtgagccaagatagtgccactgcactccagcctgggcaacagagcgagaccctgtctcaaaaaaaaaaaaaaaaaaaaaaggaaa

SEQ ID NO: 11242 - DNA, 101 bp, Homo sapiens
gcttgaacccaggaggtggaggttgcagtgagccgagatcacaccactgcactccagcctgggtgacagagtgagactctgtctcaaaaaaagaaaaaaaa

SEQ ID NO: 11243 - DNA, 160 bp, Homo sapiens
cctgggtaaagacatttttattaccagtctccttccttattctgtttctggtgatctcagaactttggagaactgaattatagcttcccttcacaaaatgctgggggaactctttataatactttagctaagcattatggtccctgatgaaatgtgctaa

SEQ ID NO: 11244 - DNA, 15090 bp, Homo sapiens
acgttccctacttcctgtgctcttgcggagacgcgcgcgtcggggtttaacgcgtttctgggccgccgtaagcccggcctaggggcagctttgactcgagagccggctataggcgcatggaaggttccctggaacgggaggcgccagcgggggcgctggccgccgtgctaaagcacagctcgacgttgccgcccgaaagcacccaggtccggggctacgacttcaaccgcggtgtgaattaccgcgcactgctggaggccttcggcaccaccggcttccaagcaaccaacttcgggcgcgctgtacagcaagtcaatgccatggtgaggaccgggcggaatttctagggacgcggaggggcgtggcttgtagaaccaacgcggtactagacgggggcagcgtttccagtggaggggatatgtcttttatttgagttgcccaatagttggaggaaggcgggacctattctgggcgggagtttctgtcctgggaaggggattttgcactctggtagttacatgctggtacggtaacctgaggaggcgaggactgattcttggtgtgggggcgggttctaggtacatttaaagctttctggaatgggcggagcctggggcaagacaaattaagggaggatatgggaggaggagcctaagtctgggcggttcttgaatttagatttgcttttcccagcggggaagggaccggatctgaaaggagatgctctctgattcctaaaagggtgggggctggctgggcgcggtggcgcatgcctataatcccagcattttgggaagccgaggcgggtggatcaagagaagaggagttcgagacaagcctggccaacatggtgaaaccctgtctctactaaaatgcaaaaaattagccgggcatggtgttgcgcgcctgtagtcccagctactcgggaggctgaggcaggagaatcgcttgaacccgcgaggtggaggttgcagtgagctgagattgcgccactgcactccagcctggtgacagagcgatactctgtctcaaaaaaaaaaaaaaaaaaaggccgggcacggtggctcatgcctgtaatctcagcattttgggaggccgaggcgggcggatcacctgaggtcgggagttcgagaccagcctgaccaacatggagaaaccccgtctctactaaaatgcaaaaaattagccgggcatggtggtgcgcgcctgtagtcccagctactcgggaggctgaggcaggagaatcgcttgaacccgggaggtggagcttgcagtgagccgagatcgcgccattgcactctagcctgggtaacaagagtgaaactccgtccaaaaaaaaaaaaaaaagggtgggggcaaatcctgaacgtgtgtcttgagatctggtctgggaaggggcagagtttacacaggagatgttccttggtcccctgtagaactggtcctgtatccctgaatgtgcagggcctggggtgaaatctgtttctggagcccacctggagtcctgagtctgggatttaaggccagtgcttaacttgacttggcccttactcacagatcgagaagaagctggaaccactgtcacaggatgaagaccagcacgcggacctgacccagagccgccgcccacttaccagctgcaccattttcctgggatatacatccaacctcatcagttcaggcatccgtgagaccattcgctaccttgtgcagcacaacatggtggggacctggtgaggccgtggccttggcctctgggtcaatgggcaatgcagttattgatcgtttaagtgagatgggcagataggggtctgttataagcagaggaatagaatcaagttttgttttgtagcagagctccctcataagagtcactggacaaggatgaggttagaagttctgcccagaatgagggcaggggcttccttcttgggccaaattcactgccttgtggctgcaggtggacgtattggtgaccacagctggcggcgtggaggaagacctcatcaagtgcctggcgcccacatacttgggcgagtttagcctcagggggaaggagctccgggagaacgggatcaataggtgagaaccctgagtggtgttgggcaggggagctggaccaagggtcctggggcctgatgcctacatgcctcctgttctcaggatcggaaacctgctggtgcccaatgagaattactgcaagtttgaggactggctgatgcccattctggaccagatggtgatggagcagaacacagaggtggggctggggcaacctggaggggccagttcagtgggagtcaggggaggcatggcctgaaggtcacatcctctcctagggtgtaaagtggacgccttctaagatgatcgcccggctgggcaaggagatcaacaacccagagtccgtgtattactgggcccagaaggtgaggacctaagcgggagcaaagtagccagactttggcatgtgttaacttatttcatctttccagcctcctggggattcagtactgttattctcagcatcctcactcttagatgaggagactcaaacacagataggcgtggtaattttttttttttttgagacaggatcttgctctgtcacctaggctggagtgcagtggtgtgatcacagctcattgcagcctcaacctcctggggccaagcagtcctcccacctcagcctctcgagtagctgggaccacaggcacatgccatcatgcccagctaattttaaaaattttttgtagagatgggggtctccctgtgtttcccaggctggtcttgaactcctggcgtcaggcagtcctcccaccttggcctcccaaagtgctgggattacaggcgtgagccactgtgcccagccaggctaggtaattttgtctgaagtcacacagataactagtggggcctcagcatccttatgctcctcccagactatctctggaacagtagaggcaacacttagcaactctcctggggcctggctcagggtcccacactcccagatgctataaaataagagctacccactccctttaattagagaatcagaacctgaaaaaaaaaaaaaaaaagctacatagtctttttttttttttttttttttttgagacagagtcttgctctgtcgcccaggctggagtgtaatggtgtgatttcagctcactgcaccctccacctcccaggttcaagtgattctcccgcctcaccctcctgagtagctgggactataggcacccaccatcatgcccggccaatttttgtatttttctacagatggggtttcaccatgttggccaggctggtcttgaactcctgacctcaagtgatccacccgccttggcctcccaaagtgctgggattacaggggtgagccaccacacccagcctacttactctttcttttttacgagacagggtctcattctgtttcccaggctggagtgcaatggcacaataatggctcactgctgtcttgagcttctgggctcagtcgattctcctgcctcagcctgctgagtagctgggactacaggtgcgtgccaccatgcctggctaattgtttttgtagagatgggaactcaccatgttgcacaagctggctctttttttttttttgagacggagttttgctcttgttacccaggccagagtccaatggcgcaatcttggctcacagcaacctctacctcctgggttcaagcaattctcctgcctcagcatcaagttcccaagtagctgggattataggcatgtgccaccacccctggctaattttgtatttttagtagaggcagggtttctccatgttggtcaggctggtgtcgagctcctgacctcaggtgatccacccgcctcggcctcccaaagtgctgggattacaagcgtgagccaccgcgcccggccacaagctggctctttaaaaaagaattagacggccgggcacggtggctcatgcttgtaatcccagtactttgggggctgaggcgggtggatcacctgaagtcaggagttcaagaccagcctggccaacatggtggaaccctgtctctactaaaaaaacaaaatgcaaaattagctgggcatagtggcatgcgcctgtaatcctagctactcgggaggctgaagcaggagaatcactggaacccaggaggcagaggttgcagtgagctgagatagtgccattgcactccagcctgggcaacgagtgaaactccgtctcagggaataaaaaaaaagagagagaaacagctcagcaagctaagaataggctggttctttatgtgccaggcactatactaagtgttttctgtgggttttctcatataggcctcatctgtgagaggtgtttctgttatgcttataattgaggaaacagtcctagagaaattaggcaccccatccacagtcagatagtcatatagccagcatggagacgaggctctgagctccagccactgtcctgtcatgttctctgcagaaccacatccctgtgtttagtcccgcacttacagacggctcgctgggcgacatgatcttcttccattcctacaagaacccgggcctggtcctggacatcgttgagggtgaggcgctagggccacagaggagaggggaaggagggctggctgagtccaaggcctgacttcggcgctcttcccccagacctgaggctcatcaacacacaggccatctttgccaagtgcactgggatgatcattctgggcgggggcgtggtcaagcaccacattgccaatgccaacctcatggtgagtgggggtggcgcttcggcccactctgcagacatgctgtgtggtgggcctatgccatgtgctgggtagacagcatgaactagacaggccaggatccctgctccccgggactgatgttctagtaggggagatagcaaacaagtgacatccacgtcagggggcagtcattgctacggggaatactaaatgatggcatgagaagagaaaggggtgctgtccaacaagaggttttggaaggaggcttctggaagtgtgagctgggagcaggggtttggggaggcatctcccaggagctatgtggttgtctcccgtgccaggagtttgtgctgctgtactagcattgagcttctggattgcaaagttcccaggagagggaacagccattgcaaaggctctggggcgcctgaagtaatccaggaacagctgggtacctggtgaggggaaggtggagtggtgagggccaggaggtgatgcagggaggtgccacagggagcctgctgggccctgtgggctgaggcggggctttggcttttgcactgagagaagtgggagaggacttgactcgggttcccatgctccccctggtggccatgtggtgaacagatggtggcaggtgagtgagaactccagtccaggacagtggtgaccatgcagggatcaggaggcaggcggtggttggatttggagggcttctgaagatagagttgctggcagctcctgccttgcagatggggcagggttgttgacacctggctgttgggtctggggaaacacagccatcgttgcccagcagctctagtgaccccagacattgacatgggccctgtctgggagcgaatgtctgtgaagggcttccttcatctgggacacacctctcagcctgtttggctacggtgtcctccctctgtgtctgtctcctgtgactggctgactgggcccaccgtgcccccgcctccccacagcggaacggggccgactacgctgtttacatcaacacagcccaggagtttgatggctctgactcaggtgcccgaccagacgaggctgtctcctggggcaagatccgggtggatgcacagcccgtcaaggtaagcgctggctgggtggggcatagggtctctgggacgatgagtgtgggtcccatggcttacccaggttcccccctacccaggtctatgctgacgcctccctggtcttccccctgcttgtggctgaaacctttgcccagaagatggatgccttcatgcatgagaagaacgaggactgagcggctgcggtcccaggaaggtcttaccccctcttctatttattaatttgcagacccagcccctcccctactttttggtcagctacgtctctagaataagatggtatctgaagtccttccatgtctgtgtctcggtccttggtcctgttggtgggtcccctggcttcagcctgctccatcctctgcctcataggcctcctctcgccagcactggacgctgcctcccatggcggtcagcaggcagggctctgttgggtggtaggccagcgactgcaccacaccggaacccacaggcagggccagagccagcgcaccctgtggagcgaggggtagggagtggttatctgtggctgggctgtaccctggtttctgaggtccctgggcaccccccatctcagtcctgcctgaagccctcagtcacctctccccgaccttcagccacctgcctctaattgcctcctagacactgcaaaattaatctacctcagactgagcccctcagtagctctgtcctaccaggtgttcaggccgcaagtcttgggagcctcttattgattttttattttttaaaatagcagagatggggtcttaccatgttgcccaggctggtctcgaactcctggcctcaagtgatcctcctgccttggcctcccaaagtgctaggactacaggtgtgagccaccatgcctggctttgggagtctttttctttttctgtttttttttgagatggagtcttgctctgtcgccaggctggagtgcagtggcgccatctgggctcactgcaacctccgactccctagttcaagcgattctcctgcctcagcctcccgagtaggtgggattacaggcacgcgctaccatgcccagctaatttttgtatttttagtacagatggggtttcaccatgttggccaggatgatctctatctcctgacctcgtgatccacccccctcggcctcccaaagtgctgggattacaggtgtgaaccaccatgcctggccgggagtctttttcttgtaccacatgttcctctatcagttattcctcttggctctgcttctagaccatgtccagagactgctgattttctgccactaccatgtttggagcatgccttgctcacagcttgcctgttccctgccaccagctgggctccatcctgtccatttggcagccccaatgatccccacttcccctggtcccaacacaatgtaaacagttcctcaagcaagccatgcttcctctttccaccttgaaaatgtcccttgatgtgcctgccctccaaggcaacttctgttctactgggcccataagaaataggtggaacattcttgctaccttagttcctaaagcaagagcttgtccgccaagtcttcagggcccccccggttccctccatcctcttatgggccttagttcccctggccaagcccagcgctgatgtctcctttgccgagattcccccggctctgaccccactacaccaggatggtctgtttctggcctgactccccaccaggctgggacatgtcaaggacagggctcagggcttgaaaccatgcacagggatgctaagatgtagctccagtttcttgaatgactgcagccctatctcacccaaggttagacatggccgtcggctcccccttgcccaggggtcagtgccagttgctcggcctggcatctgcagcccagcctgaccccggatcttgccgcacctgccgccaccctgaagcctttgtttcctgactgatgcatgcgcaggctacacctcttaacatatgctgttccctttgcctggaatgcccttcctgcctcatcttctctctagcccaagctgggcacggtgtctcaggcctgtaatcccagcactttgggaggccgaggcgggtgaatcacttgaggtcaggagtttgagaccagcctggccaacatggtgaaaccctgtctctactaaaaatacaaaaattagccaggtatggtggtaggggcctgtaatcccagctactcaggaggctgagacatgagaatcacctgaaccctggggggaagaggttgcagtgagctgagatggcgccactgcatttgcctgggcaatagtctcaaaaaaagaaaaaagggccgggtgtggtggcttacgcctgtaatcctagcacttgggaaggctgaggtgggtggatcatgaggtcaggagtttaagaccagcctgaccaacatagtgaaaccctgtctctactaaaaatacaaaaattagctgggtgtggtggcacgcacctataatcccaactactcaggagactgaggcaggagaatcgcttgaacttgggaggcggagtttacagtgagccaagattgcgccactgcactctagcctgggcgacagagcaagacttgtctcaaaaaaaaaaaaaaaaaaaaaaaaaagatcctagccttcaggccctggagtgactgaggtaaggacagggctgagatggggcaggcatctaggtatgaagtagggctgggggcacctcacctccaccaggtcccagaagaacaccttcccgtcctcagaacagctgaccacatgtgtgtcacgctcgctcaggcagcagtccagcttgtattcctggttcttatggcccttgtacctaagggtggacaggatcggggggcttggtcctctccaggggtgggagaggagggaaggggatccccacgaccacaaggactcactcgcccagcagctcccctgtgtctttgtccaggagccgcaatgtggagtccaggctggacaccagggtgcactgcccatcccggctgaagcaggtgcaggtgatggggccttgggggaagggtgggtaggtgagtgagggtggggtgcccctggttggccccccatcttccctgcctgtcccacatccccagccacactcactgcccacgtagtctgagaagagctgccccatccttaggtcatagcgtctcacgcggccatccacggagctgcaggagagggtagatccagcgggaaccttgactacactcacatggctccaggcagccctgtgccttcccagcccagtgggcctgctcttccagtgcacaggagtggaattctgaagctctggccttgagactcaggcccagggccaattacgtcctactccatcatttccaagacccacaccccctttccaagcccttggagtccttctgattcccccttttcttccttttgtttgagacagagttttgctcttgttgctcaggctggagtgcaatggcatgatcttggctcaccggaacctctgcctcccgggttcaagagattctccttcctcagcctcccgagtagatgggaatacaggcatgcaccaccacgccctgctaattttgtatttttagtagagacggggtttctccatgttggtcaggctggtctcgaactcccaacctcaggtgatccgcccacctcagcctcccaaagtgctgggattacaggtgtgagccaccccacctggcccaattcccccttttcctgcattctccagctcctcctcctcagtactcagtcccaccactttccccactacccagcaccagcatctagactgttctggtctccctgcaccccccacagccaccagagggagcacttttcaaagtacagttgacccatgaacaacacggtttgaactgaacgcgtccacttatatgtggattttcttctgcctctatcagctgtgagacaccaagatcaatccctcctcttcctcctcctctgctttctcaacacgaagatctttatgacgatctcttcacttccacttaatgaatagaaaatatattttttccaccaggcgcggtggctcacgcctgtgattccagctctttgggaggccagggcaggtggatcacgaggtcaagagatggagaccctcctggccaacatggcgaaaccccgtctctactaaaaatacaaaaattagctgggcgtggtggcacgcgactgtagtcccagctactagggaggctgaggcaggagaatcgcctgaacctagaagttagaggttgcagtgagccgagatcacgtcactgcactccagcctggcaacagagcgagactgcgtctcaaaaaaaacaaaaattcttccttatgattatttttatgtatttatttatttaatttatttacttattttgagacggagtcttgctctatcgcccaggagtgtagtggtgcgatgtcggctcacagcaagctctgcctcctgggttcactccattctcctgcctcagcctcctgagtagctgggactacaggcgcctgccactatgcccggctaattttttgtatttttagtagagacggggtttcaccgtgttagccagaatgatctcgatctcctgacctcatgatccgcctgcctctgcctcccaaagtgctgggattacaggcatgagccacagcgcccggcctatttttatttatttttagaaatcattttatctttttttttttgagatggagtctcactttgtcgcccaggctggagtgcagtggcacaatctcggctcactgcaacctccaactcccgggttcaggcgattctcctgcctccgcctcccgagtggctgggattacaggctcccgtcaccacacctggctaatttttgcatttttagtagagacggggtttcaccatgttggccaggctgatctcaacctcctgacctcaagtgatctgcccaccttggcctcccaaagtgctgggattacaggtgtgagccaccgtgcccggccagattattattattttgtagacagtctgtctttcacccagcatggagtgcaatggtgcctcgaactcttggactcaagtgatccttccacttcagcctcccaagtagctgggattacagctgtgtgccactgtgcccagctgagagtaggttttaatctgagcatgggggcagctatgattccccgtagcacctggggtgagaccaggtcctggctccactcaccctgccaggatctcgtggtctgacaccttcacactggacacgccatctctggcctcatccagcgtctgcactggctcaggcctccgtgagcggcaatcccaacagcggatactggaatcaatagagcctgtgaggccagcatgatggtgaggtcaggtttggagggggagggcagcaccctgggcccccgtgcttaggccccagactcaccggacaggataactgtggcctcttcattaaactgcaccgtgttcaccttctgagaaagttattgccactcagaggaggctggactttggaggactgggataaaggcagggttcccagtgtcggttaaagcaagggcgaaggggaggtgaaaggttttgggggaacagcaaggacaggggttggtgactgcctagcctggcatgcggagtgggggatcgtcatctggggaagggatccttacggtgtaatgggggtggccgtgtcaccacctatgcgctaatacgggtcccctccactcaaatgagggtctccaggctttcactcacccctgcgtggccccggaatttgcgcacgacctgccctgatgccacatcccacagaaccaccgccttgtccccgccgccggagcagagactactgttgtcaaaggagctggagtaaaggaggaggaggatcagcatcgacctcggatcccagcctcagcgctcccatcccagcctggtccccggctcacccggccgcatccagcacctcgtagccgtggccgctgtacgtccgcagcagcgtcccccgaagcgggttccacagcttcagcgtcttgtcactgccgcacgtcaggcagtaattgccatccactggggaacaccaggcgggggttactgggccgtcgatctcaggaggcgggaggaggacccggaatgaagacgaaggcgctcaccattaaatcgtacggctcgcactgccccctgcccgcagtccagcgtcttcaaccgtttctgcggcagctctggaggccgcggctttggctcagggaaagccatgctcccaggactccttccttgcagccttaaatcggtctgtacggaaaattccgcgccttagaaacccacgcttgggtgtaaccttattattgttcttcctgacctacttcctgtttatcacttccgggttcatcattttggcatttcggtgatcgggttggaactattgaagcccgctttcaggttcttttccccattttccctttgaaaggaagacttctggcttctcctaaatctccgttctctgggtaaggggagtccaagcctctgtcatgaggaacggaaatgcgagggcctcgggtgttactctaaaatccgccctcagcttgcacgccggaagctgcgattcctgcagcggaagaggcgtgatctggccttcgactcgctatgtccactaacaatatgtcggacccacggaggccgaacaaagtgctgaggtgaggaccccagcgtcgtgggcacgggttcgggttgtgggtgtggatcggggccctgggaagcgcctgtctatcccgggggcaggacctgagcgcccctgaccctcgagcctgtcgcaggtacaagcccccgccgagcgaatgtaacccggccttggacgacccgacgccggactacatgaacctgctgggcatgatcttcagcatgtgcggcctcatgcttaaggtgggcggggttgagcttctatgggtgtagttggacctgagaacgaggcccgggggcgggtttggaatgaagcggggtgtcttgtcattgctgatggggcgggacctgagatcggccgggagtggggctgcgatgacgctgggccgagaaagccccagtctttggtgaagtcaaggattcgagtcaggttggggatgtggcagattggtctgcgagtggggccaggctttgaagcaacttggagaggagttgtggaaaaagggcagggtcttaagcatgtgggatgtcagagtctctcttggtcctgagagacgcaggccagacagtaggactagaaaccacgtatctagagtatgccatgagcaggtgggactgaggaattccgggtggggcaaggtcccagctgcatcagatggaatcagtgggcatgatctggtgtctggaaaggtggcttcggggactcattgttgtgcctttcactaacctgcccacccacttacctttccctagctgaagtggtgtgcttgggtcgctgtctactgctccttcatcagctttgccaactctcggagctcggaggacacgaagcaaatgatgagtagcttcatgtgagacttgccctacagaacaagtgactcttgagtaaggggtggggggaccccagcctggccatcctagactgacacctctctcctgtctcaggctgtccatctctgccgtggtgatgtcctatctgcagaatcctcagcccatgacgcccccatggtgataccagcctagaagggtcacattttggaccctgtctatccactaggcctgggctttggctgctaaacctgctgccttcagctgccatcctggacttccctgaatgaggccgtctcggtgcccccagctggatagagggaacctggccctttcctagggaacaccctaggcttacccctcctgcctcccttcccctgcctgctgctgggggagatgctgtccatgtttctaggggtattcatttgctttctcgttgaaacctgttgttaataaagtttttcactctggctgtcagcctcttctgttcagtggggtgttcctcctacctggcgggaagggctctagccccataggcctggtgtggggccccagtctggaggcttctggctgttcatttgcttacttcataaaccttgtgtcttaagtcaggtgctagggacaagacagtgacttctgccctctggcaactcaccagatggccctgctgacctagataatctaggctttggtttccttttttttttttcctttttaagaaagaaaatggtcttgatctgtcatgcaggctgagtgcagtggcacaatctatgttcactgcagcctcaaactcctgggctcaagcaatcctcccacctcagcctgccacgtaactgggaccacaaatgcgtgctaccatgcccagttaattcttgttttttttgagacagagttttgctcttgttgcccaggctggagggcaatggcatgatcttgatctcggctcactgcaacctccgcctcccaggttcaagtgattctcctgcctcagtctcccaagtagctgggattacaggcatgtgccaccatgcccagctaatttttgtatttttacattttgtgtaaaattacaaattttgtgttttcaaacccgtctctacaaaacaacccatgttgcccaggctggtctcaaactcccaggcccaagtgattcaccagcctggccctcccaaagtgctgggattgcaggcttgagccactgcgcctgccctgggctttgttttcttatcagagaatgaactggtaggaattgggaaaggcatgaaagactcggggtccttccccacttgtcagaccctcttttctctccggaacacccagggatccttctcaaccaggctggatcccatccctggtactccaggggtatttacccaacgtcccaatccccacagtataggactcttcatcagatcctcctcttaggcaagctaggtccttccaggaccctagcgctgaaggtccatgggacggacaccctggattcccatggacacactacaccggctaggaaaacccggcccccttaggaaaagcacttctgctcctaccggcattaagaggcattccgtcttggaattccggcattaagaggcattccgtcttcatagcccgtgagacgccagtgtcacctttagcccaaccagtgccctgagggtggcattttcctaccttcctgtaacgacccccgggattgcccagggctacagcctctctcccgtgagcctccagaccgcgccctggccccgcc

SEQ ID NO: 11245 - DNA, 15090 bp, Homo sapiens
acgttccctacttcctgtgctcttgcggagacgcgcgcgtcggggtttaacgcgtttctgggccgccgtaagcccggcctaggggcagctttgactcgagagccggctataggcgcatggaaggttccctggaacgggaggcgccagcgggggcgctggccgccgtgctaaagcacagctcgacgttgccgcccgaaagcacccaggtccggggctacgacttcaaccgcggtgtgaattaccgcgcactgctggaggccttcggcaccaccggcttccaagcaaccaacttcgggcgcgctgtacagcaagtcaatgccatggtgaggaccgggcggaatttctagggacgcggaggggcgtggcttgtagaaccaacgcggtactagacgggggcagcgtttccagtggaggggatatgtcttttatttgagttgcccaatagttggaggaaggcgggacctattctgggcgggagtttctgtcctgggaaggggattttgcactctggtagttacatgctggtacggtaacctgaggaggcgaggactgattcttggtgtgggggcgggttctaggtacatttaaagctttctggaatgggcggagcctggggcaagacaaattaagggaggatatgggaggaggagcctaagtctgggcggttcttgaatttagatttgcttttcccagcggggaagggaccggatctgaaaggagatgctctctgattcctaaaagggtgggggctggctgggcgcggtggcgcatgcctataatcccagcattttgggaagccgaggcgggtggatcaagagaagaggagttcgagacaagcctggccaacatggtgaaaccctgtctctactaaaatgcaaaaaattagccgggcatggtgttgcgcgcctgtagtcccagctactcgggaggctgaggcaggagaatcgcttgaacccgcgaggtggaggttgcagtgagctgagattgcgccactgcactccagcctggtgacagagcgatactctgtctcaaaaaaaaaaaaaaaaaaaggccgggcacggtggctcatgcctgtaatctcagcattttgggaggccgaggcgggcggatcacctgaggtcgggagttcgagaccagcctgaccaacatggagaaaccccgtctctactaaaatgcaaaaaattagccgggcatggtggtgcgcgcctgtagtcccagctactcgggaggctgaggcaggagaatcgcttgaacccgggaggtggagcttgcagtgagccgagatcgcgccattgcactctagcctgggtaacaagagtgaaactccgtccaaaaaaaaaaaaaaaagggtgggggcaaatcctgaacgtgtgtcttgagatctggtctgggaaggggcagagtttacacaggagatgttccttggtcccctgtagaactggtcctgtatccctgaatgtgcagggcctggggtgaaatctgtttctggagcccacctggagtcctgagtctgggatttaaggccagtgcttaacttgacttggcccttactcacagatcgagaagaagctggaaccactgtcacaggatgaagaccagcacgcggacctgacccagagccgccgcccacttaccagctgcaccattttcctgggatatacatccaacctcatcagttcaggcatccgtgagaccattcgctaccttgtgcagcacaacatggtggggacctggtgaggccgtggccttggcctctgggtcaatgggcaatgcagttattgatcgtttaagtgagatgggcagataggggtctgttataagcagaggaatagaatcaagttttgttttgtagcagagctccctcataagagtcactggacaaggatgaggttagaagttctgcccagaatgagggcaggggcttccttcttgggccaaattcactgccttgtggctgcaggtggacgtattggtgaccacagctggcggcgtggaggaagacctcatcaagtgcctggcgcccacatacttgggcgagtttagcctcagggggaaggagctccgggagaacgggatcaataggtgagaaccctgagtggtgttgggcaggggagctggaccaagggtcctggggcctgatgcctacatgcctcctgttctcaggatcggaaacctgctggtgcccaatgagaattactgcaagtttgaggactggctgatgcccattctggaccagatggtgatggagcagaacacagaggtggggctggggcaacctggaggggccagttcagtgggagtcaggggaggcatggcctgaaggtcacatcctctcctagggtgtaaagtggacgccttctaagatgatcgcccggctgggcaaggagatcaacaacccagagtccgtgtattactgggcccagaaggtgaggacctaagcgggagcaaagtagccagactttggcatgtgttaacttatttcatctttccagcctcctggggattcagtactgttattctcagcatcctcactcttagatgaggagactcaaacacagataggcgtggtaattttttttttttttgagacaggatcttgctctgtcacctaggctggagtgcagtggtgtgatcacagctcattgcagcctcaacctcctggggccaagcagtcctcccacctcagcctctcgagtagctgggaccacaggcacatgccatcatgcccagctaattttaaaaattttttgtagagatgggggtctccctgtgtttcccaggctggtcttgaactcctggcgtcaggcagtcctcccaccttggcctcccaaagtgctgggattacaggcgtgagccactgtgcccagccaggctaggtaattttgtctgaagtcacacagataactagtggggcctcagcatccttatgctcctcccagactatctctggaacagtagaggcaacacttagcaactctcctggggcctggctcagggtcccacactcccagatgctataaaataagagctacccactccctttaattagagaatcagaacctgaaaaaaaaaaaaaaaaagctacatagtctttttttttttttttttttttttgagacagagtcttgctctgtcgcccaggctggagtgtaatggtgtgatttcagctcactgcaccctccacctcccaggttcaagtgattctcccgcctcaccctcctgagtagctgggactataggcacccaccatcatgcccggccaatttttgtatttttctacagatggggtttcaccatgttggccaggctggtcttgaactcctgacctcaagtgatccacccgccttggcctcccaaagtgctgggattacaggggtgagccaccacacccagcctacttactctttcttttttacgagacagggtctcattctgtttcccaggctggagtgcaatggcacaataatggctcactgctgtcttgagcttctgggctcagtcgattctcctgcctcagcctgctgagtagctgggactacaggtgcgtgccaccatgcctggctaattgtttttgtagagatgggaactcaccatgttgcacaagctggctctttttttttttttgagacggagttttgctcttgttacccaggccagagtccaatggcgcaatcttggctcacagcaacctctacctcctgggttcaagcaattctcctgcctcagcatcaagttcccaagtagctgggattataggcatgtgccaccacccctggctaattttgtatttttagtagaggcagggtttctccatgttggtcaggctggtgtcgagctcctgacctcaggtgatccacccgcctcggcctcccaaagtgctgggattacaagcgtgagccaccgcgcccggccacaagctggctctttaaaaaagaattagacggccgggcatggtggctcatgcttgtaatcccagtactttgggggctgaggcgggtggatcacctgaagtcaggagttcaagaccagcctggccaacatggtggaaccctgtctctactaaaaaaacaaaatgcaaaattagctgggcatagtggcatgcgcctgtaatcctagctactcgggaggctgaagcaggagaatcactggaacccaggaggcagaggttgcagtgagctgagatagtgccattgcactccagcctgggcaacgagtgaaactccgtctcagggaataaaaaaaaagagagagaaacagctcagcaagctaagaataggctggttctttatgtgccaggcactatactaagtgttttctgtgggttttctcatataggcctcatctgtgagaggtgtttctgttatgcttataattgaggaaacagtcctagagaaattaggcaccccatccacagtcagatagtcatatagccagcatggagacgaggctctgagctccagccactgtcctgtcatgttctctgcagaaccacatccctgtgtttagtcccgcacttacagacggctcgctgggcgacatgatcttcttccattcctacaagaacccgggcctggtcctggacatcgttgagggtgaggcgctagggccacagaggagaggggaaggagggctggctgagtccaaggcctgacttcggcgctcttcccccagacctgaggctcatcaacacacaggccatctttgccaagtgcactgggatgatcattctgggcgggggcgtggtcaagcaccacattgccaatgccaacctcatggtgagtgggggtggcgcttcggcccactctgcagacatgctgtgtggtgggcctatgccatgtgctgggtagacagcatgaactagacaggccaggatccctgctccccgggactgatgttctagtaggggagatagcaaacaagtgacatccacgtcagggggcagtcattgctacggggaatactaaatgatggcatgagaagagaaaggggtgctgtccaacaagaggttttggaaggaggcttctggaagtgtgagctgggagcaggggtttggggaggcatctcccaggagctatgtggttgtctcccgtgccaggagtttgtgctgctgtactagcattgagcttctggattgcaaagttcccaggagagggaacagccattgcaaaggctctggggcgcctgaagtaatccaggaacagctgggtacctggtgaggggaaggtggagtggtgagggccaggaggtgatgcagggaggtgccacagggagcctgctgggccctgtgggctgaggcggggctttggcttttgcactgagagaagtgggagaggacttgactcgggttcccatgctccccctggtggccatgtggtgaacagatggtggcaggtgagtgagaactccagtccaggacagtggtgaccatgcagggatcaggaggcaggcggtggttggatttggagggcttctgaagatagagttgctggcagctcctgccttgcagatggggcagggttgttgacacctggctgttgggtctggggaaacacagccatcgttgcccagcagctctagtgaccccagacattgacatgggccctgtctgggagcgaatgtctgtgaagggcttccttcatctgggacacacctctcagcctgtttggctacggtgtcctccctctgtgtctgtctcctgtgactggctgactgggcccaccgtgcccccgcctccccacagcggaacggggccgactacgctgtttacatcaacacagcccaggagtttgatggctctgactcaggtgcccgaccagacgaggctgtctcctggggcaagatccgggtggatgcacagcccgtcaaggtaagcgctggctgggtggggcatagggtctctgggacgatgagtgtgggtcccatggcttacccaggttcccccctacccaggtctatgctgacgcctccctggtcttccccctgcttgtggctgaaacctttgcccagaagatggatgccttcatgcatgagaagaacgaggactgagcggctgcggtcccaggaaggtcttaccccctcttctatttattaatttgcagacccagcccctcccctactttttggtcagctacgtctctagaataagatggtatctgaagtccttccatgtctgtgtctcggtccttggtcctgttggtgggtcccctggcttcagcctgctccatcctctgcctcataggcctcctctcgccagcactggacgctgcctcccatggcggtcagcaggcagggctctgttgggtggtaggccagcgactgcaccacaccggaacccacaggcagggccagagccagcgcaccctgtggagcgaggggtagggagtggttatctgtggctgggctgtaccctggtttctgaggtccctgggcaccccccatctcagtcctgcctgaagccctcagtcacctctccccgaccttcagccacctgcctctaattgcctcctagacactgcaaaattaatctacctcagactgagcccctcagtagctctgtcctaccaggtgttcaggccgcaagtcttgggagcctcttattgattttttattttttaaaatagcagagatggggtcttaccatgttgcccaggctggtctcgaactcctggcctcaagtgatcctcctgccttggcctcccaaagtgctaggactacaggtgtgagccaccatgcctggctttgggagtctttttctttttctgtttttttttgagatggagtcttgctctgtcgccaggctggagtgcagtggcgccatctgggctcactgcaacctccgactccctagttcaagcgattctcctgcctcagcctcccgagtaggtgggattacaggcacgcgctaccatgcccagctaatttttgtatttttagtacagatggggtttcaccatgttggccaggatgatctctatctcctgacctcgtgatccacccccctcggcctcccaaagtgctgggattacaggtgtgaaccaccatgcctggccgggagtctttttcttgtaccacatgttcctctatcagttattcctcttggctctgcttctagaccatgtccagagactgctgattttctgccactaccatgtttggagcatgccttgctcacagcttgcctgttccctgccaccagctgggctccatcctgtccatttggcagccccaatgatccccacttcccctggtcccaacacaatgtaaacagttcctcaagcaagccatgcttcctctttccaccttgaaaatgtcccttgatgtgcctgccctccaaggcaacttctgttctactgggcccataagaaataggtggaacattcttgctaccttagttcctaaagcaagagcttgtccgccaagtcttcagggcccccccggttccctccatcctcttatgggccttagttcccctggccaagcccagcgctgatgtctcctttgccgagattcccccggctctgaccccactacaccaggatggtctgtttctggcctgactccccaccaggctgggacatgtcaaggacagggctcagggcttgaaaccatgcacagggatgctaagatgtagctccagtttcttgaatgactgcagccctatctcacccaaggttagacatggccgtcggctcccccttgcccaggggtcagtgccagttgctcggcctggcatctgcagcccagcctgaccccggatcttgccgcacctgccgccaccctgaagcctttgtttcctgactgatgcatgcgcaggctacacctcttaacatatgctgttccctttgcctggaatgcccttcctgcctcatcttctctctagcccaagctgggcacggtgtctcaggcctgtaatcccagcactttgggaggccgaggcgggtgaatcacttgaggtcaggagtttgagaccagcctggccaacatggtgaaaccctgtctctactaaaaatacaaaaattagccaggtatggtggtaggggcctgtaatcccagctactcaggaggctgagacatgagaatcacctgaaccctggggggaagaggttgcagtgagctgagatggcgccactgcatttgcctgggcaatagtctcaaaaaaagaaaaaagggccgggtgtggtggcttacgcctgtaatcctagcacttgggaaggctgaggtgggtggatcatgaggtcaggagtttaagaccagcctgaccaacatagtgaaaccctgtctctactaaaaatacaaaaattagctgggtgtggtggcacgcacctataatcccaactactcaggagactgaggcaggagaatcgcttgaacttgggaggcggagtttacagtgagccaagattgcgccactgcactctagcctgggcgacagagcaagacttgtctcaaaaaaaaaaaaaaaaaaaaaaaaaagatcctagccttcaggccctggagtgactgaggtaaggacagggctgagatggggcaggcatctaggtatgaagtagggctgggggcacctcacctccaccaggtcccagaagaacaccttcccgtcctcagaacagctgaccacatgtgtgtcacgctcgctcaggcagcagtccagcttgtattcctggttcttatggcccttgtacctaagggtggacaggatcggggggcttggtcctctccaggggtgggagaggagggaaggggatccccacgaccacaaggactcactcgcccagcagctcccctgtgtctttgtccaggagccgcaatgtggagtccaggctggacaccagggtgcactgcccatcccggctgaagcaggtgcaggtgatggggccttgggggaagggtgggtaggtgagtgagggtggggtgcccctggttggccccccatcttccctgcctgtcccacatccccagccacactcactgcccacgtagtctgagaagagctgccccatccttaggtcatagcgtctcacgcggccatccacggagctgcaggagagggtagatccagcgggaaccttgactacactcacatggctccaggcagccctgtgccttcccagcccagtgggcctgctcttccagtgcacaggagtggaattctgaagctctggccttgagactcaggcccagggccaattacgtcctactccatcatttccaagacccacaccccctttccaagcccttggagtccttctgattcccccttttcttccttttgtttgagacagagttttgctcttgttgctcaggctggagtgcaatggcatgatcttggctcaccggaacctctgcctcccgggttcaagagattctccttcctcagcctcccgagtagatgggaatacaggcatgcaccaccacgccctgctaattttgtatttttagtagagacggggtttctccatgttggtcaggctggtctcgaactcccaacctcaggtgatccgcccacctcagcctcccaaagtgctgggattacaggtgtgagccaccccacctggcccaattcccccttttcctgcattctccagctcctcctcctcagtactcagtcccaccactttccccactacccagcaccagcatctagactgttctggtctccctgcaccccccacagccaccagagggagcacttttcaaagtacagttgacccatgaacaacacggtttgaactgaacgcgtccacttatatgtggattttcttctgcctctatcagctgtgagacaccaagatcaatccctcctcttcctcctcctctgctttctcaacacgaagatctttatgacgatctcttcacttccacttaatgaatagaaaatatattttttccaccaggcgcggtggctcacgcctgtgattccagctctttgggaggccagggcaggtggatcacgaggtcaagagatggagaccctcctggccaacatggcgaaaccccgtctctactaaaaatacaaaaattagctgggcgtggtggcacgcgactgtagtcccagctactagggaggctgaggcaggagaatcgcctgaacctagaagttagaggttgcagtgagccgagatcacgtcactgcactccagcctggcaacagagcgagactgcgtctcaaaaaaaacaaaaattcttccttatgattatttttatgtatttatttatttaatttatttacttattttgagacggagtcttgctctatcgcccaggagtgtagtggtgcgatgtcggctcacagcaagctctgcctcctgggttcactccattctcctgcctcagcctcctgagtagctgggactacaggcgcctgccactatgcccggctaattttttgtatttttagtagagacggggtttcaccgtgttagccagaatgatctcgatctcctgacctcatgatccgcctgcctctgcctcccaaagtgctgggattacaggcatgagccacagcgcccggcctatttttatttatttttagaaatcattttatctttttttttttgagatggagtctcactttgtcgcccaggctggagtgcagtggcacaatctcggctcactgcaacctccaactcccgggttcaggcgattctcctgcctccgcctcccgagtggctgggattacaggctcccgtcaccacacctggctaatttttgcatttttagtagagacggggtttcaccatgttggccaggctgatctcaacctcctgacctcaagtgatctgcccaccttggcctcccaaagtgctgggattacaggtgtgagccaccgtgcccggccagattattattattttgtagacagtctgtctttcacccagcatggagtgcaatggtgcctcgaactcttggactcaagtgatccttccacttcagcctcccaagtagctgggattacagctgtgtgccactgtgcccagctgagagtaggttttaatctgagcatgggggcagctatgattccccgtagcacctggggtgagaccaggtcctggctccactcaccctgccaggatctcgtggtctgacaccttcacactggacacgccatctctggcctcatccagcgtctgcactggctcaggcctccgtgagcggcaatcccaacagcggatactggaatcaatagagcctgtgaggccagcatgatggtgaggtcaggtttggagggggagggcagcaccctgggcccccgtgcttaggccccagactcaccggacaggataactgtggcctcttcattaaactgcaccgtgttcaccttctgagaaagttattgccactcagaggaggctggactttggaggactgggataaaggcagggttcccagtgtcggttaaagcaagggcgaaggggaggtgaaaggttttgggggaacagcaaggacaggggttggtgactgcctagcctggcatgcggagtgggggatcgtcatctggggaagggatccttacggtgtaatgggggtggccgtgtcaccacctatgcgctaatacgggtcccctccactcaaatgagggtctccaggctttcactcacccctgcgtggccccggaatttgcgcacgacctgccctgatgccacatcccacagaaccaccgccttgtccccgccgccggagcagagactactgttgtcaaaggagctggagtaaaggaggaggaggatcagcatcgacctcggatcccagcctcagcgctcccatcccagcctggtccccggctcacccggccgcatccagcacctcgtagccgtggccgctgtacgtccgcagcagcgtcccccgaagcgggttccacagcttcagcgtcttgtcactgccgcacgtcaggcagtaattgccatccactggggaacaccaggcgggggttactgggccgtcgatctcaggaggcgggaggaggacccggaatgaagacgaaggcgctcaccattaaatcgtacggctcgcactgccccctgcccgcagtccagcgtcttcaaccgtttctgcggcagctctggaggccgcggctttggctcagggaaagccatgctcccaggactccttccttgcagccttaaatcggtctgtacggaaaattccgcgccttagaaacccacgcttgggtgtaaccttattattgttcttcctgacctacttcctgtttatcacttccgggttcatcattttggcatttcggtgatcgggttggaactattgaagcccgctttcaggttcttttccccattttccctttgaaaggaagacttctggcttctcctaaatctccgttctctgggtaaggggagtccaagcctctgtcatgaggaacggaaatgcgagggcctcgggtgttactctaaaatccgccctcagcttgcacgccggaagctgcgattcctgcagcggaagaggcgtgatctggccttcgactcgctatgtccactaacaatatgtcggacccacggaggccgaacaaagtgctgaggtgaggaccccagcgtcgtgggcacgggttcgggttgtgggtgtggatcggggccctgggaagcgcctgtctatcccgggggcaggacctgagcgcccctgaccctcgagcctgtcgcaggtacaagcccccgccgagcgaatgtaacccggccttggacgacccgacgccggactacatgaacctgctgggcatgatcttcagcatgtgcggcctcatgcttaaggtgggcggggttgagcttctatgggtgtagttggacctgagaacgaggcccgggggcgggtttggaatgaagcggggtgtcttgtcattgctgatggggcgggacctgagatcggccgggagtggggctgcgatgacgctgggccgagaaagccccagtctttggtgaagtcaaggattcgagtcaggttggggatgtggcagattggtctgcgagtggggccaggctttgaagcaacttggagaggagttgtggaaaaagggcagggtcttaagcatgtgggatgtcagagtctctcttggtcctgagagacgcaggccagacagtaggactagaaaccacgtatctagagtatgccatgagcaggtgggactgaggaattccgggtggggcaaggtcccagctgcatcagatggaatcagtgggcatgatctggtgtctggaaaggtggcttcggggactcattgttgtgcctttcactaacctgcccacccacttacctttccctagctgaagtggtgtgcttgggtcgctgtctactgctccttcatcagctttgccaactctcggagctcggaggacacgaagcaaatgatgagtagcttcatgtgagacttgccctacagaacaagtgactcttgagtaaggggtggggggaccccagcctggccatcctagactgacacctctctcctgtctcaggctgtccatctctgccgtggtgatgtcctatctgcagaatcctcagcccatgacgcccccatggtgataccagcctagaagggtcacattttggaccctgtctatccactaggcctgggctttggctgctaaacctgctgccttcagctgccatcctggacttccctgaatgaggccgtctcggtgcccccagctggatagagggaacctggccctttcctagggaacaccctaggcttacccctcctgcctcccttcccctgcctgctgctgggggagatgctgtccatgtttctaggggtattcatttgctttctcgttgaaacctgttgttaataaagtttttcactctggctgtcagcctcttctgttcagtggggtgttcctcctacctggcgggaagggctctagccccataggcctggtgtggggccccagtctggaggcttctggctgttcatttgcttacttcataaaccttgtgtcttaagtcaggtgctagggacaagacagtgacttctgccctctggcaactcaccagatggccctgctgacctagataatctaggctttggtttccttttttttttttcctttttaagaaagaaaatggtcttgatctgtcatgcaggctgagtgcagtggcacaatctatgttcactgcagcctcaaactcctgggctcaagcaatcctcccacctcagcctgccacgtaactgggaccacaaatgcgtgctaccatgcccagttaattcttgttttttttgagacagagttttgctcttgttgcccaggctggagggcaatggcatgatcttgatctcggctcactgcaacctccgcctcccaggttcaagtgattctcctgcctcagtctcccaagtagctgggattacaggcatgtgccaccatgcccagctaatttttgtatttttacattttgtgtaaaattacaaattttgtgttttcaaacccgtctctacaaaacaacccatgttgcccaggctggtctcaaactcccaggcccaagtgattcaccagcctggccctcccaaagtgctgggattgcaggcttgagccactgcgcctgccctgggctttgttttcttatcagagaatgaactggtaggaattgggaaaggcatgaaagactcggggtccttccccacttgtcagaccctcttttctctccggaacacccagggatccttctcaaccaggctggatcccatccctggtactccaggggtatttacccaacgtcccaatccccacagtataggactcttcatcagatcctcctcttaggcaagctaggtccttccaggaccctagcgctgaaggtccatgggacggacaccctggattcccatggacacactacaccggctaggaaaacccggcccccttaggaaaagcacttctgctcctaccggcattaagaggcattccgtcttggaattccggcattaagaggcattccgtcttcatagcccgtgagacgccagtgtcacctttagcccaaccagtgccctgagggtggcattttcctaccttcctgtaacgacccccgggattgcccagggctacagcctctctcccgtgagcctccagaccgcgccctggccccgcc

SEQ ID NO: 11246 - DNA, 3830 bp, Homo sapiens
ctgggcacggtggctcatgcctgtaatcccagcactttgggaggctgaggtgggcggatcacgaggtcaggagatcaagaccatcctggctaacatggtgaaaccccgtctctactaaaaatacaaaaaattagctgggcgtgtggcgggcgcctgtagtcccagctacttgggaggctgaggcaggagactggcgtgaacccgggaggtggagcttgtagtgagccgaaatcacaccactacactccagcctgggcgacagagcaagactccgtctcaaaaaaaaaaaaaaaaaaaaaaaagctctctgattttagctgttaggtgggagatgggttggaggataccaaagccagcttgcaggctatggggataaagaaaacacctggatttcggacctactttataggtagaggttggcagacatgctgagaaggatggatgtggggtgtgagaaaaggggagacagcaagctgcgctcctcatttttaatttttatttatctatttttgagacggagtttcgctctgttgcccaggctggagtgcagtggcaccatctcagctcactgcaacctccacctcccgggttcaagtgattctcctgcctcagcctcctgagtagctgggattatgggtgtgcgccaccacacccggctaatttttgtattttttagtagagacggggtttcgccatgttgtccaggctggtctctaactcctaacctcaggtgatctgccctccttggcatcccaaagtgctgggattacaggtgtgagccaccgcgcccagccccaatccctatttttcagtctagtggatgagtggagggtggggccgtttgctgagatgcagaaagatcagggataggtggagagggagctgagggggcaactttgaggtccaagcgaggatgtcaaggaggatgtctgtctcctccaacaaggtaggctcattccagcctcacggcttttgctgttctgtcttcccatgtgcaggaaatggcctctctgcatcttcacatacggggattttctcagccttctggctttggctcaaatctcacctccttggcgtccttcacccatccctccaactaaaatcccgaactcctccacctaaagactcaaattatcctgtttaaatcctgattgcgctgggcgcggtggctcacacctgtaatcccagcactttgggaggccgaggcaggcagatcacctgaggtcaggagttcgagactagcctgaccaacatagtgaaaccccatctctactaaaaatacaagaattagccgggcgtgatggctcatgcctgtaatcccagctactcgggaggctgaggcaggagaattgcttgaaactgggaggcagaggttgcgatgagtggagatcgcgccattgcactccagcctgggcaacaagagcgaaactctgtctccaaaaaaaacaaaaaacaaaaaaggcctgatagcactcaccactattgttaactttctatcttcccaatcagattgtgggctccagtagggcagggtccacatcttggtcttgttcaccactaaatccttagtgcctagcacggagcccaccatagagaatagactacatgaattgtagagtgagtgaataatcctgttggccgtatgcactgttaggagggtgtgtttgagatacagatgacacccagggtctcacattcttgcaggagggaaagagacgtcagccctgggtcccagaagaggccactgacccagtgggagttcagggaaggcttcccagaggaggtggaggtgacagctgcagctataagggaaggaagaacagagcgttatgcagcatgtgaaggctttggagacttgtgagggcacgaaccgggctcactatcccattagacaaaagtggctgaggaaggatgaaactgtgtctaactctgcctggtgaccgaaatcttgtccatgggtgacgcttaagaagtgaccctcggccgggcgcagtggctcacgcctgtaatcctggcactttgggaggccaaggcgggcgggtcacgagttcaggagatcgagaccatcctggctaacacggtgaaaccccatctctactaaaaacagaaaaaattagccgggtgtggtggcgggcacctgtagtcccagttactcgggaggctgaggcaggagaatggcatgaacctgggaggcagagcttgcagtgagccgagattgcgccactgcactccagcctgggcgacagagcgagactctgtctcaaaaaaaaaaaaaaaaaaaaaagtgaccctcataaaaaaattagctgggcacgatggtgcacactagtcggaatgctggggtgggaggatgacctgagtccgggagtcagaggttgcagtgggccgagatcgcgtcacagcactccagcctggcgacagagtgagaccctatcaaaaaatagcagcaggccaggcgcggtggctcatgcctgtaatcccagcactttgggaggctgaggcgggcggatcacgaggtcaggagatcgagactaccctggctaacacggtgaaaccccgtctctactaaaaatacaaaatattagccgggcgtggtggccggcgcctgtagtcccagttactggggaggctgaggcagaagaatggcgtgaacctgggaggcggaggttgcagtgagccgagatcgtgccactgcactccagcctgggagacagcgcaagactctagctcaaacaaacaaacaaacaaaacagcaacaacaacaacaaaaccatcctcccctcccgaggggacagaacagaaacgaatgggcgagtgccgggccaagcagtgggtctccagcaggtggcattaaaataggaattttggctggggacggtggctcacacctgtaatctcagcactttggaaagcccaggcgggcggtcacctgagggcagaaccagcctcgccaacatggtgaaatgccatctctactaaaaataaaaaattagccaggcctggtggtgggtgtctgtaatcccagcaactcgggaggctgaggcaggagaatcgcttgaaccaggggggcagaggttgcaatgagtcaagattgcaccaccgcactccagcctgcgtaacaagagcgtgtaactcttgtctcaaaaataaattaaataaataaataataaaaataaaaaagaatcttcattcatgggaagtcgagaacacatgaaaacaagtaaaggccgaagcgcagtggctcacgcctgtaatcccagcactttgggaggctgaggcgggcggataacctgaggtcggaagttcgagaccagcctgaccaacagggagaaaccccgcctctactaaaaatacaaaattagccgggcatggcggtgcatgccagtagtcccagctactcgggaggctgaggcaggagaatcgcttgaacccggaatgtggaggttgtggtgagctgagatcgggcaattgcactccagcctgggcaacaagagcgaaaccctgtatcaaaaaaaaaaaaaagaaaaaaaaaggaagaaaaggcctaaaggcgccgggcgcggtgggtcacgcctgtaatcccagcactttgggaggccgaggcgggcgaatcacgaggtcaggagatcgagaccaggtgaaaccccgtctctactaaaaatacaaaaaaattagccgggcgtggtggtgggcgcctgtagtcccagctactcgggaggctgaggcaggagaacagcgtgaacccggaaagcggagctggcagtgagctgagatcgcgccactgcactccagcctgggtgacagagcgagactccgtctcaaaaaaaaaa

SEQ ID NO: 11247 - DNA, 20245 bp, Homo sapiens
gcctttccagggccggggaaccccaggaggaagctgctgagccatgggcgcctacgcgcgggcttcgggggtctgcgctcgcggctgcctggactcagcaggcccctggaccatgtcccgcgccctgcggccaccgctcccgcctctctgctttttccttttgttgctggcggctgccggtgctcgggccgggggatacgaggtgagtggggcctccgagctgaaacgtacaggaggcagagtgaaacccagaatacagtctagaggtgtgggtgggtctgtcctgtgggtgtctagtgaatggctgatgatatgacagtgtggtctgagtgcgtgctttgtgtcattgcgaggtctggctgtgcgcatctgagtataggactgtgtctgattgtacctgcctccgtgtctccgggatgcttgcctagactttgtctgcacttaactgtgggattggaggggcaggaggtggcagggggtgagcagtgtatgtgtggggggaggtgctggctgagagctgggactctggagtctgcctgaaattccagcctagctcttacacttcctgagtgtgtgacgttgggcaagtcacctatcctctctaagcctcagtgccttcatctggaaactggggataacatcaccccacctcccacggtggccgtctgctgtcggcaaatgctgaacaaacatcagctacttctattattattttcccggagtgtgaatgagagctgccctgtggggttgtgcaaagtggagttgtatctatgagcacaactatgtatgtgtgtgtcctgcctgggagggcctggcctcctctgcacataggcgagatcaggcctctctgagtcactcacctctagatcaagacttactctgcagcccccgacctcgggggttattgacaaggtatgtgtgtttggggtccctgtgcagacatgccccacagtgcagccgaacatgctgaacgtgcacctgctgcctcacacacatgatgacgtgggctggctcaaaaccgtggaccagtacttttatggaagtgagtagaggatggggactggtccctgggatccccatggtccctgtaatccctctgggtcctggacattagggtggggccagtgctaccctaatatccagggtttgggctcctctgtctaggaataacccccttggctctgctgttccctgagagccttatccctgttatccacagtcaagaatgacatccagcacgccggtgtgcagtacatcctggactcggtcatctctgccttgctggcagatcccacccgtcgcttcatttacgtggagattgccttcttctcccgttggtggcaccagcagacaaatgccacacaggaagtcgtgcgagaccttgtgcgccagggtgagcctaccccaaggaagtgaaaagaggaagcccagcccagcttctgcttctgcatctctggtttctgagatttgtcatgccacgtgcaagctgtataacatgcgtgtcgctccgcctgcctggactctccatttggagacctcctatacatcccacaaagccccacctgctgtgcatcctctgggaagcctgccatgcagggggcctctttcccatatctgggaactatggcctgggagcgacccctcttgtccttccgccagaaatgtgtacacaggcaggctttcacattcccagtatcacccaccctactcccactcctggctctgaccgctgaccctgaccttgcctgtcctggcacagggcgcctggagttcgccaatggtggctgggtgatgaacgatgaggcagccacccactacggtgccatcgtggaccagatgacacttgggctgcgctttctggaggacacatttggcaatgatgggcgaccccgtgtggcctggcacattgaccccttcggccactctcgggagcaggcctcgctgtttgcgcaggtgcgacccgggacctctcttgggcccacttcttcactcactctggctcctccctcgcccagtcaaaccccgccctctccctgcaatctcacaaggaccaggcccaggcctaggcctgttgaagccctgccccttgagtgagccgtaaagccagtggcttttgagctctggcctcagccggctatgcccagcccaggctgacccagctccggctggctccgccctctcccctaataggcccctcttggtgttctggccccacccactagctcgggtcctggctcctccctaaaccgggtggcaagtggatgcctaggctgccttaaaaacaggttcattacctgtgctcagaccccatccatcctcaggctgtggaagggggaacctcattcctggagtcaggcctgctctgcgctttgacagtgctggggaggtgaacctgggttctgatgttggacccgccctctccctgctagcccaaggtggtgagttctgaaacttccccaagcttggaaataagctggaggcctctctgtttcagccctacgtgtttttgtttttgttttttgagacagggtcttgctgtcatccaggctggagtgcagtggtgcaatcctaactcactatagcctcaatctcccggattcaagcgattctcctgtctcagcccccctagtagatgagactacaagagcgcaccactacgcctggctaatttttaaattttttgtagacagtctgcccgtgttgtgcaggctggtctcaaaaactcctgggtttaagtgatcctcctgttttggcctcccagaaggctgggatcataggcaagagccaccacatcgacctagcactgctttttaacctgtgctctgacctgcccctcccaagcagaggggagtttggtggtgagagggctgggcactaattcacactgccttttcctccctcatccccagatgggcttcgacggcttcttctttgggcgccttgattatcaagataagtgggtacggatgcagaagctggagatggagcaggtgtggcgggccagcaccagcctgaagcccccgaccgcggacctcttcactggtagggggcttggtgagggcagggccagccatggtgccacacactcagaagggccctgggcttgatatctgctctgttgtcactgtcctggaattcctatagtctgggaacaaaggccctgcatttccttttgcattgggacacaaattctgaagcccatcctgggtgggacatggccggctttgaaaccagggaaggtctgggtgatgggccaccccttgaacttggtgtgacctgcaggtgtgcttcccaatggttacaacccgccaaggaatctgtgctgggatgtgctgtgtgtcgatcagccgctggtggaggaccctcgcagccccgagtacaacgccaaggagctggtcgattacttcctaaatgtggccactgcccaggtaaccctggtgtccagaaccttcgagtccggtatatacaatacaatgagctctttccatggtacaggcatcccctaacacgttctccttatttttaatttttttgagacagtcttactctgtcacccaggctggagtgcagtggtgcgatctcggctcactgcaacctctgcctcctgggttcaaacaagcacatccagctaatttttgtatttttgcactggggtctcatcatgttgtccaggctggtctcaaactcctgagctcaagtgatctgcttgcctcggcctcccaaagtgccgggattacaggcatgagccaccgcacctggcctctatttttaacatttttatttatttattattatttttttttttttgagacagagtcttgctctgtcacccaggctggagtgcagtggcatgatctcagctcactgcaacctccgcctcccgggttcaagcgattctcctgcctcagcctcctaagaagctgggattagaggcacctgccaccacacccagctaatttttgtatttttagtagacagggtttcgtcatgttgaccaggctggtcttgacctcaggtgatctgcccgcctcaacctcccaaagtgctgggattacaggtgtgggccactgtgcctagtctatttttaacatttttattgagaattccttttttattttttttagactcactctgtcgcccaggctggagtgcagtggcacgatctcggctcactgcaacctccacctactgggtccaagcgattcttctgcctcagcctcccgagtagctgggattacaggtgcccaccaccatgctcggctaagttttatgtctttttagtagaaagggggtttcaccatattggccaggctggtctcgaactcctaaccttttgacccacagccttggcctctcaaagtgctgggattacaggcgtgagccaccgcgtccagcctttaacatttttataattaaaaaacattattttttcacagagataaggtctcaccatgtggcccaggctggtctcaaactcctgaactcaagtgatcctcctgccttggcctcccaaagtgctaggatataggtgtgagccaccatgcctggcataacacgttctccttaaaaaaatttttttttcctttctttaaaaattgatggctgggcatggtggctcacgcctataatcccagcattttgagaggccgagatgggcagatcatctgaagtcaggagttcaagaccagcatagccaaaatgacgaaaccctgtctctactaaaaatacaaaaattagtcgggtgtggtggcgcacgcctgtaatcccagctacttgggaggctaaggcaagagagtcgcttgaacctggcaggtggaggttgcagtgagccgagatcacgtcacttcactctagcttgggcagcagagtgaaactctgtctcaaaaaaaaaattgttttagattaattttttttttttttcttgagacagggtcttgctgtgtggcccaggttggtcttaaactcctagactcaagcgatcctcctgcctcagtctcctgagtagctgggattacaggtgtgagcccctgtaatcatgttctcatgccccctggaggaagatgctattctattcaccatcacaatgtccccctcctggatttatgtgcattcctcattagaagagatagcataggctgggcaagagatagcatggcatggtgactggatgccctcttctaggtagtgggtccaagagaactgctcaacaactggtggctacttttatctgtgtccccacgctcccaagtgccatacccccacccatgcctgtgcacccaacatccttgaccccatatacatcaaaacacagctatacacagggatggcccaggatcctctggcttcaggactcccctcttgcctgcagggccggtattaccgcaccaaccacactgtgatgaccatgggctcggacttccaatatgagaatgccaacatgtggttcaagaaccttgacaagctcatccggctggtaaatgcgcaggtcagtgcgcctaccctgtggtacccttgtgcacatgtgcgcttgcatccgggggccttgggttatgtgcatagctctcagtgctgtctttgttttctattgttctattgtggtcattctataacaaatgaccacacacttagcagctcaaaacaacagaaatacattgtcttacagttctgtaggtaagaagtccagcatgaggccgggcgcaatggctcatgcctgtaatcccagcatgttgggaggctgagccgggcagatcacgaggtcaggaattcgagaccagcctgaccaacatggtgaaacgctgtctctactaaaaatacagaaattagctgggtgtgatggtgcgtgcctgtaatcccagctactcgggagcctgaggcaggggaatctcttgaatccgggaggcggaggttgcagtgagcggagattgtaccactgcactccagcctgggccacagagaaagactctgtctcaaaaaaaaaaaaaaaaaaaaaaaatccagcctgagtctcaccaggctataatcaaggtgttggcaaggctgtgttccttctgcagtctctaggagagaatataatttccttgctttttccaacatctagaagttacccacattcaaaatctattcttggctccatcttcaaagccagccacatagcatctttctgaccctgtttctgtaatcacatccctttctctcattctcacctcttctgcctctctcttccacattttatttatttacttagagacggagtctcgctctgtcgcccaggctggagtgcagtggcgtgctctcggctcactgcaacctccgcctcctgggttcaagtgattcttctgtctcagcctcccaagtagctgggactacagtcgcgtgccaccacgcccagctaatttttgtatttttagtagacagggtttcaccatgttggccaggatggtctcgatttcttgacctcgtgatccaccccgctcggcctcccaaggtgctgggattacagatgtgagccactgtgtggcctaatttccctactttaagtttggctgatgaacaacctcaattccatctgcaaccttaattccccttttgccatgtaatctaatgtggtaataggttctggggatcaggacatggacacttttgggcagttatcattttacccaacacagatgtgttagtgttttgcactaagtggcctgtggctgtggctgtgtgcacagtcagtcactctcatcagcacagaaacttgtctcccctctcccatctcagacaccccttcccatcaatcttgtcctcactacggtgcaatctccattcccaccttccactcgctcccagcactgctatttcaccaaaacagctcttttatgtcatttatttttatttattttttctttttaaaattttatttatttatttatttattgagacaagagtcttgctttgtcacccaggctggagtgcagtggcatgatcttgcctcatggcaacctctgcctcctgggttctagtgattctcctgcctcagcctcccaagtagctgggactacaggcatgtgccaccaaccctggctaatttttgtatttttagtagaggcagggtttcactatgttggccaggctggtctcaaaactcctgacctcaggtgatccgtccgccttggcctcccaaagtgttgggattgtaatctgaggtgggcggatcacttgaagacaggagttggagaccagcctggccaacatggtgaaaccttgtctctactaaaaatactacaaattaggtgggcgtgatggcactcatctgtaagaccagctactcggcaggctgaggcaggagaatcgctggaacctgggaggcggagtttgcagccagctgagatcgtgccactgcactccagcttgggcgacagagtcagactcagtctcaaaaaaaaaaaaaaaaaaaaaagtttattgagcacctactgtgtacattgggggacacagctcgtgcaaaacaaacatccttttcctcacataggtcactttcttgttcctccaccttgctcaggtgaaagtgcacctccattcattataaaaattgtgtctaggccgggcacggtggctcatgcctgtaatcccagcactttgggaggctgaggcgggcggatcatgaggtcaggagatcgagaccatcctggctaacacggtgaaactccgtctctactaaaaaatgcaaaaaattagccgggtgtggtggcgggcacctgtagtcccaggtactcatgaggctgaggctggagaatggcgtgaacccaagaggtggagcttgcagtgagctgagattgagccactgcactacagcctgggcaacaaagtaagactccgtcccaaaaaaaaaaagttgtgttttttggtaacaatctgacagtcctgcaaaacgattattcctgccctataatgtcacacttagtttttccacaaaagtttttaataataaagttggaattattgtaaaagtttagtaaaatttcaggtttattcttgcatctctgaaatccttttaaaaaaggctagtggtcatgtttgacttcagccaaaattcattttcacacccaaccattggcttgcacgccaaatatgtatttagagaaactgaacctatgggatgcatgaatgtgcacacatgtgtggaagtgtgggcccccaggaaggtgcggactcccgagggctcactccgtcgcctcccccagcagcaggcaaaaggaagcagtgtccatgttctctactccacccccgcttgttacctctgggagctgaacaaggccaacctcacctggtatttggggaaactggggagcttgggggggttggcatgccccgtgggtcatgaccctgccctcaatgcccctgccgctgtaggtcagtgaaacatgacgacttcttcccttacgcggatggcccccaccagttctggaccggttacttttccagtcggccggccctcaaacgctacgagcgcctcagctacaacttcctgcaggtgggtaggagccgggctagagggggcatgcagccccgaggcccgacaggctgggcgccccaacatacccctctgcctccaggtgtgcaaccagctggaggcgctggtgggcctggcggccaacgtgggaccctatggctccggagacagtgcacccctcagtaagtgtcgggcccaagaggggaagaggtttgcggctgaagttggaaaccacccctaggccgcccccctcgagtttcttctttttttttttttttttttttttttttgagacggagtctcgatttgtctcccaggctggagtgcagtggtgcgatctcggctcactgcaagctccacctcccgtgttcacgccattctcctgactcagcctcccgagtagctgggactacaggcgcccaccaccacgcccggctaattttttgtatttttagtagagacggggtttcaccatgttagccaggatggtctcgatctgacctcgtgatccgcccgcctcggtctctcaaagtgctgggattacaggcgtgagccaccgcccccagccgtcctcgagttccttcttaaagcctctaagaatcctgcccgccagcaccggacctttcgcttccccttggggtctcagctgagtcccacagaacctcaccggactcattgtctatgagcagatgaggcgatggctgtgctccagcatcacgacgccgtcagcggcacctcccgccagcacgtggccaacgactacgcgcgccagcttgcggcaggctgggggccttgcgaggtgcgcggggcgagacttgggagacacgggggtggagacaggaaggggcggggccagggcctgggaaaggggacagagacaggtgtgaggcgtagccgagagccctgtggcggggctacaagggctcgtgggggcggggcttgtaggaggcggggaaagatacaggaacggggcggggctttggaggggggaaggaggcggggcgtgggcaagaggaggcggagacagctatggggtatagtcaagggcagcagggtggggctagaaggggttttggggcgactcttgagggaggcgggacagagaccggaacggggcggggcctgaggagaggggaggagtcaggcctggcgtcctgaacccaccggtccctttgcgctcttccgcaggttcttctgagcaacgcgctggcgcggctcagaggcttcaaagatcacttcaccttttgccaacagctaaacatcagcatctgcccgctcagccagacggcggcgcgcgtgagccgggacgggaggggtggatctagggcagatgggctttagagggggtagttggaaaatgtttttggaggactatacaggagtgaaattacgtgggctgcgaagctgggtcagcagagagaacaacgcatctcgagggggcttggccttaagtgccgtgaccacactaggaccagccaggggtgtttctgtgcaaagtgggtgggtttggagaaggcctgctgtgacccatgccctctctgacccccgcctccccagttccaggtcatcgtttataatcccctggggcggaaggtgaattggatggtacggctgccggtcagcgaaggcgttttcgttgtgaaggaccccaatggcaggacagtgcccagcgatgtgagcccaaacaacgaatattcccccgctgggactcctcccccagtgggcatttcctcatcgcccccatggatatcgcctgcttccatgaatacctcccactcatgcatatctcttcccccctcttgtatcttctccctctgccccttaatatcagtctccccttgggaacatatgcctcctgtgagtggtcctcccttttttttttttttttgagacggagtctcgctctgtcacccaggctggagtgcagtggcgcgatcttggctcacttcaaactccgcctgctggattataggcatgagccaccgtgcctggctggtcctccattttaataccccgcttccccaggaaaatttattgctgtttatggacatctccttcattccagaaaacgtcctcccccaaacctcttcctcccccgagaacctgcctcaagggtttcttcccctacttcctccttcactcccccgactccatggtctctccaccctcccggtgggtttttttttccacctggtgaatcttctctgcaatcatttccttggaatctgactgtccccccaccacacacacctccatttcctttccccatctcaggactcttttccttccttgagttttttgtctccatgcatgtatagctttccatgggtactcttgactcagtttccctcctcctttatccgaggtggtaatatttcccagctcagacagccaggcgcaccctccggagctgctgttctcagcctcactgcccgccctgggcttcagcacctattcagtagcccaggtgcctcgctggaagccccaggcccgcgcaccacagcccatccccagaagatcctggtcccctgctttaaccatcgaaaatgaggtgagaccccatttcaatcccctttcctgctcctgtgacaaatttgaagtgtcatggtgagctgtgtggactctgggtcagcaggtccctaggcttatgacctcctgtcacaactcccctcattgtgtgtccttgagcaagtgacctttgtctgagcctcagtgtcctttcctgggactgttatgaggacccagtgtgatcatgggtgacacttgacagacatgtcagagttggtggcaggtggtggttcgcaattttggcagggacgtttcagggaaggtgttcccgataaaggtgacatttaagatatgacctgagggagggagccgtgtggctatttgaaggaagagagatccaggtggggagagaataacaggcataaaagccttcgagcaggagagtgtgcagaattccaggagccacaaggagctcagtgtggctgaagcagggtgaacgggtgacaggtcagaccttgagggccttgaggaccaacaggaagactttggcttttgccagtcattgttgctcatgtgtctactcctagctctttgggaggctgaagcgggaggatcacttgagcccaggagttgtcccagctaattgggaggcccagatgggaggtttgtttgagctggggagttcgaggttgcagtgagtaatgattgtcccactgtactccatcctggcaacagagtgaaaccctgtctgaaaagaataataataaaataggccaggcatcgtggattatacctgtaattctagcaccacgggaggctgaggtgggtggatctactgagctcaggagtttgagaccagcttgggcaacatggtgaaacccagtctctacaaaaaattagctgggggtggtggtacacgtctgtaatcccagctacttgggggctgaggaaggaggattgcttgagcccaggtggcagaggttgcagtgagccgagatcatgccactgcactccagcctgggtgacaaagtgagaccctgtctcaataaaataaaataaaagaagttctgcagtaggactgttcatgttaggaagaaaacatctttttcatatttttattaaaataaaataaaagaagttaaaacgttcccacaggcccctaaaagtcttgtgagttctggcattgtggttcacacatcagatgcccaagttggccctggtccgcagcagaggagggctttgatgggacttagggtatcacaggtgtgctctggctgttgtggggaacagactgtaggcagccagtgtggaagtgcagggacctggaaggggttgactgcactggccctggaaggccctggtaagaggtggtgaggttgaaaataaggttgggggggccgggcgcggtggctcacacctgtaatcccagcactttgggaggccgaggcaggcagatcacgaggtcaggagatggagaccatcctggctaacacggtgaaaccctgactctacaaaaatacaaaaaatttagccaggcgtggtggcgagcatctgtagtcccagttactcgggaggctgaggcaggagaatggcgtgaacccggaaggcggagcttgcagtgacctgagatggcgccactgcattccagcctgggcaacagagtgagactccgtctcaaaaaaaaaaaaaagaaaaaaaaagaaaaaaagaaaaggctggggtgggcacgttggctcatgcctgtaatcccaggactttgggaggctgaggctggcaggtcacctgaggtcaggagtttgagaccagcctggccaacacagtgaaacctcgtctgtaccaaaaatacaaaaattaactgggcgtggtggtacacacttgtagtcctagctactcgggagggagaggcaggagaatcacttgaacccaggaggtggaggttgcagtgagccgagatcatgccactgcactccagcctgggggacagagcaagactctgtctcaaaagcaaacaaaaaaaaaatcaggttgaatggctgggtgtggtggactgcttgagcccaggagttggacactagccccaggcaacatagtgggacccccatctctagaaaacaaatttaaatttttttttttttaatttagtagagatggagtttcactatgttggccaggctggtatcaaactcctcacctcaggttatccacccaacttggtctcccaaagttctgggattacaggtgtgagccaccacgctcggccctaaaaaaattttaaattgagaaaaaaaggggccaggcgtgttggctcatgcctgtaatcccagcactttgggaggctgaggggggggtggatcatgaggtcaggagttcgagaccagcatggccaatattgtgaaaccctgtctctaataaaaatacaaaaattagccaggtgtggtggcatgtgcctgtagtcccagctattcaggaggctgagtcaggagaattgcttgaacccgggaggcggaggttgcagtgagccaagatcacgccactttctgcactccagcctgggcgatagagcgagactcagtctcaaaaaaaaaaaaaaaacaaaaaacccaggccaggtgcagtggctcacgcctgtaatcccagccctttgggaggccaaggcgggtggattacctgaggtcaggagttggagaccagcctgaccaacatggcgaaaccccgtctctactaaaaatacaaaaattagccaggcatggtggcatgtgcctgtaatcccagctacccaggaggctgaggcaggagaattgctggaacccaggggcagaggctgtagtgagcagagattgcgcccctgcactccagcctgggcgacacagcaagtttctgtctcaaaaaaaaaaaataaaaatccggctgggcacagtggcttatgtctgtaatcctagtactttgggaggccaaggtgagcagatcacttgagttcaggggtttgagaccagcctggccaacatggtgaaaccctgtctctactaaaaatatgaaaattagccaggcggggtggtgggcacctgtaatcccagctacttggatagctgaggcacgagaatcacttgaacccgggaggtggggggtgcagtgagccaagattgcaccactgtactctagcctgggctacagagtgagactcagtctcaaaaaaaaaaaaagaaaaaagaaaaattaaaaaaagaaaacacacacacatacacacacaaacccatctgtggacccttttctgcccagcacatccgggcaacgtttgatcctgacacagggctgttgatggagattatgaacatgaatcagcaactcctgctgcctgttcgccagaccttcttctggtaagggaagatcaccaggcctgagggtggggtggtggtgctcggcatggagctagggccccttacctgactctcacctgccccaactccaggtacaacgccagtataggtgacaacgaaagtgaccaggcctcaggtgcctacatcttcagacccaaccaacagaaaccgctgcctgtgagccgctgggctcagatccacctggtgaaggtcagggactaggaatgatgagtgggcagttgggaatggggaagttatggagcccaagagggtggtgggccatgtgtagagtgagggtaggggaggatttacttttccttcagatcagtgggctaagacccacagatcagcgggggaaatatttgagggtccttccatagaattgatattcatagctggtcgtatgagagtctccccataggacacatcatacaaagccattcacatctgctgtggacgtttacatacttagttttggaaattgggggtggggcattcccacttggcccatgaatcaggagagccaaatatcactgcttgaagaattcaccaaagtctgtagtaagaggagcttctatctggagtgaatatttgagagtccacccttggattgattgggtttgggtgagtctcagggtgaatgcctatgggtgcatctggctaggaacagtggtttcccagggcctctcattgatgtttgactttcatagatgacaaaactcacatttgtccacattcaagagcctcgcgtttcatgtgagtccctttgagatgaatgtctgcatatctgtatatagttttgcctgttctaacagagttacccaaattaactgtgactagaataagatagaagattattttcttctaacaaaaagtctggctgttagtccagagaaagtggggtggttccataatcacccaggacctcctcttctatcttgttgctctgccttccccaatattcagtttccacctcatggtccaagatagctgctgaagctccagccgccacatttgtgtttgagtcagtagcagagggacaggggcaaggaacattgttgacaccacttggatcactttctatggggcaaactggtcactcagctactgatagcctcagggaagactggacaatatagtctttatcccaggtagccatgtgccaagctagaatcctattctatggggcaatggtgaacaggaggcgtttatgccacgctcaagagtgatgtggtaagccagatgcagtggctcatgcctgtaatcacagcactttgggagactgaagcaggaggatcgctgagcataggagttcaagaccaggtgggagcatttgctgattaggtgcctacatagtgatgccctgtctcaaaaaaaaaaaaaaaaaaagaggccgggtgcagtggctcacgcctgtaatcccagcactttgcgaggcagaggcaggcagatcatctgaggtcaggagttcaagacaagtctggccaacatggatagaaaccccgtctctactaaaaatacaaaaattagccaggggtggtggcaggtacctgcaatccctctactcgggaggctgaggcaggagaattgcttgaacccaggaggcggaggttgcagtgaggcaagattgtgccactgcactccatcctgggcaacaagagcaaaactctgtctcaaaaaaaaaaaaagaaaaaagaattatgtgggccaggcgcggtggctcacgcctgtaatcccagcactttgggaggccgaggcgggctgatcacgaggtcaggagatcgagaccatccttgctaacacggtgaaaccccatctctactaaaaatacaaaaaattagccgggtgtggtggcgggtgcctgtagtcccagctactcgggaggctgaggcaggagaatggtgtgaacccgggaggcggagcttgcagtgagccgagatcgcgccactgcactcccgcctgggcaaaagagcgagactccgtctcaaaaaaaaaaaaaaaaaaagaattatgtggcggtgactgaaggttgaccttgatgtaggccttaatggggtttatggccagggttgggggacatttgtaggactcacctctgctcaggtacagactgacatccacctcacccgtgtgcccgcagacacccttggtgcaggaggtgcaccagaacttctcagcttggtgttcccaggtggttcgcctgtacccaggacagcggcacctggagctagagtggtcggtggggccgatacctgtggggtgagtggcacaggctgggagaggggtgtggaagcaagggcagaggggtttatccaaggctcacaaccttgccatcccattgggtacagcgacacctgggggaaggaggtcatcagccgttttgacacaccgctggagacaaagggacgcttctacacagacagcaatggccgggagatcctggagaggaggtggggggtgactgagagcactgagggggtggtctgtggtgtgttggggcccaggggtggtgagggaaatttgctgattacatgagtgtgggagacagaggacgaagggagagtgaagggcgggggagccaggcagggtgcagtggctcacgcctgtaatcccagcactttgggaagccgaggcgggcagatcacaaggtcaggagatcgagactatcctggctaacatggtgaaaccccgtctctactaaaaatacaaaaaaatcagccgggtgtggtggcgggcacctgtagtcccagctactcgggaggctgaggcaggagaatggcgtgaagccgggaggcggagcttgcagtgagccgagatcgcgccactgcactccagcctgggtgacagagcgagactccatctcaaaaaaaaaaaaaaaaaaaaaagagttggggagccagatcccaagcctgatcagctcacccccaaccccaggcgggattatcgacccacctggaaactgaaccagacggagcccgtggcaggaaactactatccagtcaacacccggatttacatcacggtagctctcccccatcctgcacctccccacctcgatagaaagggaatcaccccttatctgcagcatctcaaagctgcctggggttggggttgactgccctctactttcacccttcaactcccaggatggaaacatgcagctgactgtgctgactgaccgctcccaggggggcagcagcctgagagatggctcgctggagctcatggtgagtgggtcagagccccatccgagccagggtcctcccaacctggacccctgctggaccttgaaggctgtttctggcccagttctctgctttcaggccccactaagctgaggactccgtttctttcttttcttctctttgagacggagttttgctcttgttgtccaagctggagtgcaatagtactatctcagctcactgcaacctctgcctcctgggttcaagtgattgtcctgcctcagccttccgagtagctgggcttacaggcacacaccatcacgcccggctaattttggtatttttagtagagatggggtttcaccatgttggccaggctggtctcgaactccttacctcaggtgatccactcacctcggcctcccaaagtgctgggattacaggcgtgaaccaccgctcccggccaaggactccatttctgtgtgtggcttttcctctccgtttttctccatctcctgcccaggctccctccacgctctggcgtgccatatccaggcccccctgttaggcatttacctccttccggcctggttcccatgcctacttggatcctgcctctgctggggttgccctaccagaccctcaccttcatcctcatccgttcctcccaccctttaatttcttttgacattcccacacgcccttacccagtttctggcccaaggacacccacaaacccacgactctcaccccctcctggccactctccccccaggtgcaccgaaggctgctgaaggacgatggacgcggagtatcggagccactaatggagaacgggtcgggggcgtgggtgcgagggcgccacctggtgctgctggacacagcccaggctgcagccgccggacaccggctcctggcggagcaggaggtcctggcccctcaggtggtgctggccccgggtggcggcgccgcctacaatctcggggctcctccgcgcacgcaggtgaggggcagcggggtaggcagagaggaccggattgaagtctaccagggagccgggtttgggtgcggagtttcctaggctcagcggggatccatttggccataattagccccaaaccctcgggccaaccccatcccctgggcagtccccgcccagtgccagcccagtcccaacccccctggactgtgtagaggcacagccctagctcatgcccctaaaccaccaactcacctccggccccgcccatttcactttagccccgccctctcaccgcccccaggctctgtcctgcctcacccagccccgcggcttcagccccgccgtaactcccaaagtctcaggtcacatcagttctgctccatcgggactcgaaccctaagcttgggaccgacccatctccccattggctcagtcctccctgtcacggccctggccgctcctctcggctgagccttgcccctctccggcgaaaccccgcccctacaacctagccctgcctcctgacctggctcggccccgcccttctccatccaggccccgcccctctccaactcagccccgccctctctcccgcagttctcagggctgcgcagggacctgccgccctcggtgcacctgctcacgctggccagctggggccccgaaatggtgctgctgcgcttggagcaccagtttgccgtaggagaggattccggacgtaacctgagcgcccccgttaccttgaacttgagggtgagaagggcaaaattgagaaggagatcggagagaggcaagagagagggagagaagagaaacctggctttgccccaactcatctgggcccatccccttccccgcaggacctgttctccaccttcaccatcacccgcctgcaggagaccacgctggtggccaaccagctccgcgaggcagcctccaggctcaagtggacaacaaacacaggtggggccctggtcaggggtagggaaggggtggagtcttacctggggccggcaggtgggggcaatgtgtgaggcatgggatgttggccaggacccaaaaaggtcatgagggtatggggcagagtccagacccaggttaggggcttaaaggatctgaaatgggtgcggcaaaccaggaatgggtcttgaggtttgtgggtgctgtttagtcccaagaacaagatttgaaaatccccatccatgtctagttctgggagggtgttcatcacccctggggtcagattgagggtacgaggacagtggccagattgagggtatgaggacattggacctgggggtggtattcggggccggggaagcaggttaagagtctgggattgaggccctggagacagattcggggatatgcagctgtgtctagacccaggggaggaagcatcgtggggtgagtcagaggaagtctgcacctcctcactcctccttccccctgcacctctccaggccccacaccccaccaaactccgtaccagctggacccggccaacatcacgctggaacccatggaaatccgcactttcctggcctcagttcaatggaaggaggtggatggttaggtctgctgggatgggccctccaagcccaagcctcctgctccgggggcagaccagactctgactctcctcttggggctgctgccattaaaacgctactactaagactcaggtcgctctgtg

SEQ ID NO: 11248 - DNA, 9796 bp, Homo sapiens
gcctttccagggccggggaaccccaggaggaagctgctgagccatgggcgcctacgcgcgggcttcgggggtctgcgctcgcggctgcctggactcagcaggcccctggaccatgtcccgcgccctgcggccaccgctcccgcctctctgctttttccttttgttgctggcggctgccggtgctcgggccgggggatacgaggtgagtggggcctccgagctgaaacgtacaggaggcagagtgaaacccagaatacagtctagaggtgtgggtgggtctgtcctgtgggtgtctagtgaatggctgatgatatgacagtgtggtctgagtgcgtgctttgtgtcattgcgaggtctggctgtgcgcatctgagtataggactgtgtctgattgtacctgcctccgtgtctccgggatgcttgcctagactttgtctgcacttaactgtgggattggaggggcaggaggtggcagggggtgagcagtgtatgtgtggggggaggtgctggctgagagctgggactctggagtctgcctgaaattccagcctagctcttacacttcctgagtgtgtgacgttgggcaagtcacctatcctctctaagcctcagtgccttcatctggaaactggggataacatcaccccacctcccacggtggccgtctgctgtcggcaaatgctgaacaaacatcagctacttctattattattttcccggagtgtgaatgagagctgccctgtggggttgtgcaaagtggagttgtatctatgagcacaactatgtatgtgtgtgtcctgcctgggagggcctggcctcctctgcacataggcgagatcaggcctctctgagtcactcacctctagatcaagacttactctgcagcccccgacctcgggggttattgacaaggtatgtgtgtttggggtccctgtgcagacatgccccacagtgcagccgaacatgctgaacgtgcacctgctgcctcacacacatgatgacgtgggctggctcaaaaccgtggaccagtacttttatggaagtgagtagaggatggggactggtccctgggatccccatggtccctgtaatccctctgggtcctggacattagggtggggccagtgctaccctaatatccagggtttgggctcctctgtctaggaataacccccttggctctgctgttccctgagagccttatccctgttatccacagtcaagaatgacatccagcacgccggtgtgcagtacatcctggactcggtcatctctgccttgctggcagatcccacccgtcgcttcatttacgtggagattgccttcttctcccgttggtggcaccagcagacaaatgccacacaggaagtcgtgcgagaccttgtgcgccagggtgagcctaccccaaggaagtgaaaagaggaagcccagcccagcttctgcttctgcatctctggtttctgagatttgtcatgccacgtgcaagctgtataacatgcgtgtcgctccgcctgcctggactctccatttggagacctcctatacatcccacaaagccccacctgctgtgcatcctctgggaagcctgccatgcagggggcctctttcccatatctgggaactatggcctgggagcgacccctcttgtccttccgccagaaatgtgtacacaggcaggctttcacattcccagtatcacccaccctactcccactcctggctctgaccgctgaccctgaccttgcctgtcctggcacagggcgcctggagttcgccaatggtggctgggtgatgaacgatgaggcagccacccactacggtgccatcgtggaccagatgacacttgggctgcgctttctggaggacacatttggcaatgatgggcgaccccgtgtggcctggcacattgaccccttcggccactctcgggagcaggcctcgctgtttgcgcaggtgcgacccgggacctctcttgggcccacttcttcactcactctggctcctccctcgcccagtcaaaccccgccctctccctgcaatctcacaaggaccaggcccaggcctaggcctgttgaagccctgccccttgagtgagccgtaaagccagtggcttttgagctctggcctcagccggctatgcccagcccaggctgacccagctccggctggctccgccctctcccctaataggcccctcttggtgttctggccccacccactagctcgggtcctggctcctccctaaaccgggtggcaagtggatgcctaggctgccttaaaaacaggttcattacctgtgctcagaccccatccatcctcaggctgtggaagggggaacctcattcctggagtcaggcctgctctgcgctttgacagtgctggggaggtgaacctgggttctgatgttggacccgccctctccctgctagcccaaggtggtgagttctgaaacttccccaagcttggaaataagctggaggcctctctgtttcagccctacgtgtttttgtttttgttttttgagacagggtcttgctgtcatccaggctggagtgcagtggtgcaatcctaactcactatagcctcaatctcccggattcaagcgattctcctgtctcagcccccctagtagatgagactacaagagcgcaccactacgcctggctaatttttaaattttttgtagacagtctgcccgtgttgtgcaggctggtctcaaaaactcctgggtttaagtgatcctcctgttttggcctcccagaaggctgggatcataggcaagagccaccacatcgacctagcactgctttttaacctgtgctctgacctgcccctcccaagcagaggggagtttggtggtgagagggctgggcactaattcacactgccttttcctccctcatccccagatgggcttcgacggcttcttctttgggcgccttgattatcaagataagtgggtacggatgcagaagctggagatggagcaggtgtggcgggccagcaccagcctgaagcccccgaccgcggacctcttcactggtagggggcttggtgagggcagggccagccatggtgccacacactcagaagggccctgggcttgatatctgctctgttgtcactgtcctggaattcctatagtctgggaacaaaggccctgcatttccttttgcattgggacacaaattctgaagcccatcctgggtgggacatggccggctttgaaaccagggaaggtctgggtgatgggccaccccttgaacttggtgtgacctgcaggtgtgcttcccaatggttacaacccgccaaggaatctgtgctgggatgtgctgtgtgtcgatcagccgctggtggaggaccctcgcagccccgagtacaacgccaaggagctggtcgattacttcctaaatgtggccactgcccaggtaaccctggtgtccagaaccttcgagtccggtatatacaatacaatgagctctttccatggtacaggcatcccctaacacgttctccttatttttaatttttttgagacagtcttactctgtcacccaggctggagtgcagtggtgcgatctcggctcactgcaacctctgcctcctgggttcaaacaagcacatccagctaatttttgtatttttgcactggggtctcatcatgttgtccaggctggtctcaaactcctgagctcaagtgatctgcttgcctcggcctcccaaagtgccgggattacaggcatgagccaccgcacctggcctctatttttaacatttttatttatttattattatttttttttttttgagacagagtcttgctctgtcacccaggctggagtgcagtggcatgatctcagctcactgcaacctccgcctcccgggttcaagcgattctcctgcctcagcctcctaagaagctgggattagaggcacctgccaccacacccagctaatttttgtatttttagtagacagggtttcgtcatgttgaccaggctggtcttgacctcaggtgatctgcccgcctcaacctcccaaagtgctgggattacaggtgtgggccactgtgcctagtctatttttaacatttttattgagaattccttttttattttttttagactcactctgtcgcccaggctggagtgcagtggcacgatctcggctcactgcaacctccacctactgggtccaagcgattcttctgcctcagcctcccgagtagctgggattacaggtgcccaccaccatgctcggctaagttttatgtctttttagtagaaagggggtttcaccatattggccaggctggtctcgaactcctaaccttttgacccacagccttggcctctcaaagtgctgggattacaggcgtgagccaccgcgtccagcctttaacatttttataattaaaaaacattattttttcacagagataaggtctcaccatgtggcccaggctggtctcaaactcctgaactcaagtgatcctcctgccttggcctcccaaagtgctaggatataggtgtgagccaccatgcctggcataacacgttctccttaaaaaaatttttttttcctttctttaaaaattgatggctgggcatggtggctcacgcctataatcccagcattttgagaggccgagatgggcagatcatctgaagtcaggagttcaagaccagcatagccaaaatgacgaaaccctgtctctactaaaaatacaaaaattagtcgggtgtggtggcgcacgcctgtaatcccagctacttgggaggctaaggcaagagagtcgcttgaacctggcaggtggaggttgcagtgagccgagatcacgtcacttcactctagcttgggcagcagagtgaaactctgtctcaaaaaaaaaattgttttagattaattttttttttttttcttgagacagggtcttgctgtgtggcccaggttggtcttaaactcctagactcaagcgatcctcctgcctcagtctcctgagtagctgggattacaggtgtgagcccctgtaatcatgttctcatgccccctggaggaagatgctattctattcaccatcacaatgtccccctcctggatttatgtgcattcctcattagaagagatagcataggctgggcaagagatagcatggcatggtgactggatgccctcttctaggtagtgggtccaagagaactgctcaacaactggtggctacttttatctgtgtccccacgctcccaagtgccatacccccacccatgcctgtgcacccaacatccttgaccccatatacatcaaaacacagctatacacagggatggcccaggatcctctggcttcaggactcccctcttgcctgcagggccggtattaccgcaccaaccacactgtgatgaccatgggctcggacttccaatatgagaatgccaacatgtggttcaagaaccttgacaagctcatccggctggtaaatgcgcaggtcagtgcgcctaccctgtggtacccttgtgcacatgtgcgcttgcatccgggggccttgggttatgtgcatagctctcagtgctgtctttgttttctattgttctattgtggtcattctataacaaatgaccacacacttagcagctcaaaacaacagaaatacattgtcttacagttctgtaggtaagaagtccagcatgaggccgggcgcaatggctcatgcctgtaatcccagcatgttgggaggctgagccgggcagatcacgaggtcaggaattcgagaccagcctgaccaacatggtgaaacgctgtctctactaaaaatacagaaattagctgggtgtgatggtgcgtgcctgtaatcccagctactcgggagcctgaggcaggggaatctcttgaatccgggaggcggaggttgcagtgagcggagattgtaccactgcactccagcctgggccacagagaaagactctgtctcaaaaaaaaaaaaaaaaaaaaaaaatccagcctgagtctcaccaggctataatcaaggtgttggcaaggctgtgttccttctgcagtctctaggagagaatataatttccttgctttttccaacatctagaagttacccacattcaaaatctattcttggctccatcttcaaagccagccacatagcatctttctgaccctgtttctgtaatcacatccctttctctcattctcacctcttctgcctctctcttccacattttatttatttacttagagacggagtctcgctctgtcgcccaggctggagtgcagtggcgtgctctcggctcactgcaacctccgcctcctgggttcaagtgattcttctgtctcagcctcccaagtagctgggactacagtcgcgtgccaccacgcccagctaatttttgtatttttagtagacagggtttcaccatgttggccaggatggtctcgatttcttgacctcgtgatccaccccgctcggcctcccaaggtgctgggattacagatgtgagccactgtgtggcctaatttccctactttaagtttggctgatgaacaacctcaattccatctgcaaccttaattccccttttgccatgtaatctaatgtggtaataggttctggggatcaggacatggacacttttgggcagttatcattttacccaacacagatgtgttagtgttttgcactaagtggcctgtggctgtggctgtgtgcacagtcagtcactctcatcagcacagaaacttgtctcccctctcccatctcagacaccccttcccatcaatcttgtcctcactacggtgcaatctccattcccaccttccactcgctcccagcactgctatttcaccaaaacagctcttttatgtcatttatttttatttattttttctttttaaaattttatttatttatttatttattgagacaagagtcttgctttgtcacccaggctggagtgcagtggcatgatcttgcctcatggcaacctctgcctcctgggttctagtgattctcctgcctcagcctcccaagtagctgggactacaggcatgtgccaccaaccctggctaatttttgtatttttagtagaggcagggtttcactatgttggccaggctggtctcaaaactcctgacctcaggtgatccgtccgccttggcctcccaaagtgttgggattgtaatctgaggtgggcggatcacttgaagacaggagttggagaccagcctggccaacatggtgaaaccttgtctctactaaaaatactacaaattaggtgggcgtgatggcactcatctgtaagaccagctactcggcaggctgaggcaggagaatcgctggaacctgggaggcggagtttgcagccagctgagatcgtgccactgcactccagcttgggcgacagagtcagactcagtctcaaaaaaaaaaaaaaaaaaaaaagtttattgagcacctactgtgtacattgggggacacagctcgtgcaaaacaaacatccttttcctcacataggtcactttcttgttcctccaccttgctcaggtgaaagtgcacctccattcattataaaaattgtgtctaggccgggcacggtggctcatgcctgtaatcccagcactttgggaggctgaggcgggcggatcatgaggtcaggagatcgagaccatcctggctaacacggtgaaactccgtctctactaaaaaatgcaaaaaattagccgggtgtggtggcgggcacctgtagtcccaggtactcatgaggctgaggctggagaatggcgtgaacccaagaggtggagcttgcagtgagctgagattgagccactgcactacagcctgggcaacaaagtaagactccgtcccaaaaaaaaaaagttgtgttttttggtaacaatctgacagtcctgcaaaacgattattcctgccctataatgtcacacttagtttttccacaaaagtttttaataataaagttggaattattgtaaaagtttagtaaaatttcaggtttattcttgcatctctgaaatccttttaaaaaaggctagtggtcatgtttgacttcagccaaaattcattttcacacccaaccattggcttgcacgccaaatatgtatttagagaaactgaacctatgggatgcatgaatgtgcacacatgtgtggaagtgtgggcccccaggaaggtgcggactcccgagggctcactccgtcgcctcccccagcagcaggcaaaaggaagcagtgtccatgttctctactccacccccgcttgttacctctgggagctgaacaaggccaacctcacctggtatttggggaaactggggagcttgggggggttggcatgccccgtgggtcatgaccctgccctcaatgcccctgccgctgtaggtcagtgaaacatgacgacttcttcccttacgcggatggcccccaccagttctggaccggttacttttccagtcggccggccctcaaacgctacgagcgcctcagctacaacttcctgcaggtgggtaggagccgggctagagggggcatgcagccccgaggcccgacaggctgggcgccccaacatacccctctgcctccaggtgtgcaaccagctggaggcgctggtgggcctggcggccaacgtgggaccctatggctccggagacagtgcacccctcagtaagtgtcgggcccaagaggggaagaggtttgcggctgaagttggaaaccacccctaggccgcccccctcgagtttcttctttttttttttttttttttttttttttgagacggagtctcgatttgtctcccaggctggagtgcagtggtgcgatctcggctcactgcaagctccacctcccgtgttcacgccattctcctgactcagcctcccgagtagctgggactacaggcgcccaccaccacgcccggctaattttttgtatttttagtagagacggggtttcaccatgttagccaggatggtctcgatctgacctcgtgatccgcccgcctcggtctctcaaagtgctgggattacaggcgtgagccaccgcccccagccgtcctcgagttccttcttaaagcctctaagaatcctgcccgccagcaccggacctttcgcttccccttggggtctcagctgagtcccacagaacctcaccggactcattgtctatgagcagatgaggcgatggctgtgctccagcatcacgacgccgtcagcggcacctcccgccagcacgtggccaacgactacgcgcgccagcttgcggcaggctgggggccttgcgaggtgcgcggggcgagacttgggagacacgggggtggagacaggaaggggcggggccagggcctgggaaaggggacagagacaggtgtgaggcgtagccgagagccctgtggcggggctacaagggctcgtgggggcggggcttgtaggaggcggggaaagatacaggaacggggcggggctttggaggggggaaggaggcggggcgtgggcaagaggaggcggagacagctatggggtatagtcaagggcagcagggtggggctagaaggggttttggggcgactcttgagggaggcgggacagagaccggaacggggcggggcctgaggagaggggaggagtcaggcctggcgtcctgaacccaccggtccctttgcgctcttccgcaggttcttctgagcaacgcgctggcgcggctcagaggcttcaaagatcacttcaccttttgccaacagctaaacatcagcatctgcccgctcagccagacggcggcgcgc

SEQ ID NO: 11249 - DNA, 3844 bp, Homo sapiens
tcatgcctgtaatcccagcattttgggaggccgaggcgggcagatcacaaggtcaggagatcaagaccatcctggctaacacggtgaaaccctgtctctatcttagtaatactttattaattagtctgggcgtgtggcgggcgcctgtagtcccagctacttgggaggctgaggcaggagactggcgtgaacccgggaggtggagcttgtagtgagccgaaatcacaccactacactccagcctgggcgacagagcaagactccgtctcaaaaaaaaaaaaaaaaaaaaaaaagctctctgattttagctgttaggtgggagatgggttggaggataccaaagccagcttgcaggctatggggataaagaaaacacctggatttcggacctactttataggtagaggttggcagacatgctgagaaggatggatgtggggtgtgagaaaaggggagacagcaagctgcgctcctcatttttaatttttatttatctatttttgagacggagtttcgctctgttgcccaggctggagtgcagtggcaccatctcagctcactgcaacctccacctcccgggttcaagtgattctcctgcctcagcctcctgagtagctgggattatgggtgtgcgccaccacacccggctaatttttgtattttttagtagagacggggtttcgccatgttgtccaggctggtctctaactcctaacctcaggtgatctgccctccttggcatcccaaagtgctgggattacaggtgtgagccaccgcgcccagccccaatccctatttttcagtctagtggatgagtggagggtggggccgtttgctgagatgcagaaagatcagggataggtggagagggagctgagggggcaactttgaggtccaagcgaggatgtcaaggaggatgtctgtctcctccaacaaggtaggctcattccagcctcacggcttttgctgttctgtcttcccatgtgcagaaatggcctctctgcatcttcacatacggggattttctcagccttctggctttggctcaaatctcacctccttggcgtccttcacccatccctccaactaaaatcccgaactcctccacctaaagactcaaattatcctgtttaaatcctgattgcgctgggcgcggtggctcacacctgtaatcccagcactttgggaggccgaggcaggcagatcacctgaggtcaggagttcgagactagcctgaccaacatagtgaaaccccatctctactaaaaatacaagaattagccgggcgtgatggctcatgcctgtaatcccagctactcgggaggctgaggcaggagaattgcttgaaactgggaggcagaggttgcgatgagtggagatcgcgccattgcactccagcctgggcaacaagagcgaaactctgtctccaaaaaaaacaaaaaacaaaaaaggcctgatagcactcaccactattgttaactttctatcttcccaatcagattgtgggctccagtagggcagggtccacatcttggtcttgttcaccactaaatccttagtgcctagcacggagcccaccatagagaatagactacatgaattgtagagtgagtgaataatcctgttggccgtatgcactgttaggagggtgtgtttgagatacagatgacacccagggtctcacattcttgcaggagggaaagagacgtcagccctgggtcccagaagaggccactgacccagtgggagttcagggaaggcttcccagaggaggtggaggtgacagctgcagctataagggaaggaagaacagagcgttatgcagcatgtgaaggctttggagacttgtgagggcacgaaccgggctcactatcccattagacaaaagtggctgaggaaggatgaaactgtgtctaactctgcctggtgaccgaaatcttgtccatgggtgacgcttaagaagtgaccctcggccgggcgcagtggctcacgcctgtaatcctggcactttgggaggccaaggcgggcgggtcacgagttcaggagatcgagaccatcctggctaacacggtgaaaccccatctctactaaaaacagaaaaaattagccgggtgtggtggcgggcacctgtagtcccagttactcgggaggctgaggcaggagaatggcatgaacctgggaggcagagcttgcagtgagccgagattgcgccactgcactccagcctgggcgacagagcgagactctgtctcaaaaaaaaaaaaaaaaaaaaaagtgaccctcataaaaaaattagctgggcacgatggtgcacactagtcggaatgctggggtgggaggatgacctgagtccgggagtcagaggttgcagtgggccgagatcgcgtcacagcactccagcctggcgacagagtgagaccctatcaaaaaatagcagcaggccaggcgcggtggctcatgcctgtaatcccagcactttgggaggctgaggcgggcggatcacgaggtcaggagatcgagactaccctggctaacacggtgaaaccccgtctctactaaaaatacaaaatattagccgggcgtggtggccggcgcctgtagtcccagttactggggaggctgaggcagaagaatggcgtgaacctgggaggcggaggttgcagtgagccgagatcgtgccactgcactccagcctgggagacagcgcaagactctagctcaaacaaacaaacaaacaaaacagcaacaacaacaacaaaaccatcctcccctcccgaggggacagaacagaaacgaatgggcgagtgccgggccaagcagtgggtctccagcaggtggcattaaaataggaattttggctggggacggtggctcacacctgtaatctcagcactttggaaagcccaggcgggcggtcacctgagggcagaaccagcctcgccaacatggtgaaatgccatctctactaaaaataaaaaattagccaggcctggtggtgggtgtctgtaatcccagcaactcgggaggctgaggcaggagaatcgcttgaaccaggggggcagaggttgcaatgagtcaagattgcaccaccgcactccagcctgcgtaacaagagcgtgtaactcttgtctcaaaaataaattaaataaataaataataaaaataaaaaagaatcttcattcatgggaagtcgagaacacatgaaaacaagtaaaggccgaagcgcagtggctcacgcctgtaatcccagcactttgggaggctgaggcgggcggataacctgaggtcggaagttcgagaccagcctgaccaacagggagaaaccccgcctctactaaaaatacaaaattagccgggcatggcggtgcatgccagtagtcccagctactcgggaggctgaggcaggagaatcgcttgaacccggaatgtggaggttgtggtgagctgagatcgggcaattgcactccagcctgggcaacaagagcgaaaccctgtatcaaaaaaaaaaaaaagaaaaaaaaaggaagaaaaggcctaaaggcgccgggcgcggtgggtcacgcctgtaatcccagcactttgggaggccgaggcgggcgaatcacgaggtcaggagatcgagaccaggtgaaaccccgtctctactaaaaatacaaaaaaattagccgggcgtggtggtgggcgcctgtagtcccagctactcgggaggctgaggcaggagaacagcgtgaacccggaaagcggagctggcagtgagctgagatcgcgccactgcactccagcctgggtgacagagcgagactccgtctcaaaaaaaaaaaaaaaaaaaaaaagaaagaaaggg

SEQ ID NO: 11250 - DNA, 5536 bp, Homo sapiens
cgggacggcgagaggcacgcggcgggaggggaccggaatcccgcagctccggccgcgccatggacggcaacgacaacgtgaccctgctcttcgcccctctgctgcgggacaactacaccctggcgcccaatgccagcagcctgggccccggcacgaacctcgccctcgcccctgcctccagcgccggccccgccctgggctcagcctcgggccggtaccgagcttcggcttcagcccggccccactccgaccccggagcccacgaccagcggcctcgcgggcggcgcggcgagccacggcccttccccgttccctcggccctgggcgccccacgcgctcccgttctgggacacgccgctgaaccacgggctgaacgtgttcgtgggcgccgcctgtgcatcaccatgctgggcctgggctgcacggtggacgtgaaccacttcggggcgcacgtccgtcggcccgtggcggcgctgctggcagctctgccagttcggcctcctgccgctgctggccttcctgctggccctcgccttcaagctggacgaggtggccgccgtgggctgctcctgtgtggctgctgtcccggcggcaatctctccaatcttatgtccctgctggttgacggcgacatgaacctcaggtacggatctgtctattccttgggcatctgtctcatcccagacgcgcgtttacggccgtgggctcacgacgaaggacagaggcagtggaggggttggaattaggcgtggaggaaggaggagaaaaggagaggaagttgatgacgccccggctttagaagtcaaggccgacctgcaggttgtgctgctaggggagcaagctagacggcgagggagctgctccaaggctgggattccatgcgcagcgcggcccttcagcagggtccctcgccgtcctccccgagcgtcggggtggcagcgcaggtcgttgtccagtggaagacaaagagaagggggagtctgaactagaactcgccggcaacgtaaaagtaaaatagggctactggcccgtcagagaaagtaatctcacatagagtgcaggattgttgagtccgaccaacaagtagcagtcagcagctttaccatggcttaccttgcagggggcttgcaaggaagaacgttccttcccctcagaatcatccaggctcaatagactttataatgtcgagggcagcagtaccgagacagggggcttgtttttcctccctgccttgggttcataattccatcggtgttagacgtgctgctctcttggcactctcctcggatgtaggttctgcccagacttcaaccccgggacttgcagtctccccgttccacctctactcaacatacaagaaaaaggttagctggctgtttgactcaaagctcgttctgatttctgcacattcccttttctgcagcatcatcatgaccatctcctccacgcttctggccctcgtcttgatgcccctgtgcctgtggatctacagctgggcttggatcaacacccctatcgtgcagttactacccctagggaccgtgaccctgactctctgcagcactctcatacctatcgggttgggcgtcttcattcgctacaaatacagccgggtggctgactacattgtgaaggtaaggccccctcttccctttccatactagcttggagagcccttgatctctgacccacagcagaaatgttaggaagtttggagaaggcggaaaggaagaaaaggacttggaagtagttgcatggataaaattttttttaaaaagtttatgctacaaagataacttccacttttgggattcctagaatgacagctttaattaagacacagcttaatcaaaaccagcataagagaactatcagtactcattggaaggaaacagatcatagcagggtggggaagatgacagtgtaattaaatggcaacatattttccactaattgtatataattaaacataaaagcagattaaataaaattactttaatagaattggtgcagtattttagaaatgcatggctatcttttcaaaaatggaactctaattctgagaaactctgtagtaggttcctttaacattttattaaatttttaaaagtaagttgatactaataggacaaaaagtaatggaaaagttacattgtagtaatagaacacacaaaatattggctttaaagcacaaaataaaattgggtcctggataaataatggaggttatgttgaccttactaaatgtgtttctttttctttctccattgcaatattttatatggcttataaagctagtgaaaagataggggatttctataatttgtgcaatatttctcctaaggctttgattttttaaaaaatgaatgctttctgtagcagtagagattttaatagtttagtagattctagtagttgactggaggaaaaaaaatctttgcaaaattaagctgtctttgaaaattcaaaaacagtagcaaaaaagaataaaccatgaccaggatgctgacttcaggtaattaatcaaataaaatacgtaactattactgcaaaatgcacaggcaaattcctttagacaaatgaagagaaaaagagccaccctaatgtttcaattatgtagattcaagaagacataatcttttgttttacttattttctaaagtaatttgattatatagagtcagcttttattaatatgaaaagtagagagttcttttctgtgcatatatccaggcttgagtaaaagaaatcctgctccataatacacatgtatatgtgaatgtaaaaatgtatgtgtacatgtaaatatgcatatattaatacctgtaatatatactcatagatactcttgagatgcattaagaacttgttaatcttaatcattaagctaatgctattaatgtgatggcatttactataaaaccttaggaagtctaagagaaagtcaatcaaatgacctatttacacacccaaaacaagaaatatatttaaaataaatatattaataaattaatatatttaatatttaaatataatagacataagattagctacctttgaatttaaggttaacctagccctattctttaattaacacactattaagaaacggtttatataattgttacacctttgcaaacacttcaaaatgagcattcaatgtcaatgcttgcccaaatgatttaaaatagttctaagggactttggagccaatatttcaaaatgaagaaatcagactgtttgtcagcgctttcaatgtgacatactttgaaatggtatgcttttacatgtaatagcctggtttctgccaattatgcatctgtagtatctgtaccttatataataattattgcagcatcctctagggtagaatttgtgaccagctcagataaattttaaataattttttaagagtgtagagttacgccattcccgaagactgcaaaagggatatcccagctatccagggaaccagaagcaacatttaagctgttctctctggctctagtttcctttccctgcccactcctcattaaaaaaaaataagttaactaccaatatgaaggagaacgaggagaggaatttttagatttccgccttacaattcatacagactgttttatttgaatgagtgaaatgtaccagtcagaacatcaagatgacacgttttatacagaagtcagttgtactgtatccgaaatccatctattgtaataatacgtaagcatcattacagacttatagatgggaggtttctcatgaacaaataaaaaaggggaaagttgccaaattgcaaagaattcttcacatatttatttacatttttctctcttacataatctaagagtaggtaattgtttcaatattgcaagcaatcctctgcagtatattttgagggttaaaaagatcacacactgagcttcagacattttaatcaagtttcacaagttttaactcatgtaaaatgagaactaatttcttatggaaaacacggggttcagttcagggaaagtaaacatccacttgtctgctctgatgatcagaccatacctggggtattaggttcagttctaaatgccctgtttttaagaggcacattcacatatgaaacacattctcagaacagtcaggataccaaaacaaagttatgtgatggaggtttaagtttggggatgatctgcctgaagaagagtagccttcccctgataaccagtttttaagcttttgaagagctgtttttcaggaaaaaagcttttgaaggctatttttttttgaagagctttttttttttttttttttttttttttttttggtgaaatggagtgttgctctgtcacccaggctggagtgcagtggcgcgatctctgctcactgcaacctccacctcccaggttcaagcaattctctgcctcagcatcccgagtagctgggattacaggcattcaccatcacacctggctaatttttgtatttttagtagagacagtgtttcaccatcttggccagcctggtcttcaactcctgacctcatgatccacccaccttagcctcccaaagtgctgggattacaggtgtgagccaccgcgcctggccagaaaagctgggtttttttgtttgttttttgtttttgaagagctggtctctgtcgctcctgagagcctatatccaactcaatggctagaggttatagaaggcaaattgtccctggacataaggacaggcctccaaacaatcagagctgcccaatgtggctctggatgcttcctgaagaggtggcctgcccatcttcagaaatattctgtcaaaggtctccattttgtgttggagagcatactagatgggtgttttcttccgtgagcttaggattctctcgcctgagttcatcttcaaccatctcattgtaattttctattactaggtttccctgtggtctctgctagtgactctggtggtccttttcataatgaccggcactatgttaggacctgaactgctggcaagtatccctgcagctgtttatgtgatagcaatttttatgcctttggcagcgtacgcttcaggttatggtttagctactctcttccatcttccacccaactgcaagaggactgtatgtctggaaacaggtagtcagaatgtgcagctctgtacagccattctaaaactggcctttccaccgcaattcataggaagcatgtacatgtttcctttgctgtatgcacttttccagtctgcagaagcggggatttttgttttaatctataaaatgtatggaagtgaaatgttgcacaagcgagatcctctagatgaagatgaagatacagatatttcttataaaaaactaaaagaagaggaaatggcagacacttcctatggcacagtgaaagcagaaaatataataatgatggaaaccgctcagacttctctctaaatgtggagatacacaggagcttctatcttgctgaaatattgcttcatatttatagcctgtggtagtgcacatggttaacataaaagataacactggttcacatca

SEQ ID NO: 11251 - DNA, 4126 bp, Homo sapiens
tgcagtgcagagttcctttatttgggggcagtgcccaggccagttggtggaaagaggcaggcatacaacccactgtcaggctggggggcccagcaggggcgatggaggagacgaggtggttgagggattttctcagctgcaggttccaggcccaggacaggaggagatgtcaggcatcagacactgagcctgcttggtgcccgcaggagccaaaaactggcggccagagtttttcccgcccccgccccccgcttacccacaagggtgcccagaggccaccctctgcatcctcctttcccctcaggatggagtccaggcccaaaggggtcagattctgcagaggccaaagaggacactcaggaaggtgacactgcctcagccagccaaggaccccctgcctcgagaggaggcagcagaggaagagcaaacactttaacacaggctgtggcgacccgccccacagcacacacggcacacagagggcctcaggcacagctccccttctcagagcaaaacccaactagacacaaggcccagctcctgcccacagccacagaaacgcgggccacaggcttgcctgggctggcacctactggttctcttccctgctggcagcatgaagggaaaagacacaggagggctcagctgggctcctagactggcccaggctgagtcctggtcccagccaacatctgacaaaggaaacaccccaactggaggagacaaaaggggtgtggctcacatggagcacgctgtcaccgtcctgagggcttgcccatggagaagacagcaccctgggtactgaaggggaacggtggggcaggaaccaggaggtgagctgggactcaggtacttgctgctggccaggtactcacagcgtctggtaggtgctgtccttggccttgaggaagtgcagcacaaagaaagccaccgcctgtaggctcaacaccagcacgacacctccgataaagctggccccgtcaaatccagggctgtgggcctcagggactggggggctccctgcaggggtgaggcagggcaggggtcatagcagtcactgtgaaccaggatcccagtcctaccctcataactggcacaagtaacctggaggccccggtcctcaatatggggtgcttaaaccctgggctccgtttagtccagatcccgcaggcagttgggaagcgcctggtgggaggaacagtggcaggggagggtggggtgctgtccagccctggctctgctcctggcttgctctgtggcttttatgccacccacattctctctgggcctcatgatcacatggtccaattggtggcttggaccagtgactgggctcccaccctccctgggcctcaccagcccaatagggtgaagacagagccagaactcagaccctcccctgctcacaattcctttcagccttggacctcagggttcagagccaagatgcagacgatatagtcccttttcaggactcctaagccctaagacctcagtgtcacccaatgtcagagccctcagagagggaaggagcagggggagaagtggaggccccaactgtcaccctgctaagtgggtaagcgaggactggacagtgtgtgtcagggggaacatggctgagggacaggcttggccaaagtcacctcacaggacatagccagactcacacagggtcccctgaccatctcctctgccccttagaaggtagggctttagggccatggttgccaggctatgcctgggtggctcccagctgtgccacggtacctgtccactcctagcagggatttgatttcaggccctgggctgggtgcccagaacagggcagggctggtggatggaagatcattctgggacagtggaaaggggcccagcctgaactgggtctccctcccagaaggtgtaaggggtggaaggagtctgacaatatgaagggcaaacagtggtcccagctcccgctcagggagccccagagaaggaagctgggggatgaggagcagaagaggggagaaatgagccacatgaggctgatccggggctccagctgagggagctgagccatcaataattcagcttctgagatcggtttctggctttaattaaccaagggcctcttcagccatccctgccaagtctggtgacctccagcccctgagagggagtgggaagcaaagggtggcattcttgcctctactccgccaggaacccgccttgtgaccctctctgggcctggagggtgcagtaggcaggcactgaggatgtctcctgagcaactcgagccacacaccctcacctccaaggacaagtcccgaggagtgaccttgagttcccagaactggcaatggggaggagggatgggaactgtcatttcttgattgccttcagtgagtcagacactgaagtgggcactgtacagcttctcataaaacctgcagagcaactctatgagaaaggcatcatccaacccatttcacagatgcggagacaggctccgagggagaaggcgcagggccgaggtcacagagcatgtcagtgcctgagcccagagctgtcttcccctgcacctctgctcctcccactgccccgtctccagggagtactcacctgttgtgactgtcttcggttcataggtggggtggtggtgagcagctgaggagacaggtgatccatagcaaagcagccttcccaccccctgactcccatcaagaccccagcccccactcaccgctaaacttccgattcagatgcagccctgtccctactctagacatccaacatacttgcaagccccacacagttccctccaccagatgtgctctctctccatctctaccttccaggctcattactgatgccacctcctccaggaagcactccctctcattccctctgaacttccaaagtccttgctatgccttaaactagaagaagagctaacactcccatcccctccacacacctgtactaattttcagatgaggaaataggcagagagaggaggggacttctcagtgagctaaaggcagaactgataccgggcccaggtatgggtgagcaaaatccaccgcctgagagaggctgtttcctcctggggggcaggctatggctggggagacccatgcaacttggcttaggtgcaagaacccccttacctggacatgcctctgagcggttgtagatggagcaaccttccttgaccacctcagattgggccacacagtgtcctggtgagagaaggtgcaggggggaggtttggggagaggggccagggccttggggttcagagctgggggcactcaatctggggagggctcagctccatacctggctcctctggccggcactgctcccacatgcagctggagagattgcgcgctctgtctccctccacgcagtgctcacagacctccagctgtttgcaggccccttggaccgccggccagatattcaggcggatcagggctcccctcccaaagcctcgagctcctttacctggtagtgcggtggagtgggaagggagaattcctcgaagccaagctgtggcacccgcccaccctcccacccaacactccggtggccctcgcccctctgcacacatctgggctctcacactcacccctggatccccaagccccagcgcacacctggagcttccacagcagaggtctacacacacctagagcctccccacattcacccagagcccctccctttgcatacacccggggttcccagattcagttggagccacctcccccagaccacctgaagctccctaggcccccacacctggggcctatatttacacacagggctccacacagagctggagccccctctcccacccctggaggcctgcacttggccggaaagccccctcccctcaagcccaggctgctcctggggagacggctggctgaggtgcaagctccatccgtccccgtcgagcccctagccagaccctgccgcgagttaccagccacagccagctgggcacataggaggaggcagcaacagccgccacagagcgcagtccgcaaggcgcggggtcccggagcctccatgggctcgcggggtgggggtggccgggggcggtggccgggatcggtggacagctgccgggcgc

SEQ ID NO: 11252 - DNA, 341 bp, Homo sapiens
tttagtagagatagggtttcactatgttggtctggctggtctcaaactcctgacctcaagtgatccacccgccttggcctcccaaagtgctgggattacaggtgtgagccactttgccccgcctaaatttttattttttgtagagatgggttctcactatactgcccaggctggtctcaaactcctggcttcaaacaatcatcccgcctcagtctcccaaagtgctggaattacaggtgtgagccactatacctcctggccagttttttattttttaatatatacagggtctcactctgtcacccaggctggagtgcagtggcatgatcttggctcactgc

SEQ ID NO: 11253 - DNA, 142 bp, Homo sapiens
agggaggagggatagcattaggagatatacctaacgtaaatgatgagttaatgggtgcagcacaccaacatggcacatgtatacatatgtaacaaacctgcacattgtgcacatatactctagaacttagagtataataaaa

SEQ ID NO: 11254 - DNA, 13255 bp, Homo sapiens
ggttgtttactgaatgcttctggtatctgcagccccgctggggttcggacagggggtctggaatagggcttcacaactacagcagggctaggaccctcttgggctggaaggagctggagaggcctctgcaagctgtcacaggctcttggtgctggcactggctcaggctttcacacacacacacgcgcacacacacacacacacacacacggacaggcacccccttggtggccttcacagtttcaccttcaggtaaatgggctcatcctttgagccatgaggatgggaagcgaagcaaggaatgaaaaagctagtgtgtttgtgtgtgtgtgtgtgtgtgtgtgtgtgtgtgagcgcgcgcgcgcgcgcgcgtgtgtactcgtgcgtgtgcctgtgtgtgcctgggagtgacctcacagctgccggaacataaagactcacaggtccgcctcccaggctcaaagctggctctgcaggggacatgagaggcacaccgaagacccacctcctggccttctccctcctctgcctcctctcaaaggtaaggaggcccgggccctggaatgcactgctgactatttgggtgtggagggggtggggatgtaaaatcgcagccaaggacccccttggcagaattcctccagggccccacattgggcacagtctggcccccatgcctaagcagggcttctctccctggaactcagagctgcctccggccagccctgctgtgtgacctcagatatgtgtcttgccttctctgggcctcagcatcttcccaggtgaagggtatacagtttgtgaggcctctgtgaagaccattcatgatcattcatcaaacttaccaggcaaattgaagaggactttaatgtatcctcattatgaatgggggcactcaagacatgacatgcttggcctaactctgagccagcatttggatggatgcctagctgattggaaggttcattctgcaagggcatcaatgctgttggactcttaggcagtgagtgacccgcccgccctagctagaggggaacaggagacacctctgtggagtaatggccttatccctgaatgctgcatgggacattcaccaaagagcctgtgggacatctaccttgtctaacatgcacaacaatcccataaggaattttcagttaagtgaggctcagaaagggtaagcaacttgcaaccccagttttcagtcaagtgaggctcagaaagggtaagcaacttgcccaaagccacacagcaaagaaaggtcagagcaatagaggagagccatggtggagcccagaatgacatggatgtagggggagaagcactccagtctgtgcctccccaagcccaaactggaccaaggccacagctgctaagccttgtcatcccctcggcaaatgctgagttcccagagccatggaatcggccccaccacaagccacgatctcactgtattttcacgctcctttgaggagcacgggcaggagcttctctccctcaggctccaagtcttcgtgcctgggaagcctgagaaccacgctggcatcctgtcctgctgtttgttcttccaaaggggatgggtagggcatgatgccagtgtgggtggcttgggtagttggaataggggacttggggctctaggagggagaaggggcccaggattatacgagaacaaagtaaagctgtcctagacttgccattagggtgagacttacgggaccattcttccctggtcccaggaagcagggactgcacagaaacacagggacttagtcaccacaacatggaaagccacagcaaccctcagagggagaactgtaagtcttccaggctggccgttggctccggggctcctggctgtggaccggggcaggaggcagacacctggacacaagcaaaatcacattgatcaaggactggccagaacctcatttaatctccatcatcactcagaaacaggttgtctctactccagtttacagaggagaaaactgagcttcacctccaccttccaaagccgtttgtccacatgttcagtcacgtagcaagtcactggcagaacttgaatctcaactcttgcccaaaaaactccatgcccagtactcctgccccagatatcatgagccttgccccccaccaccagatatcacagcaaggccctggggaaactgaggcacaatgggacaacttgagtttgggccttggatgtcaacttgaacttggatgtcaatcctgattctgtctcttactggctgtgttactacacggtttgagctccagttttctcatctttaaaatgggcataatgatggcacctcacattggaggggtaaatgagacaacagcacttggcacatgacatacatatggtatcacatgagataattgtacactagaatagttgatatcattaatagcctctcctgggtatcggggcctacagagtcctgccccctgacaagcatggccagtagaggggtccacagtgggagccaaggtgcacagctgctggtctatttcctggcactcctgttttcaggtgggagggacctgagagtcatttctgacagtcctccctccattgcccacaagccaagggagctgaacctctgacttagaagggaacccaaaagcctagaccgtttctatgtgaatcacctgtggatttatgaaaatgcagattcgggctgggcgtggtggctcatgcctgtaatcccagcactttgggaggccgaggtgggtggatcatgaggtcaggagtttgagaccagcctggccagcatggtgaaaccccgtctctactaaaaatacaaaaaattagctgggcatggtggcatgcacctgtaatcctagctacttgggaggctgaggcctcccaagaattgcttgaacctgggaggcgaaggttgcagtgagtcgagatcgtgccactgcactccagcctaggtgacagagcaagactccatctcaaaaaagaaaaaaaaaaaaaagaaagaaaaagaaaagaaaatgcagattcggatttattatataaaaattcagcttcggatttatagaggggctccagatgctgcctctctgacaagctcctagatgacgctgctgctgctagttcagaccacaccttgaggggcgaggctaggccatcgtctctagaatctgaacagcctgcagcgatgggatccactcccttgtgaggcagccagacacctagctccgtgtgtccatctgctactcagtgctgtctcagtgggggctgtgatcgcctcctactttgtggcccccaccagaggctggtcagccagtttgcaatggctcctagtggccggcgtgggagttgccgggaactgaaagcaggtttgcaggattgtgggtagtgggggcactgggcggggcagagggtgaggcagagcaaaggggtcattgcctgctttggggctgcacaggagatatgaggtcattaattccatcattataaactgcaagcctccattcctctagatgaaaccctcatcccctaaggatcctactaaactcaaacttggccccccaaagatggggccactggaagcatcttgaattatacttccttcttggtccccaccttcaaatgggcagacagggagctcacggcacctgctgtatgctttggttgtttctctgatgtgggtggcgagggtcaggcaggccacatgggctgataccctgatcctgtctctggggagtgggtccctggcttacggacacagtctacccccatcccgtgtccctgagtcctcacttgggaagcaggaccggggacgctcccagccctgaatcgaacacactgacgtgtgctaagttcctgtccctctctggagctcagtttccccatccgtacctggcagggggaggaggttagactggggcagaggtgctgaaaacctagctgagcttcagaagccactggacagcttattaaaaataaagattccaggtccctgactctgggacttctgattttgtaagccccagagtgggttgggggtctgtattttcccaagtctcctggctgatgtgatgtacctccagagctgggacacatgctgaatggatcgaaaggccaaaaacatccatgatatggttcaatttattcagtcctaagataagtatccgtatgctggaaaatgtaccagaccctaccattttcatccttgacttgttgcttttgcctttctgtaagctcccagagggctggggctgagccctctgccaccattaacaacaaggatcatcaaagctaagtgcagtgagcgcctactgcatgccaggccctgtgctgagggtttgctgtgcagcatttcatgtactcctcagagcaatcctctgagttagatactttgaggaaactgaggctcagaatgcttaagtaacttcctcaaggtcactcagctaataaggggcagaattagaactggaagtctagccaggtgcagtggctcatgcctataatcccagcactttgggaggccgaggcgggcggattgcctgagctcaggatttcaagaccagcctgggtaacatggtgaaaccccatctctattaaaaatacaaaaattgccaggcatggtggtgggcgcctgtagtcccagctactcgggaggctgaggcacgagagtcgcttgaacccaggaggtggaggttgaagtgaggctgggatcgcgccactgcactccagcctgggcaacagagccagactctgactccaaaaataaaaataaaaaataaagaactggaactctagtccagagtccttgcccataactacatgccatactgcctcttagggcatgttgtgggactactggcctttgaggccaggtctgcatggctctgaggctaaggtgtggacaccacactacccagcctggcagagaagtggctggttgtgagggtctcactgcccacctcgaaagcccgtggctgagtgaggtctctgtctcttcaggtgcgtacccagctgtgcccgacaccatgtacctgcccctggccacctccccgatgcccgctgggagtacccctggtgctggatggctgtggctgctgccgggtatgtgcacggcggctgggggagccctgcgaccaactccacgtctgcgacgccagccagggcctggtctgccagcccggggcaggacccggtggccggggggccctgtgcctctgtaagcaggtttgcaggactgagtgggggcgggtgtgagcgggaggtcaaggccgtggtgtcctggatcaaagtgcagccctcctctctctacctccttgggtgctcacttcaggtatcccatccattccagctgaacttggtgtcccaaagcccactccccactccctcctctcccttcttggcctctgcttaaaccatctcactaccccaataacctttccccatccctacctgtccaaatcattgccaactttcaaagccaagttcaaacagcttctcccctgagaagcccccccagattcttcaaaccagatgccaccactcccttctcaggatccttacaacactttggggaaaataaaagtgcaaccttttagggcataatatgtgtccagaactgtgctaagcacttactacacaagtcacatcatcctcacaataaccctatgatgggaagtactttcagacctattttatgaatgaggaaacaggttcaccagcattaagggacatgcttcatgtcacacggcacgggaccagatccaacgggctctaaggaacagtttattctgtcttctcccatagtgggggccctcggagcactgctgggatcctgggtttgccatgtattcagcagtcacccgagcatgtgacattcctcaccactcttctaggccttggtattctctgatgcttcggggcagggctttgcaagctggctccagtgactgggtgccagagaattagttgttgtgggagggctgtcctgtgcatggtaagacttctagcagcatccccgaactccacccactgtatgccagcagcactccccatcccccaagtcatgacagtctgtcttcagacagtgccaaatttccccagggggcaaaatctccagttgggaaccatcactttagagaaatgcaaagaggcaagagattgttcttcttttttcttttttaataataagccttgtagaacaatttgcctctttcatctatgtgcatgtcacacttttataaaaataagaacgaaagagagagagagagaagctcatgaatcattgataatgaattcatctgtaggaaaagccttgttaaaaaacaacaggccaggcacagtgactcatgcctataatcctatcagtttgggagactgaggcgggacgaccacttgagcccaggagttctagtccagccttggcaacatagtaagatcctctctctatcaaaaaaaaaaaaaaaaaattagccgggtgtggtggcacatgcctgtggtcccagctacttgagaggctgaggtgagaggctcgcttgagcctgggtgtttgaggctgcagtgagccatggttgcgccactacattccagcccgggcaacagaccaaaccctatctccaaaaaaaaaaaaaaaaaaaaaaaaaagtaataactccatgtgaaatgctttatttacaagtactgtaaggataaggagggtgattcgttacactgactgagggatgattgcttatgaaaatgtatctgaagaacaattgagataagtaacacttcgcttacaaagctgttatttacatttgctgtgacacgtgtaaacagcacccacagagtttattttacacttgcacagcccttaccacgtgtaagacactgagggtttcacaaatataaactcatttaatctcacaaccacatgaggtaggtacccttctcttataaatggaaaaaaggggtacagagaggctaagcaacttgcccaaggtcacacagctcataagcggcagagctgagatttgaactcagggagctggctccacaagctccattgctcaactgcctgacatgcagcagttgattagtacataggctgtgattgttaataactgtattaagggatttttcttattccatcttaattcagacttcaaacacctgcaggccaaaggcgtacttgggtccctggtccttcctgcaacttcccaccttggtctgtcaacatgatgggtgctcaacagtgtttaatgatttaaactgaatttagaggccgggaactggtgaaccccaaagagtccagctaagacatcacaaaggctcagtctagggctttgcagggaacatactgccaaaaacctctcccatcacttactcgttgaacgctcttctctaagggccaactctgagctgtgagatgtgctgcagattcaccatcgtgataacagcgcatccaatgccgggatcctgatcttccgccccccagaacggcctccccagtctgttgagagcacctccatccttctcatggctcagactcaagacctgggagtcgttctagaggtctctctatctctctctcttttttttttttttttttttgagatggagtctcactctttcacccaggctggtgtgcagtggcaggatctcagctcactgtaaccccatctcttgcgttcaagcgattctcacgcctcagcctcccaagtagctgggattacagacacataccaccatgcctcgctaatttttgtattttagtatttcagtagagacggggtttcaccatgttggccaggctggtctggaactcctgacctcaagtgatccacccgcctcggcctccctaagtgctgggattataggtatgagccaccacagccggtctagacatctctcttttctcacctcccacataccacccaccagcaaattcatcgtgtatttccagcatccgacactcccatcccttctggtctgagccccgtcatcattggcctggattttgcagtagccccataatcatctccctccttctgtcgttgcccctggtctattcacaacacagcagtcagagagctcctgggaagtcataagccagatcacctccctcctctgccccaagccttctggtggcttcccatctcagaggaaaagccaaagtccccacagtggcctacaaggccccaacaggatcctgttcatgcttcctctctgacctcctctcctcctgctctctgctccagccacattggccccttgctgttccttaaataccccaggcacactcgtgcctcagggcctttgcactggctgttccctctaccagcattatttctcagcaaggccttccctgctggaggattagatgagctaggggacttacagcattttgccccaagcctggcacatagcagatgctacgtggaagcataaccctctcctgtttattgagcatctgctatgtgccaggcttggggcaaaatgctgtaagtcccctagctcatctaatcccccagcagccctgtgagccgggtaccaaggctcagagaggcaaaataacttgccccaggccccacaagtgggagccagagttggaacctaagtatgtgtggttttggttctgaaacccctgtgtgtgtacagacctactggaaggttttctcagaagatctgggagaacttgtttgctaatgagtcctttccccagacgtagctcagtggccacccaggtctcacacacacgctgtttcccgtctgcacttcctgagcagctcacacgcttcaccagcgctcttacttcattctgtcttggagatgatgccctcacacccgtccccctttcccaagcccatgagtccctcaaggcaggaactgtcctctttctgtctgggagcacagtggttggcacacaggcgggaaacagtaaatatctctggaatgataaggagtagggctattttatcagggtctctcatgtgccaaggcttatgccagctattcactgaaggggcattcctacagtactgtgtgtcgcacctaggctctgagcccaccggagggtgcagagacgcacactggccgccccagccctcaaggagttcatgtccagtggaggaagtggcaataacacccatatcttgagggcttcattgaaagagtgttccctgagcacctaggccatgcctagcactgtgtgctagagggtacggacatgtcatcccatggaacctgaagttacgattactgagctcatcattgctgtagttcaggccactcagagaagttaagtaacttactcaaagacacacagccagcaagttaagccctgacctgacagtgatgacagcacaagtggacaacgactttgttgcatgaaatctcagcgtgtatagaatacttaaactttattaatatatagtaactatactaatgataataacagagtagctaggacctatggaaggtctcttttatgttgtgatcattacgcctatcattccgagtagtctctaccaccctggaaaataagtaccattatatcccagcttgcaaatgtggaaactgaggcaagaagaagtgaaatcacttggcccaggttcacagctaagaaagggcagagtttggggggtcaatccaggcctgtcttcttgcaatccctgtgccgggatccagggtgccccagcaggctggtggagggctggggagaggtgcatatcctgggctggagccctgggcagggcccagctactgtgaggcagctgcctcaggcagcgggatctgggcagctctgcagagaaggctgtgccgctttgcgggtcaccgatgggggtgcggtttttcctccgcagtggcagaggacgacagcagctgtgaggtgaacggccgcctgtatcgggaaggggagaccttccagccccactgcagcatccgctgccgctgcgaggacggcggcttcacctgcgtgccgctgtgcagcgaggatgtgcggctgcccagctgggactgcccccaccccaggagggtcgaggtcctgggcaagtgctgccctgagtgggtgtgcggccaaggagggggactggggacccagccccttccagcccaaggtgagcgcagcggtggtccaggtcagggcaggactgcctgggggcgccaagggccacctagggggtggggtggggggcggcttcctgggtaccaggacccagggacacatcagaagctgggaggggcggaggctgaggagggagataagaaagaggagtggagggccgggcgctgtggttcacccttgtaatcccagtacgttgggaggccaagacgggcggatcacctgaggttaggaattcgaaaccagcctggctgacataggaaaaccccgtctctactaaaaattcaaaaattagcctagcatggtggcgggcatctgtagtcccagctacttgggaggctgaggcaggagaatcgcttgaacccgggaggcagaggttgcagtgagcccagatcacaccactgcactccagcctggccgacaagcacgaaacttcatctcaaaaagaggaaaaaagaaagaggagtggagggtcaccaggcctccctctttaaaaccaataaacaaaaagccactgcctttgagatgtgtaatttaaaaccataaataattaaaaataaaaactgggtgacagagccgggagaggaaaggtgggttagggtatgtgaaccaaattctcacatttcagagatataatagagctaagctcttagaatatataatattatcgtatttataatatattgatacatattaatatatttagtaatttattattatttgggcttactaaaaaaggaactcaaaactgaacgaggcaaagtggctgctctggaatgtgggccgggggtgggctagagatggagaaaagacagttacctcccaccgtcccactataaatcttcaattttagagatttttgttgttgctgtgttgctttttgaaaattatcacatgaatgtgactttctaaaaaaggcaactgaaaagaggaggattgatttcataaatgctgctgccacccacaagaggtagtcacgtgttatgggtcaggtgcacggcatctgcaacagccccgccatcccctttttgctgtgtgactctgagaaagttgcttaacttctctgtgtctcagtttctccagctgtaaaatggggacaataagagcatccacttcatagcgttgtgagaactacttgagtttgttcaagttaagcagctgtagcagtgcctggcacatggtactatatcagaggtagccgttattatccctgtgatggaatatgatatatccatttaaatacataggaaaacaccagtgagttcaccttatggataaaagcaggataagaaggtgtatttccaactcgatctcaactaagtgtgtccctatgcacgtatacaggtatatctacacatacacatgcatacacagcacacacatgtgggtagaaatcagggtttctcaacgtcagcactagtgacaattggggcaagtaattatttgttgggggggttttcctgtgcactgcagggtgcttagcagcattcctgacttctactcactagataccagtagcatccccccagttgtgatcaccaaaactgtctccagatattgccaaacctttcctgggaggcaaaattaccctagttgaggacttctagtgtaagactagaaggaaggacaccaaaatactcacagagggagacttggagcagagaaaaagctagaccatggtgaacctgccatcttgttcctggcacaagaatcctggaatctttagcatccttgccactgggccaaagcaccactccacacaggctgggcaccccctgcctgtaaaatgctgtttatccaaagagacgagaaaaccatggttcactgagggaccatcgtgaccaacacactctggttgccaaataactaatatttatggaaatcttacaagtaccaggtactgtgctaggcacttcatgcccattattttattcaatgccatccactgttaagaaatttacataacaagaaactgagatgcagagaggctgagccatttgaccaagattgccgtggccgctggcaggtgggttgattgagctgctgagccctggctgctcagtgctaactcttgttctttcccccctaggaccccagttttctggccttgtctcttccctgccccctggtgtcccctgcccagaatggagcacggcctggggaccctgctcgaccacctgtgggctgggcatggccacccgggtgtccaaccagaaccgcttctgccgactggagacccagcgccgcctgtgcctgtccaggccctgcccaccctccaggggtcgcagtccacaaaacagtgccttctagagccgggctgggaatggggacacggtgtccaccatccccagctggtggccctgtgcctgggccctgggctgatggaagatggtccgtgcccaggcccttggctgcaggcaacactttagcttgggtccaccatgcagaacaccaatattaacacgctgcctggtctgtctggatcccgaggtatggcagaggtgcaagacctagtcccctttcctctaactcactgcctaggaggctggccaaggtgtccagggtcctctagcccactccctgcctacacacacagcctatatcaaacatgcacacgggcgagctttctctccgacttcccctgggcaagagatgggacaagcagtcccttaatattgaggctgcagcaggtgctgggctggactggccatttttctgggggtaggatgaagagaaggcacacagagattctggatctcctgctgccttttctggagtttgtaaaattgttcctgaatacaagcctatgcgtgatcttgtgtgtcaggcctgtgttttctgagaaagccctcccattatccggggcagaattcaggggcagagttctctgtgaacctcacaaggtgaaatcacatggtcttaaagaaagccagaagacaggccttcaagtgatccaagaaacccaattcatattaataataattaacttttttatttatttatttttttgagatggagttttgctcttgttgcccaggctggagctggagtacaatagcacgatctcgactcactgcagcctcccgggttcaagtgattctcctgcctcaagactcctgagtagctgggattataggcgcatgccaccatgctcggctttttttttt

SEQ ID NO: 11255 - DNA, 559 bp, Homo sapiens
aggtaatgggggccccagacagcccttgacatcacctcttttatctttgccaaattctacaaacaaagcccatgtctttctgtcccccgcccccatggctggcacatagtagatgtccccaaatcttggtgatgtgaacttgtgtgtctcacccttcacagacatcaccatttcccgttgcacagaaggctccactcataccaggcgctttggctcccagaataagcaggctatcatgctatgtccgacatctaggcgttggtacgtactgttcccttggcctggaacattctgccctctctcaccctctcttttcttggctttctgaaatggcacctccatcagaaagtgtccctcactcttggtctgagcaagggaccttgcctggtattcctgaacttccacctgttttccctctgttttctccctctctgggccttgtcctcaggtcagtgttgtgcctccagctcctgcagaggcgaactcagaggcggccgaatgaaaccaaatggatttggcttgaccccatcatctagcggtgcccagcaagcgctggcac

SEQ ID NO: 11256 - DNA, 5889 bp, Homo sapiens
ggttgctgtcttcctcgtccctccggcccttcttcctactcagcgtctcacttttggcctattttctgctggatctctggcagcctcgctttctccctgacgtttcaggtgagtgtttcttcattcagtaagcacccattgggtacttgcttggtgcctgattccgctgggtggggttaagtggcgaggggaacgtacagcaggccacctgcctcccaggcatggcccacttcctttttgtacggaattccctaaaatgagaattgcccctttcccaaactaatactactgtaggtgcagtggttaagatggtgaagtctgcagccatattacctgggttccattctctgttctgccatttaccattgctgtgaccttgtaaaagtagctcaatttctgtttgtctcaatttccttatctgtaaaacacagatgatagaacttacttcatagagaggtgaggagaggattaatgagttaatacacatgctatacttatgatagtgtttcacatataagccttataaatagaacgtcagtgtgtgtttttcttgttatccatataatttacttagtaggtgacaggctgtatgtgagttgcttgggagataagcatgagtaaaatctagttcttatgttggagaagggtaatgtctaaaggagacagacgcaaacaaaaacatgtaacagctcccccattggcatctgaagaaggtgctctggggctgcagaggagggacaactatttctgccttggggagtgtctccagggcccctaccactcaataatttgcccccctcctctctctctagcatcatccccagagagccacactctgacaggtgagtacaggccacctcttgaagacaaatgcccacatcctgtcctgcttgctggtgccagtgtcaccatggagcagggcagtgccccagcattgtgaatgaactggtaacaagccatgggtttttcatggtcctaggctcctgtgtaggtgtttgcgtgcctgctccttttggggcagagggttgggtcctcctggctttgcttctaagaccaggacagcctccttttgagaggtggggtcatttgcttttttagactaaagatatctttggcattctcagagggatttaagtgtctaggaagctggtatctgaggcctccaggggtcatgtcatgtctccccagtgagggtgcggggtcaggcgcccggccgcacctgctgagtgtgcccgagttgtgcagatacctggctgagagctggctcaccttccagattcacctgcaggagctgctgcagtacaagaggcagaatccagctcaggtaacctcccctacatcatacaacagttcactacactgaaggggaatagaggtggcgggggatgggagtggagtgatataaactccccgcttggagaccctgaaagaagaggcctgggcgccttcttgaggcaacattcacagctaatccctggtgcaggaggcagtctcacctcaggaaataagcttttgatagcctgacactttctcctgccaaggcagaccagtgtgaattacaggtggtgggcattatgtattgccagcttcctgaattggtggtcttgagcatcctcttaaccaaactggaccaccccattccttgagtacatacccatccttctaccagctgagcagtagtttcttacccagccgagcggggcgcatatctcagcgtgatgttcttagacttttgctcttctctgcagttctgcgttcgagtctgctctggctgtgctgtgttggctgtgttgggacactatgttccagggattatgatttcctacattgtctgtgagtagggtctgtccctgccctatttaaagccctctcctttcttctttccttggactgacccagagggaagactatgctctctctgctcagtttctgatttgtggagatctccagggatgctttagtattagtaactgtggaagacttacctggggaggagggcagtggatgtggcaagaagaggttggcacagccttgggaaaggaccttgcctaccttcagcacttcagtttagggaccagttgaatgggggctcttaggaaattggcgtagggagctcttagttcacgttcttaacccatagtgttgagtatcctgctgtggcccctggtggtttatcatgagctgatccagaggatgtacactcgcctggagcccctgctcatgcagctggactacagcatgaaggcagaagccaatgccctgcatcacaaacacgacaagaggagtaaggggctgccctaagccaggagggtgaaagagcgggagggccttggcttggggttcatgagatgccctggaattgagatcttctccagttctttagctgtgtttgtctcccctcccatcattcatgcttggtcattgctctactactcttgcttttctagagcgtcaggggaagaatgcacccccaggaggtgatgagccactggcagagacagagagtgaaagcgaggcagagctggctggcttctccccagtggtgaggtccagggaaagcgggggtgtcaaatagaaagccagaggaaaaatctttctgctttggagctgccacctccaaaggaggtggaagccagaggttttgggagaggggatgctcctgataaattggttctcttatcccctcacatgtcgtgttcatcctggttctcctgccaggtggatgtgaagaaaacagcattggccttggccattacagactcagagctgtcagatgaggaggcttctatcttggagagtggtggcttctccgtatcccgggccacaactccgcagctgactgatgtctccgagggtatggggagccctttgctgccctgctccccgccacaatctttgtgttccctaccatgggtacttactgtgctctctggcccactcactctctaattctctcagctcctaaaagaccttaacacctaaggcttggcccagctttccatgtcttgagttctcatccttgaactcattgtctgttgtggctaatcagaccagcagcaggcccattcttaattctttgttctctgcacagatttggaccagcagagcctgccaagtgaaccagaggagaccctaagccgggacctaggggagggagaggagggagagctggcccctcccgaagacctactaggccgtcctcaagctctgtcaaggcaagccctggactcggaggaagaggaagaggatgtggcagctaaggaaaccttgttgcggctctcatcccccctccactttgtgaacacgcacttcaatggggcagggtccccccagatggagtgaaatgctcccctggaggaccagtggagacactgagccccgagacagtgagtggtggcctcactgctctgcccggcaccctgtcacctccactttgccttgttggaagtgacccagccccctccccttccattctcccacctgttccccaggactcaccccagcccctgcctgcccctgaggaagaagaggcactcaccactgaggactttgagttgctggatcagggggagctggagcagctgaatgcagagctgggcttggagccagagacaccgccaaaaccccctgatgctccacccctggggcccgacatccattctctggtacagtcagaccaagaagctcaggccgtggcagagccatgagccagccgttgaggaaggagctgcaggcacagtagggcttcctggctaggagtgttgctgtttcctcctttgcctaccactctggggtggggcagtgtgtggggaagctggctgtcggatggtagctattccaccctctgcctgcctgcctgcctgctgtcctgggcatggtgcagtacctgtgcctaggattggttttaaatttgtaaataattttccatttgggttagtggatgtgaacagggctagggaagtccttcccacagcctgcgcttgcctccctgcctcatctctattctcattccactatgccccaagccctggtggtctggccctttctttttcctcctatcctcagggacctgtgctgctctgccctcatgtcccacttggttgtttagttgaggcactttataatttttctcttgtcttgtgttcctttctgctttatttccctgctgtgtcctgtccttagcagctcaaccccatcctttgccagctcctcctatcccgtgggcactggccaagctttagggaggctcctggtctgggaagtaaagagtaaacctggggcagtgggtcaggccagtagttacactcttaggtcactgtagtctgtgtaaccttcactgcatccttgccccattcagcccggcctttcatgatgcaggagagcagggatcccgcagtacatggcgccagcactggagttggtgagcatgtgctctctcttgagattaggagcttccttactgctcctctgggtgatccaagtgtagtgggaccccctactagggtcaggaagtggacactaacatctgtgcaggtgttgacttgaaaaataaagtgttgattggctagaactgctgcctccctgactgtgagctgccttccacaccctgcactgcactgtgttctctcctcacccttaacctgcttcactccagtctgttctggctgtttattaccttgttgcaaaacagggccgaagcaaggattaccttgacaaccctagcttctccttagccatcttccttgacagtgtgatctgtttagtgagatttagcatgtgtgaataaagtatatgcaggaggaaattgctttgtcttcccaatcggtagaaattcgggaccataaaaattgtgttttaccatgtggcctacaaccttaacactgctttcttaagaagtcttcacccatctacatgctaacaactcactcagcctggatttatctttactggggaagccaaacaagcaatagaggacctttacctgtgttagaaatgagttggagccaaggaacactgaagaaatagtatcttaacagttactgagtccattgtatgtgcttggctctgctctgagtgatttatatgtattaagatttttcctcacaggtcagatatatactgttactaacttcattttatagacaggttaagcttcctgaaggccacaggtcccagtaaattgtggagccagaacccaaacccaagaagttttggcttcagcaaatgcatcagacagcccctgtccattaatagggcacaggtaggaagatgcacaaggatgtgggaactatagagaaccaatctgatgccttggcttaacaaagagtggacatggcaagccttcctctttggggaagaaaagcccagaactgagcagatggcctcctttatgagttcatgtcctccgccttcagctggaggtaccatatggcgatgctacctgtctttctgctggaggtaccatatggtaatgctgcctggctgtctgctggaggtaccatatggtaatgctgcctgtctttctgaggttgacttttatgccatgtctttcctaagtgtgtaagaatttttctgtttgcttcacatttgactgagaatcattctagggtttgattgagcccctgtcctgtgccactaaaggaactcgaacttttcatcacttagagatttcagaggggaatggaaaaacagttctaatcaataagcaagcaattcaagaaaaatagaattaatcaggcaatgactgcaacatgtcctatctttaatctattttcttattaagcttggacattgacaatagaaccagaagcttgtagctggatcaaaatattctccataggcctggagtttcatgagggtctattcttttgttgttgttgttttggtttt

SEQ ID NO: 11257 - DNA, 191 bp, Homo sapiens
gggccggggatggcgctgagcctgggcctgggtctgggtctgagcctaggcatgagtgaggccaccagtgaggcagaggaggagaggccacggccgagcggtgggacgcctggccacgacgctgtggctgcgctccgcggctgggaggcggtgctggcggcggcgcagcggttgctggtgtgggagaagcc

SEQ ID NO: 11258 - DNA, 686 bp, Homo sapiens
gggtttttttttttttttttttgagacggagtcttgttctgttgcccaggctggagtgcaatggtgcagtcttggttcactgcaacctctgcctcccaggttcaaacaattctcctgcctcagccgtccaagtagctgggattacaggtgcatgccacgatgcctggctattttttgtatttttagtagaggtggggtttcaccatgttggccaggctggtctcgaactcctgacctcaggtgattcacccacctcggcctcccaaagtgctgggattacaggtgtgagccacggcgcccagcctcatgagggtctattctttacattcaccatggtctgatggttgctacatgtttgtctatgattttttttttctattatcaggtgtcttggccggttcatgccccacgatgaaagggccagaggttttcatatgagtaaaagaaaaaagcagaaatgtgaaacctacaattaggctaaacaaaaatcaactggaaaagtacaggctgaggggagaagagttggctacatgtttatgttaggggaggagggagtacattttagctatgtattcaaacagctaatagtttaatgttgctgcttataaacttaattttaggctgcattaataaaagtgtagtctccaaaacaagaaatgtgataattctagtgtcctgtgcacgaa

SEQ ID NO: 11259 - DNA, 26166 bp, Homo sapiens
gccacgtctgcaagtcagcgtttattgctcaagcgtattaaacaaaaatgtagactgaaagagacagttcttttaaaccccatttttccggattttttaagcgctctaaaataagaaaataagaaagtgcaagccagcaaaaacgctccaagtgcctaattctgactctgaaacttgagctctctggtctgcccccaagaagacatcagcccgccccgggtcgtccctgtggctcccaccccattcccaggagcagaccccgccagcctcaaagctgcagggaggtgggggtggcctgcagacagggtggggtctgcatccggtaccagtgacagcagcctctcctctcccacggtggcgcttgtttggggctgtggccaaagtgtttgcccggcccctgactgtgtccttccggagctgccgaggactgcagagagggcctggcttgtcccctctaggagcagctgggaaggtgtcttgcctgcatcccccttcaatggttgaaaataatgattccacttgtcatgaacaccatgaaggtatcttggcagccagagtcactcctgttccgcagtgggaaacctgggagggtcctcaaaccccctggcagggtctgcaggccgccccatccagctgcatctcccaggcctcctggttctttgatcttgatggccccaggccacagatgcatctccgggcctttccagcagcccatgggggaccagtcaatacaccccacggcggtgaagagaaaacgttcatgtcttctcagatcagaaggaaagaaacaaaaccattgtgaaggaaaacacctgctggaaagtaattatcaaagtaacagcattccagtttcacagtcgccccaactcactgtggatttactgccgtcagctgggaggacccaggcgccctcgggacgaggagacgcagggaaacccactcctggccatggcactacccaaagccagtgttattctcacacccaactgtccctgcagcctggcaggtgggcagtgaccgcctgggctgtaccctaagaccccaaaacagcggagatggagaagaccgctgccctggggccttctcagtgaggatcaagacaaagtacttgctaggaggtagagggcgctgggtgaacctgtgagaattcctgggctctgacctgatctgtcctgcattttgagtaatgggagcaaacacaggagggaggggctcagcttcccccggtcactggggccagggagacgtggtccagccggtttacaaagccttggatgcagccccacccccaagaacactgcctgtcacagcagcggccacgtggcactccaagctgggcatgacagtgcccgggacgtgggcagcggccatgtggcactccaagctgggcatgacagtgcccgggacgtgggcagcggccacgtggcactccaagctgggcatgacagcacccaggacgtgggccggccagtgtggcggtggatccctctagaatgactgggtctaagtagggagacagggcaggcgacccggcgtggactggtgtggatttcacctgggagagcagcggcagcctgtgtcgcttgcgcccaggctctggaggaggggcccctgcggctcccgggccaggacagaggcgcccagccctgctctcactgtccaggaagagccgctgggcagcctgagcctggggcaggtgcaccttgcagggaagtgggtaagatcccactgggctgactgagtacccgggacagaccctaagcgtggagggaggaagcccggtcagagtgggcaggagacgcagggacccacagtctggtcaggtccagagagcccactccagcccaagccatgagagaggcaggaagaggagctggggccagttcaggggtggggctctcaagaggccgagccgggggcccttcctcggcctgggaagttgcggccatgctcctgctgttacgacacgggagccactcggagctgactgatctcactgaggcacagactagccaacattggcctattttaaaattaaactaccctaggaagtgaaaaccccacctgcagcctggtttgccctcacacaagggaaaagaggtgttagaagcagtagctcagggcgattaggggttgtgcgtttccatgcttggggccaggctgggcgctgccacccggtttccgcgtctgggggtcactgggccatttgcaccacgacggctctccaggctttctccttgtcgaactccttcagggggctcctggccacctgcaaccgagacaggaaaggtgttacttcaccagggccacctgtgcggcgggaaggtggacacgccactcggccacaggcagcgagcagccagcgttcagaagttttcttcgaatgtgaaggaagtggggaaactaacccctgggcctctgtggaaagagataaaagccttcacttcctcagtgtcccagaaacgcctgcatccccccccgcacacacggtttctaccgagcctgggatggagcagcccttcactcggccccttgccctggctctggggcggggagcggggggaggccgcccaaggttgggcatgtgcctgacggctgaggaagaaaacacttaaggcagaggtaaccagatgcctccaggcaaaagggaggacagcgccagccccagctgtccaccctgagccccagttgtccaccctgagccccagctgtccaccctgagccccagttgtccaccctgagccccagccacccaccctgagcccctgggccccagccgtccaccctaagccccagccatccaccctgagccccagccgtccaccctgagccccagccgcccaccctgagccccaaccgcccaccctgagcccaagccacccaccttgagccccagccgtccatcctgagccccagccgcccaccctgagccccagccgcccaccctgagcccctgggaccagcagttctgggatctggggagaacacctcatgcgtctgactctgggccttgctggtcacaacagaaacccaggcgggtctcatttcaggcccagggactgccgtcctagcagggagactgaccacagccaggaaaaatggcagcaaagcaactgaggaggcaggttaagggaacagcagtagggagggtggagggtgggggcgacggggtcagctgagaaacgagccaagggcaagagagcgtcctccgggacttagcgggcactggaggctctgcaccaaggttctgaggccggtggtgtgctgaacacaggagggcagggtgtgcagggcaagagcagcggccggtccgcccaggatggcctagaggtggggcaggactcagagccccgctgagtggctgcccaggtgtttgggcatcaaggtgacagtcctagtggtcactgcacctgagggtcagcgggcaggtttgcccaggggagcaccaccaggacccgtagctcggtggggggaagacgctgagcctctgcctttcagatgtgggggcagcaagacagtaggcagggcccgggggaacattgttcaggcagtgacagccagaagttgttgacaccccagctttacggagccccatgtgccaggctgggtgggcattgccttccctgcagaaccgcgtccccaccagagaccagggaaggaaacttcaggacctgtgggagtcctcacaaagccctcttctgtgtctctaagagcaaatctgaaagcattaagtccagaatatttcccagggatgggtctgggtttacccaggctttgtgtttgtatttttaaaagacattttacggctgggcgcggtggctcacgcctgtaattccagcactttgggaggccaaggcaggcggatcatgaggtcaggagttcgagaccagtctaaccaacatagtgaaaccccatctctactaaaaatagaaaaattagctgggcttggtggcgggtgcctgtagtcccagctactcgggaggctgaggcaggagaattgcttgaacccaggaggcggaggttgtggtgagccgtgatcgcgccactgcactccagtctgggtgacagactgagactccttctcaaaaaaaaaaaaaaaaaagaaaagaaagacattttacttcttcggggtttttctggggtgtttttaaaaatacaaagtggcacaatgaatcttcgagggccacgtcgtgtggccctcggaggccctcaccaggacaggagcccccaccgcaggcctctcacctccccagcgggtgctcctgtgggccactcacctccccagcacccctgaaacccacaggcctctcacctccctggctgagcacccctgtgggccactcacctccccagtgcccccaccccacaggcttctcacctccctggctgggccccccatgggccactcacctccccagcacctgcaccgcaggccactcacctccccggctgggcacccctgtgggctactcacctccccagcaccccctccccctgcaggccactcacctccccggctgggcacccctgtgggccactcacctccccagcttccccccaccccacaggcttctcacctccctggctgggcacccccgtgggccactcacctccccagtgccccctccccctgcaggccactcacctccccagccaggcgctcctgcgggccgttctgggtgtcccaggatgcaccctgcagccttgcactgaccttgaagcgcacgcactggatggcggtgcccgtgttgaggccggcctgcagcaggagcactagcagcagcagcagcagcagcacatcgtaggatggctgcaggcggaaggaggtgtgagcagagtggcccagccgccctccagcccaggagaccaaagctccctcgtgcccacggccttcacaaagagcaggtgccagggctcgagtcggagccccagtaacccaaacgcattgctatttcaacaacctgatgataatcattctagctcaattaatgaggtcaattctgctttaaattccatcagcttgtgttcaacatacaggaataaaagtgaccgagccactgccaggccccgtggacagtgctggctgctagtggtcaagtcgctccacccctcctgctccaacacgcgcaaggctcagtcccagagccagagagaatgtccgcgggaggcagaagcgctgaccgttccgtgtcagcaggatcctgagcggaggagacagggggcagccgtcctggggggatggggtgcacagacccccaacagcttcacccctgagcaccagctgctaggaaggaaggggcaggaggcagcgcggtgagctcggcagggaagaggatggagggagcggccgaggatgcagggggccagagagtgaccacggagcacccaaaaccctctgtgcccatggatagctttcccgtgttggctcaagaaaaacaaagcaactaaatgttaacacacaaaagagccaaacatctatccaatgtcactgctacaaaaagtaagagaagaaacagaacgaacagctcttctcaagttaacataaaacttttttttgcgacagtctccctctgtcacccaggctggcgtgcagtggcgcgatctcggctcgctgcaacctctacatcccaggttcaagcgattctcctgcctcaacctcgccagtagctgggattacaggtacccgccaccacgcccagctaattttcgtagttttagtagagacggggtttcaccatgttagccaggctggtctcctaacctcaggtgatctgcctgcttcggcctcccaaactgctgggattacaggcatgtgccactacgcccggcctggattttaagtaattattagaaagtctggtacttgtgttcccagctggagtttaccctggaggatggtaaaggcatgggccccatgtggtctttgctcttcggttgttgagacaccatttattgcaaagcctatgctttcctcagtctcaaaaaaaaaaaatccagagccattaaagaaaatattaatcaacttaactatttaaaaaaatagctttcacataacaaaaatcacaacaagcagaacaagaaatagccgccaggctgagaccaccatttgtatcctccatcacagatggagctggtctcccccggcaccagggttagcggaaaatggtcaggagacatgagcagagtccactgaaaaagcaatgcagacgtcctcatgctttgtaagaggtcctcgtcctcacccacattgagacggaggtgctcccacccgtgtcaccgaactccagcgtgacaccctctgtggggggctgtggagaagtgagcaccttcacgccattggcaggagggaaggtggacggcccccattgaggaggtcgccgagatttatcagcatgacagctgcacctaccctctacccagcagtctctctcctagctggatatcctaaagatgcgctgaggattcaaaaggaagatgcgtgcaggttgttcacggaggagttatttatagtagcagacggttggaaataactcagtttccatcactagggactggctgggttgaccgggcagtcaggagcgatgaaggaattcagaagagctctgatccccttgggtatcgagaaaacaccaggataaattattaagtttaaaaaaacaagcaaggggctgggcacggtggcagaagcctcctcatcccagcactttgggaggccaaggtgggcggatcgcttgagcccaggagctcatgaccagctcaggcgacagagtgagaccctgtctctgaaaaataaaataagtaaatacataattaaaaagcgaggtacatggctgggcacagtggctcacgtctgtaatcccagcacttcgggaggccaaggtgggcggatcgcttcagcccaggagctcatgaccagcccgggcaacagagtgagaccctgtctctgaaaaataaaataaataaatacataactaaaaagcgaggtatatggctgggcacggtggctcacgtctgtaatcctagcactttgggaggccgagacaggcagatcacttaaggtcaggagttcaagaccagcctggccaacatagtgaaaccctgtctctgctaaaagtacaaaaattagccgggtgtgttggcatatgcctgtaatcccagatgctccggaggctgaggcaggagaatcacttgaacccaggaggcagaggttgcagtgagccaagactgtgccactgcactccagcctgggagacagagtgagactctatcttaaaaaaaaaaaaatggcaaggtacagaatagtgattctagtatacaagctattttgtaagaaagaaaaaaaaattatcatctggttgcccataagaggagcaggtcagtcaggcatgagaccacagcttttctgagctcgtcttttatagtttggcttttgaaccacataaatattttatatattcaaaaaataccattttaaaaagaaaaaaagcaccaagccctaaaatggaatacaaccagaggccattaaacttaatggggtatcgaacccagaggataaccccacacagaaaggggccgacttcgatggcgtgtggccgtcccctgctagcagaatgcatgctgaagataaaagggaagcctcaggctcactcaggagatggcccctgggtggtaatattgtctcttgtaatcgtgaacaattatatgcatattgtaagacaacatgaagtaggagatatattaaatgtcacaggaaacaaaataattggagtaggagtgggtgaagcaaacacaagagaagtgaagaaaaaaccctgggccgggtgttgtagctcactcctgtaatcccagcacctgtgggaggccgaggacgctatcccccttcagacagtgactccatgcccccatcagacagtgactccatcccccatcagacagtgactccattaccccattagacagtgactccatcccccgtcagacagtgactccatcccccgtcagacagtgactccatcccccgtcaggcagtgactctatcccctgtcaggcagtgactccatcccccgtcaggcagtgactccatccccccatcaggcagtgactctatcccctgtcaggcagtgactccatccccctgtcaggcagtgactccatccccccatcaggcagtgactccatccccccgtcaggcagtgactccatcccccgtcaggcagtgactccatcccccatcagtgactccatcccccatcagacagtgactccatcccccatcagacagtgactccatcccccatcaggcagtgaccccatcctccatcagacagtgactccatccatccatcagacagtgactccatccatccatcagacagtgactccatcccccatcagacagtgactccatcccccatcagacagtgactccatcccccatcagacagtgactccatccccccatcaggcagtgactccattccccatcagcacacgcatgttgacctggagcaaacagcttaatacaggtcttctaatgatttgggtgcaaaaccacttatactggaaaaaaaaaaacaaaaaaacaaaaaaacactaggtatctaagaaatacatctagctacacgtgcctgagcctcagaagtcgtgttggagataagctcctactgggtcagctcaaagtaacaggactttgaattctccttaaattcacctgttaaactcaatgcagttctgatgcaaatccgaaaagcatgtctcataaacccaggacagattctaaaatgggctcagggacagagtgggtcccaggtccctgtgaagcaggtggtggccccagatacagggcggaatcgaggccccgaggccctggggccaggctggcattggggagcacggtcaccgctgcccaggaacagcggaggaggtgcctcctggagctgtccctggagccagcgcccccagagtcccaggcaaagccagcaagggccaggccaacacgcagagcaccacatgtctggggggctctgaaataaaatacaactcacttttatggctggcgggtaatccttaaacatctccacgattctcatgatgctgaatgacagatatccagaggctgtgaacagcagcggagacgtgaggctgcttatggcaatcaggacctccacctggaaaaaaagcgcgggttgcaggaccacggccggagcctgggagcccaggacagcgggcgtggccagggctgggggggcgggcatggccgggcactcatgggcatagtcccaagctggttccctgcatgactcctgctgaaacctctgccttttcttttttctttttctttttttttttttttttttttgagacaagtctcgctgtgtcgccaggctggaatgcagtggcatgatcttggctcactgtaacctccgcctcccgggttcaagtgattctcctgcctcagcctcccgagtagctgggattacaggcgcccgccaccacacccagctaatttttgtatttttagtagagaccgtgttttgccacgttggtcaggctggtcttgaactcctgacctcaggtgatccacccacctcggcctcccaaagtgctgtgattacaggcatgagccaccgcgcccggcctgcctttctttcttttttgagaggcagcctagctgtgtagcccaggcaggagtgcggtggcacaatctctgatcactgcaacctctgcctcctgggttcaagcaattctcccgcctcggcctcttgagtagctgggattacagacatgcgccaccacacctggctaattgttttgtatttttagtagagacagggtttcaccatattgtcaggctggtcttcaactcctgaccttgtgatccacccaccttggcctcccaaagtgctgagattacaggcatgagcagcctgccttttcattcacagcacagtgccacaagttttgaaatacttaccatctaggcaaggtggctcacatctgtaatccaagcactttgggaggccgaggagggcggatcacctgaggtcacgagttcgagaccagcctggccaacatggtgaaacccccatctctactaaagatacaaaaactaagcgggtgtggtggcgcatgcctgtagtcccagctacttgggaggctgaggcaggagaatcgcttgaacccgggaggcagaggttacaatgagctgagatcgtaccactgcactccagcctgggtgacagagcaagactctgtctcaaacaaacaaaaccaagaaacaaaaaacatttacctgcaattctccactcttgaaaaaatagcccttccgcatgggtcacctccttcactgctctgaagtctgtccttttaacccaccccaaatcttcctgtttgacccatcaagtctcagagacagccttcactcatgccaagcatgggcagtcaccttgcaaagcactcagggtccacattttggcagcagtcattaacgatcgaccagttcaattgtttgcggtcagtttgtggcagtttcggccgggcgtggtggctcacaccggtaatcccagcactttgggaggttgaggtgagtggatcacctgaggtcaggagttcgagaccagcctggccaacatggtgaaaccccgtctctactaaaaatacaaaaattagccgggcatggtggcaggcgcctataatcccagctactcaggaggctgaggcaagagaatcacttgaacccgggaggcggaggttgcagtgagccaagatcgtgccattgcactccagcctgggggacaagagcgagactgcatctcaaaaaagaaaaaaaaacaatcgaccagccttaggaggtgcagatgatgctcagacactggtctccttccaagggttaggcacagagagcgcttccagtgtctacaccaccttgttcaggtctgcctgtccctgagaacagtccctgctgagcgggccagcctccacctcccacaaccccaccttcctcattgtgcaggccctgcagcccagtcactgcgctctcttgggctggagcctggtcacatggcaccaagggagggctaggccaggccctggccccgctcggtgggtccctggcacccagggctgaggggttcacccaccagacacttgctgggacactctgctgccacatgactggcaatggcacttggaaagcactaagagaaaagaaaaaggaaagattttagaggaaatagtcgaagaagtcgaattccaaacatgtgccctcccaccagtgacccctccatgcaggctgcctggctggcttgctgtggggggcaggggggatggtgcagtgcccaaaggcgcagctggggcagggacgggtccgcagggaagcaggggtagcctctcagaggttttgtgtgctctctgttcctcaaccattggtttaaaattttaagcctgtagaaaagctgcaagagcagtggagggggcatctgaggccccaaaatcaccagagtccttgacattcatatctgtgctctctccagctctcccagatagcctgatgcctgaacacctgagagtgctggctgagcccagggcacactcttgcacacacccaaagcaggaccacgctcgagagactccacgtggggccgatgtggtccatgcccagattcttccagttgtcctcatcatgttctttctttttaattttttaataatttttctttcttcttctcctttttttttttaagatggagtcttgctctgtcacccaggctggagtacggtggcgcgatcttgactcactgcaacctccacctcccaggttcaagcctcctgagtagctgggattataggcacccaccactacaccaggctaatgtttgtatttttagtagagacggggtttcgccttgttggccaggctggtctcgaactcctgacctcaggtgatccgcccgcctcggcctcccaaagtgctgggattacaggcatgagccaccgcacctggccctggtcatgttatttctagagctgtttgtttgtttgctcctgatccggattcggtctgccattgagctcgtagtctccttgtgggtccctgttaatcggggagtccctcagcctctgtcacctccgttacctggtcgcttctggggggtgcagcccatcagctgcagtcgggcctccgtgtgggacaggatttcctcatgatgagccttggggagcctcggaggagactctgcagtgccccagggtgtggactgccccttcctgatgacgctgacttgactcactgggttagggggatctgtaggttcctctgttggatgggcacctcttcctttttataaccaagaaatgcccttttcccacttattgtgaggagcctgccttagttccgcacaatgtaggcagagggaggatgcatgctcttcatcctcttcatctccccgaaggtgtccaggtgccagcaccccagcccggcctgctggggagggggctgcatcagccaggggctgtggtgagagggtgggcaggacagagatgggctccgagcaggggagcctgggcagcagggagaagactggggagctgaggggctgccagtgcaaaggccccaagccagctgctgaggtgggtgtggccctggccagggaggctgaggtgtcaatacaggggtctctcctgggcttggtgcttctgaaagggccttctagctgtaagcagcagtgagggcacaggaagggatggtggcttcagggtggcctattcagggccccagtgagccatgggagggcgggagtttccccgttcacccagcatggccactccggcccctgccctagagggccaggaagctcagccataggggctggggcagctcaatcaagggccctgccctggaagggtccaggcctgcagcccagcccccaactccagccccgagcacctgcctccagcccatggtgcagggcctgggcccctctgccgcacccaggccagactcaggcaggtggagctgggtccctcaccacgcatgcctcagcgctctcctctcctcctggggtctcctgccctgaagagagggttgggagtgtgggtggatttaggggcgcccagggggcagcacctgatgggcagggggtgctctccgggaagatggagagagcagagccacccccgaggcaggaggggtctgcgggatgggaggggcctctgtgatgagggctgactgcagggacagggaagggggtagggcaagtgcctttcattctcaactttttggaggtatgtggtctctgtcctccctcagcttcgggatgtaatccctgcgtttcagaccccagggtcagttgtacacacctgcaggcgtcattctctctgtcacagacccgcttgggtgggcacccatgtgagttctctgtctcagtagctgggcctggtcctaccccttccgggggtgtggctctatcccagctcggtcctgcctgggtctctttccctctctgagcgcctcagcagcccactaggtcgggcactggtgccctgggggcattgctctgtgcctactcgcccccacagggagctgaaacacagctgctgccaatgggatgtgtccacctggcaggcgtgggccccttctcggcagtccacccggccacaccgttcccgggcaggcgtgggccccttctccgcagtccacccggccataccattcccgggcaggcgtgggccccttctcggcagtccacctggccatactgctcccaggcaggcatgggcctcggcagcttcaggaagagccccactgctgcccaggaggagcctgtagctgatgctgggtgctcaccattcctgctcatgtacataagagagcaggggcaaaatctaaaagtccacacagcatgagacaaaccaggggctggccgtcaacaccggtgtgcaggccactacgcggcaaggtgctgagaacctcgtggggtctgcgtccggaggcaggtgggtggtggctctgggtgggctacaggctgtgaggggatctggggtgtggaggggttgctctagactcactgttctgagggaacacacctgtaatcccagcacttttgggggccgaggcaggcagatcacttgaggtcaggagttcaagaccagcctggccaacatggcaaaacccggtctctactaaaaatacaaaaaaattagctgggcatggtggtccacgcctgtaatcccagctacttgggaggctgaggtgggcaaattacttgaacccggggaggggcagaggttgtagtgaggtgatattgagccactgcactccagcctgggtggcagagtgagactccatctcaaaaaaataaataaataaaataaataaaacaatgcccatgtattgagcatgtggcatgtgtcaggtgctgtgtgacacatctgctgcagtaacatttaatgtaaagtaataacagaaatatgctgcattgtatgaaacacatagtgtaatataaatgcattatatattagaaaattatatagaataataaacatctacagcctgacattcatatgttaaaaagattagaataataaaaataattggtatttttttcaggaaaaataatataaaataatcacacaaactaatataaaagcagttaatactttgactcatttaatccttaactccccagttcttctgaagttgggggccagcgaggaccctctgtggtgactctctgtctgaatgcaccaagactgagctcggggcccagccacgcaggatctgagcagtgtggcccagagcggcggcgggcgggccagaggggttactcacggccactaggatccaaaagaacgtcactgagaggtgtgggcctgaaactgagtcatccacgttcagggcaatgatccccccgaggacggcagagatgcctgcgattacctcgacgacctggaggggacaggacagcatcggctcataaggaagtggagacacccccagattcccagaatgcactgtgcagacatggacccccaggagcagggtccagtgggctggccccagatctaaccgtggaggagcccacctggatggacccccagcctcacctggcccagaccccctctgccctcagctgcggcttttcacgtccctcctggagtaaaatagccaaagaggtgtttcccccactgctgcttttgtccacagaaactgagggtattgacctgacagtggtgagggcagaaaaccaagaccctcagactcccttccctgtctcacagtgtggcaggcggcggtgctcagaccctggaccccatcgaagggactcgggaaaacaggcctggggcagaagtagcttcccataggacacacccacccgtgccatgtgggtttgccattgccacggcaacactggacgtcaccacccctttccgtggcaatgatccaaccacctggacgttagcaccccttttctagaaatttctgcataatctgccccttaattagcatatacttaaaagtgggtataaataggaggcagagctgtctctgagctgctgctcgaggcacctgccggttggagagccctgctatactgccactgcaaacaaagctgctgtctgtcacctccagctcgcccttgaattctttcctggacaaagccaagaaccctgctggcctaagccctggttgtggactcatctgcccggcaccatcagggccgcaaccagcaccgccagactcagggaggggccgcaaccagcaccgccagactcagggaggggccgcaaccagcaccgccagactcagggaggggccgcaaccagcaccgccagactcagggagggctggggaagaaacacacgcccgaaaacctgctcccgtgaaggatctctgtgagtcgcaaacacagagctgtggccagcaggaaagccaggcataaggagtgggccagcaagggcttgggggccggaagggacctgggcagccaggccttgcgtccagaaggcacaaaactccagatgcacaaataaagctgaattcccagccaggcacggcggctcatgcctgtaatcctagcactttgggaggccgaggcagacggatcgtgaggtcaggagtttgagtacagcctggccaacatggtaaaccccgtctctactaaaaataacaaaaattagctgggcgtggtggcgggcacctgtaatcccagctactcgggaggctgaggcgggagaatcgcttcaactcaggaggcagaggttgcagtgaaccaagatcacaccactgcactctagcctgggcaacagcaggactccatctcaaaaaaaaaggaaaaaaaaaaaagaagcagaacggaaatggaacctaagagaggactgaaatgctaaataaggggaagtgaaggcactgggaaacacacacagacacagtcaagcacacaggaggctgtcccattgttggagtaaaaaggcaaaatgtcactaaatgtcacaagctagacaacaaggccaaggcggagggaagggggacagaccccgcatggtctgtttatcaaggagcgtattagaatatgaagggcaacccccaaaagaatactgaaaaatttcccatccaaaattagagggaaaaggaaggacggagcctctgccaattcaaaagaaggcagggaaggagggaaaaaggcaaaatcagggaaaatggaaaactcaaaagatggtaaaaataagtagaaatttatcagtaataactctcagaggaaatgggctacattcaaaaagctagggagagagaatgacaagataaagaacaaaatacagttacgtgctgcttataacaattataccaaagtacaaggcaagaaaagttgaaagtaagaaggagaaagaggccaggtgcggtggctcacacctgtaatcccagcactttggaaggcctgggtgggtggatcacttgaggtcaggagttcgagaccagcctggccaacatgccgaaaccctgcctctactaaaaataaaataattagccgggcgtggtggcatgtgcctgtagtcccagctcctcaggaggctgaggcaggagaattacttgaacctgggaggcagaggtggcggtgagctgagatagcaccactgcaccccagcctggctgatggagtgagactccgtctcaaaaaaaaaaaaaaaattcctcggggacaacagtgtcaactcacctacggcagtaacaaactccccctaaaaattacaggacaccagcagcacctttcgcgataaggaaggttattaccaatgataccaataacagactagagtctccacagatgaggcgcacgccgccatgcggtgtagacagccaactcttcgccaactcggaatcgaaacgtgacgtttaatccagcctcagtcacccccgacagagtatgagagaaaagagaaagaagggaagttttcttactgagtaagatttcaggacccgagcaggaaatggcacttcgtccagaatgttggcgctgtcagacatggagccctacgaagaaacagaactgtcaccccgggtgcacgggcacagggactcagcactgccgctggcatccggccgccgtgggcagtgggtcaggtcagcctgccgtgtagatgcgagaccgccttggaggcgcccgtggatctttgggcttgaggaaatgttcacacacattgtccttgcatatgaaaattagcagatgtggtgtctcctggtgatcccctggggacgagcactggactgagtcaggcttagggggaggggagggtacagcatctgtcttcacctccctgtagccagcggccgccaacccctcacccagctccagagcccctcctggccggggtttctgagacccaggagagaggggtctcatgggaatgccctggagcagcccagatcggccctccgagggtgacgctgagacccacctcgctcaccctggggtgatgcctctgcaccccctgccctgcggggtcagaagctgcacccaccttctttttcttgcagtcctcctcgctggaccgtgcagcgatgatcaccgtggccgccatgagcagctccagcaggagcagcaggatgaggttgaagttgatctgccaaggggcacacacgcttcagcaccgggcccgcctttctcacgccaccgcgcttcagcgtccaccggaccacctcacgggcaggctgcgcaggactctcagccacggtccccacttttcccatccagggccagctgtgaggcactgtgggctgcacactctcctgcctcacatgggcctttggggtcttttagtttttaaaaccattcttagtgcaaaggctgtacaaacacaggccagggctggatttggccttgggctctggtctaccgaccccattctgaacgctccttgttcccacaaaagccttcacggaatgtttagagtagcttcatgcatgattgtcaagcactgagaacataaggttttttggagggtaatgaaacgactgcaggccctgaccgtattggcagtgacatgaatttatatgtgtgttaatattcatagaagcatacattttaaaaagtcagtgtagctgtctgacaattttttttttttttttgagacggaggttcgctcttgttgcccaggctggagagcaaatggcgcaatctcggctcaccgcaacctctgcctcctgggttcaaatgattgtcctgcctcagcctcccgagtaagctggggttacaggcacctaccagcacgcccggctaattttgtatttttagtagagaggggtttctccatgttggtcaggctggtctcgaactcctgacctcaggtgttccgcccacctcggcctcccaaagtgctgagattacaggcgtgagccaccgcgcccggcctgacaatttttaaaatacatttaaaaaagaaagagtgcagaaccacattcaactaaaaacagagcctcgaaatatatgatgtcataacagagccacaggaagatgtagatatatcagtagaggtggggaaggacttgaaacacttttcttagaaactgacagatcaggcagagggaggcggctcacgcctgtgatcccagcactttgggggaccgaggcggttggatcacctgaggtcaggagttccagaccagcctgaccaacatggtgaaaccccttgtctactaaaaatacaaaaatcagctgggtacggtggcgcacgcctgtaatcccagctactcgggaggctgagacaggagaattgcttgaacccgagaggcggaggttgccgtgagccgagatggagccactgcactccagtctgggcgacagagcgagactgtctcaaaaaaaaaaaaaaatgacagatcaaaaagacaaaagcataaggagaactctaaaattcagaaaagtgtgacattaaccttgtcttttattttctgtatttctggtgctttgacctctggctccttcctgatcctgaagagacagctcctcccagggccagccgacagctacagtgagtaacttgcctctgagcagttcagatacaagccactgacccagggaccacaccccatctgctctccgtcttaataaagaagcgtcacaggccgggcgcggtggctcatacctgtaatcccagcactatgggaggccgaggtggatggatcacctgaggtcaggagtacaaggccagcctggccaacatggtgaaaccttgtctgtactaaaaatacaaaaattagccgagtgtggtggcacacgcctgtaatcccagctactccagaggctgaggcaggagaattgcttgaacccgggaggtagaggttgcagtgagccgagatggcgccactacactccagcctgggcgacagagcgagattccttctcaaaaacaaaacaaaacaaaacaaaaaggcagtgtgggtgttcccactgggtcctcctgtgtctgctcatttttcctgcccaacgagagtggccaggacatactcaagcctcctccagctttccccaatcatcaagtgcattccacatgtcacacaaagcaggaggccctccttgcagtatctcggatgaggtcctggtttcctttgggatttttgtctttttttttttttttttttttttgagacggagtcttgctctgtcttccaggctggagtgcagtggcgccatctcggctcccacaacctctgccccctacaatttcacatttttgtttagaggtgcattgaacaactgtcttacacagattggatgaaacatagtattatgtcactgttaatttttaaggactgttggaaaagacattgtttaccaataaatctgtcccgcagaatcacgagacttcaataaagacaattattttctttggatgcataaatctctcaactttagtcaaactcacgagctgtgaataacatttaccacctatttccagctcaacaaacatttgctgacaccattcgtgggagtggggctgtgggtgtcaggcgtctgcgcgaagctcgtgtgaactcacgtttattgctgatgggttcaggactagtttgcatccaaaccaaattaaacacgtagtggtcacagcaaacgtggaaacaaacaatatctgaaagttgggaatctgaaaaacaaggcaggaggggttttccttctttgaataataaaagaaaaaaggtaacagataaaccacacttcaggccattcactaaaaattatcctgattaggacataatggtggggagtcctgcgtgctcagcccgctctcccctctgtgcggcaaaggctgggctgggcaggagctttactgtctggggggcaacctcgggggcccctctcggtgccacaacgtctgtgcgtgggcacacacacaagcacacatgggcacactgtctgtcagcccctccggctttctccctggcagaggctgcctgcaagctagactcaccacattggcgttcctcctggagacggtgaagctcacaattgccgaggggatgcactggaatgaaaccggaatcccatgagcctgccgctcacctgagcaactgagactctgaaatactctaacatttgcgcttccagaaggatctgaatcatattcacaaaacagtgttgccagtccatgcaacacagtgggttggcttgactagaaggcccccaggtacttctcagttttaattttttcttgagatggggtctcactctgttgcccaagctgatcttaactttgggctcaaatgatctgttcacctcagcttcccaaagccctgcgattacaggcatgagccgctgcgcccaacccccaggtacttcaaaataatttattctgaaagaagtttttatttttctgatgtgctaaaaagatatttgttaatgaaggctcttctagctggataagctttgaagcctagaatgtaactcacgcaggcacaagacctggtctttgctgaaaattacccaaaaaaggaaaaagtatcagccgggtgcagtggctcacacctctagtcccaactactccggaggctgagctgggaggatctcttgagcccaggagttcgaggctgcagtgagctgtgaatactcggtgatagagtgagaccttgtctcaaaaaaagaaagaaagaaagaaagaaagaaagaaagaaagaaagaaagaaagaggaggtctggtgcagtggctcacacctgtaatcccagtactttgggaggctgaggcgggtggatcagagtcaggagtttgagaccagcctggccaacatagtgaaaccccatctctactaaaaatacaaaaaaaattagctgggcgtggtggcgggtgcctgtagtcccagctactcaggaggctgaggcaggagaattgcttgaacccaggaggtggaggttgcagtgagcagagacggcgccattgcactccagcctgtgtgacagagcaagactccgtcaaagaaagaaagaaagaaaaaaagaaagaaagaaagaggaaggaaggagcaaaggaagtagcaagactctgcatgtgagggaggcagaaaggagtcccacagccttcttgtcctcagccttcttgtccccacagggccacaccaaggctaggagtccagggccagggagggaggttgggacgtcagggacagggaggtggatggagtcgggccagcccaggcctgtggcccttgccgtgcagggccttgctcctgcagccatgggaccccgggccctgagtcgggggtgcaggccctgaggggctgagcacagcagtgctgggtgaggaggcagaagaagccccgtcggggcctgagcgaggggcagagctagggccaggacagccaggctcagctcagcacccactcaggtgccacgagggcccagggtagagaagaaaggccgggggcagggccgagtggggccaaggctgggcgggggtgggcacttgcccatatccggcagccgctgaggctgaaggggcacagctcacagctccactgggacaagggcggctcccatggtgaggataaaggccacggagaagcttccagagagggcagcagagtgggacgggtcacctgccccaaagggctttgttctaagggagcagagacccaggacagcacggggcggggcatccactttgtttttaagacatttcgggggcgctgctggggacagtcaccaacagtgtccctagagaaagggcaggggccagagacccagcaggcatgtggaagcgagaggaggggagagctcgggaccagctgaagcaggaggggcgtggggtccgcggcttgcgggccagaggggcatggggtccgcggcttgcgggccagaggggcatggggtgcgcggcttgcgggccagaggggcatggggtccatggcttgcgggccagagcccaggggtcagccagcatggtgctctagctgccgggacgctggggaggcagtggccggggttcacagaggaccaggggacagcggttgtctgtcctcccttgctctgaggatcagtgggtgcctccaccggccttggcactgtgtaagtttctaaaaacacaacatgaagctttgggaggatgtggggcacaggtcccagtcccctgagggcagatgctgccagctctggcaggacgcagccgcaggctcagaatcaacacgcaattccctgcacaggcgtctgcagagcaaggttcaggcctgcttcatcagtaattctcaaaggtgatgaactctacgtgaaactaaagtcatatgaagagttttttgtttttttcttgttgttgttgttttgagacgaagtttcactctcattgcccaggctggagtgcagtggcacaatctgggctcactgcaacctccgcctcccaggttcaagcgattctcctgcctcagcctcctgagtagctgggagtacaggcacccaccaccgcgcccagctaatttttgtatttttagtagagatggggtttgtccatgttggtcagactggtctcaaacacctgacctcaggtgatccacccacctccacccctcaaagtgctggcatgacagccatgagccactgtgcccggcccatatgaagaggtttgaatgaggtacaggtgacagaaacctgcacatctcagaacaaagaaaccagagcacgtgccggcgagcttgggcactggcagaggcgtggaggaagctgcttacagagcctgcagcacagcgcaagtaatccatctcagccgggaacacgttccccaggtacagcgaaaaccccgaggtcaccaggaggcagctctgcaagacagcgacagaatcccaggttacaacgcgccccgtccccaggctggaccctgacccttcaacttctgcttcactgtctgtgtattggtgactcacccacgtcccccagcatcaaccacacccgcacctgggacccgcccatcctggactcctcctgtaggacagacgcagccccgccgcagcccaggacatggaccagcctcccccagccatgtcggagcatggaccccccacgctgttatctggaggagagaagaaaggggatctgccaatatttagagcaaggaatggcacctctccccacaaaatactcctgccccaacatgttgtgcgtgcagtcttccagatcccacacccaggtccagacacgagactggaaaacaactgcccatccccctccgtctgcagaacctaatttccagatctggaagaagatccctccaggcaggggctccaggcccaggggctcctgagcagggaagaccctagcaggaggcagggagggtgctctctctcacgcacagcactgcaggggtgcggtggggagggggctctctctcacgcacagcacccccggggtgagtctgaggggagtcagtatcaaaggtcactgggacccagggtcctggcagaggaagcgaggtctggggcagaggggatctggcctgggcgggggaggggctgcgaccaagtccagggcaccaggtggaggagggcagagcccggagatggccaccaccacccgggagccgcctctgtccccagctccgaggcagacgcctgtcttggtggggcatgctcaggccacgggaggtgggcaggaccactgtgggtgctgcaggggctgccggcggaggccagggcacagggaggggagaaatcacagcctggatctcattctcagcccaagctacacggaaccgggggtccctgcatagaggcctgtcctgcagcatggctctgagcagctgcacacactcaggcccaagtggctcctccaatcatctctgtgcccacgactgtgcagggaatggccaggaccccagggaaatccctcggacatctggcgctgcccgtccaccccagacctgttcctttgttccccagctccctcccagccggcccctgaggccctccctaggaggaggaggtccctgaggttctctctgtgagggccgacctgaaggcctgagacgcctcctcccacctttgcaggtgacccctcagaggaccctgggcccccagagccgagggtcatggagactcctggggcccattcatggccctgggactgtccctaccctggtgggactaagccacaacctggagcagctcaaggctggcacaacagacacccataaattaataaaaataattgtgaaaacacaagcaaaacaagctcgtcggcatccaagagttctgcagcagcagggttagtctgagagttgctctctctgtcccacctggggctccagggcgctgcagtccgtcaccagagggaccagatgctcgtggccctccaagggcttagtgtggagctactcacccccatcagcacagagaagacccacgtcttgtggctgaagcaggggggcagtctcttcgacagctgcaggtcgctcggcttcgcgtctggggcatagctggcggggtcttgccggccccgctccagcgtgggcatccggtcataggccagctcctctctgaatggctcctgggtcatggcacttggggacaccacagctgtgctgaatgtacagccacgtgtcaccagttctttatctggaataaaattatcatcggctttggccactctgaggaaacttcaataagttgtttccaagaaatattttttaacaaaagaaatattgttcatactgaagtgctctaaatttgaagaagaaaatgagcacttgaatctaaaagtgaaaaagaaataactttcctagaaaaacggacctgaatagtctgggttcagggtgagattctacactttaaatgcctcattgatccatctgggccctccaggtgcaacacctgacaacatccatcggcaacttcgtccatgaacacatcacgccggggactcaagcacgttaaactgctccaattggtagctaaacgagagattgcaaaacatgcctctactcaacggcttaatgtctgagcacttacctcccccgctgctctgccgttgggagcactggtctctgggtgagggacttccagcaagaagtattcacaaatgaaacaaaagctcagcaaacttgagctgaaggcaggggaaggagagctgcttcctgaatatcaatgaggggaggaatcgggtggatcgtagaaatgtttcgtgttggttgtgtaaaccactgcctcgg

SEQ ID NO: 11260 - DNA, 3878 bp, Homo sapiens
gggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatggtatggggaagaggacttcagagaggcagagggggtggcctgggcaggggaggagaggtctgagaccctcaagaaagattctcccggggaacagataagggcacaggcataggggctccatctgtgctggtggctatgggatcagaatgggaggcgatatggtagcaggacaatgagaggttagatggcagagggacttccagaagcagtaggtgtcactgtggtgtgtagggttgggttgctgtgggtgtgacaatctgaaagggcctccaacaccttgctcttcccttaggtccacatccaaaatgcagcgctggctggaggggttgtggtggggacctcaagtgaaatgatgctgacaccctttggggctctggcagctggcttcttggctgggactgtctccacgctggggtacaagttcttcacggtatagatgcctcttggagcctgggcagaacatggagtctttggtacctttcctcccgcctctccaacaggatgaggtggtggggagtgggcacaggagactcatgatctgtcttgccctccagcccatccttgaatcaaaattcaaagtccaagacacatgtggagtccacaacctccatgggatgccgggggtcctgggggccctcctgggggtccttgtggctggacttgccacccatgaagcttacggagatgggtgagtttcctcccaacccgtactgcagtcgtcatccatctggaatgacctctgtcattctctttcactgtgtgtgaccaagaaaaaagaatgaattcattcattcatccatattctgggagcaaaggaaattggagttaacaaaaccaacccagaaactgccttcctggtcctctatcaagtgcagcagaaggtcatggaacaaatgacttcaagtagtgttacttgttactgaagggtcagtaagagataatgacctttaggatctatttttgcacatcaagggtgggcaaaagcaacccgcaaatggagtcttaaaaggtgcctaggtgtctgctggcctacaagggtgggaaggtgttccaggctgtgggcctggcttgagcagtggcctggaggtgagactcagcctggcatgcaccctcgagaccctcttggccacttcctgttccccagtgtgagttccagtgccatgagcagccctggccccgggctgcatccctctctctccctacccctgcctttcctctatctggtctccctgcagcctggagagtgtgtttccactcatagccgagggccagcgcagtgccacgtcacaggccatgcaccagctcttcgggctgtttgtcacactgatgtttgcctctgtgggcgggggccttggaggtgagtaaccttggattttctagaggaaggggcatgggatcctataagcctgacatgaattcattcactcatagatatttatggagcatctactttgtgccataaagtagggattgggttgtgggttaaggggtaaccaacctcctgcaggcacagaggtgcatgcaggtgcttgctcctttctggtgccgagggcagctggggagtccgcgaggggtgagcgaggccctctcttatgggtctatgcttgcctgtgctgctccctctgcccactagagggaagcccaacctcaggctgaggcctagaaggggatggctgcgccatgtggggcagggacaaggaggggaggagatggcctgccacttccagaccccagtgcgaaaaccttccacagaggcacactgtccatggccctgggtcaggcagtcgctcttcatgtttggccttagtctttttggccttcaaaataaaacctgattcagcatcccctctgtctcccgggttcaagccattctcctgcctcagcctccgagtagctgggactacaggtgcctgccaccatacctggctaatttttgtatttttagtagagacggggtttcgccatgttggccaggctggtctcagactcctgaccttaggtgatccgcccgcctcggcctcccaaagtgctgggattacaggcgtgagccaccgtgcctggcctagaatctacactcttttaaaaagagattcccaggtgatttgattgcatgttaacgtctgcaaagcactaggttagatgtgaatacaggcacccgccaccatgctgggcttattattattattttgtatttttagtagagatggggattcactgtgttagccaggatggtctcaatctcctgacctcgtgatccgcccgcctcggcctcccaaagtgctgggattacaggcgtgagccactgcgcccggcctattttttttttttttttttttttgagacggagtttcgctcttgtagcccaggctggagtgcaatggcatgatctcagctcacttcaacctccacctcccgggttcaagcgattctcctgcctcagcctcccaagtatctgggattacaggcgacccccaccacacccggctaatttttgtatttttagtagagatggggtttcaccatgttggccaggctggtcttgaactcctgaccttaagtgacccatctgcctcagcctcccaaagtgctgggattataggcgtgagccactgcgcccggccacaataagcatttcctgtgcccctcctgtgtgggaggccatagaaagctcagcagctgtggttcatgatggaatcaggaactggtctattaccaactgcacacacttgagcaaattatttaacttctctgagtcttgtttctttgtttgtaatacaggaataatattggccttgcagggttgttgtgattactcaggaaagcaagactagtcaagcactttgcacagggcctggcacatagtagatgctcaacaaatactgctgtgttttgcctgcacaggcatcatattggtcttatgcctcctagacccctgtgccctgtggcactgggtggcaccctcctccatggtggggggcagagaagcctcacagatcctcccctaccaccaccagggctcctgctgaagctaccctttctggactccccccccagactcccagcactacgaggaccaagttcactggcaggtgagacattgctgggctctcacaccctctgagtctcccttccctgcctcgcctcctgtggcccaagttgccttcttccttccttgctgctccttctcctctggggtacacccctgaactgtggcttccaggctcctggagctaccctttcacctctacccactcctgccttccaggtgcctggcgagcatgaggataaagcccagagacctctgagggtggaggaggcagacactcaggcctaacccactgccagcccctgagaggacacgctccttttcgaagatgctgactggctgctactaggaagttctttttgagctcccattcctccagctgcaagaagggagccatgagccagaaggaggcccctttccacaggcagcgtctccacagggagaggggcaacaggaggctgggaaatggtggggagtggggccgtaactgggtacaatagggggaacctcaccagatgcccaacccgactgccctaccagcctgcacatgggtagaagaggccaaattgaggcacccaagtgatccactggccccacgtcacacagttacagtgaagcccaagccaggcctggttgagggtgataaacgccactgtctctaagg

SEQ ID NO: 11261 - DNA, 7029 bp, Homo sapiens
ccaccaccggccacctgagtgtccgtgagcgggccgaggcgctcatcaggtccagcctgggctcctccaccagctccaccctgagcttcctcttcggcaagaggagcttttccagcgcgctcgtcatttccggactctctgctgcggaggggggcaataccagtgacacccagtcatccagcagcgtcaacatcgtgatgggcccctcagccagggctgccagccaggccactcgggtaaggggctgggcagggctcaccaggacaggctgggatggtggcacgggctcctggcctgagcgtggcacctgccttgcgttcccacccttctgcctgcagaaccccatccccttctctatggggctcccagagtgacaaaggacagtgattagacacgaagtggcttagctgctcttgaaagcagacaagatacagagcagatatcctgtaaacgataatgcccaggcaggcactgaaaggagtcaccggatacagaggttctgcagaactgtggccatctgccctacaccggggcatgacggagaatgccctccacccattcacacagcaggactcttctcacatgattctggcctgagggagaggaaaggacacctgtcaatgctggagttagagcttcactgcttctcagccaatcgatttgactttaaagctgctgagatggcccactgcttttaggtatttaaatactagacaaggagagttctaaggacttcacccaaataagctgttacttgtccagaatcccaaaccagctgagatgaaatgaatacttgagcttcttcagtgagaaaaaagtaaataaatacccagcagtgctcctatgtgacctggtagacagggaaaatcgatggtgtcaaggcaaaaatgggtcaggtttggagagttcccccactccttttgagtgttcaggttttccttaccatggctcatgctttccatcaagcaccagagttgcagtggcttggcctctggttctgggtgaggttatttgcaggtggagacggggggctgcacctgaacatttctagtgtcaccctccctctccttcatgggaaacagctctccagggaagtaccttcctgccaggggaagccaaggctgggccggccgccctacaaggagccacaggattgcagccatgggtgccacctttcatggaaggggagatttatgggctttcctggaacccccaggctgtcctggccaagaggaaagaggtggttacttcaggagtttgaccttagttagataactaaaagaatacatttcccctcccttttctttatttcctcaataaaaatgtacaaagtatcacccttctccatgccccaatctgtgttaaagtcacaatctatgggtgtagttctgggattctgtcaaattctccttcctgctctccaaaatggacaattgtcgtagggaccacatgcccccagaatacaatggcctctgtgttctactggggtcaagcctgctagaactcagcattcatgacaggggctaagtgtgcatgaagtgacactgactacagctagaaagccaggcgcacaaatgccccttccccccagggccgctctttccagcgcagtcatccagaaaggcccacgtgcagagcccctgtgtctcagatgctgcttcagttgcccgtcctgtcctcagaggccactgtgctggccctctatcatttgacctgactttagaacctgacctcaaggatatggcagcgctagcctttagctcccacagcacggatgggggtgatgccagttagaagtgggtagtgaacgtttgctgagctgttcactgtttctctcttctctttggaagcacctctccgagccatgtgagccccctgatgccaccgagcaggggcagcttcatgaccgatgtctggctgaggctgtggcggacactctcggggttgtctgcaggagagcaagccaggaggacatgggcctggacgacacggcctcgcagcaaagtgtgtcagacgagcagtgacgggcgtgcggccgggcggggaggctggctcccccacacctcccacctgcattgctctccctcgtgctccccaaatcaccacaaccaaccaataccgcgatccatgagggactcctcctgtggaaaaggagagctgttccagaacacagaactgatctcaggtttttgaaaaaaaaaaaaaaaaaaaaaaaaaaatcaaacaacaacaacaaaaaaacctcacatgatggggaaacaaaaaaaagcaacaaagaagccacaccacacctccctggccaggcacagcgctgcccagagcggcacaccgcggacagcaccacacatgttccagaatctgaaatctcaaaagccattcactaacttaaaacaactcaacagagccatgaaacaaatgccctgatgaaaataagacaactgcatgttacatcatcggcactttatacattactgttaccatgaaaaagaaatgaacagcagcacgtctgataccatcagctgggcagatgcattaaggttaaatctaagtgtcaagaaaaccctatttctttataatatttatgcagctgttaagcgtaacatggtggcagcttcacaacaagaaccgtgatcatgcatgcagtcatgtctccagtattctgtgaaaagccaggatacgttaggatgtgagtttagaaactgagtccattcggtgcatggaaatccaccgcggagtcacacaatgctcctcactgtagtccaggcgattggtgggccgccagcaccctgcgggcttcacagggacgcgtgcttgttctccaagccccgcaacccttactgtgcacacaacatcgcacacacctttgtttttgaaattaaaatgtttatagttattgctgcgtccagtgttttgagttatactgaagcttctcatttctacaagtatatcttttatggtgagaacgacatttgggtaaattctgagacaacttttcccatcttcaagaccccaggaacctgtatccttgctggggtagaggtcccaaaatgcagtccatagagtatcactggcctggtgaaccatcccttttcaaaagacaatagttagaaggaaatactcaattttaaacagtcacacaaatttcttcaaagtatttaggatttggaaatttgaggagagggttgggggaagggtattgtagagaatctcttgccccttggaaagtaaatggtaatgcttttctaatttttttttttgtaaactaagaatcagcaattaataaaagcaagtgtactctataatcacagacagaaggttcttattttcaggtcagcactccctagaggtgcaaactttatttaatttaaatgcagttgtttgtctaatgggaagctgatagggccttgctgcagttctctaaggtggccaaattaaacttggctggcagctcctgtaatcctcttgggcaactttacagccaagccccaagggctaaatggcaggcctggagctgtgagtgtggcctccccacggagggtgactccttgagttcagtgaggaaaaccacggtgcctggcagtggtcagccaggagtatgactggccactccttaggcatccagaagtaggaaacacagaaagcattccacaaaacggggaatctccccaaagagctagaaacccaggctggaaggaaatggcagcgcaggcaagagagcaagagcaccctgggtgctcctccatcccgtttctctggggaggttcatgaggtgcttcttcaacagttattctgttcattgcttatcacagttcacgagttctcgtggcatcttttgtggggaggagggaggatgaaagtgacacagtgtatctacaacactaaggtcacattaatcagataggaatgcagtgacgctctgcaccgtctatgagagcgggcatctcgagtgtgcataccgaggcacagatgtgcacacacatccgcaggcaactgcacccacagagaaaaggtggcagtattggagtcaccccaggattcttgggggctgtttgaccagccatcaacagtgcagccatacttctttttcttttttatcgtggtacacaacttttatatttacaactcatgaacttgttaatctggtccttcatctagtcagctatgtatcagaaaggacttcctgcaaaatgttatattctaagcccccatttagaggaggcatccctaaactgacatttcttgctagagttgttcaaatattctgccagtatatagctaaagagttattttccagttcaagagttatttgggggctgggcacggtggctcacgcctgtaatcccagcacttttgtaggctgaggcaggcaaatcatgaggtcaggagttcgagaccagcttggccaacatggtgaaaccccgtctctactaaaaatacaaaaaattagctgggcgtggtggcgggtgcctgtaatcccagctactcaggaggttgaggcaggagaatcgcttgaacccaggaggcggaggttacagtgagccgagatagcaccactgcactccagctcaagcgacagagtgagactctgtctcaaaaaaaaaaaaaaaaaaaagagttatttggacacagatcaaaatggtttctcctctaaagataatattaaaaccatagcacttggttttatataaatcatgtggccaatttggcattattgattctaaattttgcagtgtgttgaaatcatctggcaagtaatttgttaaaatcatgcgatgcttcaacttctttgcccacaaaatgtgcaatgcaatgcctgtttacttagcccacccgtctccagcctcatctaccatgctgttttgtcccaagtcactatgctacacaagcatccgccatcagcacacacacaggtgtgatccacagacacaaccttctatgaatacggtaattggcaggaaaagaagaggagcaggtctgttccacattttccagcccaccagcgttcccacccccttgataactggagggctgggaactgagtgcctgaatttgcagctttactaggatctctccctgtcaaggctgatcatcagagatgacactatccatttaaaagactcacccatctccctgcatgtgcttaccctcactgagaggtaagaagaaacaatttattaaactattacgtgttaagcagctggcggtatgatctgctaaggaggaaaaggaaagaatgatttagtaaatcgtgcttcaaatcagtcctgattcctcccatccgaccttgttattctagctgagattcttcatataagcaatacatgttaattctgtgcttttcaaattgaattcctccctgagactcatatccaaccatctgttagatattttgctttgtttgaataggaggcattccaaactcaggtataagagaatccctgacttcaatctgccctgctgcccccaccccaccatccggcaagagctcctcacctcagccgtggcaccgacagggaggtggcgctcagctctgctcctctcatcctggctgcgtgcagggaggggacggtcacgtggagttctgccacggcacctcttcttcctttaaatctcagcatgacactgttgctacaggctgtgtgcgtttggccctgagttctagttatctgtgaattcatcttatccttcattaaatgtcattgccttacaatacagggattgcatctgacatctccatacatgctccatgatcattctgtttgactaatacaacaatcatttcaggacctcaccacaagagacactaaacgttctttggatttacagcagtttatcactgctaaatgtcaactctgaggtctgggggcacaaaacacactaaaaatgctaaagcctcaagaaggacgcagcagggagtgatgaaagagtgaactttggagccacgcagacgtgggttcaaatctcctttgtcaccgctatcactgtgctcctgaacgaaccacttaaacactccaagcttgtctctttaccgttaaagggaaagtgtgcagaagctcccgcagccccaagtgctaggggccaccctgaatctgttccacacaagtgcatactttcaagtaggcagtgacactcccaccccacataagcacaactggcttcagtgataagcccctcagactagctatttaactttgaaataaccttcaccagctttctttctcatttaagacaaaatcaaagtctacaaaacagacacggctgaaacaccaagctcaaaaggacaagcaccagaaggaacatggcccttggtgtttcagatgcatgaagggcggaaacgcaaaacggcctcccggaggtgccaggaaaggctccatcttgatggggtcccactccagctggggctgaccagctccaccacgcctgggtgcacattgatgacatttccccagcctgcctccctatctcttggttctcctgagggctgtggtactttcagatttacggccaggatcaggttcccaggcctttgtgggaagcctctacccaactcagaggccgtgcctctcctggcccactgaggcatgcagcccacaccggtgtcctggtgatggtggctggaagtcacagccagcctgccagacatcctgagctcggaactcagtctccctgaacagccccgccaggcagggactgtggaaggagatgcccacttcctcctcctgggcaggtagcccttttgagggcttagttcataatctattaggcctccctgttgtggtccctccaaggctaggcaagtccaagtcaagcttcacaaagttacctcggaagaaaagcgctgaggaaagagacactgatggaggaaccagacctgggctgcgtgccattttggttttgatgtgagcccctcccgccccattcactgtgccccagtgcccagcccagggctcctcacccgccacatgcccgacttgtccacagttagagagaaggcacactgctgcttataccagtgggtttgtagccaat

SEQ ID NO: 11262 - DNA, 28215 bp, Homo sapiens
tcctgtctgtaaccatcagatttatttttatatttattaagcagtaagcaaacagagttgggggagatgacctaaaatggttttcttttggaataatattttttaaaaaatcaaataactgttatcactttaagttgcatgaggctgaagctgcacctggagaggaatttaattttcatgacatgcaaaactgattaggcagtgaactctttcctcccgcttcccctgaacacatttataaacttcaacgggggtgaattccatctaatactctgaaaaccatttctcatctcacagtttacccaaatcatgtgcatgactgcaagaggaaataaacaagaaatctttaagcatagataagccacaatggatagttaatcttgtacagacaatccagcattaaggctaatttgatcttttaaacattttatgggaaacagctgttgagttttctctagaaaagcccacaaggttccataaccccataggcatacagcctcgacaggcagggctccatcaggctcctcttgaactgggcactccttcacggaaggcaggaatgcacgtgtcttcacttcctgctgctctgcacgcacgtcacgatatctggcagaaggtggtttctgttttccttggtgacctgtgggaagaagtgagagaacaggcttcagagctcctttcctcttcttcaatcttgtgctaggtaactctctaaaagaaacgcctggaaggctgggagagggtgaggtatgttttgttacccaggcaggaggcccagctcttcaggagcactcagaaacaggacaggaatcaccgagtcccagcatcagtttctgccaagtgacagctcaaaaagtcaaagtgggtttggagcccagacagatttcagccaaccatggggagagctgtgaagtgagtccgacgaggcacaccgggacggatgatgggcacacaggacccctgagcacgacctgtcctgaatggaaggaactcaactgttggagtgaagcgaggaggagagcctgggagccagcggggcccaggagggcacccagcagagcagcagtgaagcgcccaggattctgggatgctcagtcatctacccgcctctccacaaacatcaagtgctcatttgaaacatggagaagtgggagagccagagacgtgagggtgcctccgtacagactgttactcaggcctcctgactgcagtgtgttctccaacacttacaccattacaaaatcaaacaaaagcaacaaagagttcaccagagctttacccgatgatctgtttatttttctttcactaccacaccatcccgagtgccccagggtaaaggaagggccatctctgctcccatcacagtgccttcctacttggcccatataatatccatccactcaacacacgctgatggggtggaagggcaaacaggagccaggcacagagatgcgcatagagaagcaccacaggtaaggaccctgacctcatggagctcgcagaccaggacaggacaggcatgaacaaggacaatgaaggagtctggggggcaggcaggaacaggggcatgtgtggggtcaggggcaggaaaggcttccaggggtgcttaagcctggatgtaatttcgacaggtgaaccatggaaaaggggctgagccaaggttcccggtaagagcagggagtgcatgtggaagccttctgaggttcagggtggttgtatctgaagagggggcctggcatacaataggtgccaatacatgtctgaagaggagatgcagagcggacctcgtcaattctggttcctggcacctgctcacccttcttggaagagtgctctggttgtctttaggagactgtacggtctaggaaacttgcccccagccaacaagtgggcaagccaggccctggcaacttctctgagatctgtaccccaagaggagtgactgagatctgcaccccaagaggagtgagctcacgcagcaagtgccagaagctgatcccatttctactggtcctggctgcgtcaatcccgtgatcccatttctactggtcctggctgcgtcagtcccgtgatcccatttctaccggtcctggctgcgtcaatcctgtgatcccatttctactggtcctggctgcgtcaatcctgggcggctgtggctccacttgaaatgaggacagtcagcttttcctttggcttcatgggacagctccaaagcctataaggctttttgatgctgttttcacttaagttagccaaagtccattcctgttgtttgcattcaaggaatccacctgaggtagaaaggaggcgacacagaggtgggcaccacaggggcccttttcttccactctgagttcagcagtgattgcagtagcttctgcctccagccaggctctgtgagagtggactgtgatacacagctggagaatttgctctggtcttctatgacacagtacggtgactacagagtaaataacaaggtagtgtatatttcaagatagctagaagagaagattttgaatgtcatcaccacaaaaatgataatttaaagtgacagatatggaaattaccctgatttgatcattatacaatgtatacatgcactgaaacatcacactgtaccccataaatatgtacattatatcaattacaaattaaaaattaatttgaaaattgagcagaatgcaaacactccaatattaatattttgatactccctttgatttccctaagattatttctgaaaattatgcaataaaatgttgatgtgcaactctctgcagtattcacttatgatattccctgttgagaaaagcacactcccaaatgcaagaacaaggatcacagcatctgccaacctcaggagtctttgccttatgtgaaattctagtctactttttattcaacagccagaattttggttgcagaaagcctttcctgagaagctaattagaagagggaactgggagctgggagcaggaaaaggaaataaagaagactgcagaaagaagaaagtaatcccaaccattctttttttctgcactggagccttaagagaaagaaaggaagctgagtgaacctgaacccttgcacctgcccagtggctgtaggggggcccttggtaagaatttatcctgggcacagtgaagataagactgtgagcaccatggggtcagaggccacatctcattcatcctgtgacctccagatccaatcccttgcttattaggaatgttgggggcccttcccacagtttcaaggaaatgcatgtggttttgttttgctttcttgcacatagttgtatactaagaggcatttcttcccctgcctgctccatccatgttttcaggtctggggttgttaaagtcagaacataagcaggacccagtatctggtactgcatctgtgcccagcagatgagtcaagtactgtctctcgccgtacctaggccaaccagatgagaagacaaatttgtgatatcaccacctcaacttcttatttaaacaatcaagaagcgggaaggggagactgagcagggcatacagacactgatcatattaaacaagttagaaggcagtgaggtagcatgcaagcagcctggaagatcagataatatccactcactgctgccaagaacatgtgcaccccaaggtctaaacaagaggcttagtcatactatgaagctgccagcttgaaaaagaactaaagttgttgataacattttcaatgttatgacattaactagaaggcagcaaaatcaatcaatgacacactcattgggatacaatgggataaaactcaatgggatacaatggtaataacctcttagagttctgaaaaacaaattattgaagaacccataagtcacctgctatgatttgactgtgtcccccacatttcatgtgttggaaacttaacccccatgcaaatagaggtgggacctttaagaggtgattaggtcatgggggcagccctcatgaatggattaatgccattatagtgggagggagtgagttatggcaggactgggttactgataaaatgatgtctggttctccctctctattgttcactgctaaaactccagtggatagaacagtacctgacatacagtgcgtgctcaatatttaccaaatagatgaataaaaatactccatcaccaatttcttctactgatgctttactaggtaataggaggtgccaaagattgtatcagtgagattttattttccttctcaggtactgttctttcttttcttttttcagctattttttttaacacatcagagaatgttatcgttttgcctcaactgtcaaacataattcttcaaaagtcaacagaggaagaaaagcccactacactcactcagagttttactcttcccattgttctttcttccttcctgatgttccaggtctccttttaccatttcctttctgataagagaacttcctttggccattcttttagagcagttctattatgacaaattctcttagttttccttcatctgtgaatgtcttatagaattatgagtcgacagttgtttcaacacttggaaaatgtaccacctccttctggccttcatggtttctcctgagaaatctgctgtcactcatattgtttttaccctataggtaaggtgctgctttcctttcactgctttcaagactttaattttcataagtttgactatggtatgtcttggcatgaatttgagtttatcctcttggggttcactgaaaatgtaggtttatgtcttttgccaaatatgacaaaaatgcagccattacttcttcaaacactttttcaaccccacactcatctcctgttactacaatgatgtgaatgtcacatcttttgttatagtcccacaggtcccagaaactctgttcattttgttcattactttttcttttaagtctgctctttgtcaggtaatttctattgttctaccttcaagttcactgattctttctcctgtcatctctattctgctgatgagcccattcagtgacttttttattggctattgtatagttctaaaattttcatttgattcttctatcttctaggtttttgctgaaactttccagttcttgctgagactatttttcatttgtttcatgtgtatctgtaattttatgaagcatttttatgatagctgttttcaaatccttgccctataattccactatctgagtcaccttgctgttgagatctgctgatggcctttcctcactcaggtttaggtattcctgattcttggcatgacaaatgattttcagttgtgtctgttgtgttgttccttaggtccttaggttcctagccagtctgtctttttctcttcacttttcaggtcttcttatgcttgtattataaataacatccttagcaggaaaaataaacacaagtgtgtctactctatcttgtctaaaactggaagagttctcgggtgtttttggaaagtactctgttcacccaacgttatgaagaataagtcaagataatattactaatttgtgtggtatatttcccccatatcatgagctcagtctcatcttcacactatgcatattcattggaaagtactctgttcacccaacattgtgaagaataagtctagataatattactaattcgtgtggtacatttcccccatatcacgggctcagtctcatcttcacactacgcatgttcagctggtagcaaggggacgctgactctgaccccttttcatagctcattttcttacctggaatgttctcccttctttttcccatttcctccttcaagagccaactcaagaaccccttcctttggacacctctccactaccactgctcacatagatctctcccttccctgcccctagattttgattgccccatggtctgtttttcttgagggcagagatcatgcctcacaggtgcctaaacgatggactaagtactgaatgtgaagggcactctcaaaaatggattcggatactttattgcatgtgagcaatggaaagaacccaaaaatatatctaatccaacacctaagtttgcagataaagaaaatgaggttcttggccaggcacagtggctcatgcctataattccaacactttgagaggctgaggcaggcagattgtttcagctcttcaattcgagatcaaccccgggcaacatggtgaaaccccatctctacaaaaaatgcacaaatgagtcaggtgtggtggcacatgcctgtagtcccagctttttgggaggctgaggtggaggatggcttcagcctaggaggcagaggatgcagtgagccaagagcatgccactgcactccagcatgggccacagagactaaccttgtctcagaaaaaaagaaaatgaggttcttgatttataaaactggaaaaggccaggcacagtggctcacacctgtaatcccagcacagattactctgggcaacagagcaagactctgtccctccccctcaaaaaaataagttaaataaaaaataaaataaaactgaaacagaaggaccacacaaaccccaaagcaacaacaacaaaaaaaaacagggtatgtcagcccctatctcttacttaattaactcaaagctaattgttttatttacagatcattagaagcaatgattatcttgcctggagaataattttgagtctcagagagcggaagaaatgtggtatgatcctaagacacaaagtctgtttctgggcatcacagtcagctcctttcaatccttccttaggactgttagattagattagtttgtggaactagccaatccctggagtctaacactagcaatttcccggtcttccagcctagaagctatctgacctcaaaactaattttctttcatgatctttcactattcattgccttgatttccatggaaactctataatcacaaccaaaaatgtaaaataagagaagacgacatgaaactctgaagaaccccacagacttttcagggctctcaaatgtcacctccttgaagagaccttccctgatcgcccttgctactcctgcccccaactaccacattgcctggtttctttatttttgcctttatcagtatctgaaattgcttaacttatctgttcacatttttggtattcagctcctccattagaatgtaagctccatgaaagcagcgccttggtcagtctcgttcaccacagtatcccaagacttagaatgacacctagcatacagtaggtgctcaatcactattgaccaaatgaaggaataaataaatcaataaagaagcgcatacatttttccaagtctggctggtctaaccctaatggctgtttaccaccacactccaggattcttggtggcaacatgtggatactccaggattctttggtggcaacatgtggatactgccagtgggccaaggtgacatttcactcagtgattaaaatgatcatgaggaaggtgctcacgggtactcactctccactccccctgataggagtggccctgcctgcctgacttgttcacttggcacttgcagggccagggagcttttaaactgggggtggggagtgaggtgtgtgagcagagctcagccaagagcacagctaccactgactcaaagaaactaagggtaggggttggggagaagcaatatctgactgagaggaaaacagagggacaacagggaaagaaaggcaagaatttagacaaagtgccagcaatgccatgagtcccttccgactggctcagacgctgccactggtcaacaagccctagcccctcatctctcacatgtggtctacagcagtgcttctcaaagtgcgggggacctaaaaaccacatgagaacttgccagaacagatcatggggccatcccccagagtttgactccttggaccagggcaaggcccactcccaggtgatgcccatgctgccattctgcaagcctcacactgagtggcacatcctacagatgcactagtgaatgtagcagccacacgagaccacagagcacctcagatgtggccagtgtgactgagaatccaaatgtttaattcaatttaaatttgattatttatgtgattaaataaataattcaatttaaatatgattaaatttattaaacataaatagcgagatgtggctagtcgctactgttctgagcaatgcagagagcacatttccctcactactgggaagttcaactggacggtgctgctcttcagcacctggaagctgtgtctcccaacacatccacagcctcttctccccacaagcacaagtgggtcagctttaaaagggaaatctttaaaacaaaacaaaaaatatttgcctctgtatcccaacctggcgcctttcaatctgagaagagataagcttagaacaagcaccttagctcaggcaattctgatgccagagaggtcctagtgtctggtgaggagatggaagaaaaaagcagccagaacaactgggaccgtcaggaggcccccccataagcgagtttgttttttcatcaagtagaggtataatttaagttctatacatttctagaaaattagactcacctacatttcagcatggaagggaaaaaatgttaactcaaaaccaaagagatattttagagccatctgctattttagatcatctgctccatttccactgattatggaggactggctgtactcacattaaacaccttcacatcctttctgtttctgatttcttctacaagagccagtggctttcctttaggaactgggattgtgccaaggattatagtccctggggtagacagcgtctgacgaacagcttgaatgaaaagctgactgaagagctccatcttcccaatctcatcgatgacgcacactctttgccctgggccactgctgcagtcggcctgagaatgacaaagactttcactgggacatcagagtcacattaatcaaagggcccatgggtcccactccccaatcactcaccaatgaggtaaaaaagacagaaacctttttactggatttcaaaaagtgacagcatcccacagaccaccgctggtactgtgtgggaggggactgcacaagggtgagtcccaggagctgggaatcattaggactcttggaagctggcagctatgcctgtcaccagtgggatgttcaaggaagtaacggacataaattggaataaagtcatgagaaagagaatctgagatctaaaggatgcaattgtacttacttttttttcccctttagccaagacttgtttccttttaattttcacttttttccaacaacgcttatggaccagatcatgaaatacacaaacatctacctagagcagttatctcccccccagcacgtagggaatctcatatggctcaaaatggaaaaaagaggccattattatcaacaaaggctcccatgcttgctgtctcactttttttaagcctgaggtatttgggtgccacttattttctggttgtatataaatataaagcttgatctctgtcttggatcccctctctcgaatcactcactctgggggaagagaagtgctatgctgtgaggatactcaggcagctgacggtgaggtccacgtggtgaggcactgaggcctcatgccaacagccaagaggaaatgaacctgccagcaaccacatgagcaagcttagaggcagggccctcccaggcaagcctcagatgaccacagccccagccaacagcttgactgcaacctcagaaccccagctaagctgtacctggattcctgatcctcagatactgtgtacaataatgtgtttgttgttttaagctgctaaattttgagataacttgttccatagcaacatataactaacacacatgtcctctatagaaagccttcctggggaaggctgacaggactttggttgattcttccctgggagggacaaaacagaacatgtaataaacacttcaatgaatggtgaatgacaaatacaccttatatatgtttgtatacatgattattttgaaaactgtatgtaaagctgatttacaaagtattcttcactacagttctgattccttaaatgatgacagcaatatagtcctagagggcatgtctgagttaagctagattttgttcaaattccaaaagccaaagcagcatatggtacagtgtggctggtggtagggatcagtggcaaccaggggcagccagtgacagacggggctgcgggcccagatcctaaaggccttcgaaggcacacacagaggtgggaatcttctcccacagccgaaagagtctaatccagggaggatcacaagttgtgctagaaagactgctggctgtggagtcagaaacaaatgttagactccttttggaatagacaagataagatagtgggtgtctaaaccccagttgtgattgcacggaagcagtacagcagtgtttttcagacttttaagtaaacagtactctattttcctactgcatattgtacacttatgaaatatttttccattcattttattagctaaaagatcaataaggagtccactgtaatcacccaagagaggtctgaacaatctccgcacttctgtgtttctgacatgcttcatttttgcctctctattaagtttatctgtacacacgcctggtctccccacttagggcaggtacatggttgtcctcgtccgcatccttcctggggaactcaccgatgtcccagagctgagaagtggggagctgaaggagcaatgtcaccctccactggtggggtcggggagaagggcagagcatctatgaagtaagtcactacttattccaagtttttcctccaaaacgaaagccatatttgggagaaataaaacagctatcaaccacctgtctatgataataaaaacagacaactgtacaagaaggtttctgtcttcctgggggcatgccactccaactgacccgactgttcccaagtgctgtggacattttgctgcccccagagacgaagagtaattgtggatgccattcctctggaggctgtcatctaaaagccaaaataaaacttattctggcacctcaaaatgagttttggaaggtgccaaatcagacaagaagtgatatgaaagaatgtgtgtacacatgcacatgtatttatttgactatatacatgagggtagtaaaatgcacgtggccatgtgtaaatacacacgtacaggtagaaagtgtgtggctcttcaacaaccagccttcctgcaatcctctagaacattcaccagtgaaagctcatcaacatttatttaagtttcagcacaaaagaatttggacacacatgtatacattactttctaccaattggaaatcctcattttaaaaccttagcttacataaaatcctcaatctgtccagaattggggaattttataatccaagaacttcaggaatctcaaaaataaatctgtgatttttaattaaaaatgcaagttattcatattcagttgagagaaagatgtcagctgctgagccactctgaagcatgtagacactcagcctgcttttctaaatagtacaagatcatacactcaaggtcttaaaaaaagaaccactataacgtgtaacatggttttatttctatataaattcaagcaactttagagggaaacaaagaaataagtaagtaaacaaacattcaccccctttacattgttctaaattgatagagacacagacttagaacaataggggcccaggtttgaagatggtcaggaacccctccccaacccccagtgtgaggagagtcctaatgagctcccagagaaactccacctacagctgctggagtaaggagtgtgtaaaaactgtaggtggctctcagccacgtggtcagaatcacgatgtacacaccatctggggtgtacacaccaactggggagcaccctttcctcccctcacagcctctcctcagagaacaacccaggcagcattgcttcctagtgccacacctcagtcctatgtaacacactagccttcctggccacacccctcacaggcttccacttcagctgattataaatgttcagccatgaagcgcacttttagtttccctgttccgggagagaagatatttccttagatagagtcctaaaattgaccagccagggataagagaagctacgaataattttataactttggttacactcacctagtttgctttccagaaagattagaacaacaaatatcttcgtaccagttatatcagagacctgaaaatagtgtgatttttttgggtcctttatttttatatgtacttttaaaaatacaaagaacatataaatataaaataatttcatttaaccaaaatatcaaactgagagcaagctaatccaagtggtctttgccttattctgaattatttgcataataaatgtttccagtggtattaatgttaattttaggaggactgtttggattgttttattttaatatcagacacacagactagctcctgagcttacccacctgggacagcaagtatggaaagtcatgaaagtgaataaggagtgtctctcagaagttaggcagcaaaactgcagcccttcgccaaacagcagcaagttctagggaagcagaaaggcaaatggtgctaacagcagccatctctgagccagcccacaattcctcacccactgaagttattagctaaaaatgcagggctccggtcatattttatgtgtgtttattccaagccttcaagtctcataatccctttgctgtctggtggcatatggactgtgagtctccagggcatagccaggacaaggtgtctagactgcccgatggcgcctggtaacccggcccttccccagtcaagaatactccgggcagaagctgctcccccggacatgccagagatcctcaccccggcacacagacagactagctctgaggctcttcctggatgtcctaaatggcctctcgggactcacaggggctcacccacatggtcacccgactgaagagcgcttgaatggtagccatggggttttccaagctatcttgggactgaaacaacacctcctggctgacagtcagtccagtgagacggagagcccagtactcctcgtcctcctcatgctctgagcacttgggactggcctgcacatttgggctcctgggactccatgacagattactatcccactccggaccccagctccctggcaaacacaaaccaaattgtgaagggaggctcctctcaaggtactgccatccaccacctcaattaacttctcaagaaaataatcactgctattgctctgctgagcacctcctaggagccaggggccaaggcactttacaagcattacattcagtcctcccagcaacttcacatagcaggtaacagcatctgtttcacagatgaggaaaggaaattaggcattaagggatttactcaaaactcactgagagcacagtgacagagctggagtcaaaccagagatcacctgacttcaaagctctcttccacaccctgtgtgcaatacgcctccacactttgattctgaaataaagaatagcatctaggaaactgacctaaccacgaagaaactgctttcctctccaataagaacgaatagcactctggtgtttagggatctatggaggcataggcacaaaacctcaatttatttggagtaatcatattgctctaaattactcgaaaataactcatattttgggtctgagaataatatcaccaaaattatttcatcaagtatggatagcgaatggcccactgcagtaggcagatatgataaagtaaaaggacttctctcctctaccaggagcacaccccgagaagacggtggaagagttatgaccaggtatcctgatatgtccaccttcctgccagtgtttacaaaaaccaaattaaaaaaaatttcacttgcttagtaaaaattttcatcaatatttaagcttttggtaaatgtttagtatctctgatacctgataccgttttcattagaaactgcctgaggagaaagaactgattgtttttcctataataaaatggtgatggcttttctaatggggaggtaaccggatacaaatagagagaagcacagcttagagtggaaaaaagcttaaccattatggcattttttttagtgcagcttcaatgtatagtaattttatgtttgttaattactgctcaccttgctagagaaacaatttcaaaagagagtagttaaatctgcttgccaattaaggcctcaagagaaaattatttttatcttaagatgatctaataaagtttagataaaattagaattggctaggggaaatctgatgaggaggatgtgcatggtctcacactatctccccactcactgctcattagtgtcaaagaaaaaaatagtaactatacagtggagaaataggacaagtccttgatcaggtaatcaaaattaatatcactaaacatcacacacctccagatgagatactcgagaaggatgcatcatcacttatgacttatggagtattccagctttatttggtcatgaggaaacatcagaaaaactccaaaagatgaacgttcttttaaattggaactatattctttacaaatgtcaatgtcctggaagacaaagaatgactgtggaaatgttccaaattaacggaggctatggagatgtgacaactaagtgtaacatctggaggaaaagaaatgttacaaagaatattgtcaactgatgaaactagaacactaacgatagattaaagtattttttcaatgtaagatttacagaggttgataactgtattgattatgtaaaagcatatccttatttttaggaaaaatatactgaacatttaggagtaaagtaccttgatgattgcaacgtattctcaaatagtcacccccttccagcttatatatttatacacacacacaaacacacacacacacacacacacacacacacacagagagagagaataagcaaacaaggcaaatgataaacataggtgactctggataatgagagtatacaggtgttcttgcactattcttacacttataactttctctaagagtaaaattttatccaaatgaagttaaaaaaattgtcaaaaaaagaaaacacacacgtatgtactttctcagtaccagactcaagaaaacaaccaactcaccccgtatgaacttcctcctaatggagtgtggttttagactgatacgcacgggaggcgagacagaaggaaatgctggaaatgggacaaagtgagagggaaaaagaaaaacggcaacagtttatacaaactcaaccccagtccagcttaagggacgtgtgacttaaggagcatgcaacttttctgtgtttcttgagagtggactgcaagaagaaagacatgaaggtgtcataacccagggcaaaagcctgcttagcatctaaatccacagaatctcgccaacaatcagaaataataaagtctcagtctctgctcaatagaaattatgaagatttgccatgacaaatcttgcaaaatgaactgcagagtcaacctcatgctgaattttcacctcattttcttatgctgattcactgcaggaatgtccttactgacagtttaaaaactgattttctgtttgcgccagatagcttttaatttccctggctgatcctgcattacatacttgtaatacatgaggtagagaaacagaagctgagagagaacaaagaatcaaatgccacatttgctaacagcaatgacagaaattctagcaatgctgaggagcttgtcaatctttcaagaatggatcctgactagaacttggtttttctacattctttctaaagccaagtggcctgagagtgacctaaggaacacttccaggtcgagtctaaaaaaacaaaaacaaaatacttttccctagacaggagtcctctcaccttcaaaggaagtttctaagattttccaaagcagagcctatttcagaaccaaaagtagatcctgctctcaaaaacaaatatactttaaagacttattttaatcaaaacaggaaaatacaaggttcaaactatgttggttttccctgggtgttctgattttagcttactcttcctttcacagatctttgtaaaaaatgacactgttcacctggaaaacagggctttgagtagatgtcctttgttctttaaaacattataatctattgtctccattttgtgtgagtaggagatatgttgaaaatcaataaaatgttacatcttacattgcatcaaattttaataaagcattgagggtagctatcaaaaaggccattatgaaaaaggccagcattatcttatcagccttgatcattagaaaacagaaaaaacaatcctaattccagtagcaccagaaaataggagagccctatgaataacctcaccaataaaaattttaaagaaacagatggagaaagagaaacatgttttgggctgtggagaattaagattatctgaaaaattaagacaccctttatgtcaaaataactatagtcccaatcactccatataagacattttttttaatggatagtaaagtcttgattctatagttcactccagctctaccacttacacaattagtgtgtccctgggcaagtaactttccattctatgcctcagtttcctcatctgtaaaataggaatagagtgatagtgttctgaggattaagtgagttcatgcctggcacgtagttcgcactcaataatagtttactattacaagtgccaccattactacagtttctgaacaaggccattttttgaagaagaaaaataaaaacgattaccatggtaattaaaatactatggtactgatgcaaggatcaaacagatcaatggaagagaacagataactctgaaacactatacatacaagcacacatagttttaatataattaattaagcataaaaaactaattagaaatgggttatttaacaaacagttttagtaaactggctaaatatctggaagaaaatcagctgagaatctcatagcatattacactcaacataatccaaatgaattgaaaacataaatgtttaaaaaaagcatgcagaagaagaaatatataggtaaaattttatataaatttggaatagggacagacttttctctaccttgaagggaaaataatcaccaaagtgaagtgctaaactgagaaaaacagaatcaataatataaaaaggctatctgctttataaaacatctatttaagcccaaagaaaataaatgggaagagcaatggatgaacaactaaaattaaggaaaacttaatgaacaactgaaaaacatttaaccccattagtaactgaaaaatgcaaatcaaaacaaagcagtgtgttgaaaataagtagagtgctcagggctggcacagcgcagcaagacaagcacactcacaccctggcagtgggacacaaagtcaacgcagcaccatcaagaccttgaaggttcacaccccaccatctcagacttcaccttttagaccctccccagggaaacaatcatggctagagaaaaagattcatgtataaagggtgctttgttgcaaggttacttacaatggtgatacggaacctgaatgctcaacactgagggagtaatagttaaatcaaagatgaaaactcataccatgaaataggatgaaaccactaaaatctcccagctttgaagattagcatgttgtgagaccattcccatgtccctcaatcatattaagggaaacacaccaagcctatgaaactatacataacattttccctgatcctgaatgactgaataaataaaccaggtatacaaaaggggcagaaacaaaataagctaacattggctaacttagtgataagattatgagttattcacattgtgttttttatttttattttacattttttataatttttttaaccatgaatatctagaacttgaatactcaggaaaataacaaatgttgacaaataaggaaagagttaactcatggaatgaaaaaaattaacagtcaaccctactagaggctttccaaaaaccttcctgagtctagaacacttaccacacacactctatttttctttatttctcacgagcgaccacgatgctcaggctccattcctgcctaaagaaacgtaaccaggctaggcacagtggttcacgcctgtaatcccagcactttgggaggccaaggtgggtggatcacgaggtcaggagttcgagaccagcctgaccatgatggtgaaaccccgtctctactaaaaatacaaaaattagccaggtgcggtggcaggcacctgtaatcccagctactcgggaggctgaggcacaagaatcgcttgaaccctggaggtggaagttgcagtgagctgagatggcgccactgcactctagcctggctgacagagcaagactctgtctcaaaaaaaaaaaaggaaaagaaaaagaaacaagaaacataaccagagcagttttgcaaggtgaacctgggttgtgcctggccctcctgagcctctcctggagctgctcttcagctcccggccactttttttttttttttttttttttttgagatggagtcttgctctgtcacccaggctggaatgcaatggtgccatcttagctcactgccacctctgcttcctgggttcaagcgattctcctgcttcagcctcctgagtacctgggacacgggcatgtgccaccatacccagctgatttttgtttttgtttttagtagatactgggtttcaccatattggccagcctggtctcaaactcctggcctgaagttatccactcacctcagactcccaaagagctggggttacagacatgagccgctgcaaccagtcccagccacatccttacttccccacctgcaaataggcatagccctgcttggcctaattagagaagtacttttttcttatttttttgtagtattaaaacacacacacacacatacatacaaccctcaaactatctttcactcatacatattgaaatttcttacacacaatggatatttcttattatcggaatttgtgttttcatagatcccagcactatgaactaatactgtgtccctttataaagggtttctaacacttccagtttacttggttgttttcattgccagtatcaaaaatggtgtgtttatactccccagttttgttgcctaattattttaattaatattcttttcatttttttctttagtataaagacaaaacactagttccttctcctttcttcattcccataaaatatgtatgatgggagaaaaatttctgctccagaaaagaaatccatgaccctgactgggtgagaatcctatattagtccattttcacactgctataactacctgagactggataatttataaacaaaagaggtgtaattgactcacagttccgcattgttggggaggcctcaggaaacttacaatcatggtggaaggcagaagggaagcaaggatattcttcacgtggcggcgggagagagagagtgcaggggaaactgccacttttgaaaccactggatctcatgagaactccctcactatcgggagaacagcatgggggaaaccacccccatgatccaatcacctcccttcaggtctctccctccacacatggggattacaattcaagatgagatttgggtggggacacagagccaaatcatatcaaatcccctgccaggaactttttctacatggaatgtacatgtctgcatttggcaatcagaatacaaaatgttgggagaagtctgtatttctttattttttaattaaaaaacagatttatgctctgatctggtcagcatatgatctcttatataatcttgcatctagacactaaacacctgtgcaaactctcctcccaggatttggtctactctgtctgagcagggtaagtaaaaaattctttgtattgacccagtcagttcctaaaaccagaatcttcacttggaatttcatttgaagtatttcacttgacttttgaacatttaagtagagaggaatgtatgtgacgggaaaacagctaaaaagaaaagtaccatgttctctgctcccgcaaaacacagtggccacgagagtccccagcacaggaactgagggtaagttccaagaggaaggaattggggaagaaggaggtgggaggaggaaacacagcgtaggaagaaaaggagaacttggtgggttccaagaagcacaaccccctgctgaaacagaccataagataccaccagccctctgagattagaggatatcctcagaggctatagctaaaatcttcagcagcctttgggcaaccaccactacatacttcagctgagctctgaatgtcaaggagcagagaggcaaagatctatgaagacagcgtgctcaccaaaaaaaatggcaagtgccaagggcctcagcctggcatatgtgggaagtctgattgaaccagtgtggctgaagaatggcaagatgaggtcagaggttagtaaggccagatatcacagggctacagggccttctaggccactggaaggactttggactttattcttggtgccatagaaaactctggatagtttatagttggtttttgagacaggtctgtatcatttaattttcacaaatcaaagtagtaagtctgtaatagattaaatgacactcacattccttaacatggtccacagagccctgcatctcatggccccccacctcaccaaacttaccttcttcacctgctcctgctccagggctctgaggtctgaatgtatctgttcctgccatttagaatattctccccagacctccccaccctgacacatacaaataccccaatactaactctctctccccaatgccctctcacctgttcctttctgtttaaatgtcatcttcccagaactctttcctggtcccttggtctaaagtcagttcttcctgtccctccctttcatagcaccctgttcttttctttcacagcattaatgaccatgacaagtataaatttacttagtgtctacctttcccactagactaacagttttgaaagagtagaaacatgtctgttttgttcatgactgtatatgcagtacttgataaatatctgataaatagatacataaaactacataatcaataaaacaaaagctggttctttgaaaagatcatctaaattgacaaacttttagactgaccaaggaaaaaagagaagatttaaataactaaaataaagaaagaagtgacaatatcaccaatcttacaaaataaaaagcattatgggtgaatctatgaacaactatatgccaataacttagatacttcagatgaaatggacaaattactaaaaggtacaaattaccacaactgattcaacaaaaaaatacaaaatcaacagacctataaggagagatttaattggtaatttaaaagcttctcaccaagaaaaacctagcccacatggcttctctagtgaattctatcaattattcaaagaaaaattaatacgaatcattcacaaactcttccaaaaattagaaaagaaggaaacacttcctaactctattagaccagtattaacctgataccaaaactaaacaacaatatcccaagaaaagaaagctacagaccatatcttttgtgaataaagatgcagaaatcctcaacaaaatacgcctgagtaaactctatacaaataagacacagttaacatcatacataatggtgaaagactaaatactttctttctaagattaggaataagataaggatgtctactctcaccacttttattcaatgttggactggaggttctagccagggtaattaggcaagcaaatgaaataaaaggcattcaaagtagaaagaaagaagccgtaagatgtcaataaagtttttttcttttttaaaaaaggtaatataataatataatacgttaactgcttacagtacttggtaggcattcaataacaactggctattatgttcatataatgacattttctcttcctaaatgtttgttgtgctgtgaaaccaggttaagacatgactgtgagaagacagaggaaagacttatctttgggaatgttggtacctgggcatcaagagcctttccaaaataaaatatttatatgtactgaatttataggaatttatctgtagctcagagtgatagcaaattatgttgtttatccttattaagactcaatcttttcaattgtaaaatgcaaaactggggcctttaagagcaaaaggcattctgtttccatggctagcaattcccacaatacactaagagcagatgggttcaaaaagcagaaatcacgtactcacattcctcaagacgggtagtgccaactgctcaaaagaagtcaggtcgaccacatactgcccaactcggcattcacgttttccaggtggaggctctaacctgaaggaaaagacattatgttctttgttgaaaaactcctgtattgatttctggtttttagctgctccactgagcctctggcattccacatatgctaaatcatccttaaaaatgaccaacacaaaatgcggtggtctgtaaagctgatcaggttttctctgctttgaacagagctaccctgttcaaagtgtccacacctccaacaatgggccttgcagttatggcagggctatctcttaaggtccaagcagctactgcatcaacagtctttgaaaagtggcaccagaaacaggactaagaattataaagtgagaggagtttatgacttggtgaacaagttttaagtaaaatatcactttcttatacttttttcatgtgatggtttcattctgttttctttctctgagaaatccctaaaggcctaagattcttgaggatagatgacaacatttggctcaaccctgtgcccagggagacactctcaacctaaagggaaagcagatgggcatccaaggacccaacagagtatctgcttttggtgaatttagctcttgttgaaaagctcccaaagcacagatggaaggggagcttagataatagaacaccacagaaatgaaatatcagtacccaactctcgataaaggcccccgggtgccggacaacgtgacgacatcgaatcctattcttctccctccctgtctgacttcttcggtataaaatccatcaacaggcacaccagaggattttaaaacctcactggctttatggatcaatgttgtttttccaactcctaaaataaaaaaaaaaaaaaaaaaagaagaaaagcccattaggaaacattcccttactagagcacacacagcacttgtggactctgaggcagcaattatggtgggtagagaaatgggctgtaaatggatttatgaatatgaacttcaatttaattttgattgctccaggtgctaaaaatgcttaatttcaagtagaaacaagcataataaaaacacgaatgatatcttgaggtttatttttaaattgtgaaacattgttaattttgtcacgtacacaatcccagaatcaactgagaggttcctgatgatattctcccatgccatttgcatcctgtgaaatggtttacagttcccatttttctgcccaggaagtaacactggtcacacttgagtcaggggctgggaatttaagatttcagctttcaagagattacaaacggacctacacttaacagtgggaaaatcactttgttcctcctttgacttacattgttgtaactcctgaaaatgtgtctcttaaatatcattagcatccctgttaatggtcactttcaaactttttcataacagcaagcctatcaggttagcaactccttccaacatcatcttctccagggtctctaagcatttcttcacctttatcccccacaccttccccagtttgaacctatgtacctctgccccctcagcctccccaccttgatccttcctgtccatccagcctggtcagctgactactctgatgaactcactggtttgtaagcaccaacaggtgctacctaatatagtaatactcatcactgacgtcatggagccagacactgttctagcacactttggaagcattttcttggttaagtcctcacaaccatcctctgaggcaattaccatccttatgcatattttacagatggagaaactgaggtacatggtggttaggtattttacccaaggctatacccctcataaggtccatacctttcaacaggggactttacctgtcaccatgactttttaaaatatgagccttgttcccaatatggatttaagtaagtggcatcatgactacccaacaatggaaagagagagaaaactcctagcatgtctgcaagtgagctattttgagatactacagagttgcaaatcatgctatttctaagactacccactcttttaagcctccttgacataaaatatgatccattattcttatttaatgtatctatcttcacacttcacattaaaataatggcacctggctttctggaacatgaacagcaacacaacaggattctggctacagtaagccacagtgagcatgcagctggtagaactgtgtagaacataaaatgatgacattctaatccagccctggccatcagtaacaactgctttaggaaagtcactaaagaatctgtttcatgcaagtaatggcattgccgaatgtgtaagctgctacttcttttctgaagggcaatttcaatgcgcctgccacagcaccctgtagttcatgactaggaattcatcctcaggaaacatcaacaatacaaatgtgtgaaagaggacattcactgcaacattctttataatagcaaaacactgaaaacaacctaaatgttgattgtaagggaatgttaactcatggcaccatgtatataatagcacataaatacacagaaataccatgcaaccattaaaaaatatactgcttatatgtatttattagcatggaaaatagaccacaatgtatgaaaataatatatggaaaaagcaggttaatagcagaaaccattccattatgttttttttaaagaatggtcaagtacgtgtctacagaaaaaaaaaatgtcaagaagaatacagaacaaagatttacaatgttgatttctgatgttcaaattccctgtgattgtcactttcttccttaaacttttcttgttttttttaattcttatactgaatgggtcttactcttatcctaacaaaaattgccgtttatattttgaaaaagataaaatggagcaacggtaactattcctgttcacaaagggtatactgtggggactgtatgttgtgtagaacatagtagagcaataaataggaagcatttgggcaaagtcccttttggcttcttcagctctaggaatcttctttcagttaattttttcttcattagttaagctgctaccccaatgctgtctggataagaaatgacctctgcttcaggagacctcgagatgatagctgtataccaggcacaaacagatcagaaagctctggaattattttggttctggttctcccctaagcagatcctcagataaagattcaagtgcaggtagtttaacctgggcagtgacaacatgatggactggcagggaagaaattcagaaagggaagggaaggacaccagcatgaggtgcactgtcaagcaagttccactgggggcagctggagcttcaaccccctggggaatcctaagggacaagtcagggcaagtggctcagttatcctgtctgaggagtgagaaagtagggaatttatcaactaactttcaccaatcacaggttgaaggctaatcccagggcacaggaattccctggctcttctggcctgctctgtttgcaggccaagtgggctccagggaccagagaaagccctccaagatgagtcatgggtacagacagttggaaatcggaaaaaatgctaagtgccaggggcactaagaggatatgcaacaaaaagtgacctctttgagaggagactttacctgatggtctgaacatattgagaaaacagaaagaaactaggcaaataaaaacacctgacaataactcctaatggggaaaaaagttatgtgtaaaaggaaaaaaaaaaaattagagggcatggtggtgcatgcctgtagtactagctactagggaggctgaggtgggaagatggtttgagcctggaaggtggaggttgcagtgagccaagattgtgccactgcactccaacctgggcaacagagagaggccctgtctcaataagaagagggaaaaaaaagatgggtaaggtggctcacacttataatcccagtattttgggaggcccagatgggaggatcacttgaggctaggagttggagatcagcctgggcaacataacaagagacaggtctctacaaaaaaaaaaaaatacccgggtgtggtggcatgcgcttgtagatccagctattcaggaggttgaagtgggaggatcacttaagcccaggagtttgagaatgcagtgagctataactgtttcactgcactccagcctgggtgacaaagcaagatcctgtctctaaaataaataaataaatggaaaagaaatcatagattactatgtggctctgttgtgattgtctttacatggccataatactgtaaacattgactaatgaaaattacgctgtaactacattaagaagagaaggagaaaagacaaaggtgcgtgggtttgaggacaggtttaagagagctacactgtagaattatttgagtctttcaactacgtgtaggtaagactttgataaagcagaaacaagaaccaccatcaatacaatcacggtaacaggacacctccattaataaaacacacagttgtcttggggtcagcctgctgagtatcaaactgcattccaagtttcaaataaaggattgacaaaccaactttcagaaaacagttctttgcaatacttaggagtgactttagatagcaggcatttctcaaaccaccctcctcctcctcaccccctgctccccaactcccccatccaatgcctgacaaaatcccaaagtctgcaatattagctgtagcctttgctacttacaactaaacataatcattaaaataaagtgaaagagaattctagatccagggttacagcctttgatatctgaacccacactaaacttcaaaattagatttgccttgcaaaggagctgaagaaatcactttctccactcttagcccatctatctttttttagcctatctgatgcagcctacctgtcctttttagtaatgcttgatacatgggtagcgccttggtttaaaagcacctcctcctacacctctcatctgacctcaacgctatcctgcttctcagatgagaactccacaggccacagggttgagggatctgacagacatcaggaggggacagcgacaggaacaagcaagagtgtctgagaagggctcctgtaggtaccaaagcttctccacctctggcctcagctgtggagggaattcgtggggatggagatggggatgggggtggggggatgaacttagatgggaaagaaaggttacaacttcagtttcgctgtcctccaactaaaatttaccattttttttttgcacgatcaatgtagcaaagacccacagtaaggaaatacctgtgactatcaacagaaattagacatctccacttcacatcgcggttgccgcagatctcttgaaataccatttgtgcagaccacaacgtcaacactacagtaggagttaccgctgccgctggcccctgcggtttctgcccttcatcaagaagccagtctaggaccccctcacaagtgtgttctaatcctttaggccctgtgtcttttaaatcacgttttccgggaaggagtacaaactcttcagactaccaagcccgccatttaaattgggaacttcagaggccggagccctggagccggagaccctccccgacagcacaaggtcgcccgcagcccgcgcgcccccaccccctcgacctcttggaggtggggatcccctcagggttacctgggggccccgttaggaacacgtgccgggccatactggtgggcgggggtaggggttgcggtcaggggagcagtccaggttggggtcgcaattcaggtcaggtccggaccagggtcgcgactcaggacccgcccaccgcgtgtcgcaggccccgccc

SEQ ID NO: 11263 - DNA, 14918 bp, Homo sapiens
gtgctccatcgtgggtggggtaaagcggggtgggagccgatggtccgtttcctgaaggcacaggccagcttagcctgggtgctcagaggacctcggctggggtacacgtttgggggctgggagaccgttgctgaaggcagcgatcatgtggcggcggcactaggcggagtcagacggtcacgtgattgggaggggatcacgtgacggagggcggctgaggagcgcggggtggctgcctttaagtcacgtgacatgaggagaggtgggcgggtacctggaggaagctcgcggcgtcggtggcggtggcgcgcggcggccgctgagaccggggctttgagtcgcaccccgcggcccgccccccgccgccaccctcgcagatccgtgctttttcccctttgcttctctcccgtactgggtcagtcctgtccgcgctcgcgcgtcggtttgcgggtgtgcgcaggcgcggcaggggccattagccctttgggtgggcggtggagcccgggagcgcgcgggcgagaccatggcgggtagcagcactgggggcggtggggttggggagacgaaggtgatttaccacctggatgaggaagagactccctacctggtgaagatccctgtccccgccgagcgcatcaccctcggcgatttcaagagcgtcctgcagcggcccgcgggcgccaagtactttttcaagtctatggatcaggatttcgggtgagcgcaaggcctagataggaccggcgggggctttgctagagtggattgggcgacatggaggggcacacgtctactttgggccacactgggattttctggcctatggtggagcagattgtactatgctgaggtaggttgactatcccaggatggacaaggttatgcttggatagattgaggcacacggacagactaggatatcctaaaccagattagacaagattaggctttactggaataggtgggggcatactggtttatgttggagtattctagtctgtactgagtaaattgatccattgtctggttgtttagtacgttctcaggagtcctgtaacgcctgtaatcccagcactttgggaggctgaggcgggcggatcacgaggtcaggagatcgaggccatcctggctaacacggtgaaaccccatctctactaactaaaaatacaaaaaattagccgggcgtgggggcacgcgcctgtagtcccagctacttgggtggctgaagcagggagaatctcttgaacctgggaggcggaggttgcagtgagccgagatcgcgccactgcactccagcctgggcgacagtgcgagactccgtctcagaaaaaaaacaaaaaacacttgggccattatggactctactgggttgtattggttaatcctggtttctcttggggcaagacttggttttattggagcactcggtataggggcagacaaggctgttggggcctgtgctagcacaggcagccgtattgggatgttccaatctagactggtgcagacagctgcgtgtgggggcattgtaggctgtgctagaatagattgggctatcctagggtaatttgggacattcagggctatcttggactagattggcgtgtaaataatgcagagaaagcccttttgtgtttatggtctttggggctgagccttctgggtcctcaacctctgcttttttttttttttttttttttttttttttttttttttgagacagtctcgctctgtcgcccaggctggagtgcagtggcgcattctcagctcactgcaagctctgcctcccgggtccacgccattctcctgcctcagcctcccaagtagctgggactacaggcgtccgccaccacacccggctaattttttgtattttttagtagagacggggtttcaccgttttagccagactggtctctgacttctgacctcgtgattcgcccgcctcagcctcccaaagtgctgggattacaggcgtgagccaccgcgcccggcccaacctctgcttttttgaaggcaggctggattaagttgggatagcatgggttttagaagaactgaacaaactggactctagctagaaagattgtttgacatggggatgctgatactatcttgggagttatcttggctttaaggcaaggtttttctagttgtcagcaatgtaatcttggacaatttatttaaattttgtgtcttgatctcatctgtgacatggagaaaatcacagaatgaaatggttagttcacgtgtgtggcacacgggaaattcttggtgaatggtaattgtaattagcattgaggctgaccactctgtaaagtaggttatggtgatacagaataatttgcctcagagtggaccaagctgtgctgagattgtgttatgttgggaagaatcctacattatgctgagacgggttagtagtgactgggctgtgttgtcacgttgacagcaaatggattatgttgatatatatcctggctcccatgaccatattaggctaacgggttaattagacaaggtgtcctaatttggggctaaggttgtgtgtggaaagagagagaggaacaactagggtagagagtctgatgctttatacgtttattcatttagtcgacagtatttgttaatgcttaagtgtcagtgtgtggtgtgtggctaggacatggtgttgaccagagtaagtgttcatggtttgatgtcatggtcaagaagaaggggcaagtccggtccaccacagggaacccattggagagatgaccccaaggctgggctttgggatctgtcaggttgagcagattgctttgtgcagaattttgtgcccagtgaggcacaggggaatgggaaccccagcttgccctctccttgggagctttcagtctaatgaggaacttccattgtttgtttgatccaatgggtggtttttttttttttttttttttctgaggtggagtctcactctgcccaggctggagtgcagcggcgcaatctcagctcactgcaaccttcgcctactgggttcaagcgattctcctgctttggcctccggagtagctgggattataggtgtgcaccaccatgcctggctaatttttatatttttagtagagaaagggtttcaccatgttggccaggctggtcttgaactcctgacctcaggtaatctgcccactttggcctctcaaagtgctgggattacaggtgtgagtcactacgcctggcctctaatgggtgtttttactcaagaaaggacagtcttctagaaatgaattagagaaaactaaaggaaagtataagagtagaggctttgatgaggaccaaagccttttttggaaggtttttttttttttttttgagccgcccaggctggaatgcagtggcgcgatctcgacttactgcaaccactgtctcccgggttcaagcgactctcccatctcagcctcctgagtagctgggattatagacacccaccatcatgcccggctaatttttgtattttagtagagatggggtttcaccatgctggccaggctggtcttgaactcctgacctcaggtgatccgcccgcctcagcctcccaaagtgctgggattacaggtgtgagccaccgtgcctgacctttttggaaggtttgtaaggaacaggggtggggttgagaggaggccaccagccagtctcattagataggtatctcaggcagccgcatcagcgtgcgggattgcttttgaaactggactaagaggtttgagtcagactcaaggaagtctttggagcagcactgtgcccctgagggtgcgttagggagaggagaaataaggaaaggggattgagtttggagatttcttaggtgtcggagtgagttctttcaatgtaagagaagacctgaacagggcaggagaaagtcaacatcctggagccaggtgaagattgggagaaagtttgatgggggtcggggtggggatggttggtccagctcactgacctctaccttgtcgcttggcagggtggtgaaggaagaaatttcagatgacaacgcccgcctcccctgcttcaacggaagggtggtatcctgggtaagaggttctgacaccgaggaccaggccccctcagcattgccaagctccctcaagcctcagtctgtttctgtatcctccccaggccgcgcgttagcagccctggctctttacctcctgtctgtttggagagccggcgagaggccctcagccttctccttctggagtctctaatacttgctaggtttttttgctcttctccagctctctgagaccctttctcattctttcacttactgccacctgtcacaccctgactcccaagtgagccactgtttatcatttgcacccttctagctggtgtcctcagataatccccaacccgagatggcccctccagtccatgagcctcgggcagaactggcgcctccagccccacctttacctcctttgccacccgagaggaccagcggcattggggactcaaggcctccatccttccagtgagtccttcagattcttgactgcaggggagggaggtgaggagggaacccaggcctttggtaggggacgcctaggatccggagccctgttctcctgatgtgggttggaaaccatctctgcctgtccagccctaatgtgtccagcagccatgagaatctggagcctgagacagaaaccgagtcagtagtgtcactgaggcgggagcggcctcgcaggagagacagcagtgagcatggcggtgaggggcaggcctgggggccgggaagggctgggccagaccccagccttggtggggtgagcagggggaagcttggttcttgagcttcctgtccatatgtagctgggggccacaggactggtggcccctcaaggctggagcgccacctggccggatacgagagctcctctaccctcatgaccagcgagctggagagtaccagcctgggggactcggacgaggaggacaccatgagcaggtgtggctccgcacagctctccccagcgcacccagccccgtctcgtcttccagtcaatcctcttgttctttctcttggccccatgaccactttggcctacgtttgctctccttcccaacctcctggtaggttcagcagctccacggagcagagcagtgcctcccgcctccttaagcgccaccggcggcgaaggaagcagaggccaccccgcctggagagggtgaggggttcctacaggaaggctggtgctgggagaaggtggggcatgggctttggtttgggcggtgccaggacaccggcagcaccccagggttgaccctgggttattgaagggcactctggctccttttcccaccacagacgtcatccttcagcagcgtcacagattccacaatgtctctcaatatcatcacagtcacgctaaacatgggtatggggagagcctgtggctagggcgtggggagggcctggtctctagggttccgggcgtcctgtggcaggggctcctcttttcacatggcctctctccacagagaagtacaacttcctgggtatctccattgttggccagagcaatgagcggggagacggaggcatctacattggctccatcatgaagggtggggctgtggcggccgacgggcgcattgagccaggggacatgcttttgcaggtgtgctggggtagggccactgagctgccctgcacgggggccctcagcctctcccaccgtgtctctgacccacttgccgtcgcttccaggtgaatgacatgaactttgagaacatgagcaacgatgacgctgtgcgggtgctgagggacattgtgcacaagcctgggtgagttgccaagcaggttgccggtcctcagtcctctttttttttctctttcatgttttgttttggaattttaataagtactaagacagccgggcgtggtggctcgagcctgtaaacccagcactttgggaggcccagatgggtggatcacctgaggtgaggagttcgagaccagcctgaccaatgtggtgaaaccgtgtctctactaaaaatagaaaaattaagtgggcatggtggcacatgcctgtagtcccagctagtgaggtggctgagacaggagaatcacttgaaccctggggggtggaggttgcagtgaaacgagatcacgccactgcactccagcctgggcgacagagcaagactccgtctcaaaaaaaaaaaaaagtgctaagacataacgttcaaagtacatgaaacaaatgcatgacatagcaaataatactagagtaaatatccatgtcactgccatctagatcatcaaataggagattgctgataccctagaacttcctcctcagatgtcccttcctgctcccaaatgcctcactgccccaggggtagtcactctcctgacttctttggccatcaccataacaaagaaaagctttgcctcactggatagttaccacccttgcacgtatccttgaacactgcagtttcgttttacctgtttttggactttctgtgaatggaactgtacagcgtgtactctcttgtctcacttggcagtatgtttttaagagttttccatgttgatgagtcatccacattgtggtgccttccaccctcaccttctctagcccagccgcgatgtgcttgcttctccccctctttgtgtctcttaatccatccttgcttcagacccccgccctcctgaggcctcctcttcccctgcgcccttgactggacttctcttccccatagccccattgtgctgactgtggccaagtgctgggatccctctcctcaggcctatttcactctcccccgaagtgagtgacactcagggaggggcctgaagttgggggtgggggctgcccaggaggctggggccgggcctgtggtcatggggaatgggtgggaggagggtccaggcagaggtggaacaggaggctgagtcagggagggactgggctggcttttggggactgagaatgggtcattttggtgccatctttgtcccagatgagcccatccagccaattgaccctgctgcctgggtgtcccattccgcggctctgactggcaccttcccagcctatccaggttcctcctccatgagcaccattacatctggatcgtctttgcctgatggtgagccgccagcccacctcatcccaccctcccagcagaaggctgtcccgcagtggtctgatccattgcccttgtgggagcgatccctgactctggttacccgttgtctcctctgccaggctgtgaaggccggggtctctccgtccatacggacatggcatcggtgaccaaggccatggcagctccagagtctggactggaagtccgggaccgcatgtggctcaagatcaccatccctaatgcctttctgggtatggctgggtcctgggcaggtggctggagaaggggaggaggtggtgaccaaagccaggaatggcacaggcagaggcgagagcaggagttggaagaagaacctgaggcctttttccactgtgggtgctcccaggctcggatgtggttgactggctctaccatcacgtggagggctttcctgagcggcgggaggcccgcaagtatgccagcgggctgctcaaagcaggcctgatccgacacaccgtcaacaagatcaccttctctgagcagtgctattacgtcttcggagacctcagtggtggctgtgagagctgtaagtccccctgccccaactctgggagtgtggctttgcctaccttgttctgcctctccaaccctagacctagcccagaaaccgcagccagggccaccatggatggtcgagcagtgtgtgtcccgcactaggtcctgcactggccgaggatgggggctgacgtccacccatgtgctgctggacaagccatgtgccaggtgcaggactgtgtccaccgggggaaggtgcacctcttacctgagtcccgcaaagacgtgggctagtggctgtgcccctgccctcatggcagaagtagatgggagtttcttgtcagagacccttgtgaacccctgttttgagccccatcgtgggtgggtctgggagaactgttcccagttcctctccattcggtgtcttggggccctagcctcttgaagcagtgatttcttcctctcctcccttgctttccagacctagtcaacctgtctctcaatgacaacgatggctccagtggggcttcagaccaggataccctggctcctctgcctggggccaccccctggcccctgctgcccactttctcctaccagtaccctgccccacacccctacagcccgcagcctccaccctaccatgagctttcatcttacacctatggtgggggcagtgccagcagccagcatagtgagggtaagtcatccccacatacctgtacggccaggatctgagggtggatgagaggggagccagggaggagcctgggtgaggactcagttgcccctcccctccctccacaggcagccggagcagtgggtcgacacggagtgatgggggggcagggcgcacggggaggcccgaggagcgggcccccgagtccaagtccggcagtggcagtgagtctgagccctccagccgagggggcagccttcggcggggtggggaagcaagtgggactagcgatgggggccctcctccatccagaggctcaactgggggtgcccctaatctccgagcccacccagggctccatccctatggaccgccccctggcatggccctcccctacaaccccatgatggtggtcatgatgcccccacctccacctccagtccctccagcagtgcagcctccgggggcccctccagtcagagacctgggctctgtgcccccagaactgacagccagccgccaaagcttccacatggccatgggcaatcccagcgagttctttgtggatgttatgtagcccactgtggggccaggctgggccgggcgctcctggtgtgtgactgggtgtcctggccgtcatgtgcttgctcttacagtgcctgggctcagcctaccagctgctgccatacaggagattgtggccactgtgactctcaccagcagtgcctggttcctcccccttccctcaggggtagacaagggacctttgattatttttagctttgtttttttataagcctttttgggggttaaaatagagtttcttacatttttgggacttttttaataggcatttcctcttttatatgaagaattcccatccattgggccccttctaaccccagaatgtgacctcctcctccagttacccacagccctgccctttgcagggttgggggtggtcagcggtaccccggggttaggcatcctagacagcagcctgaggaagctgggagatttgggccatgtagctgcctttgttactctatttattttagtcacttgtataaaacaccaaataaagcaatagaggcaaactccccacgcctctggctcctttctttgggagggaggcaggcagcagggggaaagaaccgtcacacaggagcaaagcatgactggctagaaatttttattatttgcgaggcagtaagtgctcttgagagcaggcacagtgctgggaacactaggccccttcgggacaaaccagggccttaaggaaaggggcttcggctttggcttgagggaaggcacataactgggacaggccctggccgggagtattcagaagccaagtgggttgctggtgaccacaccaccccgctccaccaaggccttggagatgcttttgaagttgcggtagagctcttgctgccaggggtcagactgcagggcggccatgccctctcggatccgagctgcagcctggggagagggaaggaggggttgggcctgcacctccagccctcacctgagcttggcagccccgagtctcacctcgatacaccaggtgtcacagagcattttctcatgctgggccgtggggtggccctcactcagggatcttgaggccctggcaggaagcaggagatgaaaataaatctgggccggctgggatccaggcccaggccccctgcggctcaggcattccctgcctgcctcctcacctcgagagaaccaccaccatggcatagaggtcgatggccccgtctgccagccgctgcagcagaaactgttcatctgtccggtaggtggggtgggggtgggggtgggggcattagtctcaaggagaggaaagggaggggcggaatggtgtagagctcacttactgacaatccccttcttgtgttttatcagcttggcctccaccacagtggcaaactgctccagagcccgtactgccttaagagatggggacagtgcggggctcagaggggccatcggctgcagtccctgatgcaggctctcctggacccctggccgcttaccagctcgccactccgactcaactccgggtggacaagtccgctgagactcaggccgctgcccagccctgcccgcctgagaggaagagggagaatgactggttagttgccatacaccaccctgccctcccctggctctggccctaagcctaccgcctcagctgtttgcctgcctctcctagcaggaggccagcattcccaaagggattctttagagcactgccaagcccagagagctcctttcctttgtcctatgggggaagagggtccagcagtcaggactcactgtcctccccacctctacccccacccaattctctgtcttaccatacagccctgcagagccacaaacagccgaagaatgtcatttgtcccctcaaagatccggaagatgcgaagatctcggagcacacgctctactccaggttcctagcacagggccacacaaattatatgcccgtgctgagatgtgcctacccacccctggcccagccgaggctctgcagaagaccgtcctgtaccttcatgaagcccataccccccatgatttggatgcattcatctgtcaccttccaggctgcctcctagggacaaagaacagatgagactggttttgggagctgagcacccaaactggactccctcccagcatgcctgggacctcaccgagccaaagattttgctgatggcggcctctatctggaagtccgtggctccctggtccatgttagcactcaccatgtaagccatggactgaggttgcatagttgggacatgggaaggaaaattgcaaagggctttgtcagacttggcctcatcacccagatctccaagataagggctgacctagcttgtcaggtcaggcagatacttgttctgggtcagttcatcaggtgcttccaggtatttgttttcttaaaaggggtggatgtaagggatgaggtagaattaacttctggtactgctggcaggcacctgagcagaacatcattgctgtctctcttcgcagaagctgagctgactatgcctccccgcatcccctagggcattggtgtaaagctggagacccactgccccaggtgctgctgggggttgtagtctgacccgactgggaagaaagccccagggctccagggagaggggcttgggaggccctcacctcagttacatactgcagcataaccatccgtgccagcttctcctggatcagcccaaagttgtgaattttctccccaaactgggtacgattagtggcatgatctacctggaagagggtccacacatcccgctgtggttcagtgtggttctgcagtctccctaggagaggggctgggcttgcgccagagggatgggttttgcatacaaccagagttcagtctacgctggatggagacctaagctagcaagtcgggctgctggtaggggaggagtttctagtgtagggagtgcctgcaagtgatcagggacacatggcaagggggacagtgagacttctgtttgggttacctagggactcgggcagggtactcaccgccttagcaatgatgcctctcatggtacctgccagggccgcagccatgccaaaccttccattgttgaggatgtgcatggcaaccttgaagccactcccaacctcacccagcacgttctccgatggcacccgtactccatcaaagaacacctctgctgtgtttgaagccttgatgcccatcttcttctcagggggcccactgtgtcagggcagtgtgggaaagcagaggtgtgttcaacaggttgtcactgggggaaaaactgctccttcgctccttatgcaccagggaggaatgacgaccactagactattagaggctacagccaccacttcccctcaggccctgagggctaaggaggcctggctatgtcctattttgtgttggacttggttgctggagccaaaactttagctcagttgcatacatattagtcccaaaggccacattcagtccacctgctttggcttttgcacacgtccccagggtgacttgcaacagccatctgcccaggagcccagtcctgcccctcagtcctaagctcccccaacccaaattcactcactgggtaatgcccccgaagcccctctccaccacaaaagctgtgatcttctccttcacggctcctgtggctggatctgtaactggtgtcttggcaaagaccgtgaagatgtctgctaggcccccattactgtggaagaatgggatattcagggcgtggaggacggggagcagtggggcctggaattgggcggaggagaaggggagaaatgggaggcaggttgcctgatccaaagcttgcttccattgagggtatagtattttccacaggggctgggcacagcagaggttcggatggaggctgcatctgacccgcttgagggctcggttagacagaaagcggccacagtctcccctgttggggagagagctactttaccccaagttctgatgagcttcaaagtcccctcggcccacttccccatccctccagcaggcagttcccccttaacacctgggagtatccagttcttttgcatgtcccaaccagcacactgtgatgcctccccaaaaccttcccccaactgaaatgctcagccatctgataatctaagtgccaactggcctaatctgtgccaagcccagtgtgccccccaatccctggctctcctagggttgcctcaccagatgccagcttggggaggtatttttctttctgggcctttgtgccaaagagcaggatgcctttgaaaccgatgctctgatgggcccccagggtaatgcccacgccaaggtcatgcatgcccacgatctccaccaaacgggcgtactggaggggaagcaggaatctggggttgtcactggctgcagggggacctgaccttaacaggagagtgtgggcaacagggcagttcctggcctagggcagtgcctgacctgggccatccccagtgtgtagaaaagaagtggggtgtgcaaagggcacagcagagaatgctggtctgtcttaggtctaggtaggagggtgacttgctactagtcagtctattgttaggcaatccccaacttagagatttgtaaggacttgggaaccagggtgaggcccatggctcaggcctaggggactgcatgtaaattgtgttatgtttggacagttaacatccatcccacaggcacccagggcaggtgcttagaagagaccttagccctagtctctaggtctatggcaaaagagctgagtctgccaagctggggtatggcatactgggatgtggcgatagggcgccctcacctgggtgttgcaaaggcccacaccacccagctcactgggcacttgcagaccaaaggcccccagctccttgaggccctgccaagtggtctcctccaccatctccagagcgtcattcttggcgggatcgttcacttcctggggaaggcacaggatcccacatccaggctccttttgagcttaacatctccaaacacctcaccagggaccaagccccgagtcattccttacctcgaagaaacgggacacaggctccaccagctctttaagaaactgtgtctgctcttcgttgagcactgcagagggtgggggacaggctggtcaggccaggctggcaggggaaaccaccctggccccacccagctctgattatcccttcccttaccggacgggtatgggaacacctgatctgtggtgagctggcctttgaacattcccacagcaaaggacttagattcctgggcagagagaggcaaatttcagggctctggttgggtctggctaaggtccacctggcctcggggctacctaccgccttggccggttttttcctggtcagagcgtcagaggggtgggaatctgacttgtccagagccagctgggaaaagagacggttagcaagttcagggaagggacttccgctgtgtcaaggggagaacaggcgagagccgcgcggggaggcggcgcgaagcggtgacctttcccctagtttcgccctagggcaccctggcttgccctttcccctactttcggcgactgagcagtaggcaggtacctggcaccaagagggagatccctgccgatggcgggcgccgaagcggaccgccgctcccacacccccttgccaaggctgcggtgacttacctgagcggcacccccggcatagggccgccgggcagggccgggccggggctgccccaggagcgccgtgagccgcgagctgtggggagtgggggttcagtgccggcccggtgcccagggccgctgcccaccgtccctcttgtcacacacagaccttccgcccccgagcctcagcagctgccgccccaagctcgcggccatccgagccgcctgcatctccgaatctctccgggcgccgctggctcgagctctgacccagctctggcgtcctgcacgcccgcgtcctgcacgcccacgtcctggcgcccctaaccctgactcatcgtccacagtgc

SEQ ID NO: 11264 - DNA, 4456 bp, Homo sapiens
ctgccaggctgtgaaggccggggtctctccgtccatacggacatggcatcggtgaccaaggccatggcagctccagagtctggactggaagtccgggaccgcatgtggctcaagatcaccatccctaatgcctttctgggtatggctgggtcctgggcaggtggctggagaaggggaggaggtggtgaccaaagccaggaatggcacaggcagaggcgagagcaggagttggaagaagaacctgaggcctttttccactgtgggtgctcccaggctcggatgtggttgactggctctaccatcacgtggagggctttcttgagcggcgggaggcccgcaagtatgccagcgggctgctcaaagcaggcctgatccgacacaccgtcaacaagatcaccttctctgagcagtgctattacgtcttcggagacctcagtggtggctgtgagagctgtaagtccccctgccccaactctgggagtgtggctttgcctaccttgttctgcctctccaaccctagacctagcccagaaaccgcagccagggccaccatggatggtcgagcagtgtgtgtcccgcactaggtcctgcactggccgaggatgggggctgacgtccacccatgtgctgctggacaagccatgtgccaggtgcaggactgtgtccaccgggggaaggtgcacctcttacctgagtcccgcaaagacgtgggctagtggctgtgcccctgccctcatggcagaagtagatgggagtttcttgtcagagacccttgtgaacccctgttttgagccccatcgtgggtgggtctgggagaactgttcccagttcctctccattcggtgtcttggggccctagcctcttgaagcagtgatttcttcctctcctcccttgctttccagacctagtcaacctgtctctcaatgacaacgatggctccagtggggcttcagaccaggataccctggctcctctgcctggggccaccccctggcccctgctgcccactttctcctaccagtaccctgccccacacccctacagcccgcagcctccaccctaccatgagctttcatcttacacctatggtgggggcagtgccagcagccagcatagtgagggtaagtcatccccacatacctgtacggccaggatctgagggtggatgagaggggagccagggaggagcctgggtgaggactcagttgcccctcccctccctccacaggcagccggagcagtgggtcgacacggagtgatgggggggcagggcgcacggggaggcccgaggagcgggcccccgagtccaagtccggcagtggcagtgagtctgagccctccagccgagggggcagccttcggcggggtggggaagcaagtgggactagcgatgggggccctcctccatccagaggctcaactgggggtgcccctaatctccgagcccacccagggctccatccctatggaccgccccctggcatggccctcccctacaaccccatgatggtggtcatgatgcccccacctccacctccagtccctccagcagtgcagcctccgggggcccctccagtcagagacctgggctctgtgcccccagaactgacagccagccgccaaagcttccacatggccatgggcaatcccagcgagttctttgtggatgttatgtagcccactgtggggccaggctgggccgggcgctcctggtgtgtgactgggtgtcctggccgtcatgtgcttgctcttacagtgcctgggctcagcctaccagctgctgccatacaggagattgtggccactgtgactctcaccagcagtgcctggttcctcccccttccctcaggggtagacaagggacctttgattatttttagctttgtttttttataagcctttttgggggttaaaatagagtttcttacatttttgggacttttttaataggcatttcctcttttatatgaagaattcccatccattgggccccttctaaccccagaatgtgacctcctcctccagttacccacagccctgccctttgcagggttgggggtggtcagcggtaccccggggttaggcatcctagacagcagcctgaggaagctgggagatttgggccatgtagctgcctttgttactctatttattttagtcacttgtataaaacaccaaataaagcaatagaggcaaactccccacgcctctggctcctttctttgggagggaggcaggcagcagggggaaagaaccgtcacacaggagcaaagcatgactggctagaaatttttattatttgcgaggcagtaagtgctcttgagagcaggcacagtgctgggaacactaggccccttcgggacaaaccagggccttaaggaaaggggcttcggctttggcttgagggaaggcacataactgggacaggccctggccgggagtattcagaagccaagtgggttgctggtgaccacaccaccccgctccaccaaggccttggagatgcttttgaagttgcggtagagctcttgctgccaggggtcagactgcagggcggccatgccctctcggatccgagctgcagcctggggagagggaaggaggggttgggcctgcacctccagccctcacctgagcttggcagccccgagtctcacctcgatacaccaggtgtcacagagcattttctcatgctgggccgtggggtggccctcactcagggatcttgaggccctggcaggaagcaggagatgaaaataaatctgggccggctgggatccaggcccaggccccctgcggctcaggcattccctgcctgcctcctcacctcgagagaaccaccaccatggcatagaggtcgatggccccgtctgccagccgctgcagcagaaactgttcatctgtccggtaggtggggtgggggtgggggtgggggcattagtctcaaggagaggaaagggaggggcggaatggtgtagagctcacttactgacaatccccttcttgtgttttatcagcttggcctccaccacagtggcaaactgctccagagcccgtactgccttaagagatggggacagtgcggggctcagaggggccatcggctgcagtccctgatgcaggctctcctggacccctggccgcttaccagctcgccactccgactcaactccgggtggacaagtccgctgagactcaggccgctgcccagccctgcccgcctgagaggaagagggagaatgactggttagttgccatacaccaccctgccctcccctggctctggccctaagcctaccgcctcagctgtttgcctgcctctcctagcaggaggccagcattcccaaagggattctttagagcactgccaagcccagagagctcctttcctttgtcctatgggggaagagggtccagcagtcaggactcactgtcctccccacctctacccccacccaattctctgtcttaccatacagccctgcagagccacaaacagccgaagaatgtcatttgtcccctcaaagatccggaagatgcgaagatctcggagcacacgctctactccaggttcctagcacagggccacacaaattatatgcccgtgctgagatgtgcctacccacccctggcccagccgaggctctgcagaagaccgtcctgtaccttcatgaagcccataccccccatgatttggatgcattcatctgtcaccttccaggctgcctcctagggacaaagaacagatgagactggttttgggagctgagcacccaaactggactccctcccagcatgcctgggacctcaccgagccaaagattttgctgatggcggcctctatctggaagtccgtggctccctggtccatgttagcactcaccatgtaagccatggactgaggttgcatagttgggacatgggaaggaaaattgcaaagggctttgtcagacttggcctcatcacccagatctccaagataagggctgacctagcttgtcaggtcaggcagatacttgttctgggtcagttcatcaggtgcttccaggtatttgttttcttaaaaggggtggatgtaagggatgaggtagaattaacttctggtactgctggcaggcacctgagcagaacatcattgctgtctctcttcgcagaagctgagctgactatgcctccccgcatcccctagggcattggtgtaaagctggagacccactgccccaggtgctgctgggggttgtagtctgacccgactgggaagaaagccccagggctccagggagaggggcttgggaggccctcacctcagttacatactgcagcataaccatccgtgccagcttctcctggatcagcccaaagttgtgaattttctccccaaactgggtacgattagtggcatgatctacctggaagagggtccacacatcccgctgtggttcagtgtggttctgc

SEQ ID NO: 11265 - DNA, 4682 bp, Homo sapiens
gccgctccccgggggaggggagcggcttggtgcgcctgcgccagcctgtggctttctgggaatcaaagttccggaggttcatgcggtcccttttccgctgttcccggacggactacaaaacccttggtgcactgcgcctcggcgccggcggggggaggagggagagaagaggagggagggaggagagaggaggaggaggaggaggaggagggagcaggcggccggcggcgcggggggagggggcccggtccgggagtgcgggaggcagtggtagagggaggtggcggcagcggctagcggactcgagtctcaaccgggctgaggcggacacttctgtggagcgaagcagtgggagcatcgagcactagaggcggcaccgggatccccggctccggggaggggggcgccggaccgggaggaggggagggggcgatgctggaagccatggcggagcccagtcccgaaggtgagctctcgaccggtgcagagcgctgagccggcggggggcgggcgaggaatcaattggcaaacttggaggtcgagccccggagcccagcgggggagttcggggagggggtcgggaggctggccctggaggtgggagagcgacgagttgagagaccttggagaaagaggagtgggaaactgggctggggtagttggagatcagacggtgtgggggtgcgggggataggagcttgaaacccggagcctcgggggttagggcccgaaagggccaccggcagattggggccctggaactggaaggttaggggaatccagtggccggagagttgctcaggagggaggacgtagaagaggctgagtgaggggcccggtagttcgccgaggtggggtagtttgtggcggtggtaccggagctccgagtagttgccgccggagaatgcccggtgattgtcggagaggtgggcaggtagttgtggggagaagagggggtctgggtattgtctacggcagacggacctgtaccggggggtagttgtggagagagcgagccaggaagcgaggcgagctgggtagttgtagggggtggtggggcggggtggggggggttaagaccggcgacttgtcgggcgggggggtagggttggtccgcgagggttaagagcctgggagttgctgagggtgaggggggcatcggcggcagcagcggtggctgctgtggagagagagagagagtggctggttggggggaaggggccagagttgaggggtccatagcctagtaactgggtggtgagtacgggggcggaggggggggcggcggccggagagggctaggaacagggccggggggcccggtggggagcccgaaaagctggagacggggaggggccaaagccccggatgggggcggagggacggcgaaattgtggggagcgcggtatgggcgggtgggggggcaggtgggggccgcgtccgggttagagctcccgggtctgtcccggccgtgaagtagcgttggatgcgtgtgcctgtgtgtgtctggggtgggggtgaggggcgcgccgggccgcgtgctcgagtagaaggggccggagggcggggagcggttcggcgtggtcatcctggaccctgggggctggcgggcggcgtgtgcggtctcggagggcccgaggcggtggagcgcggccgggtaggaactcggggctccgggcgcgtgtgaaggacgggggcggctggcggcggcccggacgcggccccgggagcggtacggtggggtggggcgctgagggatccgagtagactggagtcgagagagaccgtgagttgggggggcggggcgccgggcctccggttgggggaaggggagcgctatagcgaggcctcagagggcgccgcgcccaggctccgcccctcgcggggcggaagggggagccggggcggatccaacacagctgggggcctgctggcctggcagagggacctgggagagcagggggttcacttaggaacaacggggtttagagggggagttttacacagattgttcctagtgtcttgactcagcttttattgcttttccagatccacctccgacccttaagccagagactcaggtgaggtttgccttacctttgcagcctagtagccctgcctgacaacgccccccgccccccttttctagacctcacttagggactgtgtttctgggaatgccattcttaaactgtgtggctttgcatgtgatccatatctccttcctttcagccaccagagaaacggcggagaacaattgaggatttcaacaaattctgcagttttgttttggcatatgctggttacattccccctagcaaagaggtaggggcaagagaattactgacttgaggctggtgtggtgggactatagagtgactgttgttcaaacagaactgtattgctttatagaaggaggcccctagaaattatatgtaagaccagggaagttggagactcttagggctgtggtaggaaagctggtatgcggggagtggatggccgggatagctagcttgaacagcagtgaaaaggaagggggatttggagtcgctggttgagattttggcatagtcttgaggtgctgtgaatggaaggtgtttatggataaattttagggagatgaaaatggtaacaaatgaggctatacagaaaaagagctaaggacataacggctccggtctgggtgatacagtgttccacaggccctgggcaggggcagcggtgaggtgtcagacttgagggtagaggtaacacggactggtcaagaggacatgctgatgggaattggggtggggagaagtttttggagtacagtgggatttagtggttgaggtaggacattttggggtaaatccagtcactccttttcaagctgggtttgtggaggggctgagatgacactggggttctgctgaccctggtctcttcccccttttaaggaaagtgactggccagcctctggctccagctctccattgcgaggagagagtgcggccgacagtgatggctgggactcggccccctcagatcttcgaaccatccagacttttgttaagaaagcaaagtcatccaagagaagggcagctcaagcaggtcccacccagccaggacccccaaggtccactttctctcgtctgcaggcccccgacagtgctaccttgcttgagaagatgaagctcaaggactctctctttgatctggatgggcccaaagtggcatctcctttgtcccccacatccctgacacatacctcccggccccctgctgctcttacccccgtgcccctttcccagggggacctctcccatcctcctcgaaagaaggaccgaaagaaccgaaagttggggccaggagctggggctggctttggggtgcttcggaggcctcggccaactcctggggatggggaaaagagatctcgaatcaagaagagcaagaagcggaagttaaaaaaggcagaacggggggatagactcccacctcctgggcctccccaggcaccccccagtgatacagactctgaagaggaggaggaagaggaggaagaggaagaagaagaagagatggcaacagtggtagggggtgaagccccagtccctgtgctgccaacaccccctgaggctcctaggccccctgccacagtgcaccctgaaggagtccctcctgctgacagtgaaagcaaggaggtgggcagcactgaaacaagccaagatggagatgccagctccagtgaaggcgagatgcgggtcatggacgaggacatcatggtagaatcaggtgagaggtttgggctggggcgaggggtttgagggtgttgtggatccaacagctcaggcagaataccaaacaaacctttttttccccaggtgatgactcatgggatctgatcacatgttactgtcgaaagccctttgcagggcggcccatgattgagtgcagcctgtgtgggacgtggatccacctctcctgtgctaagattaagaagaccaacgtccccgacttcttttattgccagaaatgcaaggaactgaggccagaggcccggcggttaggggggcctcccaaatctggagagccctgatggcaccaactttagcctggaacttccaaatgacaacatgatttgggaactgagcctcagggtcctcagcctatcccctggagcttggatactgtctgcacttcaaggcaggaattctcaagggagacttgtttgaaaatgagtgtctcactttcccaccctatccttcctccccactctgtggacttgaaattgaatccattacggttggggatgggaggctgtctgtgtcccgacacataatctctgtctcttggacctgccaccatcactttctgggtcaggattggaattgggatggaatgggacagttgtctataaaactctagtgtaaatattagcactcccctccctcatcttttcttctatttcactccccatttattttcttctacaccggttgtatttttaattttggacttcccctattgggcatggcagctcaaaggtggagtactagagcctggccaagtgaggaaggaaagcagaaaggtgacgattctcactcacctcttttgtttttaataatatcggccgctgtttgtacagacagcctgcgtgttgtaaataaagcagagtgggctcttttgtgtttata

SEQ ID NO: 11266 - DNA, 242 bp, Homo sapiens
tcacgaggtcaggagatcgagaccatcctggctaacacggtgaaaccccgtctctactaaaaatacaaaaaattagccgggcgaggtggcgggcgcctgtagtcccagctactcgggaggctgaggcaggagaatggcgtgaaccccagggggcggagcctgcagtgagccgagattgcgccactgcactccagcctgggcgacagcgagactccgtctcaaaaaaaaaaaaaaaaaaaggc

SEQ ID NO: 11267 - DNA, 5754 bp, Homo sapiens
aagaccatcctggctaacacggtgaaaccctgtctctactaaaaatacaaaaaattagctgggtgtggtggcgggcgcctgtagtcccagctactctggaggctgaggcaggagaatcgcttgaacccaggaggcggaggttgcagtgagccgagatcgcgccactacactcagcctgggcgacagagtgagactccgtctcaaaaaaaaaaaaaaaattacttagacatggtggcacattcctttaatcccagctacttgggaggctgaggcaggagaatcgcttgaacccaggaggtggaggttacagtgagccgagatcgcaccactgtgctccacactccagcctgggcaacagagtgaaactctgtctcaaaaaaaaaaaaaaaaaaaaaaaaaaggaataaaggggatgggtttgacatctgacaaaatgctgctgctgccatccgcttctgcaaaacctcaagaatgaaatgtccttcccatggcccacacgaggccctgcacgagctgcttcatccccttccaaacctcctctcctctctcttcccctcctcactctgctcagacacacgggcctcctcactgttcctccaacacgccacgtgtggtctgccccagggcctttgcacaggccatgcctctgcctggaacacctgcccccagattctcctatggctgacttctcacacttgggtcttagtgcatgcatcacctcctcagggagggccccctgcccacccccagtgaatctagccccattcaggacagtcatctttattatgcactgattgtatactaagcccagagacttcaactgtggtttctttttcatcctcccaataaatccatccatccatccgttcactcagacatgaaattctggaccctccaattcaggatctgggccacccagtgcctagcttttttttttttttttttttttttttgccgacagagtttcattctgtcacccaggctggagtgcagtggtgcaatctcagctcactgcaacctccgcctcccgggttcaagcgattctcctgcctcagcctcccgagtagctgggattacaggtgtgccaccacgcccggctaatttttgtatttgtagtagagacggggtttcaccatattggccagactggtcttgaacacctgacctcaggtgatctgccctcctcagcctcccaaagtgctgggattactacaggcatgagccactgcacccgtcagcctacttcttgtgttcattcattcattcattcattcattcatcattcagcaaatgtctatgagcgcctactctgagccactgaaccagctgggctggccctgggggagaatcgacttcccctgcaaattcactctcatcagatccccaggctggtctaggattgtttagatgccctcacgttggggaactcattccttactaagaataaccaccaccaataccaaacagtctcaagtaccaccaatagtgctgagttctcagggtgactacagcatctgctcccaagcccagcccagcccatatggtgtgtgctgtgtcaaagaacctgggttcaaatcccatgtccttttctaacccttggacaagcccctacccattttgtgcctcggtttccctagctgtaaaatggagatagtagtgcctctcttgtgggctcagcaccaggcctgttacacagctggtgcttaataaatgtgtcctgttacttaaggtctgatatgtgtagctcctgtcgtcgccgtccatgggggtgagtggggtggggaaggggtggtttgagtttctgcacatcaggacacgaggcgcggtccatgcaaatgaaatgcaaatcccatgcaaataaatctctgggtggtgcaaggctggaggtacaaggtgcacgcatttggggggcgcctgggaaccccatgaatcgagcccaggcccggaggtgctgacccgcatccagcccggctttcagtgctcggtgtaaatgtttacacctggccggccgccaggctccacgccgccccacactaggcagccaggagggggaatgtaaactcgggctgggggccgcgggacgctcgggaggagcccagacggagtcgagtgtggtgggtgtgtacacgtgagttattaaacaccgactgtatgcagtgaggaggatgccaccaggcactcacagcaccaagtaactggtgcccgaatgggtaaagctcagggcattcctgggggcccactagcgcccctgcaccagccagaggttgaagtgaatagggtaggcagccatggaaggctccctggaggaggcaccctccaaggtgagattgcaaggggagtgagagctaggtacatgtgacttcacagcctgtaatcgccagctctttgggaggccaaagtggaaggatccttgagcccaggagtttgagaccagcctgggcacgttgtgagattcccctctctattaacaaaaacaaaaacaaaaaaaattaaaaattagccaggcatggtggctcatgcctgtagtcagtcctagctacttgggaggctgaggtgggaggatcgcttgagcctaggaggtggaggctgcagtgagctgtgatcacaccactgcactccagcctgggtgacagagcaagaccctgtctcaaaaaaaaagaaagagagagagaaagaaagaaaggaaagaaaggaagagaaaagaaagagagaagaaaaaggaaagaaagagagagagagagaggaggctgggtgcggtggctcatgcctgtaatcccagcactttgggaggccaaggtgggcggatcacttgagttcaggagcttgagaccagcatagctaacagggagaaaccctgtctctattaaaaatacaaaaattagccagtcatgctggcaggtgcctgtaatcccagctactcagggggctgaggccggagaatcgcttgaacccgggaggcagaggttgcagtgagctgagattgcgccactgcactccagcctgagggacaagagtgagactccatctccaaaagaaaaaaagaaaaagagaaagaaaggggagtgggagtggggagggagggaagaagtgttctccatgcaaggacctatctgtgcaaaagcccagagctgggactccatgtccagggcagctctggtccattgctgcccacttctgggcctgcttatccatctggatgggaaacaggctcagagaggggcagagtcaatggaggacaccagcatgtagggaacagtgtcagccccagattcctgcctccagactgtcctaaacaccaccctccccgcgcctttgtcccacactgccacctgccgggaatgacctctcctcctttcactcttccccctggctcctcagctgcagccgctccggcctccttgctgttcctgggatacgccacactcagtctggcctcggggcctttgcactggctgtgtcccctgcctgtgatgccattctcctctgcctggccaactcctacgtttattcaagtctggaccttgtcatcggctcctcaggaaggcactccgggacccccagatgggggcggttccctgtgactcctggcacggaggccaaccccttccttgttcaatggttccttgagggaccattcccatgtgattatcgaccattcggcaggcgttcaaagtcaaaggccccacactgagtcctggcccagcgccctgtgcccgttggctgctggagggacagacggggcgtgcggctgaccatcccgtgcccgcaggctgaggatgcagcgctggaaggcggcggccttggcctcagtgctctgcagctccgtgctgtccatctggatgtgtcgagagggcctgcttctcagccaccgcctcggacctgcgctggtccccctgcaccgcctgcctcgaaccctggacgcccggattgcccgcctggcccagtgtaagctcctcctctgtgtggggtcagatacccccaacgtaaggggtagaatttcaggcagtggagtgggaggtggggggggtgtcataggttttttaaagatagggccagccagcccccttgcagggaggcagggacagacatcctaaaagattattcagggcaaggcatggtggcgcctgcctataatcccagcactttgggaggctgagacaggaggatctcttgagcccaggagttcatgaccagccagggcaatgtagcgagaccgccatctctacaaaaaacttcagaaattagccaggtgtagtggcgcacgcctgtagttccagctacttgggaggctgaggtgggaggatcacttgagcccaagagttcaaggctgcattgagctatgattgcaccactatactccagcctgagcaacagagcaagattctgtctcaaaacattataataataaatacattttctaaaaaaagatggggtggagggaggttgcaaattcccccaatggcctggtggagctagggtgacttctgggaactggggtctttcggctcagctgtcacaaggaattaggctctgccctgaggtcccgtgggggccagatggagattagacctgggcattcgcctggttggcccccgcggcgcagcagggggggcggtgggaggagagagaggctggatctgaggtcccagtgacctgccccaggggacagggaccaaggggaggcgggagatggagcaggagctaaaaaccggaagaaaggcccagagattcgaaggggtgaggaggggtggagagaggagagacggggctgggggcacagacacgggcaaaagtgctgctatagggacacagaaatgcccaccctgagggcaagaccctcgcccaactccccaccaatccctaatgcctgccccaccgcaggtgctgtggggtgagggtggtgcgtgggccctgacccctgtgcccacgcacatgtccatgcgtgcgcctgcgcgggcatctgaggcgtggatgccggcagggtgcgtgtgcagcgcctttgggtgtgggccacgagtacgcccatgtgcgcgtctgcgcccgcccctgccagcccacacaatcctcttttcttgtccttacaatgcacaagggtggcctccagcacgagctccacttctgtcctcccaccacttccctctctgcaagcggcgtgaagtccttcctaggactctgggacagagacccgggcgggacccccaaaatccagtgctccaggacttggggtgcggggggcaaagcacgaatggaggaatttcaggcactgcggagggtcagggcccatgggcgggtgcctgtctgccctactgcaaaaagcgagtggccactgactccccaagtccccatgttctaggctcctggtggaatttcaggctggggaccttgtgttctagcccctgtgcaagcagccagcccccgttgcagggaggcagggacagacatcctaaaagatgattcattgttgccaggtgcggtggctcacgcctgtgatcccagcactttgggaggccgaggtgggcggatcacgaggtcaggagatggagaccattctggctaacactgtgaaaccctgtctctactaaaattacaaaaaaattagccgggcgtggtggcgggcgcctgtagtcccagctactcgggaggctgaggcgggagaatggcgtgaacccgggaggcggagcttgcagtgagccgagatcgcgccactgcactccagcctgggcgacagagcgagactccgtctcaaaaaaaaaa

SEQ ID NO: 11268 - DNA, 294 bp, Homo sapiens
gcgcggtggctcacgcctgtaatcccagcactttgggaggctgaggcgggcggatcacgaggtcaggagatcgagaccatcctggctaacacggtgaaaccccatctctactaaaaatacaaaaaattagccgggcgaggtggcgggtgcctgtagtcccagctactcgggaggctgaggcaggagaatggcgtgaacccgggaagcggagcttgcagtgagccgagattgcgccattgcactccagcctgggtgacagcgagactccgtctcaaaaaaaaaaaaaaaagaagt

SEQ ID NO: 11269 - DNA, 196 bp, Homo sapiens
  misc_feature (106)..(106): n equals a,t,g, or c
tctactaaaaatacaaaaaattagccgggcgtagtggcgggcgcctgtagtcccagctacttgggaggctgaggcaggagaatggcgtgaacccgggaggcggacntgcagtgagccgagatcccgccactgcactccagcctgggcgacagagcgagactccgtctcaaaaaaaaaaaaaaaaaaaaaagaaata

SEQ ID NO: 11270 - DNA, 100 bp, Homo sapiens
ctgaggcaggagaatggcgtgaacccgagaggcggagcttgcagtgagccgagatcgcgccactgcactccagcctgggcgacagagcgagactcccctt

SEQ ID NO: 11271 - DNA, 2364 bp, Homo sapiens
ctcactcctgtaatcccagcactttgggaggccgaggcgggcggatcacgaggtcaggagatcgagaccatcctggctaacacggtgaaaccccgtctctactaaaaatacaaaaaaaaaattagccgggcgtggtagcgggcgcctgtagtcccagctactcgggaggctgaggcaggagaatggcgtgaacctgggaggcggagcttgcagtgagccgagatcgcgccactgcactccagcctgggcgacagagcgagactccgtctcaaaaaaaaaaaaaaaaaaaaaaaagaataaagtataagagaacatgagtgaatgcctgtcatctttttttttttttcttcaaaaacagggtctcactttgtcacccaggctgcagtgcagtggcgcaatcatggctcactgcaacctctagcacctgggctcaagagctcaagaggtcctaccaactcagcctcccaaggagctgggactacaggtgcatgccaccacaccctaaggtaaatttttgtgtttttatagagacaggttttaccatgttgcccaggctgttctgaaactcctgggcttaagggatcgacccacctccatctcccaaggcactgggattataggcatgagccaccgcgcctggcctatcatcatttattcatttattcatctatgcaaaaatattctttgagtgcctaattgctaagcaatgggacaagcactggcaagtcacactggcaaaatatcatcccgccactcaaggagcttataggtcagctggggagacaaagaagaacatgggcccttgtaatgagctaagtatggtgctaggggaaatatccataagttatgggaacccagaggaattcattcatttattcgtttagtaaatatttatgtgccaaactcttgggacccaatggtgacctaagcagacaagacacatccacctacagtgtttacagagtagtgtgggagacagacattaatgaaatgctcttacagacctatcattacctattgtcatatgagttatgaaagaaaaataacaggccgggcatgatggctcacgcctgtaatcccagcactttgggagaccaaggcaggtggatcacttgaggtcaggagttcaagaccagcctggccaacatgatgaaaccccatctctactaaaaatacaaaaaaaaaaaaattatctgggcatggtggcaggcagctgtaatcccagctactcgggaggctgaggcaggaaactcgcttgaacctgggaggcagaggttgcactgagctgagattgcaccactgcactccagcctgggtgacagagcaagactctgtcaaaaaaaaaaaaaaaaaagaaaggaaggaaaggaaggaaggaaggaaggaaggaaatagagtgtaagaggggggcctagtgtagtctaagatgactcaggagaagctgtttgagctgatgcctgaagacgggttgcatgtaagtagttgagtaggtaaaagagaggggtactatcatatcagggattcgggagaaaaaaaaagagagagagagaggggaagagtgctgtggacccattgagctccagcccagctccaactctgtgggtcaggaaagactttccagcatctaagctgagtccagaaggatgagtaggagtgagccagctgaggaggagctggggtggaaggaaagcattccagagcagcagatagcttgtgcaaaggcacacaggcagctgggtgtggtggctcacacctgtaatcccagcactgtgggaggccaagatgggtggaccgtttgagcccaggaattcaagaccaacctggatgacatagtgaaaccctgtctctaccaaaaaaaaaaaaaaaaaaattgaaaaaaaaaaagaagctgggcatggtggcgtgcacctgtggtcccagctacccaggaaactgaggtgggagggaagtcgaggctgtagtgaaccatggtggcaccattgcattccagcccgggtgacagagcaaggccctgtacaaaaaaaaaaaaaaaaaaagcatggaggcaacagaacatagtggattggaaggaaaaacaagtggttcagaccaggtgcagtggctcatgcctgtaatcccagcactttgggaggccgaggcgggcagatcacgaggtcaggagatcaagaccatcctcgctaacacagtgaaaccccgtctctactaaaaatacaaaaaaattagccaggcgtggtggtgcgtgcctgtagtcccagctactcaagaggctgaggcaggagaatggcgtgaacctgggaggcagagcttgcagtgagcggagatcatgccactgcactccagcctgggcgacagagcaagactcca

SEQ ID NO: 11272 - DNA, 5755 bp, Homo sapiens
aagaccatcctggctaacacggtgaaaccctgtctctactaaaaatacaaaaaattagctgggtgtggtggcgggcgcctgtagtcccagctactctggaggctgaggcaggagaatcgcttgaacccaggaggcggaggttgcagtgagccgagatcgcgccactacactcagcctgggcgacagagtgagactccgtctcaaaaaaaaaaaaaaaattacttagacatggtggcacattcctttaatcccagctacttgggaggctgaggcaggagaatcacttgaacccaggaggtggaggttacagtgagccgagatcgcaccactgtgctccacactccagcctgggcaacagagtgaaactctgtctcaaaaaaaaaaaaaaaaaaaaaaaaaaggaataaaggggatgggtttgacatctgacaaaatgctgctgctgccatccgcttctgcaaaacctcaagaatgaaatgtccttcccatggcccacacgaggccctgcacgagctgcttcatccccttccaaacctcctctcctctctcttcccctcctcactctgctcagacacacgggcctcctcactgttcctccaacacgccacgtgtggtctgccccagggccttggcacaggccatgcctctgcctggaacacctgcccccagattctcctatggctgacttctcacacttgggtcttagtgcatgcatcacctcctcagggagggccccctgcccacccccagtgaatctagccccattcaggacagtcatctttattatgcactgattgtatactaagcccagagacttcaactgtggtttctttttcatcctccccaataaatccatccatccatccgttcactcagacatgaaattctggaccctccaattcaggatctgggccacccagtgcctagcttttttttttttttttttttttttttgcgacagagtttcattctgtcacccaggctggagtgcagtggtgcaatctcagctcactgcaacctccgcctcccgggttcaagcgattctcctgcctcagcctcccgagtagctgggattacaggtgtgccaccacgcccggctaatttttgtatttgtagtagagacggggtttcaccatattggccagactggtcttgaacacctgacctcaggtgatctgccctcctcagcctcccaaagtgctgggattactacaggcatgagccactgcacccgtcagcctagcttctttgtgttcattcattcattcattcattcattcatcattcagcaaatgtctatgagcgcctactctgagccactgaaccagctgggctggccctgggggagaatcgacttcccctgcaaattcactctcatcagatccccaggctggtctaggatttgtttagatgccctcacgttggggaactcattccttactaagaataaccaccaccaataccaaacagtctcaagtaccaccaatagtgctgagttctcagggtgactacagcatctgctcccaagcccagcccagcccatatggtgtgtgctgtgtcaaagaacctgggttcaaatcccatgtccttttctaacccttggacaagcccctacccattttgtgcctcggtttccctagctgtaaaatggagatagtagtgcctctcttgtgggctcagcaccaggcctgttacacagctggtgcttaataaatgtgtcctgttacttaaggtctgatatgtgtagctcctgtcgtcgccgtccatgggggtgagtggggtggggaaggggtggtttgagtttctgcacatcaggacacgaggcgcggtccatgcaaatgaaatgcaaatcccatgcaaataaatctctgggtggtgcaaggctggaggtacaaggtgcacgcatttggggggcgcctgggaaccccatgaatcgagcccaggcccggaggtgctgacccgcatccagcccggctttcagtgctcggtgtaaatgtttacacctggccggccgccaggctccacgccgccccacactaggcagccaggagggggaatgtaaactcgggctgggggccgcgggacgctcgggaggagcccagacggagtcgagtgtggtgggtgtgtacacgtgagttattaaacaccgactgtatgcagtgaggaggatgccaccaggcactcacagcaccaagtaactggtgcccgaatgggtaaagctcagggcattcctgggggcccactagcgcccctgcaccagccagaggttgaagtgaatagggtaggcagccatggaaggctccctggaggaggcaccctccaaggtgagattgcaaggggagtgagagctaggtacagtgactcacgcctgtaatcccagctctttgggaggccaaagtggaaggatagcttgagcccaggagtttgagaccagcctgggcaacgttgtgagattcccctctctattaaacaaaaacaaaaacaaaaaaaattaaaaattagccaggcatggtggctcatgcctgtagtcagtcctagctacttgggaggctgaggtgggaggatcgcttgagcctaggaggtggaggctgcagtgagctgtgatcacaccactgcactccagcctgggtgacagagcaagaccctgtctcaaaaaaaaagaaagagagagagaaagaaagaaaggaaagaaaggaagagaaaagaaagagagaagaaaaaggaaagaaagagagagagagagaggaggctgggtgcggtggctcatgcctgtaatcccagcactttgggaggccaaggtgggcggatcacttgagttcaggagcttgagaccagcatagctaacagggagaaaccctgtctctattaaaaatacaaaaattagccagtcatgctggcaggtgcctgtaatcccagctactcagggggctgaggccggagaatcgcttgaacccgggaggcagaggttgcagtgagctgagattgcgccactgcactccagcctgagggacaagagtgagactccatctccaaaagaaaaaaagaaaaagagaaagaaaggggagtgggagtggggagggagggaagaagtgttctccatgcaaggacctatctgtgcaaaagcccagagctgggactccatgtccagggcagctctggtccattgctgcccacttctgggcctgcttatccatctggatgggaaacaggctcagagaggggcagagtcaatggaggacaccagcatgtagggaacagtgtcagccccagattcctgcctccagactgtcctaaacaccaccctccccgcgcctttgtcccacactgccacctgccgggaatgacctctcctcctttcactcttccccctggctcctcagctgcagccgctccggcctccttgctgttcctgggatacgccacactcagtctggcctcggggcctttgcactggctgtgtcccctgcctgtgatgccattctcctctgcctggccaactcctacgtttattcaagtctggaccttgtcatcggctcctcaggaaggcactccgggacccccagatgggggcggttccctgtgactcctggcacggaggccaaccccttccttgttcaatggttccttgagggaccattcccatgtgattatcgaccattcggcaggcgttcaaagtcaaaggccccacactgagtcctggcccagcgccctgtgcccgttggctgctggagggacagacggggcgtgcggctgaccatcccgtgcccgcaggctgaggatgcagcgctggaaggcggcggccttggcctcagtgctctgcagctccgtgctgtccatctggatgtgtcgagagggcctgcttctcagccaccgcctcggacctgcgctggtccccctgcaccgcctgcctcgaaccctggacgcccggattgcccgcctggcccagtgtaagctcctcctctgtgtggggtcagatacccccaacgtaaggggtagaatttcaggcagtggagtgggaggtggggggggtgtcataggttttttaaagatagggccagccagcccccttgcagggaggcagggacagacatcctaaaagattattcagggcaaggcatggtggcgcctgcctataatcccagcactttgggaggctgagacaggaggatctcttgagcccaggagttcatgaccagccagggcaatgtagcgagaccgccatctctacaaaaaacttcagaaattagccaggtgtagtggcgcacgcctgtagttccagctacttgggaggctgaggtgggaggatcacttgagcccaagagttcaaggctgcattgagctatgattgcaccactatactccagcctgagcaacagagcaagattctgtctcaaaacattataataataaatacattttctaaaaaaagatggggtggagggaggttgcaaattcccccaatggcctggtggagctagggtgacttctgggaactggggtctttcggctcagctgtcacaaggaattaggctctgccctgaggtcccgtgggggccagatggagattagacctgggcattcgcctggttggcccccgcggcgcagcagggggggcggtgggaggagagagaggctggatctgaggtcccagtgacctgccccaggggacagggaccaaggggaggcgggagatggagcaggagctaaaaaccggaagaaaggcccagagattcgaaggggtgaggaggggtggagagaggagagacggggctgggggcacagacacgggcaaaagtgctgctatagggacacagaaatgcccaccctgagggcaagaccctcgcccaactccccaccaatccctaatgcctgccccaccgcaggtgctgtggggtgagggtggtgcgtgggccctgacccctgtgcccacgcacatgtccatgcgtgcgcctgcgcgggcatctgaggcgtggatgccggcagggtgcgtgtgcagcgcctttgggtgtgggccacgagtacgcccatgtgcgcgtctgcgcccgcccctgccagcccacacaatcctcttttcttgtccttacaatgcacaagggtggcctccagcacgagctccacttctgtcctcccaccacttccctctctgcaagcggcgtgaagtccttcctaggactctgggacagagacccgggcgggacccccaaaatccagtgctccaggacttggggtgcggggggcaaagcacgaatggaggaatttcaggcactgcggagggtcagggcccatgggcgggtgcctgtctgccctactgcaaaaagcgagtggccactgactccccaagtccccatgttctaggctcctggtggaatttcaggctggggaccttgtgttctagcccctgtgcaagcagccagccccgttgcagggaggcagggacagacatcctaaaagatgattcattgttgccaggtgcggtggctcacgcctgtgatcccagcactttgggaggccgaggtgggcggatcacgaggtcaggagatggagaccattctggctaacactgtgaaaccctgtctctactaaaattacaaaaaaattagccgggcgtggtggcgggcgcctgtagtcccagctactcgggaggctgaggcgggagaatggcgtgaacccgggaggcggagcttgcagtgagccgagatcgcgccactgcactccagcctgggcgacagagcgagactccgtctcaaaaaaaaaa

SEQ ID NO: 11273 - DNA, 183 bp, Homo sapiens
gaaaaatttagccgggcgtggtggcgggcgcatgtagtcccggctactcgggaggctgaggcaggagaatggcgtgaacccgggaggcggagcttgcagtgagccgagatggcgccactgcactccagcctgggcgacagagcgagactccgtctcaaaaaaaaaaaaaaaaataataatgaa

SEQ ID NO: 11274 - DNA, 292 bp, Homo sapiens
tggctcaagcctgtaatcccagcactttgggaggtcgaggcgggcggatcacgaggtcaggagatcgagaccatcctggctaacacggtgaaaccttgtctctactaaaaatacaaaaattagccgggcatagtggcgggcgcctgtagtcctagctactcgggaggctgaggcaggagaatggcgtgaacccgggaggtggagcttgcagtgagctgagattgcgccactgcactccagcctgggtgacagagtgagactccgtctcaaaaaaaaaaaaaaaattaaaaaa

SEQ ID NO: 11275 - DNA, 181 bp, Homo sapiens
caaaagttagccgggcgtagtggcgggcgcctgtggtcccagctactcgggaggctgaggcaggagaatggcgtgaacccgggaggcggagcttgcagtgagccgagatcgcgccactgcactccagcctgggtgacagagcgagactccgtctcaaaaaaaaaaaaaaaaaaaaaagatt

SEQ ID NO: 11276 - DNA, 123 bp, Homo sapiens
aggcaggagaatggcgtgaacccgggaggcggagcttgcagtgagccgagatcccgccactgcactccagcctgggcgacagagcgagctccgtctcaaaaaaaaaaaaaaaaaatgctgtta

SEQ ID NO: 11277 - DNA, 270 bp, Homo sapiens
tgggaggccgaggcaggtggatcacgaggtcaggagatcgagaccatcctggctaacacggtgaaaccccgtctctactaaaaatacaaaaaattagccgggcgtggtggcgggcgcctgtagtcccagctactcgggagactgaggcaggagaatggcgtgaacccgggaggcggagcttgcagtgagccgagatcgcgcccctgcactccagcctgggcgacagagcgagactccgcctcgaaaaaacaaaaacaaaaacacaaagtc

SEQ ID NO: 11278 - DNA, 303 bp, Homo sapiens
ggttgggggctgcggccttgcgggctgcgcgagctggaggtgcgcgtgagcgagctgggcctgggctacgcgtccgacgagacggtgctgttccgctactgcgcaggcgcctgcgaggctgccgcgcgcgtctacgacctcgggctgcgacgactgcgccagcggcggcgcctgcggcgggagcgggtgcgcgcgcagccctgctgccgcccgacggcctacgaggacgaggtgtccttcctggacgcgcacagccgctaccacacggtgcacgagctgtcggcgcgcgagtgcgcctgcgtg

SEQ ID NO: 11279 - DNA, 15689 bp, Homo sapiens
agagcccagagagctgaacctgcatcccggacctgcggcgaccgtcgtacaccatgggcctccacctccgcccctaccgtgtggggctgctcccggatggcctcctgttcctcttgctgctgctaatgctgctcgcggacccagcgctcccggccggacgtcaccccccagtggtgctgggtgaggcacgggtctcgtggtggatctgtcggtcgggcgggacgggccgcgggcggggctgccttcccggtctgcttctgttccagtcacgaaatgggggagcgtattggtatctgtcttgtcacttaggtgatctagatctgccggctcacctcccgccatgctgggcgcgggtgtggtcagctccccacctcctgtcctggtagaaaatgggggtgagtgggagagttaccatctggttattcatagttccacctgtccgcatcattcccaagccttgcctccccttatcccatttttaagctggaaagacaggtgcttcagccccactcctgagggatggtgggggtgtgtagagtggctcctgagttgacttctgcatcgacctgggcctggttaggaggctgtcaccctcgacccctccaatgccacatatgccagaaggcattgctgaaaggaacctccttagggaaaggattgctgtcctagctggccaccaactcccacaacttatcagatgtgtggcattgcctgagggaaaaggcctaagggaaactgaagacaactgaagtcaggggaaagggttgggacaatggccatgaacctgtgtcaggcaacatgcttgtactcttaccctgccacacatgcttggactagactatgtggaggctcggtgacctcccctgctcaccccgctccttgatcacaaccctggcaactctacaacggccactgtatttccttgcagggatgggcagggatgagacctctgtctggggggccttgggtgcctcattgaggccgtcactcccatccagagctggtgtgtccgtggccagccaggattcctgaaagcagaggcatctgaggcatgaattacacgtggagtctagtgcagcatgatctccatgctctttctgctgagagtactttaaatggggacgatgcaaatcacagaagggtagagttggcaggtagggtggtgccaggcaggccccaccaggagttcccagccaggaaaagctccagggggatactaggcccaggttcaccatgggatttgggcagacttggccctgcctccccaaagcttgcaggataggaataacagtgatccccagagaggaagtctgtgtggggcaagcacagagaatccaccaacccagcctggatgggtgggtgtcaagtaaggcttcctggagtatatagctggagctaaggccaggagagagtaatgggtcggggagagacgtgagcatctcaggctgcctgggatcgagtcacaggaggagtggactgcacaggacttgtgactggttgggtcatctgaactttatcttgagggcctcagggagtcctgggttggcctgcagagttctaagtctgaggggcgtggcattaggaagcatgtggtctgtggcacacaaaatggcacatagccattttgcctggattgatgctaaccgcactcatcaattcagtcagtctgtttatccttggtcacagcagaagagcctcagaccccacccagaatcacagagcagcaggagtcctaacatgcccagcttctcagggagtgaggctgctggccttagccctgggagacctcacggtgggcagttggataagcagctcctgggcacagagcagggatctgaccttgactgtcagaagatcagaatcctctaggggtggatcctgaaatggtggtggaggaaagagagaccagcgatgtgatacagaagaccctgggcaaggggaagggaccataggcaaggccatttccacctcttgcagcctcagtctccccatctgttaagtggaaatagtaaggctgtcccctcccagtgttacttgaggtgaaaggcatgtggatggctcttttcctagttccaggcgcagatgggctcaggaagtggccactgctatttttaggggccacacagcctgaccagggtaaggagcatctgagcaaagcagatctggtgacttcctcttttaccatttcccctttggtagagacagtgaccagggtctctgccctgccctgcccagtccacaggcatgtcatccagaggctgtcatgacagggactccctccctctgcacccataccatgaagggaggtgaaggcatgtgccgcccctgcctctcatggcaccctgaagacactgggatggtgcccagggagggcacgccctgttcagggtggatttacggtcagttcccagtgaatgtccaggagagccaagtgctggtttttcactcaatgatcatggaccctaaacggggatgtgtttgggaagtggcgagagcatggcatgtgggggcaggtgaggcccgaaaggtcaatgggagtaacgagactgtgaagggctttgacgcagtggggagggatttgggtgtcaccagggccccagagttctgagtacactgaataggatggctgggatggagagaagtcaccctagggcctggactgtggtgataatggtgctggttcagggtggctgtttccaatacgggctcccagccatgctagggccctccagatgatctgctctctggcaccttactggactctggcctttagtaaggcctgggcccttggtaggctggcgggtgccaatgtaagcttctctcagctgtgtttctgttcatttccctcccaccagcctgtcctgcatactttgtctggttgaattttagctgagtggcccagggctctgttctgtttccttcttcctctctcagggcgaacaggaccctgtcttctatgtagcctgggatagctatgggtggaagacttttgggttcaagcctccagggtatatatctttttttttttttgagaccgggtcttgctctgtcacccaggctggagggcaatggcacgattttggctcactgcaacctctgcctcccgggttcaagcaattctcctgtcttaggctcctgagtagctgggattacaggtgtgtgccaccacaccaaggtaattttttgtatttttagtagagatgggctttcaccatattggccaagctggtcttgaactcctgaccgcaagtgatccactcacctcggcctcccaaagtgctgggattacaggcatgagcccctgcgccctgcctcgaaggtatatatctaatgacaagggccttggccaaactttggaggttctggaatgcaaaggggtctccaagcccctcctcccaggcagagctcccatcggggtccattaaccatagaaaccatgtgtagaggtgtgtctgtgtttgctgggggtgattcagaccaagatctcatttaacagatacggaaactgaggcctagtgtggggagtgacttcaccctgaacccccttccaataatctgaatggcccaggaggatgttccagtgaaaatccaggagacttactttatctggagttggagacaatgttagggcccttccccaaacatgtcaggcctctcccaagccccccacaggcatctctgcaccacacagcagtagcagcttttctgcacaaagatggttccctggcctttgggtcaaggtccctgctctctgaatttcctgccaccagcactgtgctttaatttgagatgtggaactgcacaggtctgccatattatctgtggctcttcagggggtctgctgcagacatcaaagttcttgggagtcttgaacctgccgggctgagggctcacacatgtcctgtgccccctgcagtccctggtgatttgggtaaccaactggaagccaagctggacaagccgacagtggtgcactacctctgctccaagaagaccgaaagctacttcacaatctggctgaacctggaactgctgctgcctgtcatcattgactgctggattgacaatatcaggtgggggctggggcacacagaggggggtgctgctcaccaacagtgcctgagaggcctccagagtctgttccttctatcctcatctcgaggtcactgacctctctccttccccaggtcctcggtctggtctggtctggtctggttggcaccacctctgcactcccaggcagaactaactttcccttcctgctgcccttgttcctctactctccagtcctggcctctcatgcctacacacaattttttttttcttttattttgggatggagtcttgctgtgtcactcaggctggcgccatctcagctcactgcaacctccgtctcccaggttcaagcgattcttgtgcctcagcctcccaagtagctgggattacaggtgcccgccaccatgcctggctaattttttgtatttttagtggagatggtgtttcaccatgttggccatgctggtcttgaactcctgagctcaagtgttctgcccaccttggactcccaaagtgctgggattacaggcatgagccactacgcctgcctacacaaaatttctgtgtcccagcccctattcagagcctcggcatggcccccacccctttccttgtctgtgcctcggcctcccctacctctccagctgcttattcttcttgggacatgccatgtctttgtacctgctgttcttttggcctggaatctatttctacaccctttgcctgataaatggcttccattcacttttttttttttttttttttttggagacggagttttgctcttattgcccaggctggagtgcaatggcgcgatctcggctcacaactcttttttttttttttaacttttattttttgagacagagtcttgctctgtcgcccaggctgggtgcagtggcgctatctcggctcactgcaagctccgcctcccgggttcacgccattcttctgcctcagcctcccaagtagctgggaccacaggcgcccgccacagtgcccggctaattttttgtattttttagtagagacagggtttcaccgtgttaaccaggatggtctccatctactgaccttgtgatccgcctgcctcagcctcccaaagtgctgggattacaggcgtgagccaccacacccagccccattcactctttaaaacatgaccctaggccaggcatggtggctctgctataatcccatcactttgggaggctgaggcagtcagatcacctgagctcaggagttgaagaccagcctgggcaacttggtgaaaccccatctctaccaaaaatacaaaaaaattagctgggcatggtggcatgcacctgtagtcccagctacttagggggctgaggcaggagaattgcttgagccagggaagcagaggttgcagtgagcagaccactgtacccagcctgggttgcagagcaagaccctgtctcaaaacaacaaaaacctgaccctggtccctttgtgacatgtcccttttgactccccagagcggtttgcctctcctcccaggccccatgcttgcttcctctaaacatcatcatgtgcccgaatttgtctgcaggcatgtttgcccaaattgcacaggcactgtacattttatatactttctttcagttagtcttacagcaaccccgttttgaaataggtgctgttttctttttttttttttcaccagtgttacttgccaacaggtggtttttaaacctgctttacaactgcgaaatctggaggctcaatgaggttacaaaattgactgtgctcactcagctaataagtggtagaatcagaattcaaatccagaatgtgtggcgttgagctgaggttccctcccaggctgagttccgtgaagggagggagtgtgtgtctgttttatccttatagcagtagaaccagaaacacagttggcgcctgataaatgtttgagctgaatggagtctcccaaattaaaagtttttcctggtcgggtgcggtggctcatgcctgtaatcccagcactttgggaggctgaggtggacagatcatgaggtcaggagttcgagactagcccggccaacacagtgaaaccctgtctctactaaaaatgcaaaaattaaggccgggcatggtggctcacgcctgtaatcccagctagtcaggagtctgaggcaggagaaacgcttgaacctgggtggtggaagttgcagtgagctgagatcgtgccattgtactccagcccaggtgacagtacaagactccatctcaaaaaaaagaaaatacaaaaatacaaaaatgagccgggcgtggtggcacacgcccatgatcccagctactcgggaggctgagacaggagaatcacttgaacctgggaggcagaggttgcagtgagcagagatgggggcactgcactctagcctgggtgacagagcgagactgtctcaaaaaaaaaaaaaaaaaaaagtttttcccagagacccgctagctgctcctccaggtgccctggcctgccggctgtttgtgatgcccattttgatgactccttcctcctctgtgtgttgtgtgactggggttatttctgggctgttgatgtgcatttctatttttatactggggacacagcctcaggtgctgccagttggaggtgccagctgataccaagaggggcctgtctgccttcactgcttctctgacccgtttagattttcacccagcgcagaactgctttggctttccagaacagttttctgcattttgctgtttgataatttatttttagtagcaacaagctactttgctatgtggtcattgggataatctacaaattgccctggagagaatgggcctccaggacctgttatctgggtcagttgtggggatcctgtcagcttcagtggctgatatctaagtgggcaagtgggactcaggaccaccagaaactccaggttcctgtgttttgggggcacatttgcttcttcagtgtgtggcgaggccagagcaaggttcccagcctcgcacagaggcacaaggcttttctcctggtataaggtgtctcccctggcccatcaccctgttcccatcatttcttcaggccttgacaaccctcttcccacaggagatggtgcagcagctgtgtactgagccctgaggcggggtctgtcctgtctggttctgtttggcactgcagctacagaaactatgagatcacgtgtgtggtgttagaagctgctgagtctgtggtaatttattacacagttctagaaaactaataggctgggtgcagtggctcacacctataatcccagcactttgggaggctaaggcaggaggatcgcttgagcccaggagtttgagaccagcatgagcacatagtgtggccctgtccctacaaaataaataaacaaataaataaataaattagccagacctggtggtgcctgcctagctgttcaggagggtgaggtaagaggatcacttgagcccaggaggttatggctacagtgagctatgatctcctcactgtgctgcagcctgggcaacagagtgagaccctgtctcaaaaaagaagaagaaagaaaagtaagaaagggctgttagggatcttaagtcagtagctggtggtccatgtcctatgtcatggcgcttaggaatttgctgggcaagccctgagccttgtggctgcagtctgacagttgatacagccctggggtactgggaggtcataggagcatggttcattcccttcctccatggaggatgtgtttggaggttggctggctgctgtgtccaatgcgcagaggaagcgggacccaattatacctacctggggccacacaaggccttcctcctgtctctccccaccagctcccatcatttctctgggccttgctccttctcctacctgcctacccacccatacagcagccctgaggcatggtgcctttctagggtttgtttttgtttgtttgtttgtttttttgagacagagtttcgctcttattgcccaggctggagtgcagtggcgcaatctcggctcactacacctctgcctcccaggctcaagcacttctcctgcctcagactccggataactgggattacaggtacacgtcaccatgcctggttaatttttgtgtttttagtagagatggggtttcaccctgttggccaggctggtctcgaactcctaacctcaagtgatccacgtgcctcagccttccaaagtgctgagattataggcgtgagcccctgtgcctggcctagtgtgttttgttttgttttttttttttttttgagacagggtcttactttgctgcccaggctggtgtgcagtggcatgatcacggctcactgcagcctcaatatcccaggtgcaagtcatcctcctgcctcagccttccaagtagctgggaccacaggcctgcaccaccatgcctggctaattttttatttttagtagcaacaaggcctcactgtattgcccaggctggccttgaactcctggcctcaagcattcctcccaccttggccttgcaaattgttggaactacaggtgtcagccactgcacccggcccctgtctggttctgttgtgtactgcactcaccacctccttcacctgggatacgttgggctggcaggagctggatgcaaggagatggagcgatggaaagctgaaagagggtagactgcctcttggggtccagtgtgaagttcacggcagaatcaggactggtacttccttctcccaaccaggtccaagaccctcattctagagtagggtcacgggggagaggggaatgttgctttgacaggggtcctggggtcagtatttggagtaagtatgccttggtggggtcctcatttggatgtaattactctgatctgtgctttttatttttatttatttatttatttatttatttatttatttatttatttttttgagacagagtcttgctctgtcgcccaggctggagtgcagtggtgtgatctcagctcactacaacctccgtgtcacaggttcaagcgattctcctgcctcagcctcctgagtagctgggattacagtcgcctcccacgacacccggctgattttgtatctttagtagagatggggtttcgccatgtttgtcaggctggtctcaaactcctcactcaggtgacctgccagcctcagcctcccaaagtgctgggattaacaggcgtgagccactgcacctgggcaatttttgtatttttagtagagacagggtttcaccatattggccaggctggtttcaaactcctgacctcaagtgatcctcccacctcagcctccctaagtgctgggattacaggtgatctgtgctttatcaacctgctttgttacttttcggtctctcctatccatctgaccaaacctgggcatgagaagggagtatgactcaggacatgatgcactgttgggacacaccaagctcagtgtcccctccgggtcactggctcaatatcctctcacaacaggctggtttacaacaaaacatccagggccacccagtttcctgatggtgtggatgtacgtgtccctggctttgggaagaccttctcactggagttcctggaccccagcaaaagcagcgtgggtatgtagcccttactcaaggcctccgggagctgggatggggtttctgccggactggagctggagctggaggaactctgctggtttgtagggacagcctgtgagctgtctctgatcagcgtgggcacagagccctgtagcattcttccaaggacctgctagctgtcacagtctccatgctgggcatagtgtaggtggccggcactagctgtatcttttcttatcctctgtatttctgtctacaggttcctatttccacaccatggtggagagccttgtgggctggggctacacacggggtgaggatgtccgaggggctccctatgactggcgccgagccccaagtaagcaggcactctcattccctccctgacgtctcgggaggtaggggtgaggtgatcatgggcaccacagaccttgggctctccccttgtccttggctgtctcctgtccctgggcctctggcatccagtctagtggtcacagccaccacctttggtcagtcttatcctgtcctccatttcccaccctgggacctctgggcctgtgagccctggggagaaatataaggcttcctcccttcatggaaggcggggggacccagaccgctctgtttgaatgtgagcaccctcccctccccctctcgtcttgtgtctggcctgagaaaagctcagtggttccggctccaggacccttcccacctgacccctgcctggctctggcctgcagatgaaaacgggccctacttcctggccctccgcgagatgatcgaggagatgtaccagctgtatgggggccccgtggtgctggttgcccacagtatgggcaacatgtacacgctctactttctgcagcggcagccgcaggcctggaaggacaagtatatccgggccttcgtgtcactgggtgcgccctgggggggcgtggccaagaccctgcgcgtcctggcttcaggtaagaccctacctggcccagcgtggggggctgttgccaggaattctgccctctcttcccttcctaagtgtcctcctgggccagcatgcctcgtgtctgtcccacggtgtgtggggtctatgcaaatctacccctaaaagtccaaagaagaaagaggctgacaaatctagtttctcagagaaaagcatttaatagggacatacgaatagaagccacatctgtgtctcaggtgggggcaagacaagatggtggatccccacactattagcccccagacccagagcttatattctgtagggaaagggcgactccgatgcgatgtgttgaacattgaaggatgataacacagaggctgttttgatttatggttaagtacgtgcacaagaaacagtagataaagtggaaatctcagtggccttcctggatctggggttaatcagaagccaacatggtggattagtatccaaaatggagttgctttggtctccacaatgactattctcttgggtcagccctgttttttttttaatttttattttttgagacagagtctggttctgtcacccagactggaatgcagtggtgcaatcttgtctcactgcaacctctgcctcccgggttcaagcgattctgcctcagcctcctgagtagctgggattacaggtgcccgccaccatgcctggctaagttttgtgttttagtagagatgaggtttcatcatgttggccaggctggtcttgaactcctgacctcagatgttccactcgcttcggcctcccaaagtgctgggattacaagtgtgagccactgtgcctggccatccctccctcttaccccatccttacttcttcatccccaccttcaccgcagaggaggaaggctagagcattttttttttttttttggaggcagggtctttctcactctgccatccaggttggagtgcagtagcgtgattttggttcatgcaacctccaccttccaggttcaagtgattctcctgcctcagcctcccgggtaactgggactacaggcgcgtaccaccacacccggctaatttttgtatttttagtagagactgggtttcactatgttggccgggctagtctctaactcctgacctcaagtcaggaggatctgcctgcctcagcctcccaaagtgctgggattacaagcatgaaccaccgcacccggccagatttttttgtatttttagtagagatggggtttcaccattttggtcaggctggtcttgaactcctgacctcaaatgatctgcccaccttgacctcccaaagttctgggattacaaggatgagccactgcacctggcctctagactacagttttttatttatgagttgcgcctccatctgtgggcagcacggagcctctgtaggcaacacagggaggaagcaggtgcagatctggctgggcctgcttgcctggcaattgggaaagccaccccttttatggctcctcccccgtcttttcatgactgttgcagctcaccagctgcagctgtagagtagagcttcttcctctagaagggagctttcctccctctgctaggacttgggggaggcttatggaccctcactttgggagctatgagccagggctgtgccaagcatctcatgagctcaagtgcctgccactgcttgacctgcttggtctactggcattgtgattgggtcaggcccagtgactctgagttggctggaagacactcagatttagtgaggactcattatagccaccacttcggtctagcctgggcctggagggacggatgtgggcataccctgagtttagacaggtagccccggcccctttcagagtttctctgtgagtccccttagagctttgtttcaaaggctgggaagctgttctgtcctgccttggcagtccaggactgggtgtgtggtgcggggaggtggaagtccgtgcacccctaggggctttccttgcctcaggggtcccccagccaggccacagcaggcagagctgaggccctacagtcagtctgagaggcctccctgctttcagatacagggtggggtgatgggtgaccatggatcctgaacaggccagaggcccctgttcccaagttgcagcttttacttcctggaggcctccctgactgccgggtgtttgtgttgttcacattcctgtgtatagggactccgcctccatctgcagcctcccctcgtgccctgtctccagcacgcctggctgcccaggtcagcgcacatgcaagtgggtggaatgaggccacggctggctgaacgctggtctgagcttaggaaaagaaaaactggtacacagttcagtgtcataaaagggaaagcagaacatgtcatctccgagttgccaacctgctgactcactttagactaggtcagtgcccacaggcctgatcagcacttggaggatggtagagtttacaggcaaggaagcatcataaatcaccctgtgggtatgtgccgccttactccctggtgaggaaagcaaaaaaaacaaaacatagcttggatgtgtggttcccagatgtagcaaaaataaagagaaacaataaaagccaaggcaagcaaactgggcaacatagcaagaccccatctgtataaaaagtggaaacatttttagcccaggcgtggtgggacgtgcttgtagttccagctatgcaggaggctgacataggaggatcacttgaacccaggaggtggaggttgtagtgagccaagactgtaccactgcactccagcctgggtgacagaatgagaccctacttcaaaaaaaaaaaaaaggaaaaatttgccaggcatgaggcatggtggcgcatacctgtagtcccagctactccaaaggctgaggcgggaggattggttgagcctgagaggttgaggctgctgtgagccgtgatcatgccattatactccagcctgggcaacagagtgagaccctgtctcaaaaagaaaaaaaaagagccaaggcagggatgggagtcacagtgattacaatgatgataaccgggtagagatgcgggactgtggactgggcccctggctggggtctggcaggggcctggtggtgaacatgctgcccaaccagctggcattcctaagcacagactgaccagagccttctccctgcaggagacaacaaccggatcccagtcatcgggcccctgaagatccgggagcagcagcggtcagctgtctccaccagctggctgctgccctacaactacacatggtcacctgagaaggtgttcgtgcagacacccacaatcaactacacactgcgggactaccgcaagttcttccaggacatcggctttgaagatggctggctcatgcggcaggacacagaagggctggtggaagccacgatgccacctggcgtgcagctgcactgcctctatggtactggcgtccccacaccagactccttctactatgagagcttccctgaccgtgaccctaaaatctgctttggtgacggcgatggtactgtgaacttgaagagtgccctgcagtgccaggcctggcagagccgccaggagcaccaagtgttgctgcaggagctgccaggcagcgagcacatcgagatgctggccaacgccaccaccctggcctatctgaaacgtgtgctccttgggccctgactcctgtgccacaggactcctgtggctcggccgtggacctgctgttggcctctggggctgtcatggcccacgcgttttgcaaagtttgtgactcaccattcaaggccccgagtcttggactgtgaagcatctgccatggggaagtgctgtttgttatcctttctctgtggcagtgaagaaggaagaaatgagagtctagactcaagggacactggatggcaagaatgctgctgatggtggaactgctgtgaccttaggactggctccacagggtggactggctgggccctggtcccagtccctgcctggggccatgtgtcccccctattcctgtgggcttttcatacttgcctactgggccctggccccgcagccttcctatgagggatgttactgggctgtggtcctgtacccagaggtcccagggatcggctcctggcccctcgggtgacccttcccacacaccagccacagataggcctgccactggtcatgggtagctagagctgctggcttccctgtggcttagctggtggccagcctgactggcttcctgggcgagcctagtagctcctgcaggcaggggcagtttgttgcgttcttcgtggttcccaggccctgggacatctcactccactcctacctcccttaccaccaggagcattcaagctctggattgggcagcagatgtgcccccagtcccgcaggctgtgttccaggggccctgatttcctcggatgtgctattggccccaggactgaagctgcctcccttcaccctgggactgtggttccaaggatgagagcaggggttggagccatggccttctgggaacctatggagaaagggaatccaaggaagcagccaaggctgctcgcagcttccctgagctgcacctcttgctaaccccaccatcacactgccaccctgccctagggtctcactagtaccaagtgggtcagcacagggctgaggatggggctcctatccaccctggccagcacccagcttagtgctgggactagcccagaaacttgaatgggaccctgagagagccaggggtcccctgaggcccccctaggggctttctgtctgccccagggtgctccatggatctccctgtggcagcaggcatggagagtcagggctgccttcatggcagtaggctctaagtgggtgactggccacaggccgagaaaagggtacagcctctaggtggggttcccaaagacgccttcacgctggactgagctgctctcccacagggtttctgtgcagctggattttctctgttgcatacatgcctggcatctgtctccccttgttcctgagtggccccacatggggctctgagcaggctgtatctggattctggcaataaaagtactctggatgctgtaaggtg

SEQ ID NO: 11280 - DNA, 384 bp, Homo sapiens
tatggtgctggcatataaccagctgtcaggtctttgcccactctgttcgcccctgcttcctggcgcagggagtccatgtcctctctggttccccaggtttgcgagagtggagggggaccacgagctcccgatgcctctcctgctctgcaggggaacttgcagatggcccatggcgcagggtcgagactcaagcccactcccaaccccgcgcccgaactgcccggactggcggggtgacgctgcactctgcgcccctaaaacgaacagattaacccctctcttgggaactgaacatgctgacctggcctctcccggttccccccgcatctgtaaccccggggcagagttacaggggctgactggccgcacccaggtgccctcggg

SEQ ID NO: 11281 - DNA, 3871 bp, Homo sapiens
gaggcaggaccttgtcctattcattaatcttgcccctcaacagttattttcagaggggcaagaagtgtttcagggttcttggcccttgtttgaccagtcgtcctaaccctcatgtcttgggtcattgttgttataatctggggttaccttttggaaggtcatggggtacccttttgcaaaagttatgggccctctccttggaaactgcacacacaccatgcagcttacaattcagggagttcacaggtctacagaatcctggaaactctcatgtccggttctactcattgtagcttcagtggaaccttctagcagtcctttccagctcctccccagctcctcagctctgcttccctccgcccatcaagccctcctcagcccataaggtgggccaggtggcctgtggggataaatcagagtgcccacaagtgcaggggcccaaagacatcccagagcaaacccaagaatccctctacaagccccagcccactcagaaggatgcattttgccccctctgtttatttgtttgtttttaattatgaaagtagggcatggtcattgttgaaaatgtgagaaatgcagagaagttaaaatgatgctttttgtttagggcgctgctgcttctggcttaagatcctaaatcaaagcagctgccagatctggacctaagacttgcttcccatcaccttacataaaagaaagagcactggactaggaatcaaagatctgaattcccatcaaatctctgctattactagcttttatctctatttatttatttatctgtctatctatctagtaccttttgtgaatatgagtgtttctcaccgaggccctcccatctctcttgcccccgatcctggaatggaccaaataccttgtttactgaaggatacagatggcatgtgactgttgagaatcactcaccctcttagagccatggtttcctcttctataaaatagggatgttcgtgcctatttgctaatcatgagtgacaatgacataaggtacataaagctgtactgcatgatgcaaacataacatcatatttgtagggttgttgctaataatactatccatcagcaaagcagtcattcatttactcagtcaaatactgatgcactggtacattcagtttcctcttttgtaaaatggggataaaaataggacttagctcatagggtatttaagattcagtgagttaatatatataaaatacttagagcagtccttggaacatattaagaactcaatacatattagctagttgagcaggctgtagtatttgttccagccaagaaaagactgttctctaacagcacaggaaataaagatggggttaggcacgacacggcagcaggacttaccttctgtctaattcagctggcagtcaaagaaagaattattagaagcctatgagcttgttctcccaaagatctactgagtacagggggatatttaaagaataaaaatccctagacccacttacagtacaggagagacaagaagctgttcacacaataacaagtgctaaattccttgatttttatactgacagctgaagttttagagaagagaaggatcaataaagaccggaatattaaagcagacaggcctaaaagaggattttagatttgataaagaattcctccagttctcagagcagggactttggagggtaacaacttggatttcagtccttgcctgccacttactgattgtatgaccttggaaaagttacttcacttctgtgagcaatgattctctcatctggaaaacaaaacaaaacaaaaaaactaacaagggtgataataatacctacctccctacctcatagggctgatgagaagattaaaaagtacctacataaagcccttctctgcgtgcctggagcatggcaagggctccatgtgaaccactattttttttttttttttttaatgaaaagtcatgggcagcaccaaagctcagaattttggcagtaaggaattatgattctacattgaaatttgccagaaggggagctgactgcctcatgagacatttttgaatgaggccaaaaaaggaaacaagtgtatcctgggattttacgagatgctaggtatgtccttagcacttaatcctcatgactaccctatgatgtaagtactatctgttgtccctattttacagttggccaaggtcacatagctgaaacggacttctgtgtgtcttctaacttttgctttcaggtctggaaaaatgcaatgtaaacctagaccctctttgaaatactgaagatggtaatcttatcccttcctcactttctgttttctaaaataacagtccttgttccttacaatgtctgttttccagattcttagaagactttttgcttattttccataactctttacttgtgatccctgaatgacaccgggggtatagcagagaatgtccatttcctcaaagttcaaaggtcctacaaaaaatagttgctagcctggcatgatggtgtgtgcctgtagcctcagctacctgggaggctgaggcaagaggattgcttgagctgaggagtttgaggctgcagcgagccatgatcacgccactgctctccagcctggatgacaaagcaagatcacatcttaaaataaaataaaataaattttaaaaatatataaaaaataaaaagtggtgccactaagtgtcctggacagcattagagaaagcaagagatagaagagtgcaaacacctgaaaggaaagagatgcgggtcttccctctcccttgagtagccaccggctatccctggagcataggagtaggattttatcccccagcttcggcctccccaggcagcacttcctttctgtgctttgactccaatttggatggtgctcaggcgggaagtaggctggggtgggaggagtttaggggaatatttgtcttctctcctgttttgccctagagattctggccaggaagacaaatggctagtaccacttggtccttttcttttcttcttttgagacagggtcttgttctgttgcccaggctggagtgcagtggcgtgatcgcggctcaccgcagcctcccaggctcaagcattcctctcacctcagcctcctgagtagctgggaccacagctccactaattttgaagtttttttggtagacatgaagtctccctgtgttgcccgggctggtctcaaactcctgacctcaagcagtcctcctgtcttggcctctggaaatgctgggattacaggcgtgagccactgtgctggcctcttttttctttttctttttttttaaggtttttatttgttaaatgggaagtctgtgccatcaactgagcattgtattttctccttagtaagagcctgggtgggccactgggagagaactatacattaaatgtaagtagcctctgggtagagagcccctggctggtttcctttcctttctctccttttctctactttggtgtctggaggcatttcccagactccagtttcttaccaccctcacggattttgctattgtattatcacctcctttatcattcccaaaattgactttatggagactcattaaaagaaaaaatcatcggccgggagcggtggctcacgccacgaaggcgggcgaatcacctgaggtgcggagttcgtgaccagcctgaccaaaacagagaaaccccatctctactaaacaatacaaaattagctgggcgtggtggtgcacgcctgtaatcccagctactggggaggctgagacaagagaatcacttgaacccgggaggcagaggttgcagtgaccaaagatcgcactattgcactccagcctgggcaacaagagcaaaactctatctcaaaaaaaaaaaaaaaaaaa

SEQ ID NO: 11282 - DNA, 3872 bp, Homo sapiens
gaggcaggaccttgtcctattcattaatcttgcccctcaacagttattttcagaggggcaagaagtgtttcagggttcttggcccttgtttgaccagtcgtcctaaccctcatgtcttgggtcattgttgttataatctggggttaccttttggaaggtcatggggtacccttttgcaaaagttatgggccctctccttggaaactgcacacacaccatgcagcttacaattcagggagttcacaggtctacagaatcctggaaactctcatgtccggttctactcattgtagcttcagtggaaccttctagcagtcctttccagctcctccccagctcctcagctctgcttccctccgcccatcaagccctcctcagcccataaggtgggccaggtggcctgtggggataaatcagagtgcccacaagtgcaggggcccaaagacatcccagagcaaacccaagaatccctctacaagccccagcccactcagaaggatgcattttgccccctctgtttatttgtttgtttttaattatgaaagtagggcatggtcattgttgagaatgtgagaaatgcagagaagttaaaatgatgctttttgtttagggcgctgctgcttctggcttaagatcctaaatcaaagcagctgccagatctggacctaagacttgcttcccatcaccttacataaaagaaagagcactggactaggaatcaaagatctgaattcccatcaaatctctgctattactagcttttatctctatttatttatttatctgtctatctatctagtaccttttgtgaatatgagtgtttctcaccgaggccctcccatctctcttgcccccgatcctggaatggaccaaataccttgtttactgaaggatacagatggcatgtgactgttgagaatcactcaccctcttagagccatggtttcctcttctataaaatagggatgttcgtgcctatttgctaatcatgagtgacaatgacataaggtacataaagctgtactgcatgatgcaaacataacatcatatttgtagggttgttgctaataatactatccatcagcaaagcagtcattcatttactcagtcaaatactgatgcactggtacattcagtttcctcttttgtaaaatggggataaaaataggacttagctcatagggtatttaagattcagtgagttaatatatataaaatacttagagcagtccttggaacatattaagaactcaatacatattagctagttgagcaggctgtagtatttgttccagccaagaaaagactgttctctaacagcacaggaaataaagatggggttaggcacgacacggcagcaggacttaccttctgtctaattcagctggcagtcaaagaaagaattattagaagcctatgagcttgttctcccaaagatctactgagtacagggggatatttaaagaataaaaatccctagacccacttacagtacaggagagacaagaagctgttcacacaataacaagtgctaaattccttgatttttatactgacagctgaagttttagagaagagaaggatcaataaagaccggaatattaaagcagacaggcctaaaagaggattttagatttgataaagaattcctccagttctcagagcagggactttggagggtaacaacttggatttcagtccttgcctgccacttactgattgtatgaccttggaaaagttacttcacttctgtgagcaatgattctctcatctggaaaacaaaacaaaacaaaaaaactaacaagggtgataataatacctacctccctacctcatagggctgatgagaagattaaaaagtacctacataaagcccttctctgcgtgcctggagcatggcaagggctccatgtgaaccactatttttttttttttttttaatgaaaagtcatgggcagcaccaaagctcagaattttggcagtaaggaattatgattctacattgaaatttgccagaaggggagctgactgcctcatgagacatttttgaatgaggccaaaaaaggaaacaagtgtatcctgggattttacgagatgctaggtatgtccttagcacttaatcctcatgactaccctatgatgtaagtactatctgttgtccctattttacagttggccaaggtcacatagctgaaacggacttctgtgtgtcttctaacttttgctttcaggtctggaaaaatgcaatgtaaacctagaccctctttgaaatactgaagatggtaatcttatcccttcctcactttctgttttctaaaataacagtccttgttccttacaatgtctgttttccagattcttagaagactttttgcttattttccataactctttacttgtgatccctgaatgacaccgggggtatagcagagaatgtccatttcctcaaagttcaaaggtcctacaaaaaatagttgctagcctggcatgatggtgtgtgcctgtagcctcagctacctgggaggctgaggcaagaggattgcttgagctgaggagtttgaggctgcagcgagccatgatcacgccactgctctccagcctggatgacaaagcaagatcacatcttaaaataaaataaaataaattttaaaaatatataaaaaataaaaagtggtgccactaagtgtcctggacagcattagagaaagcaagagatagaagagtgcaaacacctgaaaggaaagagatgcgggtcttccctctcccttgagtagccaccggctatccctggagcataggagtaggattttatcccccagcttcggcctccccaggcagcacttcctttctgtgctttgactccaatttggatggtgctcaggcgggaagtaggctggggtgggaggagtttaggggaatatttgtcttctctcctgttttgccctagagattctggccaggaagacaaatggctagtaccacttggtccttttcttttcttcttttgagacagggtcttgttctgttgcccaggctggagtgcagtggcgtgatcgcggctcaccgcagcctcccaggctcaagcattcctctcacctcagcctcctgagtagctgggaccacagctccactaattttgaagtttttttggtagacatgaagtctccctgtgttgcccgggctggtctcaaactcctgacctcaagcagtcctcctgtcttggcctctggaaatgctgggattacaggcgtgagccactgtgctggcctcttttttctttttctttttttttaaggtttttatttgttaaatgggaagtctgtgccatcaactgagcattgtattttctccttagtaagagcctgggtgggccactgggagagaactatacattaaatgtaagtagcctctgggtagagagcccctggctggtttcctttcctttctctccttttctctactttggtgtctggaggcatttcccagactccagtttcttaccaccctcacggattttgctattgtattatcacctcctttatcattcccaaaattgactttatggagactcattaaaagaaaaaatcatcggccgggagcggtggctcacgccacgaaggcgggcgaatcacctgaggtgcggagttcgtgaccagcctgaccaaaacagagaaaccccatctctactaaacaatacaaaattagctgggcgtggtggtgcacgcctgtaatcccagctactggggaggctgagacaagagaatcacttgaacccgggaggcagaggttgcagtgaccaaagatcgcactattgcactccagcctgggcaacaagagcaaaactctatctcaaaaaaaaaaaaaaaaaaaag

SEQ ID NO: 11283 - DNA, 280 bp, Homo sapiens
tcacgcctgtaatcctagcactttgggaggcggaggcaggcggatcacctgaggtcgggagttcgagaccagcctgaccaacatggagaaaccccgtctctactaacaatacaaaaaaattagccgagcatggtggcgcatgcctataatctcagctacttgggaggctgaggcaggagaatcgcttgaacctgggaggcggaggttgcagtgagccgagatcgcgccattgcactccagcctgggcaacaaaagcgaaactcggtctcaaaaaaaaaaa

SEQ ID NO: 11284 - DNA, 8680 bp, Homo sapiens
cctcagcggccgggcccacggccccgagcagccatgctgggcgcgcgggcctggttgggccgcgtccttctgctgccccgcgccggtgcaggcctcgccgcgagccgcaggtacgggcgggcgagcgggcccctagggcactccctgcgcctgcctgcgggcccagtggagggtcttccggacaccggtccccagtgccagtctggaccacccctgcatgcctggcccttcccccacccccacctccggtctgctcctgagacctggctctggctgtaaggccctcctcccctcctctcccgtcctcatcccttccctcctctccccttccttccagtgcagtgccagctcctcagggactgttctgacactgcttccaggaagccttccttgcaccccagtgctggatgctgggtcaagggcctttctccaatagtaccctgtgccctgtcacagtcctttattgctgcatggacctttcgttatttaggtctgcctgcagtcccacttccaggctgaactccctgaggtctctgattccctaggtgtcctggagtctggcccaggacctggccccacaggagtcccagcaggtgggcgctgagtgagggagtccccatgtctggtttcctctgtttgtccctcacctggtcgagtcccagaccctactgatcttggcctgtccagccaccaacagtaggctgccttccagtggggccacacccaggcctgccagagagatgcctccaagcagctgctccaggaagggccgggggaggggcctggggaggggtaagaatggagccccaagaaccattctgcccattgtgacccgccctgacctcacagccatccttcccaccgccaggcccaggaggttgggggagactaacctggcaaggagcccccaatgagccacctctcctcaccccccaaaaaacataagggggagcacaaaggccacagtctcccccatggttcagaaaggtgggttgggctgggagcaggggtcctactggggtgctgagtgaaatggagcaggtgctggggggcctgggagaaggtgggtggaggcccctggcttgcctgatgcaccagtcctcgccaggggtagctcctcccgggacaaggaccgaagtgcgacggtcagtagttcagtgcccatgcctgctggagggaaaggaagccatccttcatctacaccccagagggtccccaaccgcctgatccacgagaagtcaccatacctcctacaacatgcctacaatcctgtggactggtgagcacctctcctggggccctgcctggaatcgctggggtcctgggcccctcccagaccccctgggctactgagtgatgccccaccctgctgggtctaggtacccctggggacaggaagccttcgacaaggccaggaaggaaaacaagccgattttcctctcaggtaatgctcccaccttccctgatgtgggggtgtgggcagggagtggcagtggatgggggagggtcctctcggcctggcgggtcttccaggagactagaggccaggacgtcttccatgtagccagggccacttggccagcctccctctgacccgttgctggccccctgacctctccccatggccctgttcagtcgggtactccacctgccactggtgccacatgatggaagaggagtccttccagaatgaggagattggccgcctgctcagtgaggactttgtgagtgtgaaggtagaccgtgaggagcggcctgacgtggacaaggtgtacatgacgttcgtgcaggtgagcagccctcctcgggagtgtatgcgccacatgggctcagagcagctcccctcaccctcgccctctctccgccaggccaccagcagcggcgggggctggcccatgaatgtgtggctgactcccaacctccagccctttgtcgggggcacctatttccctcctgaggatggcttgacccgagtcggcttccgcacagtgttgctgagaatacgagaacaggtgggtgtgcctccgggagttgggggaccagggtgggggactaggaaacaagagcccctccccctagctgacctccaggtgtgcccccacctcccgcagtggaaacagaacaagaacaccctgctagaaaatagccagcgtgtcaccactgccctgctggcccgatcagagatcagcgtgggtgaccgccagctgccgccctctgccgccaccgtgaacaatcgctgcttccagcagctggatgagggctatgatgaggaatacggtggcttcgctgaggcccccaagtttcccacgccgggtcagtgccccacgcccgccttagcccaggctttggccttctgattcctatgctggtcagggacctactggctcctggcctcacccatagcttcctgtcctcctgactggcagtgacctccttgcccctagcctgtcggtagctatcggtgaagacccgactgctggtgtcagcagtgaccctctcaccttaacctagatgatgaccttctgtcccctgacttggtcagttacccagtgaccctgacttggctaatgacattctgggctctagggggacaagtaacttactggtcctctgtgaaccaatgatattctgacctctggcttaggctattaccttctgtcctgtgggttgactcttgacctcacagcctgtccagagactgcctgttgagtgaactcccagcctctgcctggcccaaggcctcctgaccaccccgatctctgtccccactttcccattctctcacctgcatgttcttggtgcccccacagtgatcctgagcttcctgttctcctactggctcagccatcgactgactcaggatggctctcgggcccagcagatggccttgcataccctgaaaatgatggctaacgggggcatccgggaccatgtggggcaggtgacgggcactgggtgttccctggaggggcagcagggggctgtggggtggggcagaagctgggactggcctccagctttgtatccgcacagggctttcaccgctactccacagaccgccagtggcacgtccctcactttgagaagatgctctatgaccaggcacagctcgctgtggcctattcgcaggccttccaggtgacccctgaccccagcccagagaacaggcatctcactctggctgcccctcccaaggccttcctggtgactgtggcttctcttaatctgaatcccctgttccctcccatgtacccactacccaggcttccctcccccgcctgcctcagagaatgttgccaccttccacctgggcctccccagtgacctctctgttcacagtctcctttcttccctttcttagctctctggtgatgaattctactctgacgtggccaaaggcatcctgcagtacgtggctcggagcctgagccaccgggtgtgtgtccatggtggcaggcaggcctggctgtgggaggggttggggcctccactgccctgtgggccggggccagccaactctcccctccccacagtccggaggcttctatagcgcagaagatgcagactcgcccccagagcggggccagcggcccaaagagggcgcctactatgtgtggacggtcaaagaggttcagcagctcctcccggagcctgtgttgggtgccaccgagccgctgacctcaggccagctcctcatgaagcactacggcctcacagaggctggtaacatcagccccagtcaggtgaggacttctggggtcacctgacgggccctggtgcctgccaggcgtgtgagctcgcagacaaaggccattctcctcaggaccccaagggggagctgcagggccagaatgtgctgaccgtccggtactcgctggagctgactgctgcccgctttggcttggatgtggaggccgtgcggaccttgctcaattcagggctggagaagctcttccaggcccggaagcatcggcccaagccgcacctggacagcaagatgctggctgcctggaatggtggggcagcacacctgagaccgagcctgtctgtaggatcccccttcacaaagcccctgtctttccggcagcggctaaatgctcactctcccttgattagcgttattattctcagttgacaaaagaggcttaaggagcttgagtaacccgcccaaggtcacgcgcaagggctgggaaccccgccatgtctggctttggagcccaagatcttagggatcacccatggctccagggaggtgttggggcctaaggtgatagggtggacatgcctggagggtcctggccagcttcttaccactacttgtctctcctggctccaggcttgatggtgtcaggctatgctgtgactggggctgtcctgggccaagacaggctgatcaactatgccaccaatggtgccaagttcctgaagcggcacatgtttgatgtggccagtggccgcctgatgcggacctgctacaccggccctggggggactgtggagcacaggttgggggctgggtagaccgggagggcccgtctccccaacgcgtccccagcctacctctgccctacttctcccctccatgtggactccagtcctggctctgccaggtgcttgctgtgagtttgtagcttccctgggcccatttactcatctgggaagtgggctgatggcacctgcccaagagggttcatctggagggttaagtgaacaaatgcgtgaaagggcctcctctgggaaaggccctctctcctggggctctccccagcccctcccgtaatgcctgtcccccagcaacccaccctgctggggcttcctggaggactacgccttcgtggtgcggggcctgctggacctgtatgaggcctcacaggagagtgcgtggctcgagtgggctctgcggctgcaggacacacaggacaagctcttttgggactcccagggtggcggctacttctgcagtgaggctgagctgggggctggcctgcccctgcgtctgaaggacggtcagtgggggtgcagggctagtctggggtcctgggaggtgtaagtgcagcgtgggtgaagagctggtgtgggcaggagccctcctggctttgtgtctctgctacttattaatggcgtgatttttggctgctgtaatatttctgtgtctcaatttcttttttttaaatagagacagagtcttgctatgttgcccaggctgatcttgaaatcctgggctcaagtgatcctcccacctcggcctcccaaagtgctgggattacaggcatgaaccactacactcagcgtgttttgtttcgttcctttcttttctttttatttcctttctctttctttctttctctttcctttcttcctttctttcttttctttctctctttctttctcttttttttttttttttgagacagggtctcactgtcacccaggctggaatgcagtggcatgatcttggctcacagcaacctctgcctccggggctgaatcaattctcccacctcagcctcctgagtagctaggactataggcatgcaccaccatgcctggctaattttttgtagagatgggatttctccatgttgcccaggctggtctgaaactactgggctcaagtgatctgcccacctcggcctcccaaagtgctgggattacaggcgagagccaccatgcctggcctgtttcttaataagtaaaatggagctaacattggtactaccttacagggttgatgtaaagatgaatgtagctgttctgtaaacatgcttagcacagtaactgacacccatggattcagatattgaccaaggctcacttggtctctgccctcatgaagcttacagtatggtaggggagacagcgaaaatgcagtaatgatgcaaaaacacatgcacaaatgtgcagttaaaattgtggtgagtgccatgaagaagtaggacgctctatgtgtgcctgctccctatcacccatgtgccttgtctgtggttaaaggtttctttcccaaaactcaaattttagctcctcaaagatcaggactttctgccactgttgtatccccagggtctagtgtggttctggcacattgtaagtgcttaataaatgttaactgagtgaatgaaagggccttgggagagaaccacagaggaggaccaactcagcctagggagagattagaggacacctgtgacaggtgtcatttaaccaaggcctggagggaaagaggggccatgtggccatggagaagctgtggagagagttcaggcatagggagcagtgcatgacaggcctggtgcaggcagcctgtatcctggaggacaggcagggcccgcgtgttccaggagggcaccgaggagaatgctgaggccggcagggcacggaagccgtcttttttttttttttttcctaagaaaagaaggctggtctcaaactcctgggctcaggtgatcctcccgcctcggcttcccaggtgctgggactacaggtgtgagccaccatgcccggctggcaaggaggttttaagtggattgtgatctgctctggtatggttttaaggaggtcactctgaccactgatggagagaagtgggggtgggggaaacaggcgaccagttaggaggccattactcgtgttcagtccaggcaggcattggtgaaggctcagaggatgtggaagtatgagatggggagacatggtgagatttggatctcttctggccacagccctggcaagactcacagatggattagaagcggagggagagggagaggaaggggacaggatgatgccgctctagcttgagcagctgagtggctggacagaggcatcagcagcgaggagggagcctggagaccaacagttgaggctaggacaggtagagtggagggtgccataaaaaagacagcaaagtactgataactgctggagtggcatccacacccagagcggggaaggggcaggatgggcagggccttttctctgtcccgtcccccaagtggccctggatacagtcctgggcagggtcctgggactcagtgacctgcccttacccccaccccctgcctccctatgtgctgtagaccaggatggagcagagcccagcgccaattccgtgtcagcccacaacctgctccggctgcatggcttcacgggccacaaggactggatggacaagtgtgtgtgcctattgaccgccttttccgagcgcatgcgtcgtgtcccggtggcgttgcccgagatggtccgcgccctctcagcccagcagcagaccctcaagcaggtggggggtgagggcatctgggctgggacctcgggtaggagggaagttggggctgcgatggcagatgggaacagggggtggggttcctgggctgtccccagagctcaggtctgtgtgtgtgcaggcacgtggcctgtcagacagggaggcagaagttaatatgagtccgtggtggctgatgaagtgtttctctgtacgtcttggtgtcagtgtaattgcttctgtccatactgtgttactggtgtgtgtgtacttccgggtgtgtgtgaccctggaggtgtgtgtctgtgcacctacctttgagggggatgctggtgtgagtgtttgtctgtctgcatgtggatgccccatctgcaggtttgcctctgtgtctgcctgcatgcgtgtgtgtctggtgtttgtgtgtgtggtatctgcctctgtgtgggcatctactgtgtgtgtgtgtgtgtgtgtgtgtgtgtgtgtgtgtgtgtgtgtgactactctgtgtctgtctgaatgggtctctgtgtgctctgggtcttctgggtgtgtgtctccccatgtttgtatctgtaccattgtgtatatgtatgacatttccacttcggtattctcatgtgtgagtgtgtgtgtgtgttcccacttgccaagcattaactcatcctggcagctgagatgagtccctgttccttcttagagatatacggtggggcggaaggaggatggggaagccctggtggtctagggctcagccctccctcccctgacacaccggagtgacctttctattccggtcagatcgtgatctgtggagaccgtcaggccaaggacaccaaggccctggtgcagtgcgtccactctgtctacattcctaacaaggtacccatccctgtgagcccaatctgccacctccccagagctgccccctcccatcctcagctcctcaacatctccttcccctcagaatgttgggaagagggaacttcccagtgggcctttctaatgggcaggtgaccccaccccggcaggtgactctccctgctctgctgctgccctaggtgctgattctggctgatggggacccctcgagcttcctgtcccgccagctgcctttcctgagtaccctccgacggttggaagaccaggccactgcatatgtgtgtgagaatcaagcctgctcagtgcccatcactgatccctgcgaattacgaaaactactacatccatgactgccccaacccccttggggtggggcagaaggtgaagcatcccaactgactagagactcaggccctgcagggccctatagaacctgtggccatccctgagcaccctgccaccaggtgacctcggccatactcactgccccccttgggcacccactcaccctagaataaacttaacagtgtcccgtggtaa

SEQ ID NO: 11285 - DNA, 8677 bp, Homo sapiens
cctcagcggccgggcccacggccccgagcagccatgctgggcgcgcgggcctggttgggccgcgtccttctgctgccccgcgccggtgcaggcctcgccgcgagccgcaggtacgggcgggcgagcgggcccctagggcactccctgcgcctgcctgcgggcccagtggagggtcttccggacaccggtccccagtgccagtctggaccacccctgcatgcctggcccttcccccaccccacctccggtctgctcctgagacctggctctggctgtaaggccctcctcccctcctctcccgtcctcatcccttccctcctctccccttccttccagtgcagtgccagctcctcagggactgttctgacactgcttccaggaagccttccttgcaccccagtgctggatgctgggtcaagggcctttctccaatagtaccctgtgccctgtcacagtcctttattgctgcatggacctttcgttatttaggtctgcctgcagtcccacttccaggctgaactccctgaggtctctgattccctaggtgtcctggagtctggcccaggacctggccccacaggagtcccagcaggtgggcgctgagtgagggagtccccatgtctggtttcctctgtttgtccctcacctggtcgagtcccagaccctactgatcttggcctgtccagccaccaacagtaggctgccttccagtggggccacacccaggcctgccagagagatgcctccaagcagctgctccaggaagggccgggggaggggcctggggaggggtaagaatggagccccaagaaccattctgcccattgtgacccgccctgacctcacagccatccttcccaccgccaggcccaggaggttgggggagactaacctggcaaggagcccccaatgagccacctctcctcaccccccaaaaaacataagggggagcacaaaggccacagtctcccccatggttcagaaaggtgggttgggctgggagcaggggtcctactggggtgctgagtgaaatggagcaggtgctggggggcctgggagaaggtgggtggaggcccctggcttgcctgatgcaccagtcctcgccaggggtagctcctcccgggacaaggaccgaagtgcgacggtcagtagttcagtgcccatgcctgctggagggaaaggaagccatccttcatctacaccccagagggtccccaaccgcctgatccacgagaagtcaccatacctcctacaacatgcctacaatcctgtggactggtgagcacctctcctggggccctgcctggaatcgctggggtcctgggcccctcccagaccccctgggctactgagtgatgccccaccctgctgggtctaggtacccctggggacaggaagccttcgacaaggccaggaaggaaaacaagccgattttcctctcaggtaatgctcccaccttccctgatgtgggggtgtgggcagggagtggcagtggatgggggagggtcctctcggcctggcgggtcttccaggagactagaggccaggacgtcttccatgtagccagggccacttggccagcctccctctgacccgttgctggccccctgacctctccccatggccctgttcagtcgggtactccacctgccactggtgccacatgatggaagaggagtccttccagaatgaggagattggccgcctgctcagtgaggactttgtgagtgtgaaggtagaccgtgaggagcggcctgacgtggacaaggtgtacatgacgttcgtgcaggtgagcagccctcctcgggagtgtatgcgccacatgggctcagagcagctcccctcaccctcgccctctctccgccaggccaccagcagcggcgggggctggcccatgaatgtgtggctgactcccaacctccagccctttgtcgggggcacctatttccctcctgaggatggcttgacccgagtcggcttccgcacagtgttgctgagaatacgagaacaggtgggtgtgcctccgggagttgggggaccagggtgggggactaggaaacaagagcccctccccctagctgacctccaggtgtgcccccacctcccgcagtggaaacagaacaagaacaccctgctagaaaatagccagcgtgtcaccactgccctgctggcccgatcagagatcagcgtgggtgaccgccagctgccgccctctgccgccaccgtgaacaatcgctgcttccagcagctggatgagggctatgatgaggaatacggtggcttcgctgaggcccccaagtttcccacgccgggtcagtgccccacgcccgccttagcccaggctttggccttctgattcctatgctggtcagggacctactggctcctggcctcacccatagcttcctgtcctcctgactggcagtgacctccttgcccctagcctgtcggtagctatcggtgaagacccgactgctggtgtcagcagtgaccctctcaccttaacctagatgatgaccttctgtcccctgacttggtcagtgacccagtgaccctgacttggctaatgacattctgggctctagggggacaagtaacttactggtcctctgtgaaccaatgatattctgacctctggcttaggctattaccttctgtcctgtgggttgactcttgacctcacagcctgtccagagactgcctgttgagtgaactcccagcctctgcctggcccaaggcctcctgaccaccccgatctctgtccccactttcccattctctcacctgcatgttcttggtgcccccacagtgatcctgagcttcctgttctcctactggctcagccatcgactgactcaggatggctctcgggcccagcagatggccttgcataccctgaaaatgatggctaacgggggcatccgggaccatgtggggcaggtgacgggcactgggtgttccctggaggggcagcagggggctgtggggtggggcagaagctgggactggcctccagctttgtatccgcacagggctttcaccgctactccacagaccgccagtggcacgtccctcactttgagaagatgctctatgaccaggcacagctcgctgtggcctattcgcaggccttccaggtgacccctgaccccagcccagagaacaggcatctcactctggctgcccctcccaaggccttcctggtgactgtggcttctcttaatctgaatcccctgttccctcccatgtacccactacccaggcttccctcccccgcctgcctcagagaatgttgccaccttccacctgggcctccccagtgacctctctgttcacagtctcctttcttccctttcttagctctctggtgatgaattctactctgacgtggccaaaggcatcctgcagtacgtggctcggagcctgagccaccgggtgtgtgtccatggtggcaggcaggcctggctgtgggaggggttggggcctccactgccctgtgggccggggccagccaactctcccctccccacagtccggaggcttctatagcgcagaagatgcagactcgcccccagagcggggccagcggcccaaagagggcgcctactatgtgtggacggtcaaagaggttcagcagctcctgccggagcctgtgttgggtgccaccgagccgctgacctcaggccagctcctcatgaagcactacggcctcacagaggctggtaacatcagccccagtcaggtgaggacttctggggtcacctgacgggccctggtgcctgccaggcgtgtgagctcgcagacaaaggccattctcctcaggaccccaagggggagctgcagggccagaatgtgctgaccgtccggtactcgctggagctgactgctgcccgctttggcttggatgtggaggccgtgcggaccttgctcaattcagggctggagaagctcttccaggcccggaagcatcggcccaagccgcacctggacagcaagatgctggctgcctggaatggtggggcagcacacctgagaccgagcctgtctgtaggatcccccttcacaaagcccctgtctttccggcagcggctaaatgctcactctcccttgattagcgttattattctcagttgacaaaagaggcttaaggagcttgagtaacccgcccaaggtcacgcgcaagggctgggaaccccgccatgtctggctttggagcccaagatcttagggatcacccatggctccagggaggtgttggggcctaaggtgatagggtggacatgcctggagggtcctggccagcttcttaccactacttgtctctcctggctccaggcttgatggtgtcaggctatgctgtgactggggctgtcctgggccaagacaggctgatcaactatgccaccaatggtgccaagttcctgaagcggcacatgtttgatgtggccagtggccgcctgatgcggacctgctacaccggccctggggggactgtggagcacaggttgggggctgggtagaccgggagggcccgtctccccaacgcgtccccagcctacctctgccctacttctcccctccatgtggactccagtcctggctctgccaggtgcttgctgtgagtttgtagcttccctgggcccatttactcatctgggaagtgggctgatggcacctgcccaagagggttcatctggagggttaagtgaacaaatgcgtgaaagggcctcctctgggaaaggccctctctcctggggctctccccagcccctcccgtaatgcctgtcccccagcaacccaccctgctggggcttcctggaggactacgccttcgtggtgcggggcctgctggacctgtatgaggcctcacaggagagtgcgtggctcgagtgggctctgcggctgcaggacacacaggacaagctcttttgggactcccagggtggcggctacttctgcagtgaggctgagctgggggctggcctgcccctgcgtctgaaggacggtcagtgggggtgcagggctagtctggggtcctgggaggtgtaagtgcagcgtgggtgaagagctggtgtgggcaggagccctcctggctttgtgtctctgctacttattaatggcgtgatttttggctgctgtaatatttctgtgtctcaatttcttttttttaaatagagacagagtcttgctatgttgcccaggctgatcttgaaatcctgggctcaagtgatcctcccacctcggcctcccaaagtgctgggattacaggcatgaaccactacactcagcgtgttttgtttcgttcctttcttttctttttatttcctttctctttctttctttctctttcctttcttcctttctttcttttctttctctctttctttctcttttttttttttttttgagacagggtctcactgtcacccaggctggaatgcagtggcatgatcttggctcacagcaacctctgcctccggggctgaatcaattctcccacctcagcctcctgagtagctaggactataggcatgcaccaccatgcctggctaattttttgtagagatgggatttctccatgttgcccaggctggtctgaaactactgggctcaagtgatctgcccacctcggcctcccaaagtgctgggattacaggcgagagccaccatgcctggcctgtttcttaataagtaaaatggagctaacattggtactaccttacagggttgatgtaaagatgaatgtagctgttctgtaaacatgcttagcacagtaactgacacccatggattcagatattgaccaaggctcacttggtctctgccctcatgaagcttacagtatggtaggggagacagcgaaaatgcagtaatgatgcaaaaacacatgcacaaatgtgcagttaaaattgtggtgagtgccatgaagaagtaggacgctctatgtgtgcctgctccctatcacccatgtgccttgtctgtggttaaaggtttctttcccaaaactcaaattttagctcctcaaagatcaggactttctgccactgttgtatccccagggtctagtgtggttctggcacattgtaagtgcttaataaatgttaactgagtgaatgaaagggccttgggagagaaccacagaggaggaccaactcagcctagggagagattagaggacacctgtgacaggtgtcatttaaccaaggcctggagggaaagaggggccatgtggccatggagaagctgtggagagagttcaggcatagggagcagtgcatgacaggcctggtgcaggcagcctgtatcctggaggacaggcagggcccgcgtgttccaggagggcaccgaggagaatgctgaggccggcagggcacggaagccgtcttttttttttttttttcctaagaaaagaaggctggtctcaaactcctgggctcaggtgatcctcccgcctcggcttcccaggtgctgggactacaggtgtgagccaccatgcccggctggcaaggaggttttaagtggattgtgatctgctctggtatggttttaaggaggtcactctgaccactgatggagagaagtgggggtgggggaaacaggcgaccagttaggaggccattactcgtgttcagtccaggcaggcattggtgaaggctcagaggatgtggaagtatgagatggggagacatggtgagatttggatctcttctggccacagccctggcaagactcacagatggattagaagcggagggagagggagaggaaggggacaggatgatgccgctctagcttgagcagctgagtggctggacagaggcatcagcagcgaggagggagcctggagaccaacagttgaggctaggacaggtagagtggagggtgccataaaaaagacagcaaagtactgataactgctggagtggcatccacacccagagcggggaaggggcaggatgggcagggccttttctctgtcccgtcccccaagtggccctggatacagtcctgggcagggtcctgggactcagtgacctgcccttacccccaccccctgcctccctatgtgctgtagaccaggatggagcagagcccagcgccaattccgtgtcagcccacaacctgctccggctgcatggcttcacgggccacaaggactggatggacaagtgtgtgtgcctattgaccgccttttccgagcgcatgcgtcgtgtcccggtggcgttgcccgagatggtccgcgccctctcagcccagcagcagaccctcaagcaggtggggggtgagggcatctgggctgggacctcgggtaggagggaagttggggctgcgatggcagatgggaacagggggtggggttcctgggctgtccccagagctcaggtctgtgtgtgtgcaggcacgtggcctgtcagacagggaggcagaagttaatatgagtccgtggtggctgatgaagtgtttctctgtacgtcttggtgtcagtgtaattgcttctgtccatactgtgttactggtgtgtgtgtacttccgggtgtgtgtgaccctggaggtgtgtgtctgtgcacctacctttgagggggatgctggtgtgagtgtttgtctgtctgcatgtggatgccccatctgcaggtttgcctctgtgtctgcctgcatgcgtgtgtgtctggtgtttgtgtgtgtggtatctgcctctgtgtgggcatctactgtgtgtgtgtgtgtgtgtgtgtgtgtgtgtgtgtgtgtgtgtgactactctgtgtctgtctgaatgggtctctgtgtgctctgggtcttctgggtgtgtgtctccccatgtttgtatctgtaccattgtgtatatgtatgacatttccacttcggtattctcatgtgtgagtgtgtgtgtgtgttcccacttgccaagcattaactcatcctggcagctgagatgagtccctgttccttcttagagatatacggtggggcggaaggaggatggggaagccctggtggtctagggctcagccctccctcccctgacacaccggagtgacctttctattccggtcagatcgtgatctgtggagaccgtcaggccaaggacaccaaggccctggtgcagtgcgtccactctgtctacattcctaacaaggtacccatccctgtgagcccaatctgccacctccccagagctgccccctcccatcctcagctcctcaacatctccttcccctcagaatgttgggaagagggaacttcccagtgggcctttctaatgggcaggtgaccccaccccggcaggtgactctccctgctctgctgctgccctaggtgctgattctggctgatggggacccctcgagcttcctgtcccgccagctgcctttcctgagtaccctccgacggttggaagaccaggccactgcatatgtgtgtgagaatcaagcctgctcagtgcccatcactgatccctgcgaattacgaaaactactacatccatgactgccccaacccccttggggtggggcagaaggtgaagcatcccaactgactagagactcaggccctgcagggccctatagaacctgtggccatccctgagcaccctgccaccaggtgacctcggccatactcactgccccccttgggcacccactcaccctagaataaacttaacagtgtcccgtggtaa

SEQ ID NO: 11286 - DNA, 5846 bp, Homo sapiens
gctttatatgagcttttatatttcacagaatggtgactttgcatatgccctggtgcattgtgggagctgctattgtcacgactaagacatttcttttggggtatccatctagccccagcctcgaaaggatggaagcagggcctccttgcaggaggtcatgttgtccatttgtctgctttcatacaagctggtccaaagaaagagttctctttcgtttggaacatctgttgggttggaagtccttccccaaatctatctgagtccttcttgctgcagagaaagccttcctgtgacctcatcctttcccctaaatgttgggaaatgctcctgagtcctgtccttgacacatacatcttccttgggttgagggatggggactgggacacatgctttgggaagggcaggtgcagagtgatggggctgacggggtgggggaagcagggggaggagctgtccctctgaggcctttgggaatcggctgtgccaggcatcctcagccctccagctaagcaacacagagagccaaaagaggctactagagacaagaaggccttcatggggccactgcttgtgggggatgtcagcagtggggaggagtgaagcaggaaggaaccgggagactggatggaattgctcccttcacacggtcacacatagccacacatggtcactgggaccagagtcagctctgtctgggcagccaggccctcagtgcaagccaccagcccatctggaggggattagtgctccggccaacaaggtcagctggccccttcctagctggagcctactcaaccttgccaggaagtcagagagctggacaagtggagcccagcctggggaggtggaagagagggaggatggagcatggtgaagcacaggtggcctttttggcagccccagccctggctttggaacagtctgggcagtgtgccaacccctcttgccactgtcgtcccattgaccctcatgaatgagttgcgaggcagttaccttcagcctcctatggataaatattcgaggcccagagagggtaagagacctgcctgcgacccctcagcacttctgtttctctctggggtcttgagggtacaataaagacccctaaggcttcctcttctcgcaggaggtccaggcgcagctgtgggggagggtgcccttggtgtcttctgtccctgcagccagtctgctttctactcggcagctcctctctccctcctgggatgagatgtgcacgcgatgatgggattctgtaaatgggttgggaagaaggagttacctccttaaagggttagttctcccaggagtgctcgaatttctaaagggggcagggtcccacataaatctcactcagaagcaggattataagagttcctgcagcatcccttcccctttgctggtccctcttgagtgtgcaccctgttctaccagcggaacacctgcgggccagggtcactggagacagggccataccgtctgggcggtcacttaagtaacttcatcattctgagcaccccccttccttatctgaaaggtggggggccatccacccagctctcagggctgttaaggtgactaaatgggataatggttgtatcatccctgagcaaagggtatcacagatgggaagattatcttagctccgcagggagccagatgggctgtgagggaggggtaaaggcagggctggagggggctggaggggctggctgagcagggtatatatggggggggttcttcctcaaacccagaaaaactcttagttaggcttagtgtctttgttgagaaactgaggcccaaagaaaggaatttcttgtccctttgtttccctttccctgcctgaggtcattcattcacctaacaactttgtgcccgacactagacaaggccctagtgagcaaaatgaacatagcccctctgggaacacagagcctagatagggagatgatcatttcattactgcaaacacaaacatataatcccagcctgggctaagtgctgtgaagttccagacttgtgtctggctcggtgctgtatcctaagcaccttggcacttaagtggcattgaaatacttgctggaaagaaggccactctgaggaggtgatgtcagagctgaggcttggagggctggagttaaataaagatggtttcaggtcttctttgccttccctgtaggttctgcctctgcctcctctctggcactcaggctaagggtaagcatctccgactggccatcagccccaacatgccgagtacagggatcagatcctgtcttgcgtggccggtctcccctaggtcctgaacccagggaagtgcatgtggatctcaatttatctagatggtgcgtttgtgcctgccctcctttcgggcatgttctagaacagagttcagtccagagcccaggggtggccgggatgatggatgagggtgtggggcctgctgaccaccaggggacctgatcattgggctgggccagcctctctgtcctcattttcccctctgcaaagaaggggtgttgggcgtccctacttctcgcgccagccccggggcctctatcctggcgggaagggcaggccgacccggcagactgcggcctctcgggagggaagaaggtgtcagacgcgcggagcaaccataaatagcccccctttcccagaagacggcacggggttcaagactcaggcgccgcatactcagaatgagagcagagactcccgccaggaaaaaaaggcacttaggggatctgctcattagcatgaaatgcaaatgagcccgcccggcctcatttacacaactctgtgcatggattcggcgaaagggcaaccagggagacgacggcgcagcagccactctgccacttcccccatcccctccccccatcggccggggcgggaactgagacgaccccaaccctctgcggtggcgggaggtgcgcgggggctgcgtgggtggtgcagccttaggagagtgaacaacgcccaggggtgatggcctcagcaaagtgaggggtggtgatggaggtcatccgacccatcccgccgcctctccgcagtggcgcaagcgccccaaaatctccggagagggaactgactgacccactaggttccgccgtgtctacctctcgcagatgttggggaagtgcttcccggcgtctaatcctcgctgttcccccctccaccggcgcccagcacacccgcggcgctccgctcccgggtacccacagctttctggagtggcgccggcggcaggagagagctagagccgactgagccccagaactcggggaggtaggcggggcaagggccggggtctgcgcgtgcgtgtgcacgcgtggaaagcacaaacccacgagggcccgctgccggtagggttaaggtgagtgagtgaaggcggcagacccgcgaagttccagttccgcggacactccttccctaagccacatagggacttaagagaaactgaggcacgaagttggggggtggcggtggtggggactttgaaggtcgagtcgataaagcccagctctgtgcttccgccccctcccacacactcgagacccccacaggttccttcttaggggtcctcgctctgctccgcagcccctcctggggatccgggctctgcggtccagcgcgacctgcctggggccacgtgttcaagcacgaagcccctgcgtggagtccacgcccttcaaaaggtccctaggggcaaagggatgaagcccaggagcgtcaatgtgaggtcaggtccagcgggttagggttacgaggtcagggtcgaagtctcagaattgactcgggagtatgaccaataagcccaagagatttgtggaggccacgcccagaccatgcctaccctagcctttctcgagctccgcccgtttctccaagactgggcccctccagcctgaagccccacccccaggacatccagctccgctccttcccttccccagtcccgcagccaagctcaactccagggtgggagattaaccaggtggagacctgggatttcgctctgggaccccctggtgacaaccctcacccccgtgccgcctgtctcctttcttccccaggcccgcccagagctgagctccgtcctccggctgctgcccaaatcaggggtcgtggacaaaggatgcctggggcctgcggccctacgccaggaccccgcgccgaatactctgattcttcgggctccctccaagggagtcccaaagaccccaatggccaataggaaagtgggttcggtctgggcagcagtctgattggctccagccttcgggagcggacccaggggcaaggggaggggagaggggcggtcctgggttttggggtgggaatcggattccagctgtggttctctccctgcgctcccgcccgcactgccacggcggacggccaatgggcgcgcggctcggggccggcggcgtccggcgattggctgcggggctgtctgggggcggggccgaggcttgaagttgaagtgagggatccagctgtggtgtgcgcggggctcctcgccgccgctttcgctcgctcgctccgcgtctcggccggaggaggaggctgtggcgccggcgacagctacggcagcggcagccaccgcggcggctgcggcggcggcatctccgcctccactcccgcccgggactgccccccactgtctccccgcccctcccggacagtgagcccgcggcggggcgggggaaggagccgcccccaccccctccaagcccacccctaaagagatccctcctcccctcccccgccgcctggcgcggagccgggacgatgctgaccccttagatccggctccagctgcgccgcgggaagagggggcgcccctccccggacccccgccctccgccgctgccccccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggcggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccatatccttcggggcacgacggccaggcgcggggtcagaagggggacgggccgcaccgccgggggtcgggggggaagaagacccaccgccaggtgagtcgaagtgagcccggagggtaggcggatggggggggggctgccagggaggggagggggcaccagagtgggagcggagacgcgagcaggtctcgtcggtaacccgggcttaccccacctgcgtacacacacctcagtcttcctgggttgggggggtggggatccaggccaggagaagagagctgtgccccgctggctcgcagctggacgccctccagatgtggtcaggggagggtcgtcatcctccagatgtgggaagc

SEQ ID NO: 11287 - DNA, 5848 bp, Homo sapiens
gctttatatgagcttttatatttcacagaatggtgactttgcatatgccctggtgcattgtgggagctgctattgtcacgactaagacatttcttttggggtatccatctagccccagcctcgaaaggatggaagcagggcctccttgcaggaggtcatgttgtccatttgtctgctttcatacaagctggtccaaagaaagagttctctttcgtttggaacatctgttgggttggaagtccttccccaaatctatctgagtccttcttgctgcagagaaagccttcctgtgacctcatcctttcccctaaatgttgggaaatgctcctgagtcctgtccttgacacatacatcttccttgggttgagggatggggactgggacacatgctttgggaagggcaggtgcagagtgatggggctgacggggtgggggaagcagggggaggagctgtccctctgaggcctttgggaatcggctgtgccaggcatcctcagccctccagctaagcaacacagagagccaaaagaggctactagagacaagaaggccttcatggggccactgcttgtgggggatgtcagcagtggggaggagtgaagcaggaaggaaccgggagactggatggaattgctcccttcacacggtcacacatagccacacatggtcactgggaccagagtcagctctgtctgggcagccaggccctcagtgcaagccaccagcccatctggaggggattagtgctccggccaacaaggtcagctggccccttcctagctggagcctactcaaccttgccaggaagtcagagagctggacaagtggagcccagcctggggaggtggaagagagggaggatggagcatggtgaagcacaggtggcctttttggcagccccagccctggctttggaacagtctgggcagtgtgccaacccctcttgccactgtcgtcccattgaccctcatgaatgagttgcgaaggcagttaccttcagcctcctatggataaatattcgaggcccagagagggtaagagacctgcctgcgacccctcagcacttctgtttctctctggggtcttgagggtacaataaagacccctaaggcttcctcttctcgcaggaggtccaggcgcagctgtgggggagggtgcccttggtgtcttctgtccctgcagccagtctgctttctactcggcagctcctctctccctcctgggatgagatgtgcacgcgatgatgggattctgtaaatgggttgggaagaaggagttacctccttaaagggttagttctcccaggagtgctcgaatttctaaagggggcagggtcccacataaatctcactcagaagcaggattataagagttcctgcagcatcccttcccctttgctggtccctcttgagtgtgcaccctgttctaccagcggaacacctgcgggccagggtcactggagacagggccataccgtctgggcagtcacttaagtaacttcatcattctgagcaccccccttccttatctgaaaggtggggggccatccacccagctctcagggctgttaaggtgactaaatgggataatggttgtatcatccctgagcaaagggtatcacagatgggaagattatcttagctccgcagggagccagatgggctgtgagggaggggtaaaggcagggctggagggggctggaggggctggctgagcagggtatatatggggggggttcttcctcaaacccagaaaaactcttagttaggcttagtgtctttgttgagaaactgaggcccaaagaaaggaatttcttgtccctttgtttccctttccctgcctgaggtcattcattcacctaacaactttgtgcccgacactagacaaggccctagtgagcaaaatgaacatagcccctctgggaacacagagcctagatagggagatgatcatttcattactgcaaacacaaacatataatcccagcctgggctaagtgctgtgaagttccagacttgtgtctggctcggtgctgtatcctaagcaccttggcacttaagtggcattgaaatacttgctggaaagaaggccactctgaggaggtgatgtcagagctgaggcttggagggctggagttaaataaagatggtttcaggtcttctttgccttccctgtaggttctgcctctgcctcctctctggcactcaggctaagggtaagcatctccgactggccatcagccccaacatgccgagtacagggatcagatcctgtcttgcgtggccggtctcccctaggtcctgaacccagggaagtgcatgtggatctcaatttatctagatggtgcgtttgtgcctgccctcctttcgggcatgttctagaacagagttcagtccagagcccaggggtggccgggatgatggatgagggtgtggggcctgctgaccaccaggggacctgatcattgggctgggccagcctctctgtcctcattttcccctctgcaaagaaggggtgttgggcgtccctacttctcgcgccagccccggggcctctatcctggcgggaagggcaggccgacccggcagactgcggcctctcgggagggaagaaggtgtcagacgcgcggagcaaccataaatagcccccctttcccagaagacggcacggggttcaagactcaggcgccgcatactcagaatgagagcagagactcccgccaggaaaaaaaggcacttaggggatctgctcattagcatgaaatgcaaatgagcccgcccggcctcatttacacaactctgtgcatggattcggcgaaagggcaaccagggagacgacggcgcagcagccactctgccacttcccccatcccctccccccatcggccggggcgggaactgagacgaccccaaccctctgcggtggcgggaggtgcgcgggggctgcgtgggtggtgcagccttaggagagtgaacaacgcccaggggtgatggcctcagcaaagtgaggggtggtgatggaggtcatccgacccatcccgccgcctctccgcagtggcgcaagcgccccaaaatctccggagagggaactgactgacccactaggttccgccgtgtctacctctcgcagatgttggggaagtgcttcccggcgtctaatcctcgctgttcccccctccaccggcgcccagcacacccgcggcgctccgctcccgggtacccacagctttctggagtggcgccggcggcaggagagagctagagccgactgagccccagaactcggggaggtaggcggggcaagggccggggtctgcgcgtgcgtgtgcacgcgtggaaagcacaaacccacgagggcccgctgccggtagggttaaggtgagtgagtgaaggcggcagacccgcgaagttccagttccgcggacactctttccctaagccacatagggacttaagagaaactgaggcacgaagttggggggtggcggtggtggggactttgaaggtcgagtcgataaagcccagctctgtgcttccgccccctcccacacactcgagacccccacaggttccttcttaggggtcctcgctctgctccgcagcccctcctggggatccgggctctgcggtccagcgcgacctgcctggggccacgtgttcaagcacgaagcccctgcgtggagtccacgcccttcaaaaggtccctaggggcaaagggatgaagcccaggagcgtcaatgtgaggtcaggtccagcgggttagggttacgaggtcagggtcgaagtctcagaattgactcgggagtatgaccaataagcccaagagatttgtggaggccacgcccagaccatgcctaccctagcctttctcgagctccgcccgtttctccaagactgggcccctccagcctgaagccccacccccaggacatccagctccgctccttccctcccccagtcccgcagccaagctcaactccagggtgggagattaaccaggtggagacctgggatttcgctctgggaccccctggtgacaaccctcacccccgtgccgcctgtctcctttcttccccaggcccgcccagagctgagctccgtcctccggctgctgcccaaatcaggggtcgtggacaaaggatgcctggggcctgcggccctacgccaggaccccgcgccgaatactctgattcttcgggctccctccaagggagtcccaaagaccccaatggccaataggaaagtgggttcggtctgggcagcagtctgattggctccagccttcgggagcggacccaggggcaaggggaggggagaggggcggtcctgggttttggggtgggaatcggattccagctgtggttctctccctgcgctcccgcccgcactgccacggcggacggccaatgggcgcgcggctcggggccggcggcgtccggcgattggctgcggggctgtctgggggcggggccgaggcttgaagttgaagtgagggatccagctgtggtgtgcgcggggctcctcgccgccgctttcgctcgctcgctccgcgtctcggccggaggaggaggctgtggcgccggcgacagctacggcagcggcagccaccgcggcggctgcggcggcggcatctccgcctccactcccgcccgggactgccccccactgtctccccgcccctcccggacagtgagcccgcggcggggcgggggaaggagccgcccccaccccctccaagcccacccctaaagagatccctcctcccctcccccgccgcctggcgcggagccgggacgatgctgaccccttagatccggctccagctgcgccgcgggaagagggggcgcccctccccggacccccgccctccgccgctgccccccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccatatccttcggggcacgacggccaggcgcggggtcagaagggggacgggccgcaccgccgggggtcgggggggaagaagacccaccgccaggtgagtcgaagtgagcccggagggtaggcggatggggggggggctgccagggaggggagggggcaccagagtgggagcggagacgcgagcaggtctcgtcggtaacccgggcttaccccacctgcgtacacacacctcagtcttcctgggttgggggggtggggatccaggccaggagaagagagctgtgccccgctggctcgcagctggacgccctccagatgtggtcaggggagggtcgtcatcctccagatgtgggaagc

SEQ ID NO: 11288 - DNA, 6654 bp, Homo sapiens
  misc_feature (554)..(554): n equals a,t,g, or c
  misc_feature (640)..(640): n equals a,t,g, or c
  misc_feature (650)..(650): n equals a,t,g, or c
  misc_feature (953)..(953): n equals a,t,g, or c
  misc_feature (1019)..(1019): n equals a,t,g, or c
gaaactgtcttctactgactgtttcaaaaccgaggccttcacatccccggaggccctgcagcctggggggactgccctggcgcctaagaagaggagccggaaaggccgggcaggggcccatggactctccaaaggcccgctggagaagcggccctatcttggcccggctctgctcctgactccccgagacagggccagtggcacacaaggggccagtgaggacaactctggtggaggaggcaagaagccaaagatggaggagctgggcctggcctcccagcccccggagggcaggccctgccagccccagacaagggcacagaaacagccaggccacaccaactacagcagctattccaagcggaagcgcctcactcggggccgggccaagaacaccacctcttcaccctgtaaggggcgtgccaagcgacgacgacagcagcaggtgctgcccctggatcccgcagagcctgaaatccgcctcaagtacatttcctcttgcaagcggctgaggtcagacagccggacccccgccttctcacccttcgtgcggngtggagaagcgagacgcgttcaccaccatatgcactgttgtcaactcccctggagatgcgcccaagccccacaggaagccttcctnctctgcatcntcttcctcatcctcgtcatcgttctccttggatgcagccggggcgtccctggccacactccctggaggctccatcctgcagccgcggccctccttgcccctctcctccacgatgcacttggggcctgtggtttccaaggccctgagtacctcttgccttgtttgctgcctctgccaaaacccggccaacttcaaggaccttggggacctctgtgggccctactaccctgaacactgcctccccaaaaagaagccaaaactcaaggagaaggtgcggccagaaggcacctgtgaggaggcctcngctgccgcttgagagaacactcaaaggtcccgagtgtgcagctgccgccactgccgggaagccccnccaggcctgacggcccagctgacccggccaagcagggcccactgcgcaccagtgcccggggcctgtcccggaggctgcagagctgctactgctgtgatggccgggaggatgggggcgaggaggcagccccagccgacaagggtcgcaaacatgagtgcagcaaggaggctccggcagagcccggcggggaggcccaggagcactgggtgcatgaggcctgtgccgtgtggaccggcggcgtctacctggtggccgggaagctctttgggctgcaggaggccatgaaggtggccgtggacatggtaagaggccagcccagccagggtggggagtgtggggttccaaaggacaggcaggcaggcagtcggggagccccttgtttctagtgctacagtgtgggccaaatgtgtctgcagtctcgggacaatctgcagagtcctgagcctctctggggtgtgtgggggaagtggaggcacccatctggctaaggcaggtcacactcacctaccctgtcccaggagacttcccgccggggcccgtatgcccagccaccgccactctcccactcacctggcatcttcaggctccagccccacccagaatccactgggcccctccccatgctgtcaccggagatgccaaggcccagagaacacgaggactcccaagattgaacatcagggctgccccgggcggtgcaagagcaagttgcccaccctctgttcctgtctccattgcctctgggatgaagctaagggctcaggaagaccctctctggcgacacaggcttggtgcatggacccagtcacagggttcctccctctgcaggacagtccatggggtcacacagtcacaacaggcagggcggggcagatccagaccctctcaccattggctctgagaccagctttggaagccatagtcactgagcaccaacatgagagagggaactctggggctgtgccgccatgcacctttggggctgtgacctgccctctctgtgcctccgtcccctcgcccctaacgtgggtatgagggtgcccatggaggaggggtcgggagggttaaaaggtgggcacctctgagcccaccgagcacagcagccctgtgatagtcagtgcagaggggcctggtggctctggtgacagcagggtgacgttcttcgtggtgtcaccacttccccagtaccatagagtacctctgtgcccttctgagggaggggtcagtgggggcggtggggtgcacctctcccccggggccatgcttctgcccccacattcaaccccgactccactgcctcatccagacttccgtggagtgacgctcccggctctcagcgctgtgtggtggctctcagtggggacgcctgcagccttctctggcccctgccctgagtcccatcccctccactccttccttcaacccactatgtgcggctgaggtcacaggggagccagaggggcttggcaggggtctccagaggccctggacaaacactgcctgcatctgagtgattcagtgacccagcacagtggccccagccggtggcttcgcccctccccctgcccagcctcctcccccgtcgctgcactgcccacctgctcctcgcagtacacccctgcagcccctctgagcagcccctgctcctgacagttgccgtggcattgcctggccaaaccaaggtcccggtgggggcccactgtgtttgccacccacgcctcctagtgtgtgtcttgggcacctgcttcccactgcccatggggatggctggagaccttctccacgcccagacgccctgcccacctcactccaccctccacctcagaggaaggctggccccgacaggactcctgcaggttcctggtgccgcgggccttgcttacccagcagatggtggccttgggcctcttccctctccccttcccagttagtgattttttgcctctctcctgctttctgtctctctctgtctctctctctctctctctctctctctctctctctctctctctctctcattactggctccttcccagcgccttgaaacaggttcaagtctctcccgtcatcaaaaaataataaccctcagatcaccagccccagctggctgccacctcccctgcttcacagccccattcctgaaagccttgtccccacggcatcctcggtcccgcagcctcaccaggggctccccgacactcacgtcccaccaggctgagatcaggtcgtctccacatcccctgcagccagcactggccggccgaagggaggaggggtcagccccgagcaccgaccaccccatcctgtccctggcccatgggtgtcttaaccgcccatgcacacacaaggtcctgctggactgaggagacagtgtgtgttggagaggcgctagcttccctacaccacgcgggggctggaacttgccagcccagcccatgcctgtctgctgtgccatgctccagaaatggcctgacagcctgcgcaactagggctgccccgggaaggtcggaaccaggaacaccctgccagacagatgggacatcctgggagaatgggcagagtctggggcttcccagggtcacttttggctcaccaccccttcctgcctcagtggcttgggggcgccatgctccttggagtgagaccctggttcaaatcccagctctgccgagggctggttccatagctccaggcgagtcacgcatgctctgagaactccacaatgtcaaaccccgttagcaggattgtggggttctgtggatcatgtgggacctgcctggcatgtggaaggggcttggggtgcagctgtgtccctggccccagcactgccacacccctcggtaccttgacctcacttttgcgctctggagggcagaacctctgagccagctctcagggataccttttttcctcgatggccttttctgggaactgccctcgcctgctatctctgagccctgcctgcccttcccccaaagccatcatagacccctacctcctatccagatggagcctggccatggaatgcttggggtgagagggacccatagcgggctccgggcattgttagggggctaggtggtgtctgcagaggccccacctgtggcagggtttacatgccgccacccctgccctcctcttgggtagctggggtcagaagggcctgaggcctcactctctctgcatcttagtttcttcacatctaaaatgctattcatatgcctgcctgagggtggttggggcctccgtgcagtaagtggagagaagccttcagccagaggacccccatatgcttaaacatccagacaccaagggccactcacagacagcagccggcttgtgtttcgtcatcccttttgggtcaggaactggggacgctggactccagatctccaggaggccatcccagactaggcgggaaggaggcctcagccctgagctgaaaacctgaaattctagaataaaccccaggccccactcccagcatgggcagcggggaggggagtgttctgacatttctcagctgctgtggttgggatggtgcgcccaccctgagcatgtggggtcctgtgggcccctactccagcctggaggcagctgcaggggtcagagaccagcctggagccctcgggcaggttactcagcctcagctctcattggtaacccaggtaaaataacagtaatcccatcataaggttgctgtgggcatgaggcttccagccatgcctggcacataggaagctattgtcgtttgtttcactggcttcgcacttgggcagaggccgccgccctctctgctgccttctctacctcaccccccgcccccagcacggtggcactgtggctctggcgcctggtgacttctccctccccggcctcaggtttgcttcactcttccaagggccttcttggtgtgactgtcctgtcctggccacgtccactccaagcagctggtccaggtgtggggcagcccccaagctcagcagaggacagttttgagacttagaggaggacggcatcagatttacatgaagtcagccatctcaagggattaccacgtcaccgcctcctctcacaggtctgagagctggtcccctggagggtgcaggtctcatcctaggtagaacagtcccagcctagcttcaaagtgctcctgctgccagaaagggtagaaaaccatgctgaatgccttcactgttgcctggaatgggagcctcagtttcaccatctgtaaagtgagattaatgaaagggacccacagagggctgttagagccagtaggcggccaggcgcggtggctcacgcctgtaatcccagcactttgggaggctgaggtgggcggatcacgaggtcaggagatcgagaccatcctggctaacacggagaaaccccgtctctactaaaaatacaaaaaattagcctggcgtggtggcgggcacctgtagtcccagctactggggaggctgaggcaggagaatggcgtgaacccgggaggcggagcttgcagtgagccaagattgtgccactgctctctagcctgggcaacagagcaagactccatctcaaaagcaaaagaaaaaagagccagtaggccaggcgctatgtcttacacctgtaatcccagcactttgggaggcctaggcaggcagatcacctgaggtcgggagttcgagaccagcctggccgacacagtgaaactccgtctctactaaaaatacaaaaattagctgggcatggcagcacatgcctgtaatcccagctactcgggaggctaaggcaggagaatcacttgaacacaggaggcagcggttgccgtgagcggagatcacaccattgcactccagccccggggggacagagtgaaattctgtctcaaaaaaaaaaaaaaaaaaaaaaagcaagccagtgggcaaggacacacaccacgcccagcacaccagaagcatgcagcagatgctggctggtagccacagccatggtagtaactggcatcactggcccaagggggtctccctacccaatgtaccagcccagagggtgctaaatgacccatgtttgtgggcatgtgtaccccagtgctgaacctccttctggtagattttcaagcaccattttggagaagggaggcagggaccacagggggccagccagcctgtacaggttttttgtgttttttttgtttgtttgtttgtttgttttttgaggcagggtctcactcttgcccaggctggagtacaggcagtggcgtcatctcggctcactgcagcctcaacctcccaggctgcagcaatcctcccacctcaccttcctgagtagctgggactacaggcacacaccaccaaccctcactattttttgtagagacagtttcaccatgttgcccaggctggtatcaaactcctggactcaggcgatcctcccaccttggcctcccagagtgctgggattacaggcatgagccactgcacctggcctaccagcctgtaaagcttgagggctgggctccaactggagactcacctgcctttcctttctcttcatcagatgtgttccagctgccaagaagccggggccaccattgggtgctgccacaaaggatgcctccacacctaccactacccgtgtgccagcgatg

SEQ ID NO: 11289 - DNA, 6650 bp, Homo sapiens
gaaactgtcttctactgactgtttcaaaaccgaggccttcacatccccggaggccctgcagcctggggggactgccctggcgcctaagaagaggagccggaaaggccgggcaggggcccatggactctccaaaggcccgctggagaagcggccctatcttggcccggctctgctcctgactccccgagacagggccagtggcacacaaggggccagtgaggacaactctggtggaggaggcaagaagccaaagatggaggagctgggcctggcctcccagcccccggagggcaggccctgccagccccagacaagggcacagaaacagccaggccacaccaactacagcagctattccaagcggaagcgcctcactcggggccgggccaagaacaccacctcttcaccctgtaaggggcgtgccaagcgacgacgacagcagcaggtgctgcccctggatcccgcagagcctgaaatccgcctcaagtacatttcctcttgcaagcggctgaggtcagacagccggacccccgccttctcacccttcgtgcgggtggagaagcgagacgcgttcaccaccatatgcactgttgtcaactcccctggagatgcgcccaagccccacaggaagccttcctcctctgcctcctcttcctcatcctcgtcctcgttctccttggatgcagccggggcctccctggccacactccctggaggctccatcctgcagccgcggccctccttgcccctctcctccacgatgcacttggggcctgtggtttccaaggccctgagtacctcttgccttgtttgctgcctctgccaaaacccggccaacttcaaggaccttggggacctctgtgggccctactaccctgaacactgcctccccaaaaagaagccaaaactcaaggagaaggtgcggccagaaggcacctgtgaggaggcctcgctgccgcttgagagaacactcaaaggtcccgagtgtgcagctgccgccactgccgggaagccccccaggcctgacggcccagctgacccggccaagcagggcccactgcgcaccagtgcccggggcctgtcccggaggctgcagagctgctactgctgtgatggccgggaggatgggggcgaggaggcagccccagccgacaagggtcgcaaacatgagtgcagcaaggaggctccggcagagcccggcggggaggcccaggagcactgggtgcatgaggcctgtgccgtgtggaccggcggcgtctacctggtggccgggaagctctttgggctgcaggaggccatgaaggtggccgtggacatggtaagaggccagcccagccagggtggggagtgtggggttccaaaggacaggcaggcaggcagtcggggagccccttgtttctagtgctacagtgtgggccaaatgtgtctgcagtctcgggacaatctgcagagtcctgagcctctctggggtgtgtgggggaagtggaggcacccatctggctaaggcaggtcacactcacctaccctgtcccaggagacttcccgccggggcccgtatgcccagccaccgccactctcccactcacctggcatcttcaggctccagccccacccagaatccactgggcccctccccatgctgtcaccggagatgccaaggcccagagaacacgaggactcccaagattgaacatcagggctgccccgggcggtgcaagagcaagttgcccaccctctgttcctgtctccattgcctctgggatgaagctaagggctcaggaagaccctctctggcgacacaggcttggtgcatggacccagtcacagggttcctccctctgcaggacagtccatggggtcacacagtcacaacaggcagggcggggcagatccagaccctctcaccattggctctgagaccagctttggaagccatagtcactgagcaccaacatgagagagggaactctggggctgtgcgccatgcacctttggggctgtgacctgccctctctgtgcctccgtcccctcgcccctaacgtgggtatgagggtgcccatggaggaggggtcgggagggttaaaaggtgggcacctctgagcccaccgagcacagcagccctgtgatagtcagtgcagaggggcctggtggctctggtgacagcagggtgacgttcttcgtggtgtcaccacttccccagtaccatagagtacctctgtgcccttctgagggaggggtcagtgggggcggtggggtgcacctctcccccggggccatgcttctgcccccacattcaaccccgactccactgcctcatccagacttccgtggagtgacgctcccggctctcagcgctgtgtggtggctctcagtggggacgcctgcagccttctctggcccctgccctgagtcccatcccctccactccttccttcaacccactatgtgcggctgaggtcacaggggagccagaggggcttggcaggggtctccagaggccctggacaaacactgcctgcatctgagtgattcagtgacccagcacagtggccccagccggtggcttcgcccctccccctgcccagcctcctcccccgtcgctgcactgcccacctgctcctcgcagtacacccctgcagcccctctgagcagcccctgctcctgacagttgccgtggcattgcctggccaaaccaaggtcccggtgggggcccactgtgtttgccacccacgcctcctagtgtgtgtcttgggcacctgcttcccactgcccatggggatggctggagaccttctccacgcccagacgccctgcccacctcactccaccctccacctcagaggaaggctggccccgacaggactcctgcaggttcctggtgccgcgggccttgcttacccagcagatggtggccttgggcctcttccctctccccttcccagttagtgattttttgcctctctcctgctttctgtctctctctgtctctctctctctctctctctctctctctctctctctctctctctctcattactggctccttcccagcgccttgaaacaggttcaagtctctcccgtcatcaaaaaataataaccctcagatcaccagccccagctggctgccacctcccctgcttcacagccccattcctgaaagccttgtccccacggcatcctcggtcccgcagcctcaccaggggctccccgacactcacgtcccaccaggctgagatcaggtcgtctccacatcccctgcagccagcactggccggccgaagggaggaggggtcagccccgagcaccgaccaccccatcctgtccctggcccatgggtgtcttaaccgcccatgcacacacaaggtcctgctggactgaggagacagtgtgtgttggagaggcgctagcttccctacaccacgcgggggctggaacttgccagcccagcccatgcctgtctgctgtgccatgctccagaaatggcctgacagcctgcgcaactagggctgccccgggaaggtcggaaccaggaacaccctgccagacagatgggacatcctgggagaatgggcagagtctggggcttcccagggtcacttttggctcaccaccccttcctgcctcagtggcttgggggcgccatgctccttggagtgagaccctggttcaaatcccagctctgccgagggctggttccatagctccaggcgagtcacgcatgctctgagaactccacaatgtcaaaccccgttagcaggattgtggggttctgtggatcatgtgggacctgcctggcatgtggaaggggcttggggtgcagctgtgtccctggccccagcactgccacacccctcggtaccttgacctcacttttgcgctctggagggcagaacctctgagccagctctcagggataccttttttcctcgatggccttttctgggaactgccctcgcctgctatctctgagccctgcctgcccttcccccaaagccatcatagacccctacctcctatccagatggagcctggccatggaatgcttggggtgagagggacccatagcgggctccgggcattgttagggggctaggtggtgtctgcagaggccccacctgtggcagggtttacatgccgccacccctgccctcctcttgggtagctggggtcagaagggcctgaggcctcactctctctgcatcttagtttcttcacatctaaaatgctattcatatgcctgcctgagggtggttggggcctccgtgcagtaagtggagagaagccttcagccagaggacccccatatgcttaaacatccagacaccaagggccactcacagacagcagccggcttgtgtttcgtcatcccttttgggtcaggaactggggacgctggactccagatctccaggaggccatcccagactaggcgggaaggaggcctcagccctgagctgaaaacctgaaattctagaataaaccccaggccccactcccagcatgggcagcggggaggggagtgttctgacatttctcagctgctgtggttgggatggtgcgcccaccctgagcatgtggggtcctgtgggcccctactccagcctggaggcagctgcaggggtcagagaccagcctggagccctcgggcaggttactcagcctcagctctcattggtaacccaggtaaaataacagtaatcccatcataaggttgctgtgggcatgaggcttccagccatgcctggcacataggaagctattgtcgtttgtttcactggcttcgcacttgggcagaggccgccgccctctctgctgccttctctacctcaccccccgcccccagcacggtggcactgtggctctggcgcctggtgacttctccctccccggcctcaggtttgcttcactcttccaagggccttcttggtgtgactgtcctgtcctggccacgtccactccaagcagctggtccaggtgtggggcagcccccaagctcagcagaggacagttttgagacttagaggaggacggcatcagatttacatgaagtcagccatctcaagggattaccacgtcaccgcctcctctcacaggtctgagagctggtcccctggagggtgcaggtctcatcctaggtagaacagtcccagcctagcttcaaagtgctcctgctgccagaaagggtagaaaaccatgctgaatgccttcactgttgcctggaatgggagcctcagtttcaccatctgtaaagtgagattaatgaaagggacccacagagggctgttagagccagtaggcggccaggcgcggtggctcacgcctgtaatcccagcactttgggaggctgaggtgggcggatcacgaggtcaggagatcgagaccatcctggctaacacggagaaaccccgtctctactaaaaatacaaaaaattagcctggcgtggtggcgggcacctgtagtcccagctactggggaggctgaggcaggagaatggcgtgaacccgggaggcggagcttgcagtgagccaagattgtgccactgctctctagcctgggcaacagagcaagactccatctcaaaagcaaaagaaaaaagagccagtaggccaggcgctatgtcttacacctgtaatcccagcactttgggaggcctaggcaggcagatcacctgaggtcgggagttcgagaccagcctggccgacacagtgaaactccgtctctactaaaaatacaaaaattagctgggcatggcagcacatgcctgtaatcccagctactcgggaggctaaggcaggagaatcacttgaacacaggaggcagcggttgccgtgagcggagatcacaccattgcactccagccccggggggacagagtgaaattctgtctcaaaaaaaaaaaaaaaaaaaaaaagcaagccagtgggcaaggacacacaccacgcccagcacaccagaagcatgcagcagatgctggctggtagccacagccatggtagtaactggcatcactggcccaagggggtctccctacccaatgtaccagcccagagggtgctaaatgacccatgtttgtgggcatgtgtaccccagtgctgaacctccttctggtagattttcaagcaccattttggagaagggaggcagggaccacagggggccagccagcctgtacaggttttttgtgttttttttgtttgtttgtttgtttgttttttgaggcagggtctcactcttgcccaggctggagtacaggcagtggcgtcatctcggctcactgcagcctcaacctcccaggctgcagcaatcctcccacctcaccttcctgagtagctgggactacaggcacacaccaccaaccctcactattttttgtagagacagtttcaccatgttgcccaggctggtatcaaactcctggactcaggcgatcctcccaccttggcctcccagagtgctgggattacaggcatgagccactgcacctggcctaccagcctgtaaagcttgagggctgggctccaactggagactcacctgcctttcctttctcttcatcagatgtgttccagctgccaagaagccggggccaccattgggtgctgccacaaaggatgcctccacacctaccactacccgtgtgccagcgatg

SEQ ID NO: 11290 - DNA, 460 bp, Homo sapiens
aggctggagtgcagtggtgcgatcttggctcactgcaacctccgcctcccgagttcaagcgattctcctgcctcagcctctcaagtagctgggactacaggcgtgcaccaccacgctcagctaatttttgtattttttgtagagatggggtttcactgctttggacaggatggtctccatctcttgacctcgtgatccgcccgcctcagctgcctaaagtgctgggattacaggcgtgagccactgtgcccggcccctagtagcgtttttaatgtgtggtcttgagcaagttggttgatacctctgcacacagtttccctacctgtatgatggagatgataatagccccttctctgcagagctgctgggaggagagtgaaataatgaacactacccacacggtgctgcctcagtcctattttgggtccagcctctgtgacctctccccacacggtgctgc

SEQ ID NO: 11291 - DNA, 400 bp, Homo sapiens
accctcttcaagaggatgtcttctcccaagaaagccaagcccaccaagggcaatggcgagcctgccacaaagctcccacccccggagacccccgatgcctgcctcaagctcgcctctcgggcagccttccagggggccatgaagaccaaggtgctgccaccccggaagggccggggcctgaagctggaagccatcgtgcagaagatcacctcgcccagcctcaagaagttcgcatgtaaagcgccaggggcctctcctggtaatcctctgagcccatccctttccgacaaagaccgtgggctcaagggtgctgggggcagcccagtgggggtggaagaaggcctggtaaatgtgggcaccgggcagaagctcccaacttctggggctgatccgttatgca

SEQ ID NO: 11292 - DNA, 400 bp, Homo sapiens; identical to SEQ ID NO: 11291

SEQ ID NO: 11293 - DNA, 460 bp, Homo sapiens; identical to SEQ ID NO: 11290

SEQ ID NO: 11294 - DNA, 2932 bp, Homo sapiens
ttcacatcagttactcattgagctggggttcgtcatattaaccaagaattcattcatctttcttttgatattgtaatcttgtcctcatctccacaactgagttggggcctgaggggtttaagagttctcactccatcacaggaggcaaggggtacccttgtgaaccagacttcaactcctggaagtcttgttcagttcataggcaaatatctttgcaagtttagtatgagacagcccaacggttaaataaataagacacagtgccatggttctaggcatttggagagggaaaaggcacattacacagattcccctggagaaaatacaggccattctcatcttctcaacatgcattttcccactcttcagtgacttttaatcttatcccctggtctatgagaaaccataacccacgtgctactgaatacatttttattttcccttcatgacatagacttggttccaagtatattttattttcctcccttatgcctacaagacatccaattttgttcaggtcccttttaatggcacttaataaatatacattctgagacctggcagaacaggctgtcccctttcacactgcctttaaagcgcctgtttgaactagctagtgcagagctcaggtggggcacgtcctagcttacagctcatggccatctctggcaccaggtctatctgtccaatactttgtgtctagggtagaggtccctaaccctggctgcacattggaagcacctgggaagctttctgaattcctgaggcccgagccacaccctaaaccaatttcatcagaatctctgggtgggacggagcctggattctgccagttgaaacctgccatggtaacttcagtgagcagctacactgagaactcctgagctacaattctagcacacagtaggccttcggtaggtatctgtggaacccacgagtgggtttcctatttcattatctgttcccctatgctctctatttttatcagaaatctgagcaggaaagagcagagagaatgagtcaagagcatcctctcaagtgaattcgctgctgagaaaggaaccgtagggcttgcatttctcttgtgtcatgcagtcttcatgctttaacaggcccagaggaggcaagttatagactgacacagacatgtatatatttcttaaaagcccttcaaaaaccagagctcactgcttaggcactatggttataacacagacatgttcttggaagcatatctaaactacctcctgtttgacacacattctaacttgggttggttacaaactttgtcagttgttaagatcacacttggtcacattttcccatttctgtgaatcttgcaacttatctttgcccagagcaacagcctagacatgaccaccccaagcagggactgcactgcacccaacattgccccagcaggtcagtcctccttgaacaggaactgtttttgaggggctccaatttccaggttctagaatggggtggctcacttaccaagttaaagaggctggctacatagaatgcagtattgagaagccccccaaggtagatcctgggttacaggaaagaaagctatactgatgaacaaggtttgctgccacaggcatgggcgtgggggagggcagcatgccgggggccaccccgagatcactgctgtcatttacatttgtatcacacttcacagtttacagggagctctgcatgcttagccccacgtcattctcagcacaaccctgtgagtgaggtctttctggatgggaacactgaagttgtgtcctacatctaaggtcccacagccaattgcatcacatccacggctgcctccaggacctcaggggccacctgaaaccactgggggttccccctggctccccttctaaccagaaacaggaaagcaagccattccctaacctccccacccaccaggccttatcaccgccttcccagagtttcctctatgatttgcatacccctttgttccctagtcctgagaacacagcagtagctgttcacctgctgccaacagcctcacacaccccacctaacacagtatcaaaatcccctcttccctggaacagcctctgaatttgcctacacacattccagaactatgacttggtcacacccactcccaggaccagtcaagagtcttgggaacctctctgctacaccgataaatccatggcttccccacttgagagggctcccagtgggtcactgcccaagataaactcagcttccagcatagagaaataaaagctgactcattggttatgatgtctcctgataccatgtgtaggaagtgaactgtctgaccaggcagttctggactcctccagaacccgcttcctgcaaccacacagcacgcaggtaacattatcccgtgtgacccacgcccacaggcaggcccggatgcaggcacagctaagactggccataacctatggagagtcctggccaatcagctgtgacctgctgtccaagtgcattgtgaccccaggtcggaatgagttctttatgcagacataatgagcagtcctggctggagcctcctgtgcccccaccacaccaagcactctgcgaggcccgcccatgtcttctggctgcctcctgagtgtgcttcacccaccctggcctggtcttcccttccacctccacctttcctttgcttcttttccccccagggtcagagcctctaagcctcccccatcatttggcaatgtaggctccaaagagggtaccctaagagggcagactccagccccacagaactgggctccgagcactggccaagaagccagaaggcacataacccctctgtccattcacttccaccaggctccactcagggttccccttcttgtcctgggcctccaggatggtcacaggctggcctgcctgcaggctcacttcatggctgcttctggcc

SEQ ID NO: 11295 - DNA, 353 bp, Homo sapiens
agagaggctgtttatcctgttcccatccacctggctctcgtccccattgctggatgctcgtcacctcccaagtacatcttttgtactaaaggcaatgactgcatctgctagtaccacagcccatactatgtgactggcactgtcctagcactctactgggtttgggttctcacaataattctatcattctatttgctgcatttttcagataagaaaaatgaggatcagagaagtcaaggaacttactcaaaattgcacagcagtgaatctaggcctgtctgacctccaaacagatatttttgatccactactgccacatcactgagcagactcagcaccctctccctctccag

SEQ ID NO: 11296 - DNA, 10876 bp, Homo sapiens
ggagcctaggcagccgagagggtgcccgaacctgagtctgagttgcggccacttcaggagctgagaggagcaggtaggtgaggagggagcgtgggctgcggggatggtgttcctgggggcctgagatatgagtaggggtcctgggagggggctcggggttccttggagacattttagcactagtggggaatggaatggcgtgtatggggaggtcctttttgtaccctgatcccaggaagtgaattcaggtgtgggtgggaggctccggagggtgctggtggtgggggatgggactccttgagaccctccctgtcccaggaacgggattcaggacttgggaaaaggatttcctgagccagtttgagctctaatggggaccttgaatgggggtttctgagatacctccttcccaaggagtaagcgcgggagggagctggggtttcttcagagacgctgtacctacaagacaggggctccaggctcgggtggggattgcagagacacccccaccccaggaaactcggtaggccacgggagggggtctttgatgaaggtctcagaaatagctcttcctccggaggggaaatgagggctcgggccaggttcctgagacaccccacaccccacacctaggaagtttctcaagtctggcagtgtctccaaattgacttctgccagaagatgagtgtttaagacttgctaggggccctggaaaagacctctaggccctagaattggggtcaaatgggagtccctgggtcatttctgtccctgggaaggggctcggttcgggcacttgtctttggcttctagtgaggatattcagagtcgtggcagagagcagtttgcagcgtctggggcaggggtctccgagtctgtccccaaccctcagctcactcaacaggttgcattagctctggtctcgggcttgggggcccaggcgggaaggaggggggtgagggcattaggaggggtggggcagccaggccgacacgtgtccctgcaaggagtgagccgcctggccacgcggtgagggtggagggaaggagagggggtggcgcgggggaccggggaatgaaagacacagatggcaagagagacagcgtgagtctggggtctgggaggagaggctatcccttctccacgtggtcggctcatctgcgctggggtccggctctctctgtagctttctgtctctctcttccccactatttctctctcactggctctctctgtgtctctctgagtaactaactgttggcttctctccttctctgatttttgttcttctctctctctcatctctttctctgtcagtctgcctccatttctatccctgtctgttcctgctcccctgccttgtctctttctccgtctttccatcggtctctatgggactcccctccccccttcttcagctcccctcactttgaagcatgctcgttccatctctgatccccccaccccatttctttgcccacaggatggaactgcaggatccaaagatgaatggagccctcccttcggatgctgtggggtgagtcaggggtccaaggaggtgggctcagggatcaggggttaggatttccctcttatcggcccctatttccctgccctatccagctacaggcaagaacgtgagggcttcctgcccagtcgtggtcctgctcctgggagcaagccggtccagttcatggatgtgagtggccccacaggatctgtcctggtggcaccttccccagctaatctcctcccgcactgctccctcttccccactcctcctcctccctgctgttcccctgcccagctatctccccagcacagctacacactacttggtcgctcccctctccagatactcctcttccccagatatgccctttccagctctctccctggccttgtttctccccacccgctcttcggcccagtgactgccctccctggctgctcccctcccggcctgcctttctcctccagctgttcttcctcctccagcactccccatcctcagcctatccccacccgcagcgtctcccctccccagctgttttacctctggtggctgcttcaccctcccccggtcctctccacttccagctgctccctccaaagtttgtcctagtttcccccttcccagctctccccattcgcagcctcttccatcttcaactcttcttccctgctagcctcttccctcctccgatggtctctccttggcttctctccaccccgcttgcttcttctctagtctttccctggccctggcattagtctccttaccctgtgccctgtcccaatgtgtgcccgggctttgctccttgcgtgcagttcgaggggaagacatcgtttggaatgtcagtgttcaacctcagcaacgccatcatgggcagcggcatcctggggctggcctatgccatggcccacacgggggtcatcttcttcctgtgagtccataggtggcctgcggggccaggggtgttgtggggcaggtgggaggcctggggccaggtctgagctgtgccacctgccgcagggccctgctgctgtgcattgcgcttctgtcgtcctactccatccacctcctgctgacctgtgctggtattgcaggtgagacccagagcctggatcccagtccccactccacccctttggaccccagactctggagccacatccagagctcaacacagaccttggaccccagaccccagacccagctccctgaatgcagaccccagatcccggacccagcaccccagaacccacccccagaccactacactctacctctaacccccacccctcagtccccggttccccagctcctaccatggtctcagttcatagtctggctccaagacccctactcttacctccagccctcatccttttccctggcctcagatcccacctcccagactctgcccccaaactcaagcccaactgcttaacccccaccttcatcctccatcagtcaaagccggttcccccaagccccaactccccagctcctgggccctctggcctgcacctctggcctggcctcctggaccttcaaccctgttcctgactccccccgctaggcatccgagcctatgagcagctgggacagagggcattcgggcctgcggggaaggtagtggtggccacagtcatctgtctgcacaatgttgggggtgaggactctgggaggtgggggtcagcttggggggagagggcggagtgaggtgggcttccccaggctgggctggggaagacggggtgggggcatgaagagaatccttctgcttacacctcccccacctgcaccagccatgtccagttacctgttcatcatcaaatctgagctccccctggttatcggcaccttcctgtacatggaccccgaggggtgagtgagcaacaccccttggctggccagcagccccttgactctgcctgtgaggcccggtcagtatcttcagcgctgtgtgtgcagctgacttccagatgttctagtttgagactgctgggcaggccacttgggtcagactgattcctctgtgtgcctgttgctctgaccacaggagtccagtcgaccgtgtgctgattttgtgacttattctggctgcttctggctggaggctgactctttatgtccggtttactctgctgctgaccatgtgtgtgtgaatgtacatagccaatggactcagactctgcctgtgggtttgactctgcgtctgctgtcctggctgattctcttgggctagctctgtgattgactacagctgtgtcccgtatactgggattccaaccatatgtgtcttaccctcggtcactctgacttcccctgtccagctgattgtttgagcttgattctaggttcatctggctgaatctgtctagctgtgagtgtgtgatcactgactccgtctagctgtgagtgtgtgatcgctgactccagcagtgtgtctgtgtgcacgtagtatgctgtggtaccaactatgtgtgactcactctgactgtacgtgtccagccaactccatctctgtgtttgatttggtggctgttctggcaaattctctctggtgtgtgtgtgtgtgtgtgtgtgtgtgatccctgaatgtggctatgtgtcctctgtattatggttgcaaccatatatgctggactgttctgattatgcatctggctgactgtgtgtgagtccggatccgctgtgctggcttggtatgtgtggggggcatgtgcacgatgggactccagcagggctagtgtgtatgcacagtgtgttgcagtgcttgtgctccagctgcacgtgtgtagctgcctctgtgtgtttcatgaacagctctgtgtgtccagtggctaactctgcctctggtcccatgggctaactctgcctctggtcccatgggctttgcatggtgtgtagatgtgtctctggttttgtcagtctgactctggtctgtgtgacagtttttttttttttttgacagagtctcattctgtcgcccaggctggagtgcagtgacacgatctcagctcactgtaacctctgcctcccaggttcaagcgattctccttcctcagcctcctgagtaggtgggattacaggcatgcaccaccatgctcggttaattttttaattttatttttttgagacagagtcttactctgttgcccaggctggagtgcagtggcgccatcttggctcactgcaacctccacctcccaggttcaagccatccttctgcctcagcccccatgctcggctaatttttgtatttttagtagagacggggttttgccatgttggccaggctggtcttgaactcctgacctcaggtgatctgcttgccttggcctcccaaagtgctgggattataggcatgagccaccacacccggccagtctgacaattttaactgagtgcttgatctttactctctgtgtgtatccttttagatttttggtttgattctgagaacactagatagctgatagtgtgaccagagatgtctcattattatagttagctcccattggtttatttctgtgtaactgtatatgagatagaaagagaccatgtgaatgtctagaacataggcattcaatcaagttgttttgaatgcatgagcagttgttcagctgattctgtcttaactgactgtcttgcctggtcaccttcctccaatatctgtacagatcccaccttttctcagagcttggttccaacagtgtggccagctggatgatttcgtttctatttcagtctttctttggctgtgcagccaaatcagtccacaggcatactttcaggcatccaacaaaccttgagctgttcaaacaagcatgcatgtgtgtttctgactttttgatggactctgcatcgtggcttgtctactggatcatcagactgttgctctacctgtcagacataccacgatcgtgactcactctctttgtgtctggcaccttgtgttgcactgattttctcctttctttctttctctttctttctttctttctttctttctttctttctttctttctttctttctttctttctctctctttctttcttcctttctctttctttcctcccttccttcttttttttctttctttcttcctttttttttttttttttgagtgtcttgatctgtcacccaggctggagtgcaatggcgcgatcttggctcactgcaacctctgcctcctgggttcaagtgattctcctgcctcagcctcgcgagtagctgggattacaggcacgcgccaccatacctggctatttatctatttatttatttttttgagacagagtctccctttgtcgcccaggctggagtgcagtggcgtgatctcggctcactgcaagctccacctcccgggttcatgccattctcctgccttagcctcctgagtagctgggactacaggcactccccaccacgcctggctaatttgttttgtatttttagtagagacagggtttcaccatgttggccaggctggtctcaaactcctgaccttaggtgatccacccgcctcagcctcccaaagtgctgggattacaggcgtgagccaccacacctggcctggactgatttttacattgagtctgactgatttggggtgtttgaccttctggttgtgcaaccacttgcgaagtctgatggcaagttttgtccagctgtgtatgtgttagctgtgtcccactgatagtatctgacaatctcataatcagcttgactgtttttgtcaaccctattgtgccgtttgtcactgtgaccacctgaatgacttctcaagctgaggttgtcagcttaactctcctgacttagggcagaaagctgcctgtccagctgtcttctgtgagtgtctgcctgacagtttcctttggctggcagctaggcactgtgtcttcctgtctctctagggactggttcttgaagggaaacctcctcatcatcatcgtcagtgtgttaatcatcctgcccctcgccctcatgaaacacttgggtaagaggctccctgggttggccattgggtagtgggattagacagaagaagccagactgagaaaacccccattcattttcaagggctgcagcacactaggagagagcttatttgatgtgggcttgaacagattagtaggagtttgctatggaggggaggtttttctgggtggaagtagaagcttatgcaaaggtaactggggtgggtagaccttgaaggctagactaggtgtttggagttcactgttccgggggtccattgattttttgttttgttttgtttttttgagaccgagtctcactctgtcacccaggctggagtggtgcaatggcgtggtcttggctcactgcaacctctgcctcccggttcaagcgattctcctgcctcagcctcccgagtagctgggattacaggtgtatgcgccaccacacccagctaatttttgtatttttagtagagatggggctttgccatgttggccaggctggtctcgaactcctgacctcaggtgatccacccgcttaggcctcccaaagcgctaggattataggtgtgagccaccacgcctggctgatttctgagactctgtgttttgcccctcttaggctacctggggtacaccagtggtctctctctgacctgcatgctgtttttccttgtttcggtgagtcacagagaagcggggagagagtttgggacattgggacatagcttcctccatgacctggcttccctgctgcccccatcctcaggtcatctacaagaagttccaacttggctgtgctataggccacaatgaaacagcaatggagagtgaagctctcgtgggactccccagccaaggactcaacagcagctgtgaggcccagatgttcacagttgactcacaggtgtgtgtgcaggcatgtaggagattgcatcacactcaggccctctggttctgtcatatggtgcatcctgctcagagtggagctggatattggacattgggagcttctatgtgtctgatatggagggcgattacggggcgggagggggatgggaagaaggggatggacccctgttggctctaatcccatgtactcgggcattcccctagatgtcctacacagtgcccattatggcttttgcttttgtctgccaccctgaggtgctgcccatctatacggagctctgccggtgagtgggcaggcaagtgggcctgaatgatgggccagcaagtggggtggtaaccagaatgtctgacactccctacagcagtcctgggactgtcacttggtggaagctaggttgtgtcatgggaggggtttggggtggccaggaggtcttggggcactcagggtagtgactgtttgctgattggggcttaagtattctcctattttaatatccagcacaaatgtggatggacagagttgggaagcagagatcagatgatcagatggagggggtgatatgcatggctggtgatatggggatagggaggtacggacagacagaggcggaggcagggatgatatgatgggagatgtgtggatgatcagacagagggacagcatggatggtcagatggaagaggcagtggcagtcaaacgcaggggagagggagacagtcatatcgggggagatatggatggtcagagaggggattttggctagtcacaggggaggcagagacgggtgtccccatgtgtgccagctgaatggcagtctgggagaaggggactctggagggtggaggctggctttgagggacctggggcaagtctcagggtctgggcatgacagttccacgacctctacacctcaggccctccaagcgcaggatgcaggccgtggccaacgtgtccattggggccatgttctgcatgtatgggctcacagcaacctttggatacctcaccttctacagtgagtggggctggggctagggctggggggagggggaaggcctggggcaggagcctctgagctctttccttctgtgaccacggacctgtcagtttccaaacagaaggtgtgcctcacttgtgtggattttgtcactgtgcatgtatgtatgggtttctggggcattggtcctggtgctctctccacatcctgcatcccgtaccctctgtctcatggcccaggcagtgtgaaggcggagatgctgcacatgtacagccagaaggacccgctcatcctctgtgtgcgcctggccgtgctgctcgcggtgaccctcactgtgccagtcgtgctgttccctgtgcgtggggcccacggctgagagggacatggatggatgggtagagggcataggcatggatgtgtgggtcaaggctggaaacaggagtggatggatggatgaaggaggcaaggatggacagacaggaaagggcagtgttttcagatggacagagatggcaaaaatcgataaacagaagtggggaggacatagatagcaggagagagagggtcaggggacagggtagtcagttggagggaggaggcacagatggatggctagaaagaagagggaggcaggaagggtcagttggagggtagaattaagaaacagggatggacagaaaaagggtggaggctgaagtgatgggatgtaggagggtcaagtctcccagatggggaggcagaactaattagacagaggagggaggtagaggtcagatggagagaggcagggagctcacacagggtggaaggatcggtggatggtcagacagaaggagaaggcaaagatggtcagctagaggaggaggcaaggatttcagacagtgggtgcaggtgccgatgggtgttcagacagaaggaagagacgtggattgtcagaggatggaggcaggaagcctgttcagaacatagagacacagatgttgggttaggcagggtggagccatagatagtcagagggaggggaaatcagggatctcagccagagggtggagctaaagacagatgatcacgtggaaggggggcagcacttgggtcctgacttctgtcccaccctactctggccacagatccgccgggccctgcagcagctgcttttcccaggcaaggccttcagctggccacgacatgtggccatagctctgatcctgcttgttttggtcaatgtccttgtcatctgtgtgccaaccatccgggatatctttggagttatcggtcagtaaacctcaccccagtcccataccccatctaatatgggccttgtccccaagtcaggttgactcctgtcccttcttcttgttctccagggtccacctcagcccccagcctcatcttcatcctccccagcatcttctacctccgcattgtaccctctgaggtggagcctttcttatcctggcccaagatccaggtaagcattccagggcagagctagggagagagggagcactccaaggagggagtgctcactccaggatggctggaggtgaaagggacatgcataggagggggctgggagagcatctgaaagaatggtctggaagaatgaaggtgattgtctaggaaggggcagaggagacagagcaccagcagggtccaggaagacagggagcactcaaacagaggctggcatagagggagcattctccagacagatggaaagagcactattgggaagagagctggaagcactttgaagaaggaggatggaggaacgtattctgtcatgggtcctgggaaggtggaaggactcgcagaaaggggctggctgtaaggaaggagagggcatacagaggagggtcaggaatggatggagcactctctgaaggaggtggaagacttgaggaacattctcagaaggcaactgggtgaggagtcccaaccagccccatcttgtctctctggcccacaggccctgtgctttggagtcctgggagtcctcttcatggccgtcagtctaggctttatgtttgccaactgggccacaggccagagccgcatgtctggacactgatcaggccctgctggcccaggtccctgtgcgcatgcacatggaggggtcagggccgctccctagggtccctcctgcccaacatgtggaggtggctggttcccatgaacgtggttgtcagaggcgggggacagcagaggctgcagactggcccacttccctcctccccagggatgccaagcttggatcatggccctaatcccaaccccaaccccatgggaggaggaggaggaggaagaagaggaggaggaggaggaggaggaggaggaggaggaggaggccaggtcctggtggagcctttgcccagcccagtcctctctgcctcctcctggctgaagctgtttgtcaggattaccctcgggctaaagaggaaaaataaagatgttgagctaccactctgga

SEQ ID NO: 11297 - DNA, 742 bp, Homo sapiens
tggctactacccctgcacctgttcccctgctgtccccaggcctctctgcctgaatctgcctctctctgcctcttttctcctgtccctccaggagtctctctgcctcaaccactctctctgccccttcatctctctgagctggtgtgtctggtcctaccctctgtttggggagctgtctggctctgtcccccacctcttggccagcctgtgtctcctgtctatgactgagcccaattgcctgttgcctttctgcaggtgtttccacgagcctatccctacccacctgtttgtttctgagtctgcctgtgtgtccctttctccctgtctctgcctgtcttccaagctcccctagcatcccctcctcccgcccatctgtctttctgtcccttctgtggtctgtctgttcctgtgctgtttctcatgcctgctttctttgtaacttcagttctcctactctctctctgtctcctctctgcacctttttctgccatccatcccatcctgctgtccgtctgctctgtgagtccatcccctctgtctgcctgtcactctctctagctgtgggtctacaccctcaatctttcaggccatttcccccaccatcaacacacaaacaaaccgctgtctccctccaagtgggtccagatagggggcgccccttctccacctcttcccccgcccagggccagaaggagggaaacgaaattaaaattaacatttcttctcaggaaaaaaaaaaaag

SEQ ID NO: 11298 - DNA, 1340 bp, Homo sapiens
acagcagagatctgtggagtaggattgtgggctggcagtgggtttatcccacagacctaagacagctacttaatttgtatagacccttcccagcctgggcctctgggttttccttctgggtggagatcatcttctgtaggaaatggaactgcttcaagccaagaagcttttacttttactaggtctttttgtgtcctgctgttcaaatattaggaagactgaaccctgtttcggtcttgacagtattacgtttcgtgatcccaaaaaaaagtgtttgtgtaacctcaagtcatgctgaaagtgaaatacagcttaaagtgggattctgctggacctgactcaacttttcacctcaccgcttggctccgtgcaggcagtatttgagtatgtggttccccctcaagtctgtaggagttgtattgtcaataaagtccaaggccagagtgcttgctttctagtaagtagagagaatttttgaaattcaacgacaaacatttattaagcccttattgtgtacagggctcaaagctaagtgctttgggtgattcagggtgattagggataggattccatcttcaagaagcctcccatctaggaagaaaggtcgataagcatagttttggacacacgggagagcatggctttctctgggcccagtaattactttggtatccagatcattagagaacggaatgccttctattgaactatgtaacagtcacaggtttagatcttctcaagttattattgcctttaatcttcatatgattcctatcctgcagttaggaaatggaaaccctaggatatagtgactgtgagctcagaaaattaggttgggagataagccagtagattgaggtggtagattcttcaagatcttgaaggggggaaggtgggggggggggacgggggagctgttcccagctatatttgcccttggcagatgggatggattctgggagaaagctctaagaaattaggcctgtacgacttattttcatgaatctagctgctaagctggaataagtgaagttaaaagtagtgatgggccaggcacggtggctcacacctgtaatcccagttctttggaaggctgaggcaggcggatcatgaggtcaggagttccagaccagcctggtcagcatggtgaaaccccgtctctactaaaaatataaaaattagccaggcatagtggcacgtgcctgtaatcccagctactcaggaggctgaggcgggagaatcccttgaacctgggtggcaggggttgcagtgagctgagatcgtgccactgcactccagcctgggtgacagaatgagactccgtcttaaaaaaaaaaaaa

SEQ ID NO: 11299 - DNA, 147 bp, Homo sapiens
acgcctgtaagcccagctactcaggaggctgaggcaggagaatcgcttgaacccgggaggcggaggttgcagtgagctgagatcgtgccactgcactccagcctgggtgacagagtgagactccatctcaaaaaataaaaataaaaa

SEQ ID NO: 11300 - DNA, 590 bp, Homo sapiens
ctattttcaaggagttcacttacactcagggaccctaggaacatttaaaggataattttattgtcataatctgcccttaacaaaattaacaaaatgaccctcaaaatttgctgattcagccattcctagcaatgaaaggaggaacctggctacctaccagacttcttatttctggtgtacttggttcttggtgacctctaggcaggcagcaccccagcagggctggactgtgtgtgctccctggaaggctgacatttccggagtgtgaatgctggcagtaagacatcggaagcatcttcctctttgagtgtgccaactcttggccaaagatagctctagaaattgtaagaactttgagagcagattctgtttgtcctatagaaaactcccatcagcatattgcctctacatccagctagaatgtgtcagatttcacatgttcattcatagtctcaaccactcttttttcccccctctctttttatctttttccagttttttgtttgttttatctcttcatcacggtgaatggggttcttacagcttagagttgtcttgtttgtgtgtactcatgctcttgaaggaagggg

SEQ ID NO: 11301 - DNA, 16772 bp, Homo sapiens
cggtgccgtggcccaggggccgggccgaggtcccgggggcggtgccttgcgggcccgtcccggggcggtgcctggtgggctggccccgcggctcctcccctctctgcgggcccagtcgccctttggccgggcgagctaatcgtcggctcaatgacgacgaggcccgacccttcccgtccaggacctacagagacaaccgaaggagagcccaaggcggcttctttgctgtcgccgcccccactgaagcaagagctccccggctccactgaaacaccagctcatttaagctttccccaacgcccggccctccgggacgatacctaacaacgaccggcgcccgcatctggaataggctggcgagatacttagtatccgagggctcgggacttggcgccatcgaggtcatggggacccaggatccagggaacatgggaaccggcgtcccagcctcggagcagataagctgtgccaaagaggatccacaagtttattgccctgaagagactggcggcaccaaggatgtgcaggttacagactgtaagagtcccgaagacagccgacccccaaaagagacggactgctgcaatccggaggactctgggcagctgatggtttcctatgagggtaaagctatgggctaccaggtgcctccctttggctggcgcatctgtctggctcatgagtttacagagaagaggaaaccctttcaagctaacaacgtctccctaagcaacatgataaagcatataggcatgggcttgaggtgagtagaccccattgcctagaatgcctttggcttcactttgttccagctcaaaacttctagcagaggtgggaaagggcaagaaagcagttgggcttcttgtctgagtgaagcggtccctatccctggcatattttaggcctgtggttttggaccgtgagaccaggtcacatctctttgcaacacccttccctcccagtgttttgtcttttcagaaggaaagggtaggaacatttggtcatgcaatcagcctttcccattcaggctcttctcacatactggtttccaatgacttccctttgggattagctatactttgtggcaaggtaggaaaggataatctggctgctgtgatactaacacaatgttgttttatttgggggtgggggggtctcaaccccttatttcccacaagcagctggggcattctctgtacctcattagacacactgttagagtcccaacactactgcttctttcttcaagctttagctccagggagtaggtaagaagagcctccctgccctcacctctgaagtgatgagaaggtgctgtcattctgttctgggatagagagctcttgatattaagtcatttatcagagaggcactgccatagatgtagaacccatctagatccccactgagttcaaagactagtgatgaggagccagacccattaacaggaacaggtggatgtgaggacagaaagcatcaccctgaggtcatcctgactcagtctacacaatacacacagaactgtggagggaggcataaagcttgggaaaccctgcccttacagtttctagagtaggagacccttcatttccccagtcagtgctgtggggctgtgatggggagatcagttatctaaccctagccctggggagtgggaagggcctgatgctgcctgcacatctggctttgttggtgcctgtgggtagcctgtagcagagaagaatcatccctccaggctgcttctggaatcaattcagtccaagtttgaccccaaaagtttttgcatcaaaataggatctagtgtacatagagaagtacactgagttgcatgtggtaggaacaatgagatcaagaaaagatgggcatcctagcctcttagcccttaaatatgaactgagtcatagaggcctgaagctgtgctcaaccccctggaccctggctccccattccaggatagagtggggggtactgatacaaggcttttggaataggatgagttcctatgaggagaaagcacaggtgagacaagaattctaagtgataactcttgagttgaggttgaaattgtggagaaggccaaataggtcaggaatggccagctaccatattaagggagtaagagagctcctaagatggagctgaactgtgggcactctgaccaggagctctagcaagacagaattctctgggtcttaccttcgtaagaactcaatttcaattgttctcccttccagccagagtccactcattcaataaatatttattgagtgcttgttccatgccagatagtcctttgttctgtctgtcctcatagattgcagttactctccctggttgccctaatcctcggccacaccctccctctaccagtcctttctggtctctagtttcaaagtccggttttctctaagctggcagagaggattctctgccttcctgtcatcccatcctttgtcttccctcttctttccacccctagaatgtgctgtccctttttattttattattattttttttttgagacagtcttgctcttgtcacccaggctggagtacaatggtgcaatctcagctcagtgcaacctccgtctcctgggttcaagcgattctcctgcctcagcctcctgagtagctgggattgcaggtgcctgccaccacagctggctaatgtttttgtatttttagtagagacggggtttcaccacattggccaggctggtcttgaactcctgacctcacgtgatccgcccacctcggcctctcaaagtgctgggattacaggtgtgagccaccgtgcctggccgctgtccctattcattaatcacatttcttctcctctgctccagtctgttatctctcttgtgccccatcatttgtatgttcattcatctgtaaaattggcaaatatgcattgactgcagaccatatgtcctaccctgtgcttggacctgagggtaatattcagctagtctttgtcattgtccctttccccaaggaacttaaaagtatgtcagcctcacatgaggaacattgaaataacaaggcaatgtctgattaggaattgagataacagtttgtatatatgagtaataatcatacctgtactttatggctttcttatctattatgtcatttgatctttcaaccatttcattagatagctagagcaggtggtatccccattttgtagatgaggaaactgggacttaggggttacttacccaattatttggttagaagtggtgtgactgaacagtaggcataatgtggcagtaggcaggagagtggaaatgggaaagagtctggcagggcaggggctacttagtgaggacccatctggaatgagaatttgtaggaaataagattagaagataggctgggacagatgtcagagccttgaaaacagaatcgtttgcctattgaaaacagcctcaatcatttgcctcttggatatagggctgtaccaagcccaggaaaatgttgggattttttgaaggctttaccaagagcaaaatcagaaagcttcacagtttaaatgttgaatttaaaaaaaaaaaaaaaaaaggcttgagaggaaatgtccagaaataaatataaacactgattgtctatgggtgagattatttttttccccctttcacctttcataattagaaagaaaaatgatcattttaaaaagaagaaaggccagaagcggtagctcacgcctctaatcccagcactttgggaggccgaggcgggcggatcacctgaggtcaggagttcaagaccagcctggctaacatggtgaaaccccatctctactaaaaacacaaaaaaatgtgccaggcatggtggcgggcacctgtaatcccagctacttgggaggctgaggcagaagaatttcttgaacttgggaggcggagtttgcagtgagccaagaccgagccactgcactccagcctggacaacaaggaacgaaactctgtctcaaaaaaaaaataataaataataaaaataaagataagaaagttattcccagcagcctatgcctgttttggaggtaggggattgggggcggaggctgtaggccaggaaaccataaatggtcctttcagcacgtcagacagaagctcctgatgttggaaataaagcagtggtggtggtgctagagaggtaaggagagatcagaaagccccttctgaggagaacaaaggagagaaacaaagccactccttcacttcagctggggtgactgggaagatgaagggaccttgaactgtatagaaatcaagaggaagaaaggtttgaaagcagatgtccttgggacatttaatgggaggtcacagagagaggcaggtgactcagcctgtgaacagctgcccacctgcccccttccactcacattgcctcttgctcctcaggtacctgcagtggtggtaccggaagacccatgtggaaaagaagacacctttcatcgacatgatcaattctgtacccctaagacagatttatggtgagccccaccccatctctgctctgctcagagaaggcctagcctccaggtctaccacagttaggaagagacttccagcttatgcaaattgcactgttccatcccctaggttttcagaggaaccaggctttatagtctagaaagttagaaatgggcttattttcctctcccaataccccactaaccaccctgatttctctaggttgtcccttgggtggcatcgggggaggcactattacccgtggctggagaggccagttctgtcgttggcagcttaaccctggaatgtatcagcaccggacagtcatcgctgaccaagtaagagccaggaggtggagaggccaggacaatacctccccaggccaagaaggaaggacctcttggctagtgtagaaggtagcagttagatgtgaataagattcaatctaataagtactctcgggatgcttcctgtgtgcccagccctgagctaggatataccgtaggaataagacacacacaagcacacattccttgaaagagtaaacagatctggcatttctctagtaaatgcctcctgtctacctcactgccccaacccaactagctgaggcagcccccaaccacagagaatgcagagaattcccaaatcacttaacctgcctgaaagaacattttgtaggactggaagggaaaagaaaacccaaagtctataaactcatgggaaaaaaagacacgtagtacaaggttcctcaccctgattgaggaaccttcaccaaagttcagctcctctgctgatcactcccctggaggtctcctggcttagggtctaaaaagctccttctctcccaggcttagatctctagccttcttccctcttctgaagcttcacttttttccttttgctcctgcatcacatctgggccttaaattgccagaagtatgtgtcctgcctctcatcatctctctctagttgaccgcccctttagagttgcctaggaagttcctctttcttggctccagcattcagcctcatcttcaaaggaaaaatgactagcaaatctttagtccaattaatgacaatacccttcctggttcacgtttaccagccctgcccatgtcccaagatccctctctgcctcatcccttaggtatcctgaggggaatggcttccagaattgtgactctacaattaaagtaattattgcatgcttaacatgtgctagacactgtgctaggctctttgtatactgtttaatattaaaaacaatcctacaagggaagtaccactattatgctcattttgcagatgaggacactaagatccagagaggtttagtaacatgcgcaaggtcacaaggttggtaaatggaaaggttgggattcagaaccatttctttctggggtgaagagcttgtggtcttaaccattatgtaccattccaacaaaatgaaaaattattttatacagttgtccctcagtatccatggggggttgggcccaggacctgctatccgaggatgctcaagtctttgatttgaaatggcttatagtatttgcaaataaccattgcacatcctcctatatactttaaatcatctgtagattacttataatacctcatacattgttacataaacccttgttgtgccgtacagtaaataaagtgtgtacatattcggtacagacacaactttttttccacatattttagatttggttggttgaatccactgatgtggaactcacagatatggagagcccactgtatacaataaaaatatttgacatagtttgaaccagggaaagggatattaatccctcatagctcctaccctccaagagctaaaactttttttgagaaaataagacttaggggaaatggagactgtgagaccacatcagtgctaaaaggagaggggtggatagtatactgtggaaaaagggacggtgctgcagatttcgctcattccctccacatacatgccaactctgaagaagggtgcatcagtgaattaaaaaatgtccctaccctcagaagaatccatacagcagtcagggacacagaatggtcagtcaatacattataacataatacaccaaatgctagaatagaaggggaggggggcacacataatgactcactgctggaagaagtagaggaggaagagatggcttttgacctaggctttgaaggatgagaggtttcaccagatagcgaacaagcatgagcacaggcatggaggagagaatgtagtgtgctcaaggaacagtgagtgtttttatatgaacagactataggtgcttgaacaggtgatgagtctgatgggcagggagaggccagctcaagaagggccttgaaagccaggcaagagttgagactttagcctgagggccatggggagtcactgaaacatcctaaccaaggactgacatatcttgatttgcctgtgagaaagatcactctgctacccagatgaaaagggccacagaaaaagcaggagattgggcttaagtgaggtgctaacaccaccgtagtggagaagggagagaaagcttgggagatagatggatggggaggtagcaggacttggtgattcactgagcctgggggatgacttgaagctgatggtgcagtggtaacagttgcaggctctgaaaggggaggagctgatttgaggagagggaagacttagtctgtggtccctgtggtttaccccgttccagcctatctgccctcttaagttcacagtgtgcctgcgtcgggaagggcagactgtgtaccagcaagtcctgtccctggagcgcccaagtgtcctccgcagctggaactggggcctgtgtgggtactttgctttctaccatgccctctatccccgagcctggactgtctatcagcttcctggccagaatgtcaccctcacctgccgtcagatcacacccatcttgccccatgactaccaggtgaggcccccacatctgtatcttccattgccctcccttccccaggacctgcctctgctagaaactgcatggcctgcgaggcgcggtagctcacgcctgtaatcccaacactttgggaggccaaggcaggcggatcatgagatcaggagatcgagaccatcctggctaacacgtgaaaccccatatctactaaaaatacaaaaaaaaaaattagctgggcgttgtggcaggcacctgtagtcccagctactcgggaggctgaggcaggataatggtgtgaacccgggaggcggagcttgcagtgagccgagattgcgccaccgcaccccccaaaaaaaaaaaaaaagaaactgcatggcctgtgaaagggaggttggagccatgaacatcacactggcttcccagaaccaccgcccaactggttctggtcttctatattccctgctaggcagcttgcctgggaatatggggagatgcaagtggacaaaagaagagtacactggggagtatttgagtcaggtcctctgtgtgcccaggactgatcctagcagagtggggtcaggaggcgctctactgggaccgtctgagtctaatcttctgcccccaggacagcagcctgcctgtaggagtctttgtgtgggatgtggaaaatgaaggggacgaagctctagatgtgtccatcatgttctccatgcggaatggactgggtggtggagacgatgccccaggggtttgtggaatgagcccttctgtctggagcgtagcggggaaactgtccgggggctgctcctgcatcatccaacccttccaaacccctacacgatggctgtggctgcacgagtcacggtaaggaaagagcctgccctataccttagcccctgaaccccacctccaccccagcatggtctcttcatccaccctcatcatactcctgtaagcccctgggcctgggaggttaagagtaagtaagaggagctggggagctagccgggacccagtgtactcgtggagcctgccctcacagtccctgaccccttcacaggcagctaccacggtaacccacatcacagcctttgaccctgacagcacggggcagcaggtgtggcaggatctacttcaggatggacagctggactctcccactggtgatggggggtctgactgggagatggtgggaagagaggttgtccctgtcttgggaccaggggtgggaggcctggtaataagtaggccttgtttccatgttagggatccctatccctggggctgaaggggctcctgtcctgaattctcttgtgtttctctcaggccaaagcacccctacgcagaaaggagtaggcattgctggagctgtgtgtgtttccagcaagttgcgacctcgaggccagtgccgcctggagttttcactggcttgggacatgcccaggatcatgtttggagctaaaggccaagtccactacaggtgaggggaccaagaaagtgtaaggatccagagtgctggggctctgacctggggcttgtgttcatccttccccttcccaccccaggcggtatacaaggttctttggccaggatggagatgcagcacctgccctcagccactatgcactgtgccgatacgcagagtgggaagagaggatctcagcttggcagagcccggtattggatgacaggtgccagtggggcccatttcttgcctttctcctgggcactcactccaaatgggactcctcgatttactctccacccaccaaagtcagtagacttgcactgggattcatttgatgatcccactctgctgaacccccaaatcctttccatcttgggaggtacatgttccttaaaccatttcctcctcctcgcttcccagatcactgcctgcctggtacaaatctgcgctgttcaatgaactatacttcctggctgatggaggcacagtgtggctggaagttcttgaggactccctaccagaggagctgggcagaaacatgtgtcacctccgccccaccctacgggactacggtcgatttggctaccttgagggtacaggatgctggtgggctgggatatggcaggccatccccaagtcaggatgatggatttgcctaccccagggtattggttaggatgagggggtgttgggtgtggactagtaacaatgccccacctctaaatctagaggacaagctacagaggggtttgaaggggaagcaggaattctggcaacagtgtgtctcattcattcctccaggccaggagtaccgcatgtacaacacatatgatgtccacttttatgcttcctttgccctcatcatgctctggcccaaacttgagctcagcctacagtatgacatgggtgaggatcccttttgtgccgcttctgccctcttggctccccatacccccgaacttctgtggtccctcagattgtctcttctttcccttcccttcatacgtatctgcatgctgcttactggttccccactgcagtcacacacatagctgtgtgcccctcctcaggcatgcccattccctgcctcccttctgtgtctctcccccagctctggccactctcagggaggacctgacacggcgacggtacctgatgagtggggtgatggcacctgtgaaaaggaggaacgtcatcccccatgatattggggacccaggtaaaagtccaccccaaggtcagcttccctccctcaacttttgcaccctctaccctatccaccaatgcaagtgacccaagtcccctcctctcccacagatgatgaaccatggctccgcgtcaatgcatatttaatccatgatactgctgattggaaggacctgaacctgaagtttgtgctgcaggtttatcgggactattacctcacgggtgatcaaaacttcctgaaggacatgtggcctgtgtgtctagtaagggatgcacatgcagtggccagtgtgccaggggtatggttggtgtctgggaagagcctagctggttgttgcctttcctcggtacctaggtcttcaacatcttggtccctctctaggctgtgatggaatctgaaatgaagtttgacaaggaccatgatggactcattgaaaatggaggctatgcagaccagacctatgatggatgggtgaccacaggccccaggttagcgggtaggggtttccaggaggcctgaggtgagaaactgggcaacaagggattgtagggctcaagaaagaatgactcattgtctattacacggcatgggagcagctggagctgccagtctgacccccaaacccatgtccctgatcagtgcttactgtggagggctgtggctggcagctgtggctgtgatggtccagatggctgctctgtgtggggcacaggacatccaggataagttttcttctatcctcagccggggccaagaagcctatgagagactgctgtggaatggtgagttcggggagcctaagtagtcttaaggcagctgagaggacaccaggagccttatttttctcttcctcgactccaggccgctattacaactatgacagcagctctcggcctcagtctcgtagtgttatgtctgaccagtgtgctggacagtggttcctgaaggcctgtggcctaggagaaggagacactgaggtgagagaggaggaggagcagccagagagaaaaatgggttttccctggaggtgggaagtaagtatatgagaccatgttcctgcccttgcccctccaggtgtttcctacccaacatgtggtccgtgctctccaaactatctttgagctgaacgtccaggcctttgcaggaggggccatgggggctgtgaatgggatgcagccccatggtgtccctgataaatccagtgtgcagtctgatgaagtctgggtgggtgtggtctacgggctggcagctaccatgatccaagaggtaatgcactccttttcccatctctccaccatctgtatcctggcccagaaaacttcctcaaccaccaaatttcttcaaggcataacccaatgccatcttgtccgtctataaagcctcccatttttccctggtatgcattccagctcctgccttcaggcttctgtctgtgggtcatagttatctcctccacttgctgggagctccttgaaggcaaagactctactgcctccatctatccagtggaagtggctcttcagagggtgccaagttagtatgtatgactgtcatctctcccaacagggcctgacttgggagggcttccagacagctgaaggctgctaccgtaccgtgtgggagcgcctgggtctggccttccagaccccagaggcatactgccagcagcgagtgttccgctcactggcctacatgcggccactgagcatatgggccatgcagctagccctgcaacagcagcagcacaaaaaggcctcctggccaaaagtcaaacagggcacaggactaaggacagggcctatgtttggaccaaaggaagccatggcaaacctgagcccagagtgagccgtctgaactgtgggagggaagtgctaacagcccagcctccagcctggcctttcctccttcccctctgaacctcctgcaaccctgagccatcaggacaatcataccccttcccttctctccacccaattgtgccagtaaatgggggttgagggtgacctaggcagcattagaatcacttatttatttctttcctcacctgttccctgactgcgtgaaatgttcagggaggtcagttgatttccccaggtacattcatggtgtgacagacacatgggtacaaataaaagacccagaaagccattaagtgtggtgtgtttgagccctcagtcgtcctgacagggcacaggagctgcggccagcccttgcccaccgctttttatttggacacagatggggagccccccaggctcctgctgagaccccccacatatcctcatatctagcctgagtatctgtcctgcaaaatgacagaggggctaccagtaggaagccatcctcccttccttgtgagatttgcctgcagggggaggatgggacctcggcagagaggctctgagaagaggtcagggaatggccactccaggggaggctctgcactgggagcctgaggcatgtaatgcagcaggcaggaagtgttgccaggggcctggagtacacagtctgagccgtccaaccactggtgtgtgctgtctttcggcacttctgactgcagggcaggcagctccagctggtaagggtcctcactggggagggcacgaagctggcgggacaacactgaggagacaaagaatcttcagaggccaacccagacctctccccttgccctgtctgagagctatccttaagcctcttacctccatgctcagctggcaggctcccccttgtgtcagaggagtacatagcaggtacaaggaggaggcagaaggagactagtaggacctagagcacaggaaaaaggagatgaagaagggctctggattgccctgtccccaccaactgagaaaaggatttctcccctcatcaccatcctcaccaagatgcaggtgctgctgctgctggttttgtttgatatctcaatcaccatggcctggagtttcctcagttgatctagaagggacctagaggaagagaggggccaatagtgagcatcccctggcctagcatcctgagacacagtgaaactcctgttcaggccacctcctccatctctgcactggatcctctctcttacttttcattctatttttgcaaacgacttcttcctctctggacaaaatgcctgaagttcctcattaaaacaacaacaacaacaaaaagcaaaaacaaaacaaaacaaaaaaactctgccaggacttaacctcctttgcgaatatcatcagtcgttccccactgtctgatcagctatgcacataatcctcaccaggcattttctatgttctctaccttctgtcccagctcatgtgtgttaagagttccagcccaagatgactatgctggactagtcctcttgcctaggatgctttctctctgcctagaatgctttcccaacccaaccccagaatcctaactactatgaaagcccatgacgtctttcttaccccctttctttttcttggtacttaacttattcttagttacttgtaaatgtattcctcactactgggagcttcttggaatcagagacctagtgaaggcagctgcccagttagaaatcaagtgtagggcaggggaaagagtgagaaagcattaaatgaggggcataggaagggaatggtttggagggatacttacaaattctgttcctccagaagctgtactttgttctgaagctccatattctgggctgtgtatttcaagaccctgggggaaataacaaagatacggggatatggcctgtatcctcccttcaaaaacctaatacttacaacagagtccctctccctttcatacctgctctctaaacccccaacatacaccttctttttcctgcggctctcttgagcagatcttttatttcgaatcttcctccgcacacgtttcagaatttgttcctctgtctgaaaggaaacagggaaagggatatcattagaggaactctagaaaaaggagttgaaacgcaactgagatcaatctctttccaatacagaaatcccttctacagcttccctgaccaacaggcattcagattctttctgaatgcctccacggaccaggtgttaaccctaacaagccagaccattttaaactattaaaaaaaaaactggtcgggcagtattcaggcgacgtggctcatgcctgtaatcccaacactttggggagctaagacaggaggaccggttgagcccaggagtttgagaccagcctgagcaacatagtgagaccttgtctctactaaaaataaaaaattagccgggtgtggtggcacatgcctgtggtccctgctactcaggagactgaggaaggaggatcacttgagcctgagaggttgaagctgtagtgagccatgatctcgccactattctccaacctgggcaataaagcaagaacctgtcttcaaacaagcaaataaaaacttccttatcctgaaccaacagctgcctccttataatttctatccgttggacttacctagtatctctggggccaaatagaataaaccctgtttagctattttaaggcacttaacatttcctcagagcttaaagaaaaaaaaaaagacaaaatttttaactcatcttctcaggatagactgcatcctcttagtatctgtcaaagatgtgctctagccagtatcaaggaaagcaagagagtgacttgtagagacaataactctattgctacagtttccaaatcccatgaactttcttagtagccacatcacactgctgactcatcttgtactttgaagaaattaaaattcttcactttgggaggccaaggtgggtagatcacttgagcccaggagttcgagaccagcctggcaacaaggcaaaaccccatttctactaaaaataccaaaaaaaaaattgccgggcagggtagtgtgcacctgtagtctcagctactcgggaggctgaggtgggagaatcacctaagcccagaaagtcaaggctgcagtgagccatgatcacatcagtgcactccagcctgggcaacagagcaagaccttgtcaaaaaatatatatatattcctgtaacctttctattaatgagcactgatttcatcatagtaccccagtactctgcttgtgaagttgccactcattgcttaaaactgaaaactaaggattttacatttattcatgtactgcttagtccaaccctgttgaactctctaaacagttctaccattcagcaagaggtggattactatgaagccaacgaagtgtcaaggcccttcacttacacagtcctttccaaggcccaatactaatgttgcactgataattttgagttatttttttaacagaacaccaaaatttgtataagcccaacaaaaacgaggatctgcccttgcatctggcatattgtgtacctgcctcaacttcctattagcaataaatctactaagtttctcacctcaatccttttttaaagttattgatataaagttaacagaatttgcctacttgggacttttaatcccttttcagcctttgttcaaccaatgagagtcttaccttagtgagaggaagtgtctcaggcagaataagcccctccttctccaatagactcttctcctcatctgtcagtactagcctagcaatctcctagggtaacaagaaagtggacggcagttgcatggggatgtcagagaggaatggggaatcctgcccccacctggggaatgtgagagtaatctcctgaaaatcaagtcaagtacctgctctgccagctcctccatatgctgtggagtcatctgggtcccctcttttctacagctctcactctctgcaaaagggaaagtatgaatagccaggcccatgaaccctgtcctccccgcaaacttatttcagactcacctagatccatagagacagtttcccgtgggagggagtaggtgtggtcatggtggacaaggcaggggttggaggagctgagaatgttcaacgacgctgggggactcagcagggagcacagcaaatcatctacttcccagtcgctcggtacctgcgcagggttccaatgaacaggccttgaccttatcaccatcacctgacttcatggacatcccacgctttccccagtcagaaccccaacctacctcagaaagcggcagcgcccagtccagtggggccctcacggcctcatcgggtgccgtccccaaatctccactttcctctagcaggaaggccagcaggtcttggtcaccagcatccaattccagctccatttgggacaactacggaaagggtgggccaccgggccccaacgtccgaagcccagacacgagccccaggccagctgtaggcctcgggcacctatccactgtccctctacggccgggattccccgccggcggctttccatagccctctccggacccgcctcccaggctcaattctcctcagcctccaacgcagcgaaagtgacgcaccccaccccgtggcactgtgggacttggagttccctccaactgagaagaggcttgggtgcagcgccacgtcccaggggctatgcaaatgtaggggacggccctgctgccgcctcgcaccccgagggcgggggttccggggctccggctccgccttctaccccaagctagaaaaaggaagagttctagcctgaaagggaactcgggcgtcgtcctggcgtcctctccggattgcg

SEQ ID NO: 11302 - DNA, 3118 bp, Homo sapiens
gaagggagggcgaggccggagcccgagggcgacccgagaagcggcggggcggcgggccggcgggcggggcgcagagccaggcagcgcaggtaggccagaccgggccgggcgggggccttagggtggggccgcggggcctggccccggggcgggcgggccctgcctctcttgcgtgtccggttcgggtcctattagttggagaggtcagcgtccagcgcatctcggcttgagctcggcgtgaagtaggccgtcttggggaagacaggcctttcctgggagcagtcctatgtctgggataggctttggggagcgtgaggagtcgggtggcagcggggcgcagggcggggacgggctttggtgttagctgatagcgggcatgtgggtaggaaagctttgggtgagttggggattaggtggggtccgtttaggaatcaagggtcgctataggagttaaaagctggggttaaaacttaagagttagtgtgagtcaggtccgttttagataggtaaggtttagattacggtcattatcttgtttgctgggatggccatcatacgtcataatttgagttcagggtcaggttaagggtcaacaaacaacaggaatcaggttagagcttgtttgagggattaaagaatgttggcatggtcggtgttaaggataaacagtgaaagcgtgagttaggaatcaaattataaatgaactttaggcttaggggtcaacatttagggttaacatcaggggatttggtgctaaaggcaaaacttagatcagtttcagggatcagggattggatatgagtctgtgctaggaaagggatgaatgtccaagccggtactgggaatcaggaaacaaattagaggtggggttaatgttaggaatttggggcagctttaggggttgtggtttgaggctagcatagttgaccttgagcagataaaatttaagaggttggcagtaggtaaatgcccttcttttgtagggaaatcctttattcctatgtagttacaggggcttctttttacccagagagataaactaatttcaggctagcgttctggctttagctagaattgcaggcatctgggattccagcttctttattccattctctaagcccaaggcccttgctgtggccaccacagttaggggacagagattctggactgtgttgtttacagacaacataggtgggaaatagggacccaggatgtacaaggcctagtcacaagttggggactgcctagggaagaaggagctgatgactatgggggaagctaaccaaggaatcactgttgccatgggagaagggaataactgaatcccctgaaagtttagccctgcttctcccacttcacttgttctcttggtattaagccctcctctccaactctcatccctgactctgcatttcacacccatcctgcctatccccttacaaaatacttcccttgcctttaactctcccatgctcatcttatcatccgttcccatccttagttctacctccctcaccaacctttaatccgcacatcctacctgaatttaccctcatcaaaacctgagctttcccatcattttaaattactctcctaccattttcacccagtcatgtacctacattccacctggtcatctgctgaataccctactcccatcccctgctgtgtgtcaccccctggatctaagcctcttttaatttcttggaccatttgtagatccccttcccccactccccaacagaaaagaggaaacgagacccaaagaggaaactgggtcttgctgatcccacgcccagccaggccactgaccacacccccacttcactcccagcctgaccctgccactgaccacagcactatcctctactcagcctgacccagccactggctgtaccccatcccccatcccagctccagctttacttagacattgccaatgtcccttcactttcccacccccaccccagtctgatttagtgactgaccacaggcccagctcttctcaacctcctatagcctgacctggcctctgacctcaccccatcattccctgacttagccaccatccatgtaatcattccccttcccccaacctgatgcagtgactggtcatatatgtatcttatgtatatgtatttttccaaacaccatcatcaccagcattctttttctacaccctgtcttctcatcctttttctacaccctgtcttccccattcccagcctgatgcagtcactaacccaaccccatctgcccctagtggctactaatcatatactcataccctttttccccacagcctaaccacatcccgtaaccacagcctcatcctcacattctctgcccaacctgatcctttcccctcttcccaattcgtcgcctaaactcaagctgccccagccgctaaagtggctgctgatgataggaagctgtgggactctaacctgtctaccttagtagttattaggtcctgtcatttctacctccccaaacttgttctgagtgacatcttcctcaatgccattccaactccggcttcattacctttaatttgtactaatacagtgtccttctaactaatctccaaggtaactgccagagttatttttctaaaatccagttccggttatgtctcttctctgctcaaagactcccttggcttccttttgtcctccaataagtaaaattcctcatacccctctccagtcttcctctgcctttccatcctaaccctgacttccccaccactgctcccttgcaggtacccctgtgcttcaacagcctgcctgctcacttccctgaatgctcctccacgatttactgcttctccatctttgcttatgctatttctctgcctggagtgaaaactacccctgacacatctccagctggctggcgtagtggagaaagcttgggctttgcagtcagaaacctgggttcggatcctggcttcacaacttattatttggagaagtatttgaacaagtatttaacatctttgagtctgttttctgatctgtaaaaatggaaataatgacacctactgtaaggattaaatgaaattatgtatacaatgcaagtgacatagtcaataaatggcagatcactattgttt

SEQ ID NO: 11303 - DNA, 10231 bp, Homo sapiens
ttttttttttttttttttttttttttttggagacagggtctccctctgtcacccaggctggagtgcagtgcagtgatgcaatctcggctcactggagcctcagcctcccaggttccagtgattctcccatcccagcctccagagtagctgggattacaggaacgcgccaccacacccagctaatttttgtatttttagagacagggtttcaccatgttggccaggctggtctcaaactcctggtctcaagcaatctgcctgcctcggcctccccaaatgttgggattacaggtgtgagccactgtgcccagtccatcatctattgtctgtaataatttagaaatctggcaccaggattatgaaattcactatacagtgtgtggcataacaccaagcttaaatggtcactcagtggacttcacaataatggccactttatgcttctggatgcaaaacgttgggagagtttgaagtggatatgaatttgagaatgcgttttcttgtaggaaaagtaatggaaacataagcatctttttctaatcacaggaaaggttaaggctttggtgaaagcaagcataactgagtttaaaaacagtctagaataagaaaagggtaatagaagaggaaggaaggcagaagtggaccatgcagaataaacaatcaagcctagcttttttaaaaacctgaggtcttactaaagagaaaggaggaaaaacggaagatttcaacataagagtgttaaaggtggaaaagagccagaaaggactgtgggcttaaaaaaaaaaaatcagtgaagcagtagtggtgtatgttggcaaagagaagtgtagagttgagaggagggagagaatttatagtagaggaagtcggtgtgaagttttcctctcaagatgcccagcagagcaaagaaggaatgaaggcaaaggccactgggaatagagtagggctggggctaaaacagcacgggagagtgcaacagggcccaaagtaagacattttcttttcttttcttttttttttcattaattgacccagatttgcttgtttgggaccaaaggcaatgcagagtttagggatctttataatttataaagtaatcacctttggcccaacataacacagatcataaggatcatggcagaattcgtctctgagacaagtacaaaataccattttagagttgattttagaagagaagtcagactaataaattgctgtgttgtagaaatactatggtgaattaaacagctttaactttttctatcagccacaggataaatacagaaactgtataattacatacacatccacagaagatagtagcctcatatgctaaaattgtgagttgtttgtctgtatactgtagtccaaagctcccattccaagaaatgttttatttggttcaaaatataaagggcaggttagagggctacacagaaaaaaggctaaaaataaagacagtaaaatgagggagaggaaaagtggaagtgcagcactactgatccagaaaaactgaggcatcagccacaaagaattcaatcaagtcagtgaggggcaaatggcacaaaagccaaacaagaaaaaggctgaataccatattaccaatctgagagcctcacttttggttttaagtcaaatattgaattagattgtgcaacttttctatttttatttttttatttttaaaaatccaccaaaattacttaaatcatttgacagagtcatacaattttaaatgactataaaaatgtgcagatcagtgccaaattttttggcaaaggctgaatggcagacagtaatccaagacgcagacaaccttgcttttaagccatccgttacacagagaccagcaggctcccttctacctgtgagaccaaataatcccaaaatgtaaccaaataatcataactccccctactcctaaaacctacccttcacccttcactgtctacgtcagcctctggacagacctgatgcctggggtttggccatttccgccttcccaccctgtgttggtctccctcctccctcctcaggtccctcagttctcccaggcctaacttggcgtgcttccttcctctctcaccccaatcaatccggctctccttccctttctgggttacgccacctgcccgactcccggtttccccctcgggggcccctccttgccctggggtctgctctcggcccgccaagttctcccaggggatccctccccacctgcctccatacagtcagactgtgttcagtgtccgtttcgcgcccgtagcgacaccacgacagaagcccactaagtgaccctctgctcccagaaaccctcctggctcctccagaccctccggggctctggcccgcagctcccctctccctccggcggcgggggtcggctgtgactcaccagagggccagcggccggggttggggtgggggggccggaatgctctcacttcctctccgcgcacctgccccgaggctggagcgccgcccggccgggcctccggcggatgttttccttgttcccaagcgtgtagtgcgcgccagccgccccctccgggacctgcgcgccagccaccgcgcccccaggacccagcgggcctggtcctcaccactcaccccctccccagcaggcacgcatgcgggctcgacccacacctctgcaccgccccccaacttctgggagaggactcctggctcagcccagcctctagctttccagaagcccctatatgcctacctcatcttcgttataggcgatgaaccttcacttctgtccccgtttccgcacacgcaccaatccccactggcgatcccttccccttcggcatcacccccaccttcatgcgccccagctccccactcacatccgccccctattgggctggctctagcttgcaagagcagaaggtggcccagggcccagccttccaggatgtcccctggaccccctctctgggaaaggcggcagagctactggccactgacaagacctttgggccctcgtgctagacaggccttcgaatccacctgctccagcccagagagcaggcccaggccgtgcctcccacaccgcagccgacctcagagcaccctgcctcaactgtgagttttttcttggcaatcctctgaaacggaaagggtatcagtcctgactagggcgaacgtgaggtccattctgcatctccatccaccttagctgtctccttggaaaaggacagcaagggagtttgaggtgcactgacacagtcatttctgaacagtgaagagatgacaggtagggtggtcccccttgaaaagtcagccagaagtagctgtatctgatgcactaggtggcagggagtgagtcttggagtaaatgggactgaaaacgtagaaaaaccaaataaatgccaaagagactatccctatggagaatacctagaacatgggtctttgaagtgtggaaaaatgaaagaaatccaatttgaccagggcctttagtgccaaagagatggctagcaggagagtggtgagaaaggagaactggagagttcacatgagcggaaataggaagaaatggatccaaatccaagtgagaaaaagcaggagacttaaagttagcctggcaggatgatgagaaaaggacatcttgtcctagggtagaggcgagggtgcagatctgggggaagaaggcttattgggaacagtttctcaaactagacattcagaagtcaatacaagggccaaaaccaaaatgttcctggaggtacctgtttttgaaagaggtgggaaaggtgacatggattaggggtctccatcccccaggccacaggccagtaccagtctgtggcctgttaggaagcgggagcacaaagcaggaggtgggcggcaggcgagtgagcattaccgcctgagctcctcctcctggcagatcagcagaggcattagattctcacaggagtgcaaaccccactgtgaactccgcatgcaagggatctagattgcacactccttatgagaatctaatgcctgatgatctgagatgaaacagtttcatcccaaaatcatctccccgctgctatccccctccatccactggtggaaaaattgttttccacaaaaccggtccctggtaccaaaaaggttggggactgctgacaaggagtatgagtgtgaaaggtgcagaggtctatgccaggagacagccatccccaatagaagccctcagctatgcacaaactgcttaatgtcattcaaagaaaataatgtcgcccattttgcctcagagctttagccccaatcacagcaactgctatttcctgacgcttacgcaccagagatggtgataagagcactgcacgcattatctcagtaatcctcataacagcccaatgagttggcattactatccccaatttatagatgaggaaacaggctcagagaggtgaagtaatctgaccaggttacatagctaagtggagtcaggatctgaatccaagaagactgtctctacagcccatgctctcaataatccatcctgggctcctccagaacctgtgggaaactcagaggatgccaaatgataaattcctaaaaacctcactccattatatatgggaggaaagagaggacacctctgtgaacctggagtgattcatcccatcagggcacttagagatgctcctctttgaaaggggaaagaaccatccccagatgtggggtgatcccacatctgctgtatgtttgaaggtgataagcaatggacagttcacctctggaatgcctgaggaaaagagaccctccccaccatctctgaggggcagccctatttcttggatacattagggaaaccctgccctaggatctgagggaaacacagtctccactccaggtgcctgctcactctcctggagcttctggccgtcgcaccctattgcagctcctgggtttggctggggcacaggattaaccatccccaggaaatgcctccctccggtccaggcagggatcccagcatacacacccctggtggtggcagtgggggagaaagggggaaggtggaatgcttccttctctccaggtcagggaagagatctggggaccacctgggggccctcgcccctcctgcctccttgctggggaagtgcccagtccagtgccccctccatggccacctccctccctctagctgtgccggggcatgaatcagctctcacagcttgttaaagctagacctcttgttttcatgccctcacctcaggaaacagagttacaacttttccagctctactcagcagggggccagggtcctcactttataaacatccccagcctgtgagagcagagggcagggagatagtgtgagacaggagcccaggggagaaagacagaaactaagactcaaggagcaacgcaaagcaaagtcaaggagtcaagaccagagtagctgagcagaggccaagaagggtctgagagggctgtgcagcagcaatggccctaaggatgctctgggctggacaggccaaggggatcctaggaggctgggggatcatctgcttggtgatgtctctactcctccagcacccaggagtctacagcaagtgctacttccaagctcaaggtaaagtggggtgaagcgttaggaatggaggagcagcagagagggcacagggaggatggggccttacagatgatcccgtgtcaaaatacccaggcttcctccagctgtgaaacaggaaagacaaactaaatacggggatagtgcgtacttactgtctccaccccagaccagaagagcctctgcctctcatcagcactcctacacctactaacatttcccgttcttccctagccccctgtcactatgaggggaaatattttaccctgggtgagtcttggctccgcaaggactgtttccattgcacctgtctgcatcctgttggcgtgggctgctgtgacacgtgagtgaccaaagatggccagagagaatgactctgatatgagtgactgagggatgaccagggagtgactagattgctgtgatgtaagaatgaacagaagagcaatacaagatgggccaaacctgaagggaccaacactagtgtgaaagataaggcttcaggctataaatcaggggaggttggggtggacctggagagaaaatactcctgttataaaacaaaaaggcccacatatggtaggtgacagcttagttaggaggaccaaggggccactgaaaggggctctgtggggggaaaactgtgagagagggaacatgtgggcagggataaaggcagcctttcactgtgctgactccttcccctatccttggttccccaggtcccagcatcccatcgacttcccggctgggtgtgaggtacgtcaggaggcaggaacctgccagttctccttggtgcaaaaatctgaccctcggctgccctgcaaagggggagggcctgacccagaatggggctcagccaacacccctgttcctggggctcctgctccccactccagctaaactcaactgatcatccatctgctgactgctcactgctgctgccacttccagggaaaccactagcagctgccaatgtattctgaacaaataaattaatgctatagctgaaagcccgactctcactgtccacgacattggaccccaggtggaaaaagtgggtcccattagagtccaggtgctgagttctcagtatccggaaggaactagcaccagggtgggccagtttcagatggttatggtgctggtgctggggcctggggcagcatatgaggccagggtggggctagtaggcagcaccttgatgggcaggtcccagctgaaggtgtctacaggtacttgctcaggtcctgtccaggtggtaggttcgggctgttccacagggggtaggagtaccaatcctggttctcgggacgttacaaattcaaaatgcaatctccacttcaaggacactatggaagaaaaagattaaggtagaagcatcagaagctagcaggagtaaaagccaatgacaggatatagttagtgaatgagaagaaaacaatctgtgttcaggaagacagggaaaagtcacagggcagggagctgtgattaagggtttttctgaagcaatgggtactaccacagatgtgagctgaagatagcagtattaagtacctaataacctaagagtgaggcagtcaagtctaggtagcatgaagtaatcaaaaatcagtgtatcacagggtcctagtaggtaggtgtggggaaggagttctatcaagctgttaggagtttaggggtcagtgcatctaagaaacaggaagaggttgaaggtctgagaaactgttccgggtcagaggctagacgtgggtatgtctgggagtgtgtataaggaatcaggatccattacaccctcccttagcacagcattttactgtccccctctcccttctccagtaacagtgagggtctcaccaatggctgtacagaagcctggggtggagctgagagggattgggagggagaagctggttctagttgtatgtaggcaggattcctggtgccgggcgtgagtcacatgtgacacagaggggacaccccctgccccacgtcgccgctggtactcaggctgtacacgctcctcggtctgtaagctgactgaaaactgggagcaagagacaggtgtgtgctaacaggaagtgctgtctgtaggtgagaggacagcccaacctcaagctgttttacaaagggaccctggatgaccccactatccccttctacatgccacccctctttatacaggccttccaccctagcccttcaaccccagcaccccagcaggtaagaagctctgctcccttcttacctgcaaacaagctacggttccttcccctaagtttaaggtccccaccacgtcctcgccaagtctgtacacagatttgaagatgccaaacgtcccaactttccctcggccatcactgatattgtatagatctggggagaataggacactataagcctggagtctacatactggataacgtctaggactgggcaccacaggccaaaagatggggcttttctttaaaattggaggtgtcaggtatcagtggatccacagaagtgtgtggtggttaggagactgtctctgagatgggaaaacaatgaggggaaggatggggtaggacaattctgaaagaattctcacggaggctgcggcaggatgtggcagccattaggcgttccccagccagctcagctagccatgaatctttcttcccaccttcatcctcctccaagaatggactggatggggctacagcctcatcctggggaaaccggacatcctgaaggcctagagaaagaatgagtggagaggtaatgctgagagggaacggagatgagagtagaggttagggttttagattctaacatgagatggctaaaggtaaggggtgccagggctgaggtttacatctctatctccagaaccctccctcccttcccaactccctagcactgtcactgagaccaggaagtttccctgcagtccctcttgcaagccctctaagacaatttctgctttggcatcgcccttccccagcccttccctccaggagcccttgcttaccagtcagcacaagaaccctcagagggactctgagtaaagtgataggggagttgacacgctggcagccaatggtcagtttgtagacgtacttgactgactgaccccgaaaggagggtggtccctctatgggcagcacttcactgtaggagtctggttgggaagtagttgtcaggacagccagaggcaccagaggagtcctccctccaggagacttagaaggcaattcagggatggggacaatcactcacatgatttggactctccaggatcaagcctcaggtcacagaatagaattttcggtggagtagaaaggatacactggcccctctcacctgaaaaaggtaaaaatgactaatttaatgacccattgtccagtactgaacaagactagcacggcaagtggagatagtgaaaggctgccaggccctccgtccctgctgtgaaatgggaatagtcttctacccctaaagcaatagtcatgctccccaacatccccagcatgacagggactataagaacaagaacaattaacaacttcacccatgggtgacaatgcctccacacacaccctccgcaccccccctctcccaggcaaatgcccctctctaacctcggtgtggcagaaagacagtctggctgtcgggctggacatctggctgactagagtcaggaggaggcagtgctactcgactctcactggcatggaactggcagtggatttgggcactggcccaggccagggcctcactgtgggaaaaggaaaaggaggcatcagaggtagttcctgacctcacaaatgctttcccaagctccctatcacaccatcttaaccaacaaggttagatggctgtcctagtgatcaggaaatccacaatcccaaagagaaaccattaaataaagagtagcagactgtgcgtaaaaaggggaacgggggaggggaaggaaagcgtacagctatgtcatccacatcttctgttaaagagccctctcctacaatgacagcacagtgagcaagaggaggtggtgtcgctacaggacaacctgagctctgcctcagccccagagataatctggcttcttcccagaagggccaccaccttcagtgccagcatccccacctggatgcagaagtggccgtgggcggaagggggttggtgacggtcactacacactccagcgcctccccagccaaaaatacaggaccccggctgagctctgctaccacttcaatcatggcagctccggaatcagatctagaaggaaacaaggcggggcggaggtcagcaccttgacagggaggggcgttgcggtgagcacctagggctgagggctgaggacaggggtggtcagcaccgtggtgcccgagggagctcctggatataggaggggtaggcgggtgggagggaggcgactgaagactcagtactgcccagggggaggacatcgctctgggccctagaccccagcccctgtgcgacgggttcttctccctgggcacccccgcggagttcccaaactggcctccgctccccctttcctcaaagttccacgtcccagcccaagatcaccgccgctagtcacctcgcatagtcgacactagggatcggcacccctaggcctcatct

SEQ ID NO: 11304 - DNA, 7328 bp, Homo sapiens
aaccattccacatttgtggggaagatctggctcactgttctgattgtcttccggatcgtccttacagctgtaggaggagaatccatctattacgatgagcaaagcaaatttgtgtgcaacacagaacagccgggctgtgagaatgtctgttatgatgcgtttgcacctctctcccatgtacgcttctgggtgttccagatcatcctggtggcaactccctctgtgatgtacctgggctatgctatccacaagattgccaaaatggagcacggtgaagcagacaagaaggcagctcggagcaagccctatgcaatgcgctggaaacaacaccgggctctggaagaaacggaggaggacaacgaagaggatcctatgatgtatccagagatggagttagaaagtgataaggaaaataaagagcagagccaacccaaacctaagcatgatggccgacgacggattcgggaagatgggctcatgaaaatctatgtgctgcagttgctggcaaggaccgtgtttgaggtgggttttctgatagggcagtattttctgtatggcttccaagtccacccgttttatgtgtgcagcagacttccttgtcctcataagatagactgctttatttctagacccactgaaaagaccatcttccttctgataatgtatggtgttacaggcctttgcctcttgcttaacatttgggagatgcttcatttagggtttgggaccattcgagactcactaaacagtaaaaggagggaacttgaggatccgggtgcttataattatcctttcacttggaatacaccatctgctccccctggctataacattgctgtcaaaccagatcaaatccagtacaccgaactgtccaatgctaagatcgcctacaagcaaaacaaggccaacacagcccaggaacagcagtatggcagccatgaggagaacctcccagctgacctggaggctctgcagcgggagatcaggatggctcaggaacgcttggatctggcagttcaggcctacagtcaccaaaacaaccctcatggtccccgggagaagaaggccaaagtggggtccaaagctgggtccaacaaaagcactgccagtagcaaatcaggggatgggaagacctccgtctggatttaatcctggcgggcttaaaacctgtgcttttcatagtttatggtaagcagcagctcactgaataatgacttccattgagtaaacatttggctctggttatcttcagggatgctgttggctcatgatccaagctcaggggactctggaggcggggctgggctgagggagagaaagggaaacacagtgttcccaggcacatgttcttagcaataatacagttgcagaactttacatttgtgtcttccagatctggagaagaacagacatatttaaatcattcttgttgaacagtttttgtatgtacagtattatggtacttttttttttttagtatgagaactttttttgtatttgtacattgaactgctgtagttatacttttatattaaaggggaaaaagtccttataaataatgcctattaggctagtgctattactttgttcagcaaattctaccctggctttagagtttttaatagatgctacacctaataaaagtgcctctcatattgcaggaacgatttcagatgtgtaaggagactgaagaggagataccagtttttagtcttggaaagcaagttcacagtagaaggaggttgagatctttcttttatgtgagaaatctttgaatctcattcatgcgatcagagttgtagccaatttttgaaaaccttattttcaaaggaaataaatgattcactgtaggattcctttaaatatcaagcatcaccagtatatgctttgatggtatatgtatataacttaaagttctttcaaaagcctgatacagaaacgtgtccccagtttggtagcaatgtggaaaacctggctagagatgatatggagctgtccctcagaaagcaaagccatgcctggaatccctaataggctgcttagttgtgaacctgtttgatttgccttaagcctctatccagaaacctgcccgcttccgtctggttaagaagccagtggtggatattttctttgttaacattagaaatgcaaacattcccttgtcaaccaagaatactcaaagctacttgtattggaaatggcagaaggcctaaatccaaatttcttattttttataatttaccatagaagttttgtgattaaattcttacttctgccagtggaggtttatgcctgaaaggtcatggggtcctgtctgtaaatagacctaaagagaagtgcagtatttattctttgtaggcataatgtgtttgtcactgacaagcattcatgttcatcccactagtcttttattgcagtcttttattgtcattttcagccttatgttggagagctttgctttctcatcatgttcacattgtcttaagttttgtgagcttctgagaaagagcttggtaaaggtttaaaggggactttgttccaccagggagcattttatttgggcgtctcacccttttctaatgaaagctgttgtaagccacctctgacttggaaattctgaaagtatgaatattttttatatcttaattgtaaaatgccagttctccattatttagatgaatagtagaacactgcaccctttgtgcagtgtttttgtttctctactgcattcctacccccaccaaaaaaaagaaacttaaggaaatttttttttgagacagggtctccctctttcacccaggctggagtgcagcagcatgatctcagctcactgcagcctctgcctcccaggctcaagcaatcattccacctcagcctcttgattagctgggactacaggcatgtgccaccatactcggctaattctgttttaaaaattttttttgtagagatgaggtctcactatgttacccaggctggtctcgaacttttgggttcaagtgatcctcccgcctcagcctctcaaagtgttagtattataggtgtgagccaccatgcccagcctagaaaatttaaccttatcttttagccattcatttacttttatttgcttttttaaaaaaaaatctttaaattttagcctagagaagcacctcaggaactctaaacatcttaggcaaaaattaaactcaggtgagactgaaggagaaatttcagaaatacacatgtacctcatgggtaattaatagacatgcacagtttccttcaaatcaaatgtttaataaggaaattcatataattccaagaaaacaggcaaaatttggaatacataagcctagctaagataaagaactaccagttaattcttaacatcactggagcttccagcaggttttttaattgaaggacaaaaagtgtccatacatttgtgttatctcttcagagcctgagggagaagagagtggctttgcccagtggaaaggctggggatttgagaatgatacagggggaaggagtcaagcagaaatgccaggaagaaccaggcaaagacatttggcgccagaagcatccacttaatttctgtgaagagtgcccctggtgtttcatcttggcctgttttgatgagaatgttatcttttgtgtctggataacgcgtcagcttcttaaagtacatataaagatattctgtcacctccccacatgcacacacttttaaaatctatttttattctcttgctaaagttgtaattatgtcaagaattttccagctctaactgccttcttagtacatgtctttctgcctttgaagcatatgagtttgccaaagtcattctcccctaatgacatattgtggacttacattaagaaaatgggccaggcgcggtggctcacacctgtaatcccagcactttaggaggcccaggcgggtggattacctgaggtcaggagttcaagaccagactggtcaacatggtgaaactccatctctactaaaaatacagaaattagccaggagtgctgggtggacgcctgcaatcccagctacttgggaggttgaggcaggagaattgcttgaacccaggaggcagaggttgcagtgagctgagatcataccattgcactccagcctgcaagacagagtgaaactcttgtctcaaaaaaaaaaaaagaaaaaaagaaagtgagcctgttgatgtctagctaacccattggtggagtctgcattgaatctgtaagaatattgttctggatcatgcaggtgggatttgtataaaaagcctgtccaacatttagttctcactcgcatcagaatcatactgttttgaattgccatataagacatgctccatcatgacacttgcttctcctccaaatacaagttgagtgcttagtccttcacctgctagaatcaggatacaatcaacatgattatgttccttaacacacttggatttatgcagatgtggtgtgtcctttgctcttttttttcttaagacagagtcttgctcttgtcgctcaggctggagtgcagtggtgtgatttcggctcactgcaacctccgcctcctgggttcaagcgattctcctgcctcagcctcccgagtagctgggattacaggcaccaccaccataccaggctgattttttttgtatttttaatatagacagggcttcatcatgttggccaggctggcaggctggtctcgaactcctcacctcgtgatccgcccacctcagcttcccaaagtgctgtgattacaggcgtgagccaccgcgcctggcctgctcttaaaacccgttattcagaagatttgtaaaagaaataggctttttttttttttttggttaattcaaacgaggggaaaattagatagcattttcccctaaagaaatgttaatgttcattttgtggctttgttttcaagtttcaggagccatgtacatctcagaagtgttacgaagtgattagaaaaggcctctggtaaaagaccttcaaggaccaaccattattattggtcacttgtttgaacttggcgcttaaaaaaaaagttggactgtgatgctttggtgctctttatcacagacatcagtgatggtctgaaacactctctagcagtttatacgaagaatggacttacatgttatcagttacactcatgatttactcgttcagcttctacaagtccatactttatgctgtctcatttaagagacagtccacttctgaaaataaaatcgatagttgatgatacatttttggctagccagctttctgtaaaaggcaagtatgttagacatgcacagtttccttcaaatcaaatgtttaataaggtacttcaagaaacgcctttttaaaaatcaaaggttttggccaggcatggtggctcacgcctgtaatcccagcactttgggaggccaaggtgggcgaatcacaaggtcaggagtttgagaccagcctggccaacatggtgaaaccccgtctctactaaaaataccaaaaattagccgggcgtggtggtgggtacctgtaatcccagctactcaggaggctgagatgagaatcacttgatcccaggaggtagaggttgcagtgagccgagattgcgccattgcacttcagcctgggcaacgagtgaaactctcaaaaaaaaattcatagtaataataaagtccctgcatgcagtttggaaataaaatttaaactcatttatgtgtaataaatatgtaataattcacagtcaccatcaaatgttggaatcattgaattgcatacttgtactcattccggccacatcatgaagtgtttaaagatttgtatttgctgttgtccctatgtagttctattgatgtttggttttgttttttggggtttgttttgagcccaggctagagtgcaatggcacaatctcaactcactacagcctggacctccttggctcaagcagtcctcccacttcagcctcccaagtagctggtctgcaagtgctcaccaccacacctggctaatttttgtattttttgtagagacagagctctcactatgttgcctagactggtctcaaactcctgggcccaagcaatcctcccatcacagcctccgaaggtgctgggattacaggcataagccactgtgcccagcctgtttttaataatgatattaagtgggtttggttcatgtgttattaatcagtgttaataatcgtacttttttttttttttaaaagaaaccatggtattctaaaatcaggagtccaaataaaagaaagttctcggctgtgcatggtggctaacacctgtaatcccagcactttgggaggctgaggtgggtggatcactagaggtcaggagtttgaaacaagcctggccaacatggtaaaaccccctctctactaaaaatacaaaaattagccgggcatggtggtgcacacctgtaatcccagctactcgggatgttgaggcatgagatttccttgaacctggaaggcagaggttgctgtgagccgagatcgcgccactgcactccagcctgggtgacagagtaagactgtcgccaaaaaagaggaaaaaagttatccagtgcagtttctacagagataaaagaagtaatagttctggctgggtgtggtggcttatgcctgtaatcccaacactttgggaggccaaggcaggtggatcacatgaggtcaggagttcgagaccagcctggccaacatggcaaaactgtctctactaaaaatataaaaattaggtatggtggcacgtgcctgtacttacagctacttgggaggctgaggcatgagatgacaatctcttgaacccaggaggcggaggttgcagtgagctgagattgcaccactgcactccagcttgggtgatggagtgagactcaaataaaaaaggtactagttctgcatttcagagttggcttgttgaaccaggctatatgcttccaagatttaaatgtttttctgtattatactctcaattgtgttttaaaaaaatctcttacagaaatctctacctcaggcactaagtgttatgacatgggtagcatattgatattgaaaacttagctaggacttccagccttttaagataatttaaatgtaaaattaaatggttaaccagcaatctaatgtcatgtggtgtgcagtttggatattgcatgaacagctaaggaatcacctgttctagtgccaaagatcactcattgctaattttgttctgtacagcttatgtaatattttcatggtggagacggactctgtgtgctcagggccttgtctctaggaagattttgtcaattccaaatacagttttgaagattca

SEQ ID NO: 11305 - DNA, 1387 bp, Homo sapiens
  misc_feature (903)..(903): n equals a,t,g, or c
  misc_feature (1320)..(1322): n equals a,t,g, or c
gtttttagtcttggaaagcaagttcacagtagaaggaggttgagatctttcttttatgtgagaaatctttgaatctcattcatgcgatcagagttgtagccaatttttgaaaaccttattttcaaaggaaataaatgattcactgtaggattcctttaaatatcaagcatcaccagtatatgctttgatggtatatgtatataacttaaagttctttcaaaagcctgatacagaaacgtgtccccagtttggtagcaatgtggaaaacctggctagagatgatatggagctgtccctcagaaagcaaagccatgcctggaatccctaataggctgcttagttgtgaacctgtttgatttgccttaagcctctatccagaaacctgcccgcttccgtctggttaagaagccagtggtggatattttctttgttaacattagaaatgcaaacattcccttgtcaaccaagaatactcaaagctacttgtattggaaatggcagaaggcctaaatccaaatttcttattttttataatttaccatagaagttttgtgattaaattcttacttctgccagtggaggtttatgcctgaaaggtcatggggtcctgtctgtaaatagacctaaagagaagtgcagtatttattctttgtaggcataatgtgtttgtcactgacaagcattcatgttcatcccactagtcttttattgcagtcttttattgtcattttcagccttatgttggagagctttgctttctcatcatgttcacattgtcttaagttttgtgagcttctgagaaagagcttggtaaaggtttaaaggggactttgttccaccagggagcattttatttgggcgtctcacccttttctaatgaaagctgttgtaagccacctctgnacttggaaattctgaaagtatgaatattttttatatcttaattgtaaaatgccagttctccattatttagatgaatagtagaacactgcaccctttgtgcagtgtttttgtttctctactgcattcctacccccaccaaaaaaaagaaacttaaggaaatttttttttgagacagggtctccctctttcacccaggctggagtgcagcagcatgatctcagctcactgcagcctctgcctcccaggctcaagcaatcattccacctcagcctcttgattagctgggactacaggcatgtgccaccatactcggctaattctgttttaaaaattttttttgtagagatgaggtctcactatgttacccaggctggtctcgaacttttgggttcaagtgatcctcccgcctcagcctcnnnaagtgttagtattataggtgtgagccaccatgcccagcctagaaaatttaaccttatcttttagc

SEQ ID NO: 11306 - DNA, 856 bp, Homo sapiens
agatgcttcatttagggtttgggaccattcgagactcactaaacagtaaaaggagggaacttgaggatccgggtgcttataattatcctttcacttggaatacaccatctgctccccctggctataacattgctgtcaaaccagatcaaatccagtacaccgaactgtccaatgctaagatcgcctacaagcaaaacaaggccaacacagcccaggaacagcagtatggcagccatgaggagaacctcccagctgacctggaggctctgcagcgggagatcaggatggctcaggaacgcttggatctggcagttcaggcctacagtcaccaaaacaaccctcatggtccccgggagaagaaggccaaagtggggtccaaagctgggtccaacaaaagcactgccagtagcaaatcaggggatgggaagacctccgtctggatttaatcctggcgggcttaaaacctgtgcttttcatagtttatggtaagcagcagctcactgaataatgacttccattgagtaaacatttggctctggttatcttcagggatgctgttggctcatgatccaagctcaggggactctggaggcggggctgggctgagggagagaaagggaaacacagtgttcccaggcacatgttcttagcaataatacagttgcagaactttacatttgtgtcttccagatctggagaagaacagacatatttaaatcattcttgttgaacagtttttgtatgtacagtattatggtacttttttttttttagtatgagaactttttttgtatttgtacattgaactgctgtagttatacttttatattaaaggggaaaaagtccttataaataa

SEQ ID NO: 11307 - DNA, 971 bp, Homo sapiens
gaagcacctcaggaactctaaacatcttaggcaaaaattaaactcaggtgagactgaaggagaaatttcagaaatacacatgtacctcatgggtaattaatagacatgcacagtttccttcaaatcaaatgtttaataaggaaattcatataattccaagaaaacaggcaaaatttggaatacataagcctagctaagataaagaactaccagttaattcttaacatcactggagcttccagcaggttttttaattgaaggacaaaaagtgtccatacatttgtgttatctcttcagagcctgagggagaagagagtgctttgcccagtggaaaggctggggatttgagaatgatacagggggaaggagtcaagcagaaatgccaggaagaaccaggcaaagacatttggcgccagaagcatccacttaatttctgtgaagagtgcccctggtgtttcatcttggcctgttttgatgagaatgttatcttttgtgtctggataacgcgtcagcttcttaaagtacatataaagatattctgtcacctccccacatgcacacacttttaaaatctatttttattctcttgctaaagttgtaattatgtcaagaattttccagctctaactgccttcttagtacatgtctttctgcctttgaagcatatgagtttgccaaagtcattctcccctaatgacatattgtggacttacattaagaaaatgggccaggcgcggtggctcacacctgtaatcccagcactttaggaggcccaggcgggtggattacctgaggtcaggagttcaagaccagactggtcaacatggtgaaactccatctctactaaaaatacagaaattagccaggagtgctgggtggacgcctgcaatcccagctacttgggaggttgaggcaggagaattgcttgaacccaggaggcagaggttgcagtgagctgagatcataccatt

SEQ ID NO: 11308 - DNA, 5365 bp, Homo sapiens
gtccacgtgcggctgcgccagcgcatcatcttgtacgaattaaaggtgcgattagggagcggggtctgcaactgggtagggaccagacaggaccgggctgagataacgcacagggcctaactcggtgatggggcctccggagagatgctaagcagctccttctccaagaaaggcaggtcctggggaatgagaaggttgagaggaggccgagatagggctgcccgagctccaagcgtgtaggaaaaggatgcgccagggctgggatcggtggctaatgcttgtaaccccagcactttgggagaccgagacaggtggatcgcttcagtctaggagttcgagaccagcctgggcaacatagggaggctccctctctaccaaaaaaaaaaaaaaaaagtttgtttttttttaagtaagcacaagaagcgggcggggcctaaggcaatttggttcaaagttaagtgatgggagcggccagcagggcgtcttgatacagctgaactggaacttcaggccaggaataaagcgcagggccacctgggggcggagcctctgatgggcagggctgaccaggggcgggtcttgggatgctgggcggagcctcaggggcggggcctggggtgctgagattgaccgcggagggatgggggcttgggttgctggatccggccgcgaaggggcggggctgtaaagggccgctggtttcctggagcgggtggaaccaggactgcagaggttgttagcgggtggggagacggctgcatcagttcacgttaaggaggatctctggagagccagacctggggaaccgggaggcccgcgccttgggaaatggagtccaagcgggcatctctcctgccttcaggtggagctggaggagacagtggtgcggcgccaggctgcggtgcggacgctgggccagcaagccagggtttggttggtgcgggtgctgctcaacctgctggtggtcgcgctcctgggggcagccttctatggcgtctactgggctacggggtgcaccgtggagctgcaggtgcggacggtcttggaagaggaagccagggggtcctggaacctacatttccaacggtggagggaggggacggaagtttgggatgccagagatcttagagaggaagtatgggagagggtatgttcggaccctggacttagggattttaaaggaaaaagagaggctgggcgcggtggcttacacctgtaatcccagcactttgggaggctgaggcgggcggatcacgatgtcaggagttccagaccagcctgaccaacatggtgaaaaacagtctctactaaaaatacaaaaattagacgggcgtggtggtgggcgcctgtaatcccagctactcaggaggctgaggcaggagaatcacttgaacccgggaggcagaggttgcagcgagccgagatcgcaccgctgcattctaggctgggcaacagagcgagactctgtctcaaaaaaaaaaaaaaaaagaagaagaagaagaagaggccggggggaggaccttaagcttggctcctccaggaccccaagcctctactcatggtccatcccgctcccaggagatgccccttgtccaggagttgccactgctgaagcttggggtgaattaccttccgtccatcttcatcgctggggtcaattttgtgctgccgcccgtgttcaagctcattgctccactggagggctacactcggagtcgccagatcgtttttatcctgctcaggttccagcctcacggggatggctgggaatgatgaagggtgggggcggtcagagggatgttggcgctgacaggtaagacacggaaatcctgctgataccgaatccagggattcaaatcctgactctgttggccaggtgcagtggctcacacctgtaatcccagcactttgggaggccgaggctgaggtcaggagttcgagaccagcctgacaaacatgatgaaaccccgtctgtagtaaaaatacgaatattagcccggcggtagtggcttctgtagtcccagctactcgggaggctgaggcaggagaatggctcgagcctgggaggtggaggttgcagtgagctgagatcgcgccactgcactccagtccgggtgacagagtgagaccctgtctcaaaaaaaaaaaaaaaaaaagaaagaaagaaagaaagaaatcctgattctgtcactgggcctcagcttcatctgtgagatgggttgaatgcgggcgcgttccactgagaagggaactgccacatggtgggtaccgggtcagggcccattctctgccttccccccttcaggaccgtgtttcttcgcctcgcctccctggtggtcctgctcttctctctctggaatcagatcacttgtgggggcgactccgaggctgaggactgcaaaacctgtggctacaattacaaacaacttccggtgagaacggcatgggtgtgcgtgggactcttgggtccctgaaggaaagatggagctgggtgggtccagactcttggtttgggcggagaggggagcttggggtgctggaacactctcccaagggtatgaaagtttgaaaaacgaggacccccagagaaagtattgacagggtctcataggcttgcgatgtggagactcggacgcgtgggcctccaggtgcccgggtcccgagttctttctgatatatttcttccttcttcagtgctgggagactgtcctgggccaggaaatgtacaaacttctgctctttgatctgctgactgtcttggcagtcgcgctgctcatccagtttcctagaaagtgagagccccgccccttgctgtggccccgcccctctaggacgaggccgtgccccatcgcgctgttcttttcaccgcgcacctttttaccattcccgcctctgcctgctccctttgcttgccctaggtccgcagatctccccgctccccgcccttgttttagtgggttacttccctctggccccgacggcggcgacatctgggtcccttctagtcctcaggacccgccctctggacacaccccctccacgtggagtcctgaaagtcccgcccccccccccccaaccaatacgcatgcttcctattggcgggcggggcggtggaggcggggaaactccaggccgccactcccctgactccggcccggccccgccccgtccttcaggctcctctgtggcctctgtcctggggcgctgggtcgtctggcggggacccaggagttccaggtgcccgacgaggtgctggggctcatctacgcgcagacggtggtctgggtggggagttttttctgccctttactgcccctgcttaacacggtcaagttcctgctgcttttctacctgaagaaggtaaggggtaggggggacccttgggtctgaggcaggaggtattggggcccgcactcctgggtcaagggcaaggaagatcctgggggcctggattactcggtcctgagagaggagggggttggaggacagactactgcatctgagaggaggggtctagggcattctgacttatatgtctgaggatctggggactcagactccggggtcctagatgaggaaggggctcagactcctggttcggaaaaaaggagaggcaggtaggccgggtgcagtggctcacgcctgtaatcccagcacttcgggagactaaggcgggtggatcacctgaggtcaggagtttgagaccagcctggctaacatggcaaaaccccgtctctactaaaaatacaaaaaaaattagccgggcttagtggcaggcgcctgtaatcccagctactcaggaggctgaggcaggggaattgcttgaaccagggaggtgaaggtcgaagtgagccaagatcgtgccactgcactccagcctgggcgacagagcgagactccgtctcaaaaagagaaaacaaacaaacaacaacaacagcaaaacaaattagccgggagtggtggtgcacacctgtaatcccagctactcgggaggctgagacacgagaatagcttgaacccgggaggggaggctgcagtgagagccactgcactccagcctgggcgacagagcgagactctgtctcaaaaaaaaaagcctgggcgacagagcgagactctgtctcaaaaaaaaaaaaaaaaaaaatggaggcacagactcttgtgtttcagagcccttttctccgtgccttcccccaccagcttaccctcttctccacctgctccccggctgcccgcaccttccgggcctccgcggcgaatttctttttccccttggtccttctcctgggtctggccatctccagcgttcccctgctttacagcatcttcctgtaagtgcgagaggctcccgcctctctccctccctctctccccattcagtgttcagactcctggcactatgtgagcccagcctgtcttgacttcaggatcccgccttctaagctttgtggtccattccgggggcagtcgtccatctgggcccagatccctgagtctatttccagcctccctgagaccacccagaatttcctcttcttcctggggacccaggcttttgctgtgccccttctgctgatctccaggtgagacggcccagacttctgggtctgggtttgaatgcgtgtgatctgggggccaccacctgcgtccaagagaggagaggcttgggcgtgggagcaggcaacgtactgagtctgagggaggaggcctaggctcctggactgctgggtccgaaggaggaggtgggcgggacgtaggactcctggatctgaaggcggaggggctgggagactgaactccttgagcccagacgaggaggggcttaggcgtccacatccctggcttcgaaggagccagacgtttggatataatggaagagcgtgtcaggagtggcttccgttcctgtctccttcagcatcctgatggcgtacactgtggctctggctaactcctacggacgcctcatctctgagctcaaacgtcagagacagacggtgagccaggcgggtccctgagagggcccctggggaacatggaaaggggttggggaagaggattgtctcacctccacctctctttgccccaggaggcgcagaataaagtcttcctggcacggcgcgctgtggcgctgacctccaccaaaccggctctttgacccccgcagcccacgtcccgctttcagaccccaggcccattgtaagcctaggtcacaacatctgtaaactaggagaactggagaagactccacgcccttccagctttggtatctggagatttccagggcccctcgccgccacgtcctgactctcgggtgatcttccttgtatcaataaatacagccgaggttgctgagcgcgctttgaaa

SEQ ID NO: 11309 - DNA, 5360 bp, Homo sapiens
gtccacgtgcggctgcgccagcgcatcatcttgtacgaattaaaggtgcgattagggagcggggtctgcaactgggtagggaccagacaggaccgggctgagataacgcacagggcctaactcggtgatggggcctccggagagatgctaagcagctccttctccaagaaaggcaggtcctggggaatgagaaggttgagaggaggccgagatagggctccccgagctccaagcgtgtaggaaaaggatgcgccagggctgggatcggtggctaatgcttgtaaccccagcactttgggagcccgagacaggtggatcgcttcagtctaggagttcgagaccagcctgggcaacataggggggctccctctctcccaaaaaaaaaaaaaaaaagtttgtttttttttaagtaagcacaagaagcgggcggggcctaaggcaatttggttcaaagttaagtgatgggagcggccagcagggcgtcttgatacagctgaactggaacttcaggccaggaataaagcgcagggccacctgggggcggactctgatgggcagggctgaccaggggcgggtcttgggatgctgggcggactcaggggcggggcctggggtgctgagattgaccgcggagggatgggggcttgggttgctggatccggccgcgaaggggcggggctgtaaagggccgctggtttcctggagcaggtggaaccaggactgcagaggttgttagcgggtggggagacggctgcatcagttcacgttaaggaggatctctggagagccagacctggggaaccgggaggcccgcgccttgggaaatggagtccaagcgggcatctctcctgccttcaggtggagctggaggagacagtggtgcggcgccaggctgcggtgcggacgctgggccagcaagccagggtttggttggtgcgggtgctgctcaacctgctggtggtcgcgctcctgggggcagccttctatggcgtctactgggctacggggtgcaccgtggagctgcaggtgcggacggtcttggaagaggaagccagggggtcctggaacctacatttccaacggtggagggaggggacggaagtttgggatgccagagatcttagagaggaagtatgggagagggtatgttcggaccctggacttagggattttaaaggaaaaagagaggctgggcgcggtggcttacacctgtaatcccagcactttgggaggctgaggcgggcggatcacgatgtcaggagttccagaccagcctgaccaacatggtgaaaaacagtctctactaaaaatacaaaaattagacgggcgtggtggtgggcgcctgtaatcccagctactcaggaggctgaggcaggagaatcacttgaacccgggaggcagaggttgcagcgagccgagatcgcaccgctgcattctaggctgggtaacagagcgagactctgtctcaaaaaaaaaaaaaaagaagaagaagaagaagaggccggggggaggaccttaagcttggctcctccaggaccccaagcctctactcatggtccatcccgctcccaggagatgccccttgtccaggagttgccactgctgaagcttggggtgaattaccttccgtccatcttcatcgctggggtcaattttgtgctgccgcccgtgttcaagctcattgctccactggagggctacactcggagtcgccagatcgtttttatcctgctcaggttccagcctcacggggatggctgggaatgatgaagggtgggggcggtcagagggatgttggcgctgacaggtaagacacggaaatcctgctgataccgaatccagggattcaaatcctgactctgttggccaggtgcagtggctcacacctgtaatcccagcactttgggaggccgaggctgaggtcaggagttcgagaccagcctgacaaacatgatgaaaccccgtctgtagtaaaaatacgaatattagcccggcggtagtggcttctgtagtcccagctactcgggaggctgaggcaggagaatggctcgagcctgggaggtggaggttgcagtgagctgagatcgcgccactgcactccagtccgggtgacagagtgagaccctgtctcaaaaaaaaaaaaaaaaaaagaaagaaagaaagaaagaaatcctgattctgtcactgggcctcagcttcatctgtgagatgggttgaatgcgggcgcgttccactgagaagggaactgccacatggtgggtaccgggtcagggcccattctctgccttccccccttcaggaccgtgtttcttcgcctcgcctccctggtggtcctgctcttctctctctggaatcagatcacttgtgggggcgactccgaggctgaggactgcaaaacctgtggctacaattacaaacaacttccggtgagaacggcatgggtgtgcgtgggactcttgggtccctgaaggaaagatggagctgggtgggtccagactcttggtttgggcggagaggggagcttggggtgctggaacactctcccaagggtatgaaagtttgaaaaacgaggacccccagagaaagtattgacagggtctcataggcttgcgatgtggagactcggacgcgtgggcctccaggtgcccgggtcccgagttctttctgatatatttcttccttcttcagtgctgggagactgtcctgggccaggaaatgtacaaacttctgctctttgatctgctgactgtcttggcagtcgcgctgctcatccagtttcctagaaagtgagagccccgccccttgctgtggccccgcccctctaggacgaggccgtgccccatcgcgctgttcttttcaccgcgcacctttttaccattcccgcctctgcctgctccctttgcttgccctaggtccgcagatctccccgctccccgcccttgttttagtgggttacttccctctggccccgacggcggcgacatctgggtcccttctagtcctcaggacccgccctctggacacaccccctccacgtggagtcctgaaagtcccgcccccccccccccaccaccaatacgcatgcttcctattggcgggcggggcggtggaggcgtggaaatccaggccgccactcccctgactccggcccgccccgccccgtccttcaggctcctctgtggcctctgtcctggggcgctgggtcgtctggcggggacccaagagttccaggtgcccgacgaggtgctggggctcatctacgcgcagacggtggtctgggtggggagttttttctgccctttactgcccctgcttaacacggtcaagttcctgctgcttttctacctgaagaaggtaaggggtaggggggacccttgggtctgaggcaggaggtattggggcccgcactcctgggtcaagggcaaggaagatcctgggggcctggattactcggtcctgagagaggagggggttggaggacagactactgcatctgagaggaggggtctagggcattctgacttatatgtctgaggatctggggactcagactccggggtcctagatgaggaaggggctcagactcctggttcggaaaaaaggagaggcaggtaggccgggtgcagtcgtcacgcctgtaatcccagcacttcgggagactaaggcgggtggatcacctgaggtcaggagtttgagaccagcctggctaacatggcaaaaccccgtctctactaaaaatacaaaaaaaattagccgggcttagtggcaggcgcctgtaatcccagctactcaggaggctgaggcaggggaattgcttgaaccagggaggtgaaggtcgaagtgagccaagatcgtgccactgcactccagcctgggcgacagagcgagactccgtctcaaaaagagaaaacaaacaaacaacaacaacagcaaaacaaattagccgggagtggtggtgcacacctgtaatcccagctactcgggaggctgagacacgagaatagcttgaacccgggaggggaggctgcagtgagagccactgcactccagcctgggcgacagagcgagactctgtctcaaaaaaaaaagcctgggcgacagagcgagactctgtctcaaaaaaaaaaaaaaaaaaaaatggaggcacagactcttgtgtttcagagcccttttctccgtgccttcccccaccagcttaccctcttctccacctgctccccggctgcccgcaccttccgggcctccgcggcgaatttctttttccccttggtccttctcctgggtctggccatctccagcgttcccctgctttacagcatcttcctgtaagtgcgagaggctcccgcctctctccctccctctctccccattcagtgttcagactcctggcactatgtgagcccagcctgtcttgacttcaggatcccgccttctaagctgtgtggtccattccgggggcagtcgtccatctgggcccagatccctgagtctatttccagcctccctgagaccacccagaatttcctcttcttcctggggacccaggcttttgctgtgccccttctgctgatctccaggtgagacggcccagacttctgggtctgggtttgaatgcgtgtgatctgggggccaccacctgcgtccaagagaggagaggcttgggcgtgggagcaggcaacgtactgagtctgagggaggaggcctaggctcctggactgctgggtccgaaggaggaggtgggcgggacgtaggactcctggatctgaaggcggaggggctgggagactgaactccttgagcccagacgaggaggggcttaggcgtccacatccctggcttcgaaggagccagacgtttggatataatggaagagcgtgtcaggagtggcttccgttcctgtctccttcagcatcctgatggcgtacactgtggctctggctaactcctacggacgcctcatctctgagctcaaacgtcagagagagacggtgagccaggcgggtccctgagagggcccctggggaacatggaaaggggttggggaagaggattgtctcacctccacctctctttgccccaggaggcgcagaataaagtcttcctggcacggcgcgctgtggcgctgacctccaccaaaccggctctttgacccccgcagcccacgtcccgctttcagaccccaggcccattgtaagcctaggtcacaacatctgtaaactaggagaactggagaagactccacgcccttccagctttggtatctggagatttccagggcccctcgccgccacgtccctgactctcgggtgatcttccttgtatcaataaatacagccgaggttgctgagcgcgctttgaaa

SEQ ID NO: 11310 - DNA, 22001 bp, Homo sapiens
ggaagtgcaaagaggcgggcgtgccagtccctggacagctacgacgccatgaatatcttgcccaagaagagctggcacgtccggaacaaggacaatgtcgcccgcgtgcggcgtgacgaggcccaggcccgggaggaggagaaggagcgtgagcggagggtgctgctggctcagcaagaggtaagctcggaagccggcagggcggcgctccggggcccagcgcgcaggcgccgcggttgggggccggaagcggaggcgttgcgcaggctcaatgtgccccgtgtgaaattcgggaccaggcgccgatcccactttcgaggacgttgccccgcaaaccttgtgcccacttccacgaaaccttccttgatctcgccctcgtcttagtttttcccccactgatgtatttcacatggctggaacagtgtctagcacaaaagagaagcttaacatttaatgaatccgtgaacccttggacagttcaaggaaattcggatcactttttagtttgcctgcacagcctatttattgagcatctactgtatgctaactacatgccgtgcacctgacttgcggaatccccaataagcactgttcgttcttagaggggcactgtcatctctgttgcacgaagtgagatggcttcagtgaggggaaggcacattttaaggagaggcggacagccaggctccacgccatcgggcgagccctttcgtgcaccgccccctagacacatacacacaaacacgggctttccgtatggctctttaaatctgtttggtgtacacccaactttcatttccttagctagtctgatcctccgccgtgggtgggaggtagtctaggtttttagaatctcagtaggctgctgagcgctgtttgaaatccgcgtcctgaaggcaggggacagggcttcagcagacttggggtagtcacttggagccatggctagaattcagatcgtctggcctaatgcatacctttatggctgttttaattgtctcacttgaggttaggaacccctttggtttaggccagggacctcctcccatacatccttgatgacccgtggtttactatttgaaagggagtttacaaaacccaggcgttgcctcatctgcctaccctcacccccagctaggacaggtgcctcttttaggcgcctagtgctccctttctcataaccccagcaccctggactgccattttctgtggtgggcaccagactcacagttcttgaattacctctaggttctgaatgtcctgcctataactttctccccaggcccgtacagaattcctacggaagaaagccagacatcagaactcactgcctgagcttgaagcagcagaggcgggagccccaggttctggccctgtggacctgtttcgggagctgctggaggaagggaaaggagtgatcagaggcaataaagagtacgaggaagaaaagcgacaggagaaagtaagctggcctcacccacttcatcagaggggccatgaatcgagttggagggagggggcactttagccattggttgtgaccaaggtcaaacaagagtgaacacacagaatttaggaccataccaaggcatgacactcaaaaagcgttggctattgccgtctgggcgcccacaggggttggaggtagatgctagaggtccccagctgctgggcaaaccgctcagttctccaaactggaggagtctcaaacctgatgggcttttaaaaatttaaatcagccggctgtggctcacgcctgtaatcccaccaccttgggaggctgaggcgggtggatcacctgaggtcaggagttcaagaccagcctggtcaacatggtatctctaaaaatacaaaaaaaattagccgggcatggtggtgcgcgcctgtaatcccagggaagctgaagcaggagaatcgcttgacccaggaggtggaagctgcagtaagccgagattgcgccactgcactccagcctgggtgacagagcgagaccccatctcaaaacaatcaaacaaaaagtgaatcaatcgcctcttgctttttggctaagatcaagtgtaaaaggtacatcagtggctgtgcatggtggctcacgcctgtaatcccagcactttgggaggccaacgtgggtggatcacctgaggtcagaagttcaagaccagcctggccaaacatggcaaaaccccgtctctactaaaaatacaaaaattagctgggcatggtggtgtgtgcctgtaatcccagctactcggggggctgaggtaggaggattgcttgaacctgggaagcagaggttgcagtgagccgagatcgtgccactgcactcgagtctgggcaacagagcgagactccatctcaaaaaaaagaggtacatcagctcttgtcatttatctgctgtctctggacttgctgaccccacccatcgctcctctgctttgcttgatcccttcaggcttctcttcaagtctctctgcaaagatgcctgcctctgaacactcaagtggctccacttgtcccctccttcccctgctgttactgtacctgctactgtccccccagggggagctttgcctctgtttgtcttccatccccagcacctggtccaactggttcataacaagccttagatacctgttcgcttagatacctgtgtcagggagacacacctgacaccttgaaagattatatcacatctcttgtatttcctggccccctcaggagaggcaagagaaagctctgggcatcctgacatacctgggccagagtgcagcggaggcacagactcaacccccttggtaccagctacccccagggcgagggggccccccgcccggcccagccccagatgagaagatcaagagccgtctggaccctctgcgggagatgcagaagcatctggggaagaagagacagcacggcggtgatgaaggcagtcgcagcagaaaggaaaaggaggggtctgagaagcagcgacccaaggagtaagaagaccccacctcggcagaccagggcccagaccttcagggcttggcagcagcccagcatgggcactgcagcgtctctggtcaggacagccagggactccgtgaagggctggctaggtggagaagtggttctcagcatgtggtccagggagccctaggggtcctgacaccctttcccggggtgctgtggtgtcaagcctattttcctgacactggtggacttttccactcgtgttctcaggcatgtagtgcaggtttccagaggctgtgtgatggggagacaccctcactctgatggccaatggcagatgcttgtgtccaaactttcttagttttcactaatgatttgcagcatattaagagaacccatttaaacaaaagctcttggggtccttggtttttaagagtataaaggggtcctgagaccaaagagtttgagagctgctgggttagagagtaaaagcaggcttctgtctccaggatgctgcacccctggtctagagggggtacactgcctgtagtcttctttcctctagaaagggaaactgagggccagggggctgctaagtgtgctttcttgacctggagaagcatcagattttaaagactggggaggaccaaagcccacagaagggaaggccagagacgtgcccatggcgtcccagcaccaagtggctgcttccagcaggcctaaggagctgaggctggggtgtgctggatgcagcggggcttccaggcggcagctccctctatgggagaggttgggggaatggcctcctaggggctaccagctttctgacctcactcctctccccacaggcctccatccctggaccagcttcgagctgaacgtctgcggagggaagcagctgagaggtctcgggcagaggccctgctggcccgggtccaaggccgggcactacaggagggtcagccggaagaagacgagacggatgaccggcggcggcggtacaactcccaattcaacccccagctggcccggcgcccccgccagcaggaccctcaccttactcactgactcctgagggggtacaggagaggccgctgctgccagccgtcatataaaactatttattcataaatattttccaaaatgaaaataggtttaccaaaaaatgtccctcactggggaggggaggagggggcagccctcgcccccgggcccccagggtggggctgagaggaaaacctcccggccccctccctgcttcctgggagagggggatgccccgtggcttggggcctccctccagtcttccagggcagggccctcacctgggcagggggatcagcatgcgggggaagggggtgggtagagggaggggccggtgtcactggaggtcccggtcctccaggtagcggtactcaaaggtgaagccttccttcttccgctggccccacttctcgtagtcaaagtagatgtaggtgccctggccgggggagaaggcggtcagtgagtggacgaggaggtggtctgggatctgggccggaccaacagacaaaggggacaattcttagggctgtggatgtgtcaggcaccgggccagctgccctgcacgcacacactctcatccatcctcacaaggttcttcttgggtaggaaatgttatcatgccacttcagcgaggaggaaacggagggggccgcagaggttccaccgaagccagctgccagaacggggccccagccccaggtgtgagtgcacagccttcgtttcctcgagggctgtggcttttgagcacctctcacgtgagtacaggatgcacagcctagcatttaatcttcacaaagacctcgaggcagtgggtactgtcacccttgttctagagaatggaacagtctcagagtctaaatccaagcactctgcagggacattttattggtgacggaagtggtgtgggaatttctgaatgactggatgccctgaaatgtactaacttggaggatggttttgggccaaaccaggaaaggacaggaagtctgtggttaacatctgaggacacaatgggagaggacctaggttctaaatgaatgtcttaagtgcttcaaagatggcaacctgggagaaccaggagaggggactgagttctctgaggacaaggaccttgtactacttcatccccatgaaggggctcggcatcagggaagtatttggtggaaaaaaacatcactgtagaacacaccaactgaaagtaatttgaaaaaaaaaatccatgacactgactatgtagcagtcaccattaagtacttacatgttattaactcatttaatcttcataacaactgcattaggtaggtggtcttccccccatttttacagataagttaattgagacacagaggttcgagtgacttgcctagagtcgcccagctggactgggctgaaacccaggtaggttggttccagagtgtttgcaagcagcaggaatttcccagtattagaacttgagaagcccattcaaaaaaaatagtttcggcactgagcccctgccctgctgagtgctgggacctggaggtgaagtgggggccatcaaggtccctcggcagcagagcccacagcctggtgcagggacacatactgggaaaatcccacaccccaagcgagtgtgcccagcactgcaaaggggaggcactgggctgggtggctccaggaaggtttctttgaggaagggacatttgggctgagacctacaggaggcctaggagctggccaagtggaggatgagagggcggtgttccaggctgagcagacagccagagggaggagtacttggtcaggctgagggactgcgccagctgaaaggtggaggcaagggagcagaggccagcaggggctgcctggagcctggggactctaccccaaccctagcagcgggaagagagggggcggggccctcacctgctcaaactcgtcagtgatggtcttgggctcctcgtgcctctggaaccacatcatgtacttggtgtggaatcgccatgactgcttctttagggccttggctgccagatactgtgccttagtgccctgggggaggaacagtggagagggggatcagggggcccccaaactgggtggggagccaggggaatggggcaggacatcagggctgaaccccggcccccgccacagaccacagttgggctggacaatcctcttggagatggggctgggggcacagaacataccaatgctgatcaggagaaggaaaatgagacaggaggtgaaaattgctttcagagaagctttgagaaggaagaaaaactaatgtgtgatgagagctgagagaggaggcaatttagaaaatttcccaagtggggatgagggtggaggtcactcatgactcactggggttgggagggggctggacagctccccagtggtctccagggaggcctgagaatgtgccgatgagcagagtggggtcggcctagactggggctgctggagcagggctggggaggggccgcgggtgagccagtgggcaactggaagcggggctgaggtgtgcctcagtggaccagcctcgctgtcaacccaagcagttctaacatctctgggctggaaggcggggacggggacaggtggatttggggcaggggcccaggagtgggaatagggagggggtgcggtcccagtggccgcagtggggcacccacctcacccctccagcccgaggggggacggcggcggtggcggcgaagccggggggcccgaggctgccccgggggccctgctgtacctccagatagtagaagatgaagaagagtgtctcggtcgacaggcgctggtagaattccacagtgtccgagtgtgggggtggcatctggtggtggtaggggggcgtcggacaggggttccgggggaggtactgcctgtgagagcaacaggaaggtcagtgccagctgcctactagtcctgtcgtgatcaaaagggtgctcagacatgcatccctgcggggggaggtggtacagaaagacccagggcggtgctgaccttcagtggagagcccaagtcaggggcctggtgctctacccacagcctcacaggttcagccactgcctcctccgtaagactcaagtcccagaccatcccccttccctgtggcccctcaccgaatacgctcagagtcagaggggtgaggcatgtggtgccaggcggcctcttccatggcctgctgatagagctgctccttggtgaggggcacagggcccagtggacagacacccagcgacagcggtatgttcacctctgacagctgcaggggcggctgggctgaggccggaggtgctgatgtactgctcaggatgatgtctgtggggagggtgggggtccggccccctcagtggtgaggatgggtcaggggcagcccctcctctttggcccgctgcttccccaccatcctgggtccctcacctcgctcggtcaggtgcagcgttggcacagggtcctcaatgccagagctgatggctgcccgttccgccatggacttcaaggagctcagaggctcaggggcctggggaggaaacaagaggcctggcctgagcacttgggctgcaggagcaagtgcagcctgacacaggccccagatgctctcacctgccctgtttgggggccgtggagggccaacgacccactccccacaatctacccatgacaggtaaaagcatcaaactgtagggaaacaatcggagaccacgacgcattcatcagcagaggaacgtctcgtgagtgggactctgcagcatggaatactacgccgagattttcaaaatacaagttcgtgacatactacagaagtaaacgccaacctgcagaatatgtacagtgcgctaccatttttgtcaaaggatgtgccaatagtacacgctccttcactagggacacctacacgctgggagagctcccgcctgtcttgaaggaggcaggaggtctacatgctcagctgtctgcctgtgactggcatggggtgactggaatcggggtgggcccagcccggctaggcttcagtctccttgctggaaacaggtaggttgggtctccagccccgcagccacagcctcgtttcctattacaaaggttacagcaggcttctgttccccaaagtcagggctggttcctcccatctcctccagccacgtgcagctgtcccaaaccccagccctgtgctggactctccacaacgagtcagtcgccaaggcttatccattctgtctcgctatatcgcccaggcaggtctcaaactcctgggctcaagctatcctcccgcctctgcctccctaagagctgggattacaggtgtgagccaccacgcccagctatccgtcctgcttctaaaccccactggatggctcccttccctgtcgtgccaccatgtcccacacagcccaggcctgtcctctcctgcccagaccaccctccctctatcctgtcctcaccagccccaggggacctttccaatgaagtcatgttgttccttctctactccaaaccttgccatggttcccgaccacccaccccagcgattcatttttgttgttggtggtgttaaaagatatggaccccttctgaaaatctcaaagctgctgtttccctttttccagaaaaatgcacgcactataaatatcctgtccacctacttctaaaatttgggccgggcacggtggctcacacctgtaatcccagcactttgggaggtcgaggtgggtggatcacctgaggttcggagttcaagacctgcctgaccaacatggcaaaaccccatctctattaaaaatataaaaattagcctggcgtggtggcaggcgcctgtaatcccagctactcagtaggctgcggcaggagaatcgcttgaacccaggaggcggatgttgcattcagctgagattgcaccactgcactccagcctgggtgacagagcaagactctgtctcaaaaaagaaaaaaaaaaaaaattaatgcttctgttgggccagaaactgttccaagagctttatgaggatgatttagtcttccaaataaccctacatagtaggtataatcgtgactattgccgtttcccagatgaaggcacagaaaggacaatgccaagacttggacctggacagcctgggcgcgcacactgcctcctggacagcctgggcgcgcacactgcctcctggacagcctgggcatacacactggtccccccatggaagctgcgctacagtatactggctcacaagccaagccccagctcctgaccctcgatgatcaggaccccaccgtcctatcctgctacacccactatctcagccctgcagctggtggcactgtctcctgcagagtggacacctctctcctctctgctgcatcctgcccagcttcctaagcacacaggcagatgcatgctcctcctaaagcacctcctgaagcccttcctgcagctgttagcccccctgcctggtccaggtctcagcttaaacatcaccccctctcagaccttcctgggcctgtctcccaggtcaggtcagatgcccctcggtgggcccaccgcaaccttccctgcagctgccccagcagggaagcttcctaaagggtggaaccaggctgcattcacccaaccagtctttctacttgtgcagaaagtacaccagtctatgccttgtgaggacaaacggggacagaaactgagggcctgcgggggggatgaagatggagacccagagagagcaagcaacaagtgcaaccaagagaaaggaaaagagacccagagaaacagagctttggagggaacaagagaggaggtatgagagcccccagagatcaaggtcacggggagggtggtacagaaagacctggagaaagagcaagtgtgagaaggggacagaaagccagagaaagagatccagaaagagggtgggggcagggggtgcagctagagacctggaggaaagaaacaacagagtcaggacacagaggctcgggggatgtccgaggagcccaccttgatttctggggcggtgctgaactgtggaggcccattgagcagggcaccggctgccttggcatcactgaagctgggcgttggggagctgggaggattcacaggcagtggcaccaggaggctgggtccccctgagttgttccctgagcctggggccacgcccccagcccccgttggggctgccgcactgggttccttcctggagagagagcatggaagagggggttgagaggagggtccctgagggtgggatgggcagagaggcctggctggagagaggggagactgcacagatcagatgggatctgagaggggcaggtgagggcagacagatgggagaaagaagtggttctctgggcaaacaaaggcagagcccaatctttggaatggtttctcatcagcagagcagagctgtgggggtgggggtgaggattctcgggtgctccaccaggccacaggctgatcaaaaccacttgccctgggcaggtgttcacagggcccactcccccttgggcaggccagctggagctggggtgagggggcaggaagcaggcctttcctttgtgcacactgatctttcttagggcattcttcgggaaacaggcagacccagtggaatggtctgagctaagatttgaaggagtggctgcagaggaataaggacttcgggacaattcactttgaaaagtgaaacagtgaccctccggtggcagtcaattggcctcaggcaggtaacagaaatggggaggaaagggtatggggctcttgagaaaacttccacttagatgagaacgtattttagaatgttctgaagggcaaagcagggaggctgatgtagtttccttgctggaaagaagtgggggtgtaacacccgagggagatggaggatagcgcttggccattcccagcagcaagggcggggggttcagaacccaccgatgcgggggtgaggcgcctgcgcctctctgtttcaaaaggctgccatcccaaccctgccgatggccgagacactcacgaggtgctgggaggtgggttgtgggggccggaaggggggcccaaggcctggctgctggcattgttgcccccactgctgctcaaagccacctctgccgggctgtctgccacaactgagctgtaacctgggaacaaagagtaaatggaaagggctgctgcctgctgcccagccccgcccacgccccccaccccgctgcctcctcactcactggtggcgccattctgcttgccagcccctccaccggcactgctgttactactgctgctgctccctccacctccgctgccgccgcctccgcctccgctaggctggacgctggggggccggggctgggtcgtgctgggcccactgggagctggtggggccacagcctgggcatagggagcaggggtgcccgagttgtggctgggagctggactggccttggggcccagggcacttgggggtgctgcgggggcggggaccccattgttgccaggagtggtgctcaaggcagaggcagcaggcggggggccggaggggtaggtgggcggcacagctggggactgagggtgctggttgctgtggacaggcttggagccgtttttggctggagactgcgggtgggagagagcagagggtcaggacccagtgggccagctggtctccctcaccacccccacctcaggctccatctttgtcccagcagcctcctctctggcctcgctgcccccacctgctcctgccctcttggggacctgggtgaccttactcaccctcatggcttcaatcaccttcatgcttaaaacactcacactgatttccagcctgcccagcttcccaagtcctgcctggacaccgccccatggacacccccacagggatctgacacacaacttaggttgtcagccagagaagatccatctgttggaagccagaggactagtgggaaacacttaagtgttctcaatatgagattagctggagccgcctaatgtccaagagtagaaggaaaaacagctggaaattggatagtaattctgaatgtcacctgaagggtcacagaagctactcacagggctggaagttaccagcactccagaaagtggtgggagggtaaatgtgctcatggtatccctaccgcaggcaatctgtggacagcactccggctgctgagcctaaccacctcctgggcttctttccagccaccccacaggcaccttgcgcttaccaagcgcccaacaggactgactacccacttctctcctgggcatcgctgcttggcagtgggggcctgggaaggtggcagagcccagcctggcccctggagtacctgcctcagtgtctctcctcatcacctcctggccctgttgcccgccctcactactacctgcgggtccccttagtctccacaccagcctcctcaatgcccactcagggtgtccccttggaaccatccatcccgttagcccacagaggggcctcaggcccatgctgctcctgcctaacattgttctgtagcagcgtttccgaaagcgtgctcctgtcctgggagatgttaaaggagttgaagaagcactgcccgccaccgtctcctctcagaaatttgcagtgtgtattatcagcacagcaaaggccccatcgcttcctaggcttattggactctggaggccactcaggtccacaaagcctgagcccctcagcctgacagtcccagtccctgtgctcacagttgggcccctggccctgcagacctggccagactcatctctcctcacttccaaactttctgtcacaacttgcccatgttactggctgccacctctccctgccaggcaaactcacctgactgtgaagcccagggcactccacagcagcatctcctgactgcctggccaggccaagggtgacctgtgtgctacccccttgaccacagcaccagtcacctgtccacttgccctgcccacctgccctcagggcagcactgatttctgagccacctgtgtccaccagcccagcacagtggccggcgctcaggcctcaagatgcctttgggaagcaacagaggagtgaatggcgtgcccacccggtccaggctcacacccacctggctgacttcactgtctgtggaacgtcccctcttcttatcatcttcagagttttcctgaggtaggggaggcagaatagaaacctgtgtgacctctggggctctgatggagaaccgccaatctctgaatgccccggggacctgggcccaattgactgccattgcggccccagagctggtcaaatggctgtccttaatctgcctggagaaaccatctcaattcaggctctccagtcttcttgttttctgggagccagcactgacccaccagcctcttaaggatctgggaacctgctctccacagggaagccaacccttggatccctgcccaaggtggccagctacccagcctcctcaggcagcccaggcaccggcccctcccacttcccagatccaggacctaaactggcgcgggatgcaccctattgctctttatgtcctttagggacccagatataggaccttagcgtgtgctccaagagcctagaccctggatacctagatctgtgtttcctcaattacgctcccatagccactttggagtgacccagatttgtctcctcgagtcctgccctgctggaaacacaaggtactagtgtcccgtggggcctcaccgtggtacagttggctgggctgggcgggatgggagagctggaggtggttgaggtgggcgtgctgctggactggttgaagatctcatcctccatgtggctgtggctgggaggggaggtggcgaccagcgcctgtgctgtgggggcagaagaagggcatgcttagctggctcacacagcccattctgggccctcacttcctgtgccacgatcagccccagggcctcacgaatgtcctcgaggtccaggtcatcgtagagaaactcgttctcctcgaagtcggggtcctgggatgagtcaacatagtactcaacgtcgtccttgatcttgcggatggcgtcaacgaggatggagtcattgtccagcatgcgcaggatggtctctagcatgcgcacgtggtagcggtgcttctcgatgtgccgcttcaagccctcaatccggtcctgcttctgctggcgagcccagggccaggctcaggggctgcagagcacctgcttggcccctcctgcccccacagaacctgtcctcagtccctgacccctgtggagacccaaagcctccacgccatccccttcggggtggggcagtatggggtccacccaccctctgagccctgtggggaccaatcttagccttgacatcttgggatcccactgctccctcctctccccacacctttctggctccaggagtccttggaaacctctaaaagacccagaggtccttgtgccatcccacgacttggcctccatctgcacctcacctgacagcccagatttctcaactgagcccgcccaccactgtgactgcctctggcatacagataccctccgacctgctccagcagtaacaatgataacccccatttgtgaggagcttgctgtttagaattgtgatatctgtcatcactaggcccccaaccctacccatttatccctgagagagcccagattcctaagcctcgctcctgccctcccctcaaggcccctttaggatttaacatcttagccttggttccaaatctctgctctgttcaaggacccatcatctccccgaaagcccctggttcccaaacccctcagagtctgacacccaaccctgtcatcttccacttcctgaccctctcccacccacagcttccctgaggacccggctctcccctccctgtctttctggtttcagcaagtctgtacagtttgtatccctttgaactcataccccacaatcccggattttagaacctgggaccccaacatccagctttgtcccagactcctgtcttccttcaggcctggttctctgccttctccatgttctgccttgtctctacccactgtgctctccctaggaccagggccctctgggtgccaggaggcctcttgccatgggtgtccttcaggtctcacttttactctgtggcccaagctcaacctgcactcaccttcccccaagtcgctcctcttcacaaaggccccacggtctacccagacacccaggggagcctgagattctgtctgacctccttcctgccccacgcgtgcagctgctaagccctcccaatcctgtctctcaaatccctaatcccggctgttggccctgtccgcctgaggaatccaggccccaactcccaggagcataaatgactggcctcctgctggccagcccattcccatgcccatccccatcccaaaggtgtcgggtctccctcactcacatccttgtcgcccttcttcttgcgtgtctgcactgacagtgactccacttcactctcaaactggtccacctgcatgttgagcgtgtcgatggtattctaggggagggagaggaagaggaagcccatcagctagggttccgcctacacccagggctcaggatcctcagagttcacctcctcttctctaccccaactcaccgtgagccactggccaacctcttccttctccttctgggcaggatctaccttctgggccaggcccaggccctctttgctgtaagctttggttttggtctctcgttccacaactttgaaccgttccatttgctgtagagagtgcagttggcaggggggctctcaaaggtgggaaaggagctgactaagggccagcagacactccgacctgagcctcgtgaccctactttctgagctctgagtccgctgcctcttcacttcccttaggtgcagaaaccttacttctcttgaggacctctggggtctggccgctctgcctccgccccttgggatctcaagaatctggtgaccttcccacctctctgggactcaggctctgggctcctaccgtctcaatgagcttgcggttgtctataagctgcctcttgtccttgatctcgttggacgctacccatgtcttgatttggtccctcagccgctgcagatgggaaaagcaagaaagtcagacctcaggacccaggaactggggcccacagctccttctccctgggacccagcagtccactctcccagttccctctaccctcaggacaaaggcgtccaggcccccagccccctcacttgtagcttcttaatctccttctttaggtcagcctcatacttttctttctggttcgcgttggctgcattgtggagctgagggatggagagaattgagaagtcagtgtgggaggggatgtcccagtacccactccagtgattcttccttatgctagggactcgaggaccccccccaacccctacccccaatccatcttagagctgattctcttaggtcctcagcatctgcatatgtagcccctcccgctggtcaacacccagaggtcctgagccgccttcctgtgccctcctctctgaagacccagattattagggtctcagcccctgtaccttctgccaaatatcttcaaactgctccacgccctcggacaccttcttgaggcagcgatcaatctcacctggccagggaggaacaaggctgtgagaatcctgcccaggtggcaggtatctaaagagcagtcctcagaagagggagcatgtggctacaggtgcagcaggaagtcagtctagtaccttggagtttgcgcttgtccgccatcttccctgccctacagacgcactctcttcatactctcttggagacggacgctgctaggagagattggagaggaattaacacgtattccctggctggtaaaaacccagagacatggacctagtcagcatagtgaggtaggtgggactggtaaagagaagaagcatttgctatctgacaagagaccagccccagttctcctgatgctcgcttgactgcccagcatagtgtctggccaacaggggaccccataagtttgttgaaacaagaaaagttacatacttttttgtgtgcctctgactcaggaagtggaaaattcctagagcatggagtaccttctccccagaatacactcaaaaaggtttttcagagcaggacagtcatgctgcacacagctgatgactgggatggaggcattagccctggaaatcacacttcctactcagaggggctgggcagaggtggctaggagaggtcatccctcagacaagtcaggagacaaatgaaactggcagctcacagagaagggcgtgtgtgtgtgtgtgtgtgtgtgtgtgtgtgtgtgtgtaagctgtaggtaggagaagaaagattgggggtgggggaaaacgacggcgagcagagatgccgaaagctgtgaagagctgaacccgctcatgcagacagggctgaatgccaagtagaagggactcaaaccaccaagacatttattccagagcaggatccttaaaccaaaaggaaataacactcctaacccaaagaagctaataccaagaaggcttagagatttgggggcagaaggcagtacccaagagagacctgggagaagacagaaatcttactaagataagagggtgcaaaggtaccgcagctgtgagggagccgatctgcactcatggaggaatcccatagcaagtggattggtaatttagagtcagggagacatagaccatcagggcaggaacccaaaacttcaagagaggagcgtctttattttaaaggaagttacctggaacccagagaagactgaggtcaaaagggagttccaaggagctttagtccaagggaagacataccttagggcctgacagcgagaccaggggagccctgggaagagaggcttatgcctcagaagaagacttctgagataccagcggagattgccctcttcccctccagggagggggcctacaatgaaaagcacagttccctgggatccacgggccgctcccactctacgtgtgcagggcagggaaccctggagtagtcacttactgtaaagacagaaacagccccatactgaggaacaagagcctcaatacagagggaagtcacaccaaaagagtcctcacccacaaagaagggaacatctggcaaacagtgctatccaacagaactttgcaatgctggaaacactctatttgcgcatatctgttggccactgaacatctgaaatgtggcaagtgtaatggaggaactgaatttttcatttttaactagttactaatcaccacatgtgactagcagcaaccatatgggacggatatgctttagaacaagaagcccataaaggacagggctggtaccttacccccagggagaattttcccaacaccgcagggacccattctgggtgataataggtaggggtgctaccttacacttgagggaatttaaatctcctcagtaaaaggcccaacctaaagaaagccgcagcagcccccgcccaggtcagctatcacgccctacctggggaatctctaagaaggcaaagcaaccaacaaaaggacccaggagaaggtgccacagtggggattcaggctgaggaggggaaagcccctttgacccagggagctcacacaaggcaagggcctggacaccagagctcaggtgtgcagggatcctcaccaaagtccaacaccccaacacagaaaagcctcttactgcatagggggaacaagaatgtgaaacgagagtttacactccctctttccatcccaagaacccaacagagggtcatgggcaggtgctccagcccagagagagaagaggtctcatggtctacacccctaaacaaggcaatcaacaccttaggcaggtgacgccctccctgtgtctccacacggaaaggactggtatcctagtgcagaggaagaatacccacagagaggagaccacactgtggcagcaagagaaggaagtcctggaggggtcacaagccagaaggaggggaacaagagcgctaacccagggaggtgatgtttcagacagaacagtgtgacatcgaagtcggctacagctgagacccagtgaggaggcagctcctccacagagaaggggcaagtgccagaggcccagggtacttgtcccctagagaggctggagccttagccacagtagagacaacaccttccccgctaagaaaatccttatatcatgagggtatctgtacctctggtccccccagcaaaggaccagagagaagggaagctggagcctgagtctcgaagcagagacgccgccagagaagaaagagccccatttgctgtagtcaggggggcatccaccaagatcctccaaggaaggtggtgatcgcaggtccactctcaggcgtgaagaacctgtgctccagcagcaaaggctctccaagagcactgaggaatctgggaacctcggcccaggaggagacttacccaagaggaacacacatccccacagggaagggacccacaaggcgggtggcggggcggggggaggtgagcaggacaccagcctcacaggagccaacacgctaaaatcagagccaaaaccagtaaagaagagccccccagacttcatctcagggaagatgataccaccacacaaagactcgaggagggaggggcaggaggtcagccctgggaaactaacaccgggtggtccttaaccttgggggccgtcatgtgcccacagagtggtctttgtcatgaggcacctttgatctgggagagcttccgcctctgcagcaaggagctctgagaagtgatgttgaagggtgatccttaacccaggtggctgctgacgtggccacacagaggctctgagactccagaagaaggatgcgttagggcctggggtagaggtagtcatctccactgagatgccccatgccaagggtggggggctggaatctcccaccttggaaagtctacaccagagaagtctctggtcccagggacagggtctacagtggagtctcccgcttgagactcaggtatcttacatccacacagccaggaaactatgccttaccccatacagtgacaaatcaagagggggttttggaagcatgagccgggggcacctgcatccgagaggggtcctcagccttacggtggggacacatgcagaggcgtggacacctcaaatccagaaaagcagccataccaataccaaggatggcaagaaccttatccctgggggaggtgacaccaagaaagggtccttaccctggagagaaggcacagccccagagggaagagcccccacctcgcagtacaggaacccgggtctaggaagcttcctactctcatggggtaccagcagcggggccagaaggcgaaacccttgttctccaactgctgacacccagcgtaagggtagatgggaagtcaacaaacccacagtgtgggatctgatgcaaatatcaagggcagtgggcttcttggtccttggagagctgacaccctaaaggaggagactggtgtgaagatggaagaagcctcatactcaggcaggggtgaagggagggaggggagacatcaaaacccctcaccaaaaggacaggagagctcaccccggggtgggtggccgccctgcactgagaggcagggactgctcagaaagaggggctggtgctgcccgcagtgggagctcactaacatggacagcgtggcggcttagtgtctttcaccaggcacctgagcgccaggggatcccagcagcccccagcaacaagaccacagtggtcctgatatcactgggagacgcccacacccagaaggtcggagagtcacgatgcaggggagttcaaggctgcaaagccaggggcagacgccaggatcaaagaagtgtgagagctgagaccagacgtgggccacactgaggacggtcctgtaccccaggtgggggaaagccaaactcccccaaaaaggcaggcgcccagtgcagcgggatggcgaggctggagccacccagggcgctactcgctatgagagggaagagctgcagactacagaggtggaaacttcggcaaaggctccaactaacggggagtttctcctccactcctctcccaagaggctcccatccgatacagacgggcagctggaactgagatccaggggcgaggctgccgcgtcccgggacgccagtgaggagggatgcggaggcgcctcggtcctgggaagggtgactcccccacccagctggggtcctcgtcccgaccaccaccccccctccccgccaccgtcgagggagaagccccggcgcggagctgccccacaacgcgaaggaccgaggccgaggggggcaggcacctgagccccgagagggcgggcacctgggaccaggggcgcctccatccttccagccaggagccataccgacgcggagaggggcgggcacctcgcgcccgggaggcttcgcaccctcacacccctaccggggggcccgacgcgatgccacgcggggaggcggcggcgggcggggcccggggctccgggctcgcggaaggacccccgggaggcgctgaggaacgtgaaagaggcgcaggaacgggagggcgagagggagggagccgccccccgccgggagccccgcgctgcagaggcggcggcagggggcaggcgaggggaggccatgtcgcgacagacggcggtgtcgccagggcgggaggcggcggggagggcggacgatggcgccggggggaggaagggaaggggtccggcccagtcgagcctgacgctctcaccacaggagctggcgccgccgctgaggagcgtatcgcgacaggcgggggaggcgagcgcccgccgcctttttctcgcgccccgggcccgggcgctatcgcgatagcggcgcgtatgtcggatagtgggtttgtttgattgggcccggggttgttctgacgacgggggtcggggctcaagggaggccgcggcgtctgccgatggctccgcggaagctgaccgggccc

SEQ ID NO: 11311 - DNA, 13994 bp, Homo sapiens
  misc_feature (156)..(156): n equals a,t,g, or c
  misc_feature (10132)..(10132): n equals a,t,g, or c
  misc_feature (11830)..(11830): n equals a,t,g, or c
ggaagtgcaaagaggcgggcgtgccagtccctggacagctacgacgccatgaatatcttgcccaagaagagctggcacgtccggaacaaggacaatgtcgcccgcgtgcgacgtgacgaggcccaggcccgggaggaggagaaggagcgtgagatngggtgctgctggctcagcaagaggtaagctcggaagccggcaggcggcgctccggggcccagcgcgcaggcggcggttgggggccggaagcggaggctttgcgcaggctcaatgtgccccgtgtgaaattcgggaccaggcgccgatcccactttcgaggacgttgccccgcaaaccttgtgcccacttccacgaaaccttccttgatctcgccctcgtcttagtttttcccacactgatgtatttcacatggctggaacagtgtctagcacaagagagaagcttaacatttaatgaatccgtgaccccttagacagttcaaggaaattcggatcactttttagtttgcctgcacagcctatttattgagcatctactgtatgctaactacatgccgtgcacctgacttgcggaatccccaataagcactgttcgttcttagaggggcactgtcatctctgttgcacgaagtgagatggcttcagtgaggggaaggcacattttaaggagaggcggacagccagctccacgccatcggggagccctttcgtgcaccgccccctagacacatacacacaaacacgggctttccgtatggctctttaaatctgtttggtgtacacccaactttcatttccttagctagtctgatcctccgccgtgggtgggaggtagtctaggtttttagaatctcagtaggctgctgagcgctgtttgaaatccgcgtcctgaaggcaggggacagggcttcagcagacttggggtagtcacttggagccatggctagaattcagatcgtctggcctaatgcatacctttatggctgttttaattgtctcacttgaggttaggaacccctttggtttaggccagggacctcctcccatacatccttgatgacccgtggtttactatttgaaagggagtttacaaaacccaggcgttgcctcatctgcctaccctcacccccagctaggacaggtgcctcttttaggcgcctagtgctccctttctcataaccccagcaccctggactgccattttctgtggtgggcaccagactcacagttcttgaattacctctaggttctgaatgtcctgcctataactttctccccaggcccgtacagaattcctacggaagaaagccagacatcagaactcactgcctgagcttgaagcagcagaggcgggagccccaggttctggccctgtggacctgtttcgggagctgctggaggaagggaaaggagtgatcagaggcaataaagagtacgaggaagaaaagcgacaggagaaagtaagctggcctcacccacttcatcagaggggccatgaatcgagttggagggagggggcactttagccattggttgtgaccaaggtcaaacaagagtgaacacacagaatttaggaccataccaaggcatgacactcaaaaagcgttggctattgccgtctgggcgcccacaggggttggaggtagatgctagaggtccccagctgctgggcaaaccgctcagttctccaaactggaggagtctcaaacctgatgggcttttaaaaatttaaatcagccggctgtggctcacgcctgtaatcccaccaccttgggaggctgaggcgggtggatcacctgaggtcaggagttcaagaccagcctggtcaacatggtatctctaaaaatacaaaaaaaattagccgggcatggtggtgcgcgcctgtaatcccagggaggctgaagcaggagaatcgcttgacccaggaggtggaagctgcagtaagccgagattgcgccactgcactccagcctgggtgacagagcgagaccccatctcaaaacaatcaaacaaaaagtgaatcaatcgcctcttgctttttggctaagatcaagtgtaaaaggtacatcagtggctgtgcatggtggctcacgcctgtaatcccagcactttgggaggccaacgtgggtggatcacctgaggtcagaagttcaagaccagcctggccaaacatggcaaaaccccgtctctactaaaaatacaaaaattagctgggcatggtggtgtgtgcctgtaatcccagctactcggggggctgaggtaggaggattgcttgaacctgggaagcagaggttgcagtgagccgagatcgtgccactgcactcgagtctgggcaacagagcgagactccatctcaaaaaaaagaggtacatcagctcttgtcatttatctgctgtctctggacttgctgaccccacccatcgctcctctgctttgcttgatcccttcaggcttctcttcaagtctctctgcaaagatgcctgcctctgaacactcaagtggctccacttgtcccctccttcccctgctgttactgtacctgctactgtcccccagggggagctttgcctctgtttgtcttccatccccagcacctggtccaactggttcataacaagccttagatacctgttcgcttagatacctgtgtcagggagacacacctgacaccttgaaagattatatcacatctcttgtatttcctggccccctcaggagaggcaagagaaagctctgggcatcctgacatacctgggccagagtgcagcggaggcacagactcaacccccttggtaccagctacccccagggcgagggggccccccgcccggcccagccccagatgagaagatcaagagccgtctggaccctctgcgggagatgcagaagcatctggggaagaagagacagcacggcggtgatgaaggcagtcgcagcagaaaggaaaaggaggggtctgagaagcagcgacccaaggagtaagaagaccccacctcggcagaccagggcccagaccttcagggcttggcagcagccagcatgggcactgcagcgtctctggtcaggacagccagggactccgtgaagggctggctaggtggagaagtggttctcagcatgtggtccagggagccctaggggtcctgacaccctttcccggggtgctgtggtgtcaagcctattttcctgacactggtggacttttccactcgtgttctcaggcatgtagtgcaggtttccagaggctgtgtgatggggagacaccctcactctgatggccaatggcagatgcttgtgtccaaactttcttagttttcactaatgatttgcagcatattaagagaacccatttaaacaaaagctcttggggtccttggtttttaagagtataaaggggtcctgagaccaaagagtttgagagctgctgggttagagagtaaaagcaggcttctgtctccaggatgctgcacccctggtctagagggggtacactgcctgtagtcttctttcctctagaaagggaaactgagggccagggggctgctaagtgtgctttcttgacctggagaagcatcagattttaaagactggggaggaccaaagcccacagaagggaaggccagagacgtgcccatggcgtcccagcaccaagtggctgcttccagcaggcctaaggagctgaggctggggtgtgctggatgcagcggggcttccaggcggcagctccctctatgggagaggttgggggaatggcctcctaggggctaccagctttctgacctcactcctctccccacaggcctccatccctggaccagcttcgagctgaacgtctgcggagggaagcagctgagaggtctcgggcagaggccctgctggcccgggtccaaggccgggcactacaggagggtcagccggaagaagacgagacggatgaccggcggcggcggtacaactcccaattcaacccccagctggcccggcgcccccgccagcaggaccctcaccttactcactgactcctgagggggtacaggagaggccgctgctgccagccgtcatataaaactatttattcataaatattttccaaaatgaaaataggtttaccaaaaaatgtccctcactggggaggggaggagggggcagccctcgcccccgagcccccagggtggggctgagaggaaaacctcccggccccctccctgcttcctgggagagggggatgccccgtggcttggggcctccctccagtcttccagggcagggccctcacctgggcagggggatcagcatgcgggggaagggggtgggtagagggaggggccggtgtcactggaggtcccggtcctccaggtagcggtactcaaaggtgaagccttccttcttccgctggccccacttctcgtagtcaaagtagatgtaggtgccctggccgggggagaaggcggtcagtgagtggacgaggaggtggtctgggatctgggccggaccaacagacaaaggggacaattcttagggctgtggatgtgtcaggcaccgggccagctgccctgcacgcacacactctcatccatcctcacaaggttcttcttgggtaggaaatgttatcatgccacttcagcgaggaggaaacggagggggccgcagaggttccaccgaagccagctgccagaatcgtccccagccccaggtgtgagtgcacagccttcgtttcctcgagggctgtggcttttgagcacctctcacgtgagtacaggatgcacagcctagcatttaatcttcacaaagacctcgaggcagtgggtactgtcacccttgttctagagaatggaacagtctcagagtctaaatccaagcactctgcagggacattttattggtgacgaagtggtgtgggaatttctgaatgactggatgccctgaaatgtactaacttggaggatggttttgggccaaaccaggaaaggacaggaagtctgtggttaacatctgaggacacaatgggagaggacctaggttctaaatgaatgtcttaagtgcttcaaagatggcaacctgggagaaccaggagaggggactgagttctctgaggacaaggaccttgtactacttcatccccatgaaggggctcggcatcagggaagtatttggtggaaaaaaacatcactgtagaacacaccaactgaaagtaatttgaaaaaaaaaatccatgacactgactatgtagcagtcaccattaagtacttacatgttattaactcatttaatcttcataacaactgcattaggtaggtggtcttccccccatttttacagataagttaattgagacacagaggttcgagtgacttgcctagagtcgcccagctggactgggctgaaacccaggtaggttggttccagagtgtttgcaagcagcaggaatttcccagtattagaacttgagaagcccattcaaaaaaaatagtttcggcactgagcccctgccctgctgagtgctgggacctggaggtgaagtgggggccatcaaggtccctcggcagcagagcccacagcctggtgcagggacacatactgggaaaatcccacaccccaagcgagtgtgcccagcactgcaaaggggaggcactgggctgggtggctccaggaaggtttctttgaggaagggacatttgggctgagacctacaggaggcctaggagctggccaagtggaggatgagagggcggtgttccaggctgagcagacagccagagggaggagtacttggtcaggctgagggactgcgccagctgaaaggtggaggcaagggagcagaggccagcaggggctgcctggagcctggggactctaccccaaccctagcagcgggaagagagggcggggccctcacctgctcaaactcgtcagtgatggtcttgggctcctcgtgcctctggaaccacatcatgtacttggtgtggaatcgccatgactgcttctttagggccttggctgccagatactgtgccttagtgccctgggggaggaacagtggagagggggatcagggggccccaaactgggtggggagccaggggaatggggcaggacatcagggctgaaccccggcccccgccacagaccacagttgggctggacaatcctcttggagatggggctgggggcacagaacataccaatgctgatcaggagaaggaaaatgagacaggaggtgaaaattgctttcagagaagctttgagaaggaagaaaaactaatgtgtgatgagagctgagagaggaggcatttagaaaattcccaagtgggaatgagggtggaggtcactcatgactcactgggggttgggagggggctggacaggctccccagtggtctccagggaggcctgagaatgtgccaatgagcagagtggggtcggcctagactggggctgctggagcagggctggggaggagccgcgggtgagccagtgggcaactggaagcggggctgaggtgtgcctcagtagaccagcctcgctgtcaacccaagcagttctaacatctctgggctggaaggcggggacggggacaggtggatttgggacagggcccagggagtgggaatagggagggggtgcggtcccagtgccgcagtgggggacccacctcacccctccagcccgaggggggacggcggcggtggcggcgaagccgggggcccgaggctgccccgggggccctgctgtacctccagatagtagaagatgaagaagagtgtctcggtcgacaggcgctggtagaattccacagtgtccgagtgtgggggtggcatctggtggtggtaggggggcgtcggacaggggttccgggggaggtactgcctgtgagagcaacaggaaggtcagtgccagctgcctactagtcctgtcgtgatcaaaagggtgctcagacatgcatccctgcggggggaggtggtacagaaagacccagggcggtgctgaccttcagtggagagcccaagtcaggggcctggtgctctacccacagcctcacaggttcagccactgcctcctccgtaagactcaagtcccagaccatcccccttccctgtggcccctcaccgaatacgctcagagtcagaggggtgaggcatgtggtgccaggcggcctcttccatggcctgctgatagagctgctccttggtgagggcacagggcccagtggacagacacccagcgacagcggtatgttcacctctgacagctgcaggggcggctgggctgaggccggaggtgctgatgtactgctcaggatgatgtctgtggggagggtgggggtccggccccctcagtggtgaggatgggtcaggggcagcccctcctctttggcccgctgcttccccaccatcctgggtccctcacctcgctcggtcaggtgcagcgttggcacagggtcctcaatgccagagctgatggctgcccgttccgccatggacttcaaggagctcagaggctcaggggcctggggaggaaacaagaggcctggcctgagcacttgggctgcaggagcaagtgcagcctgacacaggccccagatgctctcacctgccctgtttgggggccgtggagggccaacgacccactccccacaatctacccatgacaggtaaaagcatcaaactgtagggaaacaatcggagaccacgacgcattcatcagcagaggaacgtctcgtgagtgggactctgcagcatggaatactacgccgagattttcaaaatacaagttcgtgacatactacagaagtaaacgccaacctgcagaatatgtacagtgcgctaccatttttgtcaaaggatgtgccaatagtacacgctccttcactagggacacctacacgctgggagagctcccgcctgtcttgaaggaggcaggaggtctacatgctcagctgtctgcctgtgactggcatggggtgactggaatcggggtgggcccagcccggctaggcttcagtctccttgctggaaacaggtaggttgggtctccagccccgcagccacagcctcgtttcctattacaaaggttacagcaggcttctgttccccaaagtcagggctggttcctcccatctcctccagccacgtgcagctgtcccaaaccccagccctgtgctggactctccacaacgagtcagtcgccaaggcttatccatcctgtctcgctatatcgcccaggcaggtctcaaactcctgggctcaagctatcctcccgcctctgcctccctaagagctgggattacaggtgtgagccaccacgcccagctatccgtcctgcttctaaaccccactggatggctcccttccctgtcgtgccaccatgtcccacacagcccaggcctgtcctctcctgcccagaccaccctccctctatcctgtcctcaccagccccaggggacctttccaatgaagtcatgttgttccttctctactccaaaccttgccatggttcccgaccacccaccccagcgattcatttttgttgttggtggtgttaaaagatatggaccccttctgaaaatctcaaagctgctgtttccctttttccagaaaaatgcacgcactataaatatcctgtccacctacttctaaaatttgggccgggcacggtggctcacacctgtaatcccagcactttgggaggtcaaggtgggtggatcacctgaggttcggagttcaagacctgcctgaccaacatggcaaaaccccatctctattaaaaatataaaaattagcctggcgtggtggcaggcgcctgtaatcccagctactcagtaggctgcggcaggagaatcgcttgaacccaggaggcggatgttgcattcagctgagattgcaccactgcactccagcctgggtgacagagcaagactctgtctcaaaaaagaaaaaaaaaaaaaattaatgcttctgttgggccagaaactgttccaagagctttatgaggatgatttagtcttccaaataaccctacatagtaggtataatcgtgactattgccgtttcccagatgaaggcacagaaaggacaatgccaagacttggacctggacagcctgggcgcgcacactgcctcctggacagcctgggcgcgcacactgcctcctggacagcctgggcatacacactggtccccccatggaagctgcgctacagtatactggctcacaagccaagccccagctcctgaccctcgatgatcaggaccccaccgtcctatcctgctacacccactatctcagccctgcagctggtggcactgtctcctgcagagtggacacctctctcctctctgctgcatcctgcccagcttcctaagcacacaggcagatgcatgctcctcctaaagcacctcctgaagcccttcctgcagctgttagcccccctgcctggtccaggtctcagcttaaacatcaccccctctcagaccttcctgggcctgtctcccaggtcaggtcagatgcccctcggtgggcccaccgcaaccttccctgcagctgccccagcagggaagcttcctaaagggtggaaccaggctgcattcacccaaccagtctttctacttgtgcagaaagtacaccagtctatgccttgtgaggacaaacggggacagaaactgagggcctgcgggggggatgaagatggagacccagagagagcaagcaacaagtgcaaccaagagaaaggaaaagagacccagagaaacagagctttggagggaacaagagaggaggtatgagagcccccagagatcaaggtcacggggagggtggtacagaaagacctggagaaagagcaagtgtgagaaggggacagaaagccagagagagatccagaaagagggtgggggcaaggggtgcagctagagacctggaggaaagaaacaacagagtcaggacacagaggctcgggggatgtccgaggagcccaccttgatttctggggcggtgctgaactgtggaggcccattgagcagggcaccggctgccttggcatcactgaagctgggcgttggggagctgggaggattcacaggcagtggcaccaggaggctggtccccctgagttgttccctgagcctggccacgcctcnccgcccgttggtgctgccgcactgggttccttcctggagagagagcatggaagagggggttgagaggagggtccctgagggtgggatgggcagagaggcctggctggagagaggggagactgcacagatcagatgggatctgagaggggcaggtgagggcagacagatgggagaaagaagtggttctctgggcaaacaaacgcagagcccaatctttggaatggtttctcatcagcagagcagagctgtgggggtgggggtgaggattctcgggtgctccaccaggccacaggctgatcaaaaccacttgccctgggcaggtgttcacagggcccactcccccttgggcaggccagctggagctggggtgagggggcaggaagcaggcctttcctttgtgcacactgatctttcttagggcattcttcgggaaacaggcagacccagtggaatggtctgagctaagatttgaaggagtggctgcagaggaataaggacttcgggacaattcactttgaaaagtgaaacagtgaccctccggtggcagtcaattggcctcaggcaggtaacagaaatggggaggaaagggtatggggctcttgagaaaacttccacttagatgagaacgtattttagaatgttctgaagggcaaagcagggaggctgatgtagtttccttgctggaaagaagtgggggtgtaacacccgatggagatggaggatagcgcttggccattcccagcagcaagggcggggggttcagaacccaccgatgcgggggtgaggcgcctgcgcctctctgtttcaaaaggctgccatcccaaccctgccgatggccgagacactcacgaggtgctgggaggtgggttgtgggggccggaaggggggcccaaggcctggctgctggcattgttgcccccactgctgctcaaagccacctctgccgggctgtctgccacaactgagctgtaacctgggaacaaagagtaaatggaaagggctgctgcctgctgcccagccccgcccacgccccccaccccgctgcctcctcactcactggtggcgccattctgcttgccagcccctccaccggcactgctgttactactgctgctgctccctccgcctccgctgccgccgcctccgcctccgctaggctggacgctggggggccggggctgggtcgtgctgggcccactgggagctggtggggcacagcctgggcatagggagcaggggtgcccgagttgtggctgggagctggactggccttggggccagggcacttgggggtgctgcgggggcggggaaacattgttgccaggagtggtgctcaaggcagaggcagcaggcggggggccggagaggtaggtgggcggcacagctggggactgagggtgctggttgctgtggacaggcttggagccgtttttgctggagactgcgggtggagagagcagagggtcaggaccagctgggccagctggtctccctcaccacccccacctcaggctccatctttgtcccagcagcctcctctctggcctcgctgcccccacctgctcctgccctcttggggacctgggtgaccttactcaccctcatggcttcaatcaccttcatgcttaaaacactcacactgatttccagcctgcccagcttcccaagtcctgcctggacaccgccccatggacaccnccacagggatctgacacacaacttaggttgtcagccagagaagatccatctgttggaagccagaggactagtgggaaacacttaagtgttctcaatatgagattagctgagcccgcctaatgtcccaagagtaagaaggaaaaacagctggaaattggatagtaattctgaatgtcacctgaagggtcacagaagctactcacagggctggaagttaccagcactccagaaagtggtgggagggtaaatgtgctcatggtatccctaccgcaggcaatctgcggacagcactcgggctgctgagcctaaccacctcctgggcttctttccagccaccccacaggcaccttgcgcttaccaagcgcccaacaggactgactacccacttctctcctgggcatcgctgcttggcagtgggggcctgggaaggtggcagagcccagcctggcccctggagtacctgcctcagtgtctctcctcatcacctcctggccctgttgcccgccctcactactacctgcgggtccccttagtctccacaccagcctcctcaatgcccactcagggtgtccccttggaaccatccatcccgttagcccacagaggggcctcaggcccatgctgctcctgcctaacattgttctgtagcagcgtttccgaaagcgtgctcctgtcctgggagatgtcaaaggagttgaagaagcactgcccgccaccgtctcctctcagaaatttgcagtgtgtattatcagcacagcaaaggccccatcgcttcctaggcttattggactctggaggccactcaggtccacaaagcctgagcccctcagcctgacagtcccagtccctgtgctcacagttgggcccctggccctgcagacctggccagactcatctctcctcacttccaaactttctgtcacaacttgcccatgttactggctgccacctctccctgccaggcaaactcacctgactgtgaagcccagggcactccacagcagcatctcctgactgcctggccaggccaagggtgacctgtgtgctacccccttgaccacagcaccagtcacctgtccacttgccctgcccacctgccctcagggcagcactgatttctgagccacctgtgtccaccagcccagcacagtggccggcgctcaggcctcaagatgcctttgggaagcaacagaggagtgaatggcgtgcccacccggtccaggctcacacccacctggctgacttcactgtctgtggaacgtcccctcttcttatcatcttcagagttttcctgaggtaggggaggcagaatagaaacctgtgtgacctctggggctctgatggagaaccgccaatctctgaatgccccggggacctgggcccaattgactgccattgcggccccagagctggtcaaatggctgtccttaatctgcctggagaaaccatctcaattcaggctctccagtcttcttgttttctgggagccagcactgacccaccagcctcttaaggatctgggaacctgctctccacagggaagccaacccttggatccctgcccaaggtggccagctacccagcctcctcaggcagcccaggcaccggcccctcccacttcccagatccaggacctaaactggcgcgggatgcaccctattgctctttatgtcctttagggacccagatataggaccttagcgtgtgctccaagagcctagaccctggatacctagatctgtgtttcctcaattacgctcccatagccactttggagtgacccagatttgtctcctcgagtcctgccctgctggaaacacaaggtactagtgtcccgtggggcctcaccgtggtacagttggctgggctgggcgggatgggagagctggaggtggttgaggtgggcgtgctgctggactggttgaagatctcatcctccatgtggctgtggctggggggggaggtggcgaccagcgcctgtgctgtgggggcagaagaagggcatgcttagctggctcacacagcccattctgggccctcacttcctgtgccacgatcagccccagggcctcacgaatgtcctcgaggtccaggtcatcgtagagaaactcgttctcctcgaagtcggggtcctgggatgagtcaacatagtactcaacgtcgt

SEQ ID NO: 11312 - DNA, 1438 bp, Homo sapiens
gcccatatcacttaaaaagttcaaagccaaacaatgtttaacctctccttttttacattgtatggactttgtatgctgaagcttcattcagcctcctcctggttcacattgttattgttaatatcattatttttgtctgtcgtttattgtcagtctacaaattagatattattattgtttttgttttatacaggcaacatttatctggatttgcatagatgtttaccattttctttactcagtgttttatcaaatacatcctttaggaattcctttaatttggtctcttgttggcgtatgttcagttttcatttgtctattaaatgtttatcacttttttcgtgataggttgttctgctgggttcacaattttaggttgccagttctgtttttttgtttgtttgtttgtttgacacttggaagatattattctagtgtcttcaatattctgtctttggtctttggtcattctaattaccttttctttgtatatgatctgtcccttctccatggcttcttttaaaatcttctctttatctttggtgtttttcagttaaatatgtaatagaactaggcactgatttgtttatatttatcctgctcgagacacatgatgtttcatgtatctgtggctttttatagtttaaaataatttctggaaaagtcatagtcattatctctttaaccgctccctctcttccattctctttgttctctcttcctcgaactcctgttagtcatttgatcctccatatctctgaatatttttgtatttcttttattatttatttcttgtctctgctacattttacattgagtaaaagtgggatgtgacagtgggaaatcattagtgacttagaaattccagttggtcattgggccaattttgatgctaccttctctcttttatttctcactttaaaataaaatttgcaaaaacaaaaaattaaatatagtatgagtccagttactggcctaaggagctaaaagcattctgggtttgtatgaagacagctgagttataacaaatgagagtactgttgtgtgactgcattaattattccctttttaaatgtacaagagcaaggcattctacctgactgtgttattgagctctgcagcatacatgtgacagagctaaaacaaacaagcaaacaaaagaaaccacagctttaggatactctgttcatgaatatagcctgaaaatgataatcaagaagtaaacttttaccagtattaaggaacattaagctgcctatctctcagtgaatttcagaatgatattttaaaagttagtttaggctgggcactgtagctcatgcctataatcccagcactttgagaggcagaggccaaggcaggaggatcacttgagccccggattttgagaccagcctgggcaacatagcaagacactgtctctaaaaaaaaataaaaa

SEQ ID NO: 11313 - DNA, 329 bp, Homo sapiens
aggaaatgaaacccttctgaaaattggtgaatgcagtcctgtcagagatttagatttttgaagatgctgatacatagaagattggaagacatgaatatcttaaatgttaactacttttaattcattggtctaagactcagtgttaactgtcatgtataagattttattatttgttttatgttgcttctgtatataccttgaggtgtttaagaaaatatcttgtttcaaactgggattgaaggaagttatctgcagtctttaaaaaaaaattcttagaataattaagagaaatcattattattgtaccaagcctgtggttaagaagaaat

SEQ ID NO: 11314 - DNA, 1122 bp, Homo sapiens
ccagggcccagcatcagaagccggccgttttgatagacgtgttccctctgcgtccttgcagccttccatctgtgctacctcccaggaagccgaaggccgcagagtccctttcggatggcactgggagcaggaaaatgaggtgattatgggctgctgctccaagaagtattggcagctgttgctggggcggctccctggggtgtcatccctttcttgctcttgtggatgggaaccagagcaccccacttcaaagactctgtaagccagggcttaccagagaaagctgaagagtctagggccaattttaatcagtttcttgtgcttctcatgccaaaagagatgattgtcctcactatagttcatcctatagtgcggcgggcctgactcgctactgccctctaatgttctgggagagaagctgttgggtctttcctacctaatctggtagaaatgttagaacagaggctaatttggggaaataaatctctcaatttttttgagttgctttgtgtgtgtgcgcgcgcgcatgtgtgtgtgtaaggggcagggtctctaagaaagaaagaaaaggaggcgagaggaggaaagaacctgtttcagtttcccaggctctggcaaggtgactgaggaagcgccaagccccttagcctctttgggctctggttacctcatcagtaacattagaaggttttatacatgatttatccttttttattcagctcttatagtctataaatctccagtaagttgtggaaataaactgtcttttaaaaatctttaaaaaaccattttccggccgggcgcggtggctcacgcctataatcccagcactttgggaggccgaggcgggtggatcacgaggtcaggagatcgagaccatcccggctaaaacggtgaaaccccgtctctactaaaaatacaaaacattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaacaaaacaaacaaacaaacaaaaaaaacaaaaaaaaaa

SEQ ID NO: 11315 - DNA, 1120 bp, Homo sapiens
ccagggcccagcatcagaagccggccgttttgatagacgtgttccctctgcgtccttgcagccttccatctgtgctacctcccaggaagccgaaggccgcagagtccctttcggatggcactgggagcaggaaaatgaggtgattatgggctgctgctccaagaagtattggcagctgttgctggggcggctccctggggtgtcatccctttcttgctcttgtggatgggaaccagagcaccccacttcaaagactctgtaagccagggcttaccagagaaagctgaagagtctagggccaattttaatcagtttcttgtgcttctcatgccaaaagagatgattgtcctcactatagttcatcctatagtgcggcgggcctgactcgctactgccctctaatgttctgggagagaagctgttgggtctttcctacctaatctggtagaaatgttagaacagaggctaatttggggaaataaatctctcaatttttttgagttgctttgtgtgtgtgcgcgcgcgcatgtgtgtgtgtaaggggcagggtctctaagaaagaaagaaaaggaggcgagaggaggaaagaacctgtttcagtttcacaggctctggcaaggtgactgaggaagcgccaagccccttagcctctttgggctctggttacctcatcagtaacattagaaggttttatacatgatttatccttttttattcagctcttatagtctataaatctccagtaagttgtggaaataaactgtcttttaaaaatctttaaaaaaccattttccggccgggcgcggtggctcacgcctgtaatcccagcactttgggaggccgaggcaggtggatcacgaggtcaggagatcgagaccatcccggctaaaacggtgaaaccccgtctctactaaaatacaaaacattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaacaaaacaaacaaacaaaaaaaaaaacaaaaaaaaaa

SEQ ID NO: 11316 - DNA, 2979 bp, Homo sapiens
tttcagaggaccttatcatgtccttcactgtatccatggcaatcgggctggtacttggaggatttatttgggctgtgttcatttgtctgtctcgaagaagaagagccagtgctcccatctcacagtggagttcaagcaggagatctaggtcttcttacacccacggcctcaacagaactggattttaccgccacagtggctgtgaacgtcgaagcaacctcagcctggccagtctcaccttccagcgacaagcttccctggaacaagcaaattcctttccaagaaaatcaagtttcagagcttctactttccatccctttctgcaatgtccaccacttcctgtggaaactgagagtcagctggtgactctcccttcttccaatatctctcccaccatcagcacttcccacagtctgagccgtcctgactactggtccagtaacagtcttcgagtgggcctttcaacaccgcccccacctgcctatgagtccatcatcaaggcattcccagattcctgagtagggtggcttttggtttttgtttctttcttgtcttgtcttttattgaaaggaaatcaaaaataggctaaacagaattttgagggcatggcccaaataactcatgagttccaagttgaaacatggttgtgcaagttggacattacaatgtaaaacacattttcttcaaacacgttttcccttttgtttcaaaaaatgtaatattttcccccaagcgttttatatttatgtattttgtattcaatgtgaggcttattaaaaatagtgattctaatgtaagaatcagctaagatgcattatatatattttaattaaaattaaaacttcagatatttgtggattacaatcctcatttacttccaatgtgactaaaaagagaaaaaaaatcactgtgtcactttaaagaaaaatcttctaagggatttggattttactttctttagaatgacaagtgaatcatattgacattttacaatcttagatttttctttttttttcttttgagacagggtcttgatccgtcgcccaggcgggagttgcagtagcatgatcaggactcactgcagcctctatctcccaggctcaagtaatcctcccatcttagtgccccaagtagctgggactacaggggtgcactaccacaccgggttgaatttttttttaattttagtagagatgaagtgtcactatgttaccaaggctggtctcaaactcctaaactcagatgatcctcctgcctcggcctcccaaagtgctggaattagcctggccaatcttggatttttaatggaatatgtgggcacaaaatgacagaacataggacattctaaagttccttgatttgatcattataagaagtgtgggactcaagcacaggaaactgaactcttttggtgtcattggatgtttcatttttgacactaattttttctggacaaactctttatgtgtttttcccaagaatagttatctacttcctggaggcaaaatccttggatttactaacatgatgatttaccttttcttcaccgttgtcgttacattgttagaaaagcaacaggaaaaaatccaattcatttgacctaaaaacaagcctcaagtttaaaaccaagctcacgtttttcttaagggaaaaattttctttcttaaacttacatctagcaacttggaaagcactttctctggggatcttcttttgtaactttgcagacaaataagtatgagtcactggggagagagtttgttattgaaatagatgttgcccatgaagaattctccttcctggattgactcttaatcatcaggcatcattcctggtttgcttctctacgaatctcaattccaacttctctgcagagtctgtacagtgattaagccatgccagatggtctttggtgcacacagttatttaagaatccacttccacaggtggctgcccttgtaaggaagaatgcatccctaaatgtggccaccagagagttccagtgggcagatgtctgtggctgcccttctcatttaaggacatgagttcactggagtattactcaaaaagtctgtggttcatttccagtattgtgaatatttagtttatgtggccgtttctttgtttctttgaacagtgggattttcagtgaaaaagtaccctctttttcatttcctattgcagtggtcacagctaatagtgtctgaacatggttcaagaataagagattccatgtagcattttctttattattttcatttcccttatattatccatcattccttaaggacaattattcttaataatgcttatagaaaatgttctctaattaaacatgccaaaaggaaaaagtaagagaaagagggagcaagaagaaaatggaagaaaaagggaaaaaagctaaccggataaccaatttgttataagttggttttcaacaaagaaatttagcagccaagtaaggtttcaagggaatattaacttggtatcagggctacttttttttttttttttttacttgcatgtcatccttaatgtctaacatgcattaacagcacagagtatggtttttatcaagaatttgtgttgggagtaaaaactgctttatagctcccaaattaggaagagaagagcagaaatcctctggggcatttaaccatctggcagaattgttgctgcacccttatcccagttataagacagtcaaaatgactatggcctaaatattgcgagtgtatgaaatgtgaaattaaagcaaaaactggagactttgaatgtatttatttaattagaaatgctaagcggatcgtgaaataaaaatacatttatgcgacgcggtatccaaaatccatttatgaaataatgccaacactgaacttaaaagcttggacctataacatctctaatcgacattcgctgtgtagggcacattggacgcgcgatggtgctatggaaccctttcttatttaaatgtatcgc

SEQ ID NO: 11317 - DNA, 2983 bp, Homo sapiens
tttcagaggaccttatcatgtccttcactgtatccatggcaatcgggctggtacttggaggatttatttgggctgtgttcatttgtctgtctcgaagaagaagagccagtgctcccatctcacagtggagttcaagcaggagatctaggtcttcttacacccacggcctcaacagaactggattttaccgccacagtggctgtgaacgtcgaagcaacctcagcctggccagtctcaccttccagcgacaagcttccctggaacaagcaaattcctttccaagaaaatcaagtttcagagcttctactttccatccctttctgcaatgtccaccacttcctgtggaaactgagagtcagctggtgactctcccttcttccaatatctctcccaccatcagcacttcccacagtctgagccgtcctgactactggtccagtaacagtcttcgagtgggcctttcaacaccgcccccacctgcctatgagtccatcatcaaggcattcccagattcctgagtagggtggcttttggtttttgtttctttcttgtcttgtcttttattgaaaggaaatcaaaaataggctaaacagaattttgagggcatggcccaaataactcatgagttccaagttgaaacatggttgtgcaagttggacattacaatgtaaaacacattttcttcaaacacgttttcccttttgtttcaaaaaatgtaatattttcccccaagcgttttatatttatgtattttgtattcaatgtgaggcttattaaaaatagtgattctaatgtaagaatcagctaagatgcattatatatattttaattaaaattaaaacttcagatatttgtggattacaatcctcatttacttccaatgtgactaaaaagagaaaaaaaatcactgtgtcactttaaagaaaaatcttctaagggatttggattttactttctttagaatgacaagtgaatcatattgacattttacaatcttagatttttctttttttttcttttgagacagggtcttgatccgtcgcccaggcgggagttgcagtagcatgatcaggactcactgcagcctctatctcccaggctcaagtaatcctcccatcttagtgccccaagtagctgggactacaggggtgcactaccacaccgggttgaatttttttttaattttagtagagatgaagtgtcactatgttaccaaggctggtctcaaactcctaaactcagatgatcctcctgcctcggcctcccaaagtgctggaattagcctggccaatcttggatttttaatggaatatgtgggcacaaaatgacagaacataggacattctaaagttccttgatttgatcattataagaagtgtgggactcaagcacaggaaactgaactcttttggtgtcattggatgtttcatttttgacactaattttttctggacaaactctttatgtgtttttcccaagaatagttatctacttcctggaggcaaaatccttggatttactaacatgatgatttaccttttcttcaccgttgtcgttacattgttagaaaagcaacaggaaaaaatccaattcatttgacctaaaaacaagcctcaagtttaaaaccaagctcacgtttttcttaagggaaaaattttctttcttaaacttacatctagcaacttggaaagcactttctctggggatcttcttttgtaactttgcagacaaataagtatgagtcactggggagagagtttgttattgaaatagatgttgcccatgaagaattctccttcctggattgactcttaatcatcaggcatcattcctggtttgcttctctacgaatctcaattccaacttctctgcagagtctgtacagtgattaagccatgccagatggtctttggtgcacacagttatttaagaatccacttccacaggtggctgcccttgtaaggaagaatgcatccctaaatgtggccaccagagagttccagtgggcagatgtctgtggctgcccttctcatttaaggacatgagttcactggagtattactcaaaaagtctgtggttcatttccagtattgtgaatatttagtttatgtggccgtttctttgtttctttgaacagtgggattttcagtgaaaaagtaccctctttttcatttcctattgcagtggtcacagctaatagtgtctgaacatggttcaagaataagagattccatgtagcattttctttattattttcatttcccttatattatccatcattccttaaggacaattattcttaataatgcttatagaaaatgttctctaattaaacatgccaaaaggaaaaagtaagagaaagagggagcaagaagaaaatggaagaaaaagggaaaaaagctaaccggataaccaatttgttataagttggttttcaacaaagaaatttagcagccaagtaaggtttcaagggaatattaacttggtatcagggctacttttttttttttttttttacttgcatgtcatccttaatgtctaacatgaaaaatcagcaaagagtatggtttttatcaagaatttgtgttgggagtaaaaactgctttatagctcccaaattaggaagagaagagcagaaatcctctggggcatttaaccatctggcagaattgttgctgcacccttatcccagttataagacagtcaaaatgactatttcctaaatattgtgagtgtatgaaatgtgaaattaaagcaaaaactggagacttttaatgtatttctttaatttgaaatgttttgtggattgtgaaataaaaataaatttatgtcaagttttattcaaaattcatttatgaaataatgccaacactgttctaaaaagcaaggagtcaagaaattataaaattcagattaaatcaggaaaacacattagatggaaaattatactatagaatttgagcttattaaaatttattgcata

SEQ ID NO: 11318 - DNA, 207 bp, Homo sapiens
ggccgggcgcggtggctcacgcctgtaatcccagcactttgggaggccgaggcgggcagatcacctgaggtcaggagtttgagaccagcctgaccaacatggagaaaccctgtctctactaaaaatacaaaattagccaggccgtggtggcacatgcctgtaatcccagctactcaggaggctgaggtaggagaatcgcttgaacct

SEQ ID NO: 11319 - DNA, 216 bp, Homo sapiens
ctgcccccatgcagtggtagtcaccgttctgtcccccgcgggtgctggtgagaaaggtaaaagggcggttccagagcctgagggcctgtgagtgcagtttacataactgccgaaacttaaggaagcgtctaaataaaaagaaacatgttaacccaaaatggtttatttgtttttttttttttttgggttccagagctcatgccaacatgcaaaaaa

SEQ ID NO: 11320 - DNA, 518 bp, Homo sapiens
atgatttttaaacagatttggcacaggagtgcctttctgggtttagggaagtggtggacaaggcaggagagaaccacattcatcttctcctcttgtgtttgtcttctgtctttcaataacgtccatgaactgtgaggttagtgtcttggctgagagataagtatggcttggcattgattcttctgttgttacctcaagctgttttctagtccccaagaacagcactctcagtgggtgtggaagtgggcgggacatgaagcaatggttttacattgcattgcctggctacagcttggcatttctttcctttttctttttctttgcgtcattgccattggtgccactaattttgcttcccctctcttttataacttgtttcttcgggagttgcctagagtctctgcattatatcttatttggtattgaggcagtgtgttcttggccaataacctaggagatgatatctgttcatcttacaggtttagtgctggaggaattcattaaaaataataataaaa

SEQ ID NO: 11321 - DNA, 3598 bp, Homo sapiens
atggggcggccctggccagaagcggaggaggtggcacccgggaccgagctggggtcttggaggaagagagggtgaggggaatacagtactgggggtgagagaagggttggacagaagagggtcgggtatctgggcatgcgcagggccgcaggactcttggtggggtagcgagggggacggtcccacgactgctccgaagggccgggactcccagtgggggcgggacccccggagtgcccgcctgcggactcccaagcctggagcctggggagagggtgggcacctccgttcccgcacacccgtccatggtgtgtgcgccgagcgtccaggagccacggcggtgtcttccttgcgcgtcttttacacgtgtgggggtaggctgctcctcggggctgagccgtggccagggttatggagaggcccgcctctccccagatggcgtcgtcgagccctgactccccatgttcctgcgactgctttgtctccgtgcccccggcctcagccatcccggctgtgatctttgccaagaactcggaccgaccccgggacgaggtgcaggaggtggtgtttgtccccgcaggcactcacactcctgggagccggctccaggtgggttagactttatggggtgctgggaggtgtggcagatctctgcattcttttaagaccttcttccctgctccccacacctgggaggctgccagaagtagtggaagagcatgagctttaggtctaccaacctggacctgagctcattatgtagcctcagtctacctcagtttcctcttctgtaaaatgggaatgagaccttcctcaaagggatctataaggtaattggcagagtgccacactcgaggggccgcccctctatgagtggacgcttcctttctcctccctcacctccagtgcacctacattgaagtggaacaggtgtcgaagacgcacgctgtgattctgagccgtccttcttggctatggggggctgagatgggcgccaacgagcatggtgtctgcattggcaacgaggctgtgtggacgaaggagccagttggggagggggaagccctgctgggcatggacctactcaggtgcagaccctgcccttcctcatctgcctgacacaccagaaatctaggggctgagttttgacctgggcccatccatccctcccccagcctggttcacaggggcctcctcctctctgcagactttgcccttgtgccttcgtgaagaaggctgcagcagcagccacctttgggcctctcctggcccagaaatagagcagtggttatttatttattttcagttgaaatcttacatagagtcccaatttataaaaccagtaatagtggatggagcagctctgggtggagagaggttaggggctcaggacacttctctctctgaaactgtgtttcaggccttttcatggaaccctcaaagcatagcacatggaaccagagcattgaaagccactggcataattgcatttgatacgatcagtgccagcagatttgctgtgtgacttgggcctatcaccaaacctctccgggcctcttctgtcccctggagcttctgccaccagccattgatccctctgtcacccttctgtcccttggccctctcttttgccaggctggctttggaacggagcagctctgcccaggaggccttgcatgtgatcacagggttactggagcactatgggcaggggggcaactgcctggaggatgctgcgccattctcctaccatagcaccttcctgctggctgaccgcactgaggcgtgggtgctggagacagctgggaggctctgggctgcacagaggatccagggtgaggtgttccctttctcccagctttgggaagtgggagagatggtaggggcagggaggggcccgatccaggtgcaagcctgtcaggacatccagggagatgggagatgagcccacttgggaattctcctccccttcacttggttaagtcttccgtgtgctacagcctgttgcttcctctgggaagccttcctggacttccctgggtggtcaggtttcctgcttatatgcaagcaggtacttctttttcatcgcattcaacacagttgcatgcttacatttatctctgtgattattttgtctgcctcccccaccaaaacgtaggctccatgagggtaggtagttctcttctccaccatgttctcagcacctcgcccagtgcctggcatagaatagatgctcaatggtaaatgaaccactccccgatctcctccacagagggggcccgcaacatctccaaccagctgagcattggcacggacatctcggcccaacacccggagctgcggactcatgcccaggccaagggctggtgggatgggcagggtgcctttgactttgctcagatcttctccctgacccagcagcctgtgcgcatggaggctgccaaggcccgcttccaggcagggcgggagctgctgcggcaacggcaaggttagtgaacggtggagggggctgggggccaggagggccacagcagtgccagccactctcccctcccacagcttccccctctactccttggcagggggcatcacggcagaggtgatgatgggcatcctcagagacaaggagagtggtatctgtatggactcgggaggctttcgcaccacggccagcatggtgtctgtcctgccccaggatcccacgcagccctgcgtgcactttcttaccgccacgccagacccatccaggtgggaagaatgagggtggggaaggctggggagaagagaggatctgatatatctccgtgcttccatctgtgcccctctaggtctgtgttcaaacctttcatcttcgggatgggggtggcccaggccccccaggtgctgtcccccacttttggagcacaagaccctgttcggaccctgccccgattccagactcaggtagatcgtcggcataccctctaccgtggacaccaggcagccctggggctgatggagagagatcaggtatcccccagggagtaggggctaccttgaggggatgatagacctcccccactcccagtgggactctggaaatatgaaggaactagggagtggaagagatttcagagctggggagaggagttcctcccttcaaagccagcaactgcctttggggaatgtcggggggtatctcctttctcctgcttgtgtgaggtggtacacagtccccccttcacctggcgggaagcctgtcccggacagactcatctcagctttcccttggggcaggatcgggggcagcagctccagcagaaacagcaggatctggagcaggaaggcctcgaggccacacaggggctgctggccggcgagtgggccccacccctctgggagctgggcagcctcttccaggccttcgtgaagagggagagccaggcttatgcgtaagcttcatagcttctgctggcctggggtggacccaggacccctggggcctgggtgccctgagtggtggtaaagtggagcaatcccttcacgctccttggccatgttctgagcggccagcttggcctttgccttaataaatgtgctttattttctcttcagtgaa

SEQ ID NO: 11322 - DNA, 5689 bp, Homo sapiens
tttagaatcaggtggctcactgagctctgtattttgtttcctggagctttcactggtttcttcccctgagataccccaagtgacatgaaaagcatactcagggcctagagacactttactggggatgggcttctgtcacaggtcagaggtctgagaagaggggcaggccccactcctctccactagtagagaaaggttgacagagaatcatttcttgcttctcttggccgtagttttggttgtgctgggggcctcagccacagaggccttgggggctgtggctgctcgtgcccccttccttccccagaaagagctttggtggcccctgggaatcagactgcatggtttcttggtgggagaggaggcctggggtgaggagacggcctcagggactgtctcctccccttgcgcaggagtggcagaagggctgctgtccccagccatgggcaccccaggtagcaggggcaggtcggtgagggtgggctgcatctccatcctcagcaggtgctctgtcagggccgtctgttgccggtgctccctgtgcctgctcagctcctgctccagctccttgaggaagcctgggaggggccgggggtggagggtacagggtgggtggagccctgggctcagcaggagggtccctgggctcagggaagtctctggctggccccttgtcccttgtgggaaggagcctgaggctggggcccaggactgacacctggctctggcccagatgttgatctgaacttggggctcccctccccggacgccactgccaccttagcttccctcatgtcccacagggcagaggtgggctctggggaggctgaaaaccttggaaagcagggtcacctcgttctgagcagaatgggccactcagctctgggaactcctcatcgcttgaggcttcatcctcctcatccgaaatccagcgctccaccacaggctgcccgtccaggtccaggagaagtggcagggcttctgtcaccagctcgctgcagagcagaaggagcagaggttacccaggagggcaccctggcgtggaggatgcaaagacacgcaccacagcactcacacccggaggggtggtggctcatgagctaggtaggaggtgggggagaaggtgtcatggacaggaccccaggtttgcaggctgagaggggtctgggctgagttagcaggtagagctcagccatgacctttcttcccaccctccactccttaccggtagccatcctggttggtgcagctgtttccagacaggttgaggatgagaaggctctgggggaactcatctgcacacagcaaagagagaggaaatggggttctcacttgatcttagccaaaagaccatgaagcgatgggaatggggttctcatacccactttctagtccaaagccagtacctctaggcacaaccccttgaactccctgaggatgaaatgtggacctgcaggggcatggctaatagaagcatgggcagatgggtgcagaggggagggcaggccccacaggggatgtgtttggtgagccagggcgagtgggttcctacccagcttcaatgtttctatcaggttctcagaaaggtccagaaactggaggcatgggaggtcgaggaggttttccacctgcctgatttggtttcctgccagagacaggaagctgtaggggaaggaaggggtacagaggcagagctgaatcatggaacagctggaagaaaagaggagggcacctgacaccggggcccctgggctaggcagctgatgaccagtggggacacatggccttctggggtgagggagtagatctaggcttgctggtccttgactgacaaggacccaggcttggagaaatctgaaccagttctttgggatatggctaggttcccccaacccctcttcccctgcctgagccctggcaccacataccgcaaggaggggatgcaagccaggttctcaatttgctggatcttattctgcaagaagaaaccgaagtggggaaaccaagctgagatcagatgcgtcaggggccctttacggggacaaagccccaagaccatgtctactctgcagctggagatctggcactttgggaatgatcaccccactccttgaacaggttgccactaccttaagaaagatgattttctttccccatgtggatggttaagggtgtaaacctggggtatctaaacctgactacgtatactcttctgattccacaaccaaagagtgacctgggaatcagaaaaggaaactaagaagccaccaggaaaacggaaagggccttggtggtggcttgcatacacagagagaacaatgagcatacaggaacttgacggttaaagtttctatggggaaagttgaagcgagctgggaatactcaaccaggggaaggctgaagatcaaccaaccaccaccaccaccaccaaacagccttcaagtaggatctgaatgatgtacaggaatcttcatagtttcctcttcttcaaaacaggaaatgggctggagctatttaacgtgaaagatttagagtagatgccaaaaagaacttctagatcaagagaagtgcctaaagaacagtggaaggagcacaggtcatgttcaggatctattttgagggaattagtttttcaattcaggaccctatgtcattcgtctgggaatggtttaaatgaaggtctgcctgcctgaacaccagggaatgggcaggatgacctggttggctcctttcagatgagacagattaggtccacaggggtcaaggggaggggaagggtggagaaagaagttaccccttgcagatagagactgtgaagattctggaggccttctaagttcctgatagtagtaatcccctcccggtccaggcggacagtctgcagttcatcaagagtgtgaaacctgggaaaagagtcagtaagggtggtgttagagcaccactcatgtggtctcttagcagggaggatgggagacggaggagggaaggggtttcaaggaggggtagttggctgagtcattttaatcagatgtgagaaacatcttgacatcttgaggtggtgtctagatcatgaaaccggcttgacttgcagactcgtatctctattgttagcactgggaagggtgagagagaggagtaagggccctctgggaaattgggggatggcagcttatggtttctggagagattcagaggcaagagaaaccttcctctggccagcttggatggtggaggcaggggtgggacagagatgagacactgcagaaagatccttcctcaccttccttttgagtcgttcatggagaaaaaagcacttgttccatccacccattcattcattccacaacattgctgagtgcctactagagacaaatgacagagtctctgcccaccactaataaagaagcagggcaggctgaccatggtggcttaccctgtactcccagcactttgggaggccgaggcaggaggatcgctcgagcccaggaggtcgaggctgcagtgtgccatgattatgccactgcacttcagcctgggtgacagagcaagaccctatgtcataaaaaaaaaaaaaaaagaggctgggcgaggtggctcactgtaatcccagcactttgggaggtcgaggtgggtggattgcctgaggtcaggagttcaagaccagcctggctaacatggtgaaaccccatctctactaaaaatacaaaaaaaattagccgggtgtggtggcgcacacctgtagtcccagctactcgggaggctgaggctggagaatcgcttcaactcaggaggcagacgttgcagtgagccgagatcacaccattgcactccagcctgcgcaacagagtgagactccgtctcaaaaaaaaaaaaaaaaaataggaagaaggccaaacatctatgacaagtggataacagaggcaagtacaggggaaaggaagaaggaggaggaagaagggaaagaaggaggaagaggaagaagaaagaaagaaagaaagaataaggccaaacatccctgacaagtggataacagaagcaagtacaggggacaaagggagtacataggctgtgcactaaattcacagtaggaggaatcagggaatgcttcctagaggaggtgacagatgagtaggcattagccatgaaggtggggggatatggggagaaggcatttcaagcagaaggaatagtacatgctaatacagcccttccgaaactccaatatgcccatgcagattctaattcagtagatcgggtggaggggctgagatgctccacttctaacaagccccctgtgatgccaatgctgctgtcctacccctgcaccccctcccatccacacatactctgagtagtaaggtactaaggtgtgagtacacagtgtgggaaattgtacacttgtggagagtggccagaaataaggctgaaaagcagaagtcaactcatgcttaggcattgggatttatttgggaggaagtttctatcagtgaatgcctgattagatttgttatttaaaaggatcactttggctactcaggaggctgaagtgggaggattgtttgaggagttcaagaccagtctggccaacagagcaagaccccatctctaaaaaagtaattaaaaatactttactttttgtttgttttagaaatagggtctcaccctgttgcccaggctggcatgcaatggcatgatcatagcttactgcagccacaggtacctgggttcaagtgatcctcctgtctcagccacctaggactacaggtgtgcaccaccatgctcagctagtttatttttattttttagagataggattctgtctctattgcccaggctggtctcaaactcctgggctcaagtgatcctcctgcctcagcctcccaaagtggtgggtgtgtaggagagaggtgaacacggccttatctaagacagttgagtgaggatggtgaaaaagaaatggaattattttgaagaagggaaaatcagctgggcattaccactgattgaatgtgtggagtaaggagagaaacaaagatcagttgacaaatcagtacacgtcagggacctggtcatcctgagtgtttcagccttctagcaccccttttctcccccatgcactcacatcttctctgacagttccccatcttcagggaaagtcaagttccgcttagtgataagggcttcagtgatgcagacgcccccttcctctggaccctgggctgacttccctgtgaaaagatgagtccaactgtgacacttcctcactcttggaggccttaccccgctgttttccaactgctctacccaccgtcccacctccctactcacctccagacatgatctaaaataaaaggctgctggtctgaggcgggagaggaacgaaaagagaggtcttggcggcccctaaggatggcagaactcaggatggcaggaggagagagaaactcagagacttaggagaggaggaaagggggttgattcagagaaaattgctggggtgaggtcgaagaaaacagtaaattgatgtgaagggtctggagtttgaggggtgtggaggggctttgctggcagcaagctggggtgttgtgggcaggaatggttgagaaaggagcagttcctaggaagccggagtcgttgctaagagactggacgccgagtggggaggtaaaggcgggctccgttggcccgg

SEQ ID NO: 11323 - DNA, 3008 bp, Homo sapiens
ggtgcacaagcttctcatcgtggtggagctgttgctgggggagatccctgaccggctgcagttccgccagccctccctcaagcgctcactcatgccctatttccttctgactcaaggtaaggctggcttccccaccccagagcccactaggcccccttcagtggggcctcttacatgcctgtgcctatttgcatcatccaatctactcctgttctgcctgcagctgtcaggacaggaaacctagccaagttcaaccaggtcctggatcagtttggggagaagtttcaagcagatgggacctacaccctaattatccggctgcggcacaacgtgattaagacaggtgtggatcaggatctgaggggctgttggaggagcagaagccaggccagggcaaacctagtgggtatccttgggcaagtgaagggtctgtgtccactctgcccaccccatcgctccttcctctcccaggtgtacgcatgatcagcctctcctattcccgaatctccttggctgacatcgcccagaagctgcagttggatagccccgaagatgcagagttcattgttgccaaggtggggctggttcaggaaccacagtgaccaggttgtcactttcctgccaatctcaggaggcaggagtgggaggagtttggccaaggaggggaataggtaaagcaatggcatagtcatttcagggcgtgcccgtcatttgcagtgaagccaagaagttgccagagagagcatggatgtgcatgtgagtgtgtgagtgtaggtgtgtgcacatgttgagtttatgatagtgcctgtgagtgtgagaatataaggagggcagaggaatgggatggaacaagatgttctctgacttagaagatgggcgtgctgggccaggcgcagtggctcatgcctgtaatcccagcactttgggaggctgacatgggcagatcacctgaggtcaggagtttgagacaagcctggccaacttggcgaaaccccatctctactgaaaatacaaaaattagccaggcctggtggcaggttcctgtaatcccagctacttgggaggctgaggcaggagaatcgcttgaacccgggaggtaaaggttgcagtgagctgagatcgcaccaccgcactctcctgcctgggtgacagagcgagactccatctcaaaaaaaaaaaaaaagaagaagctgggtgtgctggtgaactttcctctttgggggcctgcaggccaaccgggatggtgtcattgaggccagcatcaaccacgagaagggctatgtccaatccaaggagatgattgacatctattccacccgagagccccagctagccttccaccagcgcatctccttctgcctagatatccacaacatgtctgtcaaggtgagaagcccgtggctgcagagtcacgcctggcagcagcacacccctccctccacactcatggattcctcagagaagactggcttaatttgtggcccacgtcccagccaatctctgtaaaatcactgagctgcagcacagggggcccagaatggggaggggacttggccatagttccatagccagttgccctctcctattgcgtttaagggatgatgtggtcaccagggaggaccaggcagggattcagagggcggggttctacatttggttccaaatttgaggcatttaacttctcaaagctctgtttctccatctctgaagctgatagggaggtgttacctgtcttgcttgcttcacagggttggtaagattaaaagaagtccctgtattgaggcacttagcgaagtctaaattgtaaaaaagatggcgctggtatctagctccacaaaagggtgagcccttatcctcagttaagcactgagtttggcgctgttactatttgcttgccatgtttttttctggtctcctccgaggaaactaggatattgctgccttgcttaaaatctggctaagccctactccacgtgacatgcaaggccctttgtgacctggtcccttaggtcaagcctcccctcccactcctgccccaccacccagcagccagcccactgggtgcaggccaggcccctcccacatggaatcctccaccgggaaggcctctccccgttgccacatccactgtgttcctccttttcctcctccctgcccagtcaagagagttggtcgtttattcctcttttttcagcatttcccacagggcactgtaataattcctttgatgcctagccccccactagactaactggagaggggcccgccgcttcctgcctggtgtctagctcacagaggggacgcagggagtgcaggttgcgtgagtgcctcacctgcttccttccctcgctcatctcctctctttgctgtgccccaggccatgaggtttcctcccaaatcgtacaacaaggacttggagtctgcagaggtaagctctctgctttctgggtgagaccgaaaggtcaaacttccacacagaaggggagtcgggcgagtgtctggaagggctgagctgctctgaagctttggcctcacttgcctctctccccaggaacggcgtgagcgagaacagcaggacttggagtttgccaaggagatggcagaagatgatgatgacagcttcccttgagctggggggctggggaggggtagggggaatggggacaggctctttcccccttgggggtcccctgcccagggcactgtccccattttcccacacacagctcatatgctgcattcgtgcagggggtgggggtgctgggagccagccaccctgacctcccccagggctcctccccagccggtgacttactgtacagcaggcaggagggtgggcaggcaacctccccgggcagggtcctggccagcagtgtgggagcaggaggggaaggatagttctgtgtactcctttagggagtgggggactagaactgggatgtcttggcttgtatgttttttgaagcttcgattatgatttttaaacaataaaaagttctccacagtgc

SEQ ID NO: 11324 - DNA, 282 bp, Homo sapiens
gaggtagacaggctaggtattgttattgttatttggtagttttagagatgaggaactaaggacccagttgctcagtgtttcctagctagtgaatagagactagacaccaagtgttctacgtgcagactttatactgctcagcctggcacacaaaatggcaatggcatagtccccagactgcggtcccaactgtctctttcctaacagctccccaggcacccacacttttctgcctctttttcaatctgtacccttgaccctcctcctttttctgctttgtca

SEQ ID NO: 11325 - DNA, 776 bp, Homo sapiens
  misc_feature (709)..(709): n equals a,t,g, or c
  misc_feature (738)..(738): n equals a,t,g, or c
tacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgactgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgccaaaggaagagtatgagtattcaacatttccgtgtcgcccttattccctttattgcggcattgagcctgtctgtttttgctcacccagaaacgctggtgaaagtaaaagatgctgaagatcagttgggtgcacgagtggngtacatcgaactggatctcaacagcggtnagatcctcgagaggtttcgcccccgaagaacgtttttc

SEQ ID NO: 11326 - DNA, 878 bp, Homo sapiens
  misc_feature (741)..(741): n equals a,t,g, or c
gaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaaacgctgtgaaaagtaaagatgctgaagatcagttgggtgcacgagtgggttacatcgaactggatctcaacagcggtaaaaaccttgagagttttcgnccccgagaacgtttttcaatgatgagcacttttaaagttctgctatgtggcgcggtattaatccctatttacgcccgggcagaagcactcggtcgccggatacactattctagaatgacttggttgagtactaacca

SEQ ID NO: 11327 - DNA, 150 bp, Homo sapiens
cgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcgg

SEQ ID NO: 11328 - DNA, 25211 bp, Homo sapiens
  misc_feature (15723)..(15724): n equals a,t,g, or c
gagccaggcagtgagactggctcgggcgggccgggacgcgtcgttgcagcagcggctcccagctcccagccaggattccgcgcgccccttcacgcgccctgctcctgaacttcagctcctgcacagtcctccccaccgcaaggctcaaggcgccgccggcgtggaccgcgcacggcctctaggtctcctcgccaggacagcaacctctcccctggccctcatgggcaccgtcagctccaggcggtcctggtggccgctgccactgctgctgctgctgctgctgctcctgggtcccgcgggcgcccgtgcgcaggaggacgaggacggcgactacgaggagctggtgctagccttgcgttccgaggaggacggcctggccgaagcacccgagcacggaaccacagccaccttccaccgctgcgccaaggtgcgggtgtaggggtgggaggccggggcgaacccgcagccgggacggtgcggtgctgtttcctctcgggcctcagtttccccccatgtaagagaggaagtggagtgcaggtcgccgagggctcttcgcttggcacgatcttgaggactgcaggcaaggcggcgggggaggacgggtagtggggagcacggtggagagcggggacggccggctctttggggacttgctggggcgtgcggctgcgctattcagtgggaaggttcgcggggttgggagacccggaggccgaggaagggcgagcagagcactgccaggatatcctgcccagatttcccagtttctgcctcgccgcggcacaggtgggtgaaggagtgaatgcctggaacgtactgggaactgcaccaggcacagagaaagcgggcttgccattatagtgggttccgatttggtttggaaaacatgggcagcggagggtggagggcctggagagaaggccctacccgagacaggggcggggtgggaaggacggcagatgctgggagcacgaggcaatttctttatgacacagaactcatgctctagtattccatctgtttcagccgaagaaaagaaccagctgaaggggcaggggagaaggggcggaggtattctcgaggcccattggcgtcctttaggactcaggcagggaagggcccttggtgctctggagccggaggtggtgcgcctggtactgggaccccggagctgagcccggcgcctcagcccacctggctgtctgccgaccgtgtgcggggcgagtttgctcaacaactctgccagcttctggccctcaggctgtgggaagcttcttcccggggcgagaccactagctttttctaagtattaccagcccaggacttggctgaggttctgtgtcccccagcttggagtcagatgtggggttgaatcttggcttcctctcactagctgtggtgcttgacaagtcacttatccttgagcctccattgcctaatctttaaaagggaggtgacaatcgtccctacggctcagtggcagcagatggggagatgaagggaaagttctgttgaccatgagtgaacttacaatgcaagccccggggggatcacttgcagttttgtccctgtctgcagtgtgacctgttggtgacattgtctttgctccaaaccacagctcctggggcagaggggaaaattctgccactcacagctgcctgcccacgcttctgtctgagtgtgctgggtggcaggatggcaagtccttactcagctcagtatagccctcttccttgttccctgagcctttgactttctcgagggatgttgtggggttgtggccaggataagaaagggcatttcaagttaccactgctccaaaacaactgttctggaaatagtgagtaccccatcctgagaggtgagtaagcagaggctgtatgaccacctgaaccaagcccttgaggatgtttcttctctggtggaagtttggaacaggagcctcctcaagttcatttattcattcattcaatggttattttgtgggaatcgaatttagaatgaaaatattttttggcaagcagaaaataatttttagaccaatccttttcttttagtcatgagaaactgaggcccagagagaggaggtcaccccaggtgcattagaactgggtttccagaactgacactccactgcacagagtactctcccaattcattcaatttttatttagcggaaggcattttcagatgggtctttgaagcattagtaggagttcagcgatgatggtgtcatgagaattttattctaggattaggaggtaccatgaacaaagatacagagctgggaaaaccagaggtggaagataaggagcacatgtccacagttctttttcttttttttttgagatggagtttcgctcttgttgcccaggctggagtgcaatggtgcagtctcagctcactgcaacatctgtctcccgggttcaagtggttctcctgcctcagcctcccaagaagctgggattacaggtacctgccaccacgcccggctaatttttgtatttttagtagagaaggggtttcaccacgttggccaggctagtcgcaaactcctgacctcctcagtggatccgaggaggtgatcctcccgcctcagcctcccaaagtgctcgaattacaggtgtgagccaccacgcctggcctccacagttctttatccaccgtctgaaatgtaaaatgttacgaaaaccaaaagttttttttgtgatttatttgatggtagcacctgacgtgaactgacatgagattatttttaatttagttgtgtgaatatgcatattcatatattttgctgcatagattacagtatgcagctccagattcttccaagcagactctgattgcccattactgcctttctaaaatccaaacaagttctgaggttcaaaaccgatttggccctaaggctttgggtaaagggggtggactctgttctactctgactggagtccaagatgcatatatacagagatatgggtgatggggctgcaaggtaggttgaggtaggggccaaggaggagcatggagtttggacttgattcatgaggctgtggggagccagtgaaggttcttaagcaggtatgtctgcctgagagcagttggagcagacaagagctaaaaaccaaacaaatcaccatagatagtggctgctataatttgtttgtcccctccaaatctcatgtggaaatttggtcctcagtgttggaagtggggcctaatgggaggtgtttgggtcatgggggaggaacccctgtgaaaggcttggtgccgtccttgtgataatgagtaagttctcccgctatgatttcccttgaaggctgattattaaaaagagcttggcacctccctctcttctctcttgcttcttctcttgccatgtgattgatctctgcacatgtaggctccccttcaccttctgccatcagtgaaagcagcttaaggccctcaccagaagcagatgctggtgccatgcttcctggagagcttgcagaatcatgagctgaataaatcccttttccttgtaaattactcaccttcaggtattcctttatatagcaacacaaaaggactaagacagtggccttgacttttctctctctttaagaagtgttgcctttgctcacttagtcatcccttctgcctgcatttgtagagcatctggatgggagatttatataaccgtcactcttgactttcccagcaggcctatgtcataggtactgtggtctctacaatacagcagaggtatctgaggctccgagaggttgagtgacttgctcatggctgcacaaccagtaaatattggagctggaattcaggtccacggtttcctggctccaaagcccatgattttttccctcaatttattctgactggggcatgggggagggggtggcctttgggcagggccaccaggagcgaccaggcccgtagagagctgggtgcaggtacagaggaaaacctgttgtcgagtgtggcccgtagttcccatttttgcctgaatggcacatttgaaagtgttatataaccatgtgaataataatagttggcctatatgagttttttaatttgctttttggtccgcatttggtaacttctttatcatctactatactctgttgtgtctcttttgttgtaatttgtaagtaggggtgagataaagtacacctagggtttgctgggtttcttccatgtcatcatgttcctccttgcatggggccaggatccgtggaggttgcctggcacctacgtggtggtgctgaaggaggagacccacctctcgcagtcagagcgcactgcccgccgcctgcaggcccaggctgcccgccggggatacctcaccaagatcctgcatgtcttccatggccttcttcctggcttcctggtgaagatgagtggcgacctgctggagctggtgagccaccctttttgggaatggcacttcctgatagggctgggccactgcatatacactggggactgtgcttagtaggcccattgctgaaaatcagaaggggacagcaagtatgtattgagcacttatcgggtaccaagcacagtaactactggctttctgtatagaattccctttaagcctggccatgccccagtggtacgtctatcttcatttgaaagacgaggagactgaagttcagaggggaccacacagacagctaggggtagagcctggatcaaacccattggtctgcctgccagccattcttgtgccaatgcatctgctgcctacggaaacctgtagggacaaggccctgggatgttcagtggagcctgagtcattttataaaaaagcatgactctagggtccaaaattcctttgaagctgttgctatccagagtgaagtcccttctttaggacagggtggccctcctccctcctggatgtcacatcttcggtggaggggcagaaaggggactgggtattctcctcaccctggccctagtgcttcaaatcttaaaaaaacgtttttatttgtgcttctgcaccaccttctagcccacctcgtttcctggcctctaacttgatgagagcgtgtgtcattttcacactgattctccacatggcaggcggtgcttcttagcctcctgcagacagtgaggccccacggtcttgtccaaggtcacacagcgtgtaatgggcagggtcagagtctggagtctggacctgggtctcctagctgcactgcactgctgccccatgggttaatcagctcagcataccgtggctgaacagctacctcataccaaggcctgtggcgccatgacagggattgacagggtccctgccttggaaacccgtagtctaagtagaggagactgacaagtcaatgccttccatcagtctgctcaacacacgtttaccaagtgcctactgtgtgctgcagaggcgaagatgacacagctcaggcctttcccttgagcttacagttcaggaggagagactgaccagtgactgccagtacagttgactatgggacaatgtgctcagccttggggagagacgaagaaggtacccgtatagcaccagatgacaggcacgagccccacaggccagggcagctgctcagaggagagtaggccaagcagaaggcaaacagaaggctgcaggcatttgccatcgagagctggacttcaaactgggcatcataccagcctgggttcgagtcctgcccagccccttattggctgtctaaccctgagcaaatcccttcacctctctgagcctcattcctctatctgtaaaccagttataataattggaacattcatttaaggactaaatgaggtcgtgaagcattcagcagatgctaggtacggaaactcgctgaagtgggggcaggttaagaagcctctggggatacgaaggcatccagggactagttgtggcaggaggctgttaccacttaggtctgaagggtaaggagagggaatagctttccctctgcccagttggagccggtggcatggaggagaggctgcctgtggggaatcacccgagggttcaccgctgccatgcgcagggagtcaggaggtagggagggagtggggcagatgcacaccatttttttttttttttgagactctgttgcccagactggagtgcagtggtgccatatctgcacctctgcctcccgggttcaagctcactgcaacctctgcctcccgggttcaagcgattctcctgcctcagcctcccgagtagctgggactacaggtgtgtgccaccatgcctggctaatttttgtatttttaatagagatggggtttcaccatgttggccaggctggtctcgaactctcgacctcaggtgatcccccacctcggcctcccaaagtgctgggattacaggcgtgagtcaccgctcccagctgctgatgcactcttgtccttctaactcctgctagtgcctcccattggctgagcccaactggaagctttgcaagggagctggtgctgcagtttgcactgagcaggctggagaaggctggagaatagactaggggacaaaccgaattgccagtgctgttatgtcatgatttaggcatggagtccagggcctgagcttcactccatgtccatcctgcccagagccttggcacagcctggctcccagacaagatgtcaagttcagaatccttcctaaaaggaatcctctatgccagaccgtgttgcagggatatgggggtgctgggctcccagcctgatcaaggagcgagaaaactcaggctcctagtctgtcctccggggcactagcagggacaaggtgggaggctgctgggctgggatgtggggacaggtttgatcaggtaaggccaggctgtggctgtgtttgctgctgtccaaatggcttaagcagagtcccccggcctctctggcttctgcaggccttgaagttgccccatgtcgactacatcgaggaggactcctctgtctttgcccagagcatcccgtggaacctggagcggattacccctccacggtaccgggcggatgaataccagccccccggtaagacccccatctgtgccctgccccaccccatctgagctgaatccatttgctctgccctggcctggcctccctgctggtggtttccacttctcggggggctttgggactcagcacctccactgacccctttttttctgtcccatccccatcccctgcagcccccactgcctgccttcctgttgccccacaaatgcaaaagtcttgccttaaatgatcctcttttcctccttttctcttgttttccttttctcaccatttggaatggcccagcaggctgcacttaccttggaaggagggttcatctgatggtgactctacctagggcccccaggcctctataactcccagtgccctgcagactggaccagatcctttaatgggatagacacaaccctgtctgggatgcctctgcctaccttcctgttttgctgctccacctgcctccagctccgtttggcttcctggggctccctgcctgggccactttgtgtcttccctctaggcctttctttccactgttccctctgcctggtgtggcctggctatggaagggagggagcaggagcggccatggaaaacggtctgcattctagcagggacttgcaggtggcaattcagtcggggaagactctagatgcacctggcctgaggagagaatgaagggttctagttggactgtgttaagtttgaggtgcccatggtgtgaggtctggagctcagcgcagagatgatgcaatgtggtgggtccatgcaacatggtgccaggacgcagagcttggggtgaactcagctttcaccccttaccggttctcgtgggatcttgggaagccactttcttctatgagctttgtcgttcttgtctgtaaaatgggcacataaccctgtccctgtccttctcacaggttgctgtgagactccaatgagttgaaggatgtgcagatgcttttggaagtgaaaagttggggggctactgtgtgactttgcatacacccaaactgtgtgaccttgcatatgtctgagttgctgccattgcaacagatcagagctggtgggctgggtgtggagaaagggtttgtgtgggggacatcctctggcaagggtggcagcagcagaagtgaggggcctggtcggtcatgtgtgctgacccggcctgggcagcctgtggccagggagaggacagctcctctgtaggaagagcgtgttcctttccaaccaggtgagacctcttcagtggagccctggagccccctgtactccacatcagtgcctcagggacctcccggagcaggctaatatcagagaccaagagggacactggcagaggatcacagagaccccagtccaggcagggactgagaagatcttgccccctaagttagtttcctagcactgctgtgacaaaataccaccccctcggttggaacaagttgattctctgcagtcctggaggccagaagcctgaatcagtgtcggcaggaccactttctcccggggggctccagggagaagcttctcttgcctcttccgtgtcccaacagcggcagcacaccaatcccagcctctgtcttcacacagccttctctgtgtctctctcctcttcattgtctcataaggacacttgtcattggatttagggcccactggatcctccaggatgatctcatgtggggaaccttaaccacatctgcaaggaccctttttccaaataaggtcacagccacagtttgtgggggttaggatgtgagtgtatctctttggcagccactgttccctcctctcccttgggccagaagcagacgtggggccctttcttccccataggatgcccatggattgccccccttcccgcttcccccgagcgtctgtgggaggtggcaggaatggcaggcaggtgtgtggaaccccttctggagtcatatcaagggcttggctggaggaagtcctcctggagctgttgggctggcatggggcaggctggctgggcccagcagcagcttcttcattcatggggaggccacaagcatgggccctagagctggctgccgccctcaaacccagaccctgcactcttaactgtgtgaccttgcatacgtcactcaccctctctgatcttcaggttcctctgcaaaagggaggtaatgataaccctcactctggggggctgtttggagggttaaatcagttattgctgtagcatgcatttctctgtcaggtattgagtgaggtgctgtgattttagccctgcatttttcttttcttaccattcaataataacgttttgagcaccctctgtgcgccaggcaccatattaggtgctggggatacaaatgtgaatgaaatgaatgtggtctctttccccaacagtgtatccagaagattaatccattccttaaacaaatgctacttgacacagattagttctggataggctgagagctctgaaggagtgcaggcagctgcgagcctgtgtatccagcagaaggatcaggaaaggattcctggaggaagcgctgttctagccaagacctacgggggcattattaaccaggcaaaggggacggtgtccaagcagtggaatgaacgtggattgaagctgtgaggcaggagggagtgtggcctgtgcagaagggaccgaggctggtgagaccagcagggcctgggtggcctccaggtcagatgtgaaaggaagaacttggccacagtctgagcttctcaggcgtatggcagggctgcctggtgagagggaatgagctccctgctctggaggtatgcaagcaggactgggctctcacctgccagaggccacagagctttccagaggctggaagaggccactccaaggcctctttgcccctgagagtggtggctcttcttgaggccaccttgccacgctgtcacagggaactagcagcccctgcctcacccgggggtttggaagatagagggaggcctaggaagggccctgtgtctcatccgagctgggcccctttccagcctctcactggaaggaagcccaaggatgttcctgtgggggcttttaccaggcccacctgccctctgctggccatgcttgcagcctcctgaccctgtcccagcaggacagtgggctggtgtgagcgggcaggaaccgcctgcacttagaaggtgtggggctgcctccccgagcttccatctgccgctggggccacaccccaggcccagggatgggaccccatagtggtcacatcatcttgcagcagaacccaggtacagctcctggagcagatggtggtcccaagcacgggtgggaccagaaaggactctcacctgggctaactcagctgcagcctcagttccctcctcacacacgaggaacatggactggaagcctgcccagcaggccttctgctcgatgtgcgttgtgtggcttacgtccagggagggaagcagcctctgtgctgtcttctagataagcctgtattccccgggctgtctgccaatgtatccagttgtcccgtcagcctggaagctctgagggaaaaccttgggctgcttcctgagcacctgtatcccctgcagccagcccggggcctctgctaggagcagactgagcatggcttatgggcctggcaccatctggcctctgcccaccttgctggccttgtcttgtgtctgccccttcgacattccatagcccagctcaatatctagtggttcctctagggtggcgagcactgtttggtctccagatgtcttcaggtcggagctcacagcgctctcagccaccccttcccagtgtagcaccgggcacatggtagatgcctattgatgagtgaaagctcctaacacactcagagagcaaggactccgcctcatcccacagcctgggaggagaggcagactgccaaggacctgctcagcatgctacagaagaaaccaaagtgcccacgggactgatcagtggagcttcctgccgagactggaggccttagggcagggtagacagtgtgtgtgcaggctggggactcacagttcggactgtgcccagacctactagcatagtgggtgggtgggaggatgcgggactgggggccgaccttgcctgaaattcatgtgggatctcagagcagccactgaattgctctgtagggggctaaatagtggcccccacagatacacacacccagacagagcctgtgagccagaccttatttggagaaaaggtctttgtagatgtaattaagcatctcaagatggcatcatctggattatgcggtgggctgtaagtcctgtgatgtgtctttatgagagaaaggcagagggagatttgacacacacaggaggggccacgtggagacagaggtggagattggagaaatgtggccacaagccagggaacaccagcagccaccagaagccggaagacgtgaggcagggttcttcccagagccttcgctgctgagtctgggaatttgttaccgaagccataagaagtgggtacacgccctgagcctcccacacttgctcacctgtcctgagatgagaatctctactctgcagcatatttggaggatcactgcgggggccacagaggtgctgttcagatggcacttcagaagactcaggagaccctggggcaggagcagtttgactgacagcccagagggctgccctctgattccacctgaggccctgcttttcctggctgcaggggttccagggccaggccatttccgctggcgcaggactctgctagcagcaacctgcctgaagtcttcctttggcctggctgagagtttctgagacctgcgctggagcggaggtgcttccttccttgcttcctttcttcctctctcccttctccatccagcaggctggacctgcctggcatctgtgagctctccctactttctcctataccctaacctttgtcctgcatgggcgactcccccagtgagtctcttgcagcttttaccccagtgcctgcttcttggagaatccaaactgatccagttagggatgataaagtgtagggtaggtgctcggtgactgttttctctgaggttgtgactcgtgtgaggcagaagcagtccccgtgagccctcctggtatcttgtggagtggagaacgcttggacctggagccaggaggcccagacatacatcctgtccgagctgcagcttcctgtctctaaaatgagccggccagcgcaggtggccagacatcactgttattctcctttgagtctttaaatcttgttgtctttcttgcagactcggtgagctgtgaaaggctataataggggctttattttacactttgatactattttttgaacattcatattattgttagatattgatattcatatgaaggagcaggatgacttgggtccttcttggcagtagcattgccagctgatggccttggacagttacctgccctctctaggcctccctttccttgtctatgaaatacattatagaataggatgtagtgtgtgaggattttttggaggttaaacgagtgaatatatttaaggcgctttcaccagtggctgggatgtgctctgtagtttgtgtgtgttaactataaggttgactttatgctcattccctcctctcccacaaatgtcgccttggaaagacggaggcagcctggtggaggtgtatctcctagacaccagcatacagagtgaccaccgggaaatcgagggcagggtcatggtcaccgacttcgagaatgtgcccgaggaggacgggacccgcttccacagacaggtaagcacggccgtctgatgggagggctgcctctgcccatatccccatcctggaggtgggtggggactgccaccccagagcattgcagctgtactcctgggttgcacccccccagctgtcactgtcccctccctgccatcagttgtgggaagggcgttcatccatccagccacctgctgatttgttatagggtggagggggggtctttctcatgtggtccttgtgttcgtcgagcaggccagcaagtgtgacagtcatggcacccacctggcaggggtggtcagcggccgggatgccggcgtggccaagggtgccagcatgcgcagcctgcgcgtgctcaactgccaagggaagggcacggttagcggcaccctcataggtaagtgatggccccagacgctggtctctctccatctggacctggcctgggaggtggcttgggatgggcccagggagagctaatgtctcctaaccaagaatgctgtggcagcctctgccgcagagccagagaaccagagtgccaaggctggcagggttcccagtggccacgagtgcagatgaagaaacccaggccccaagagggtcatgcaggtagcccagggagttcagccttgaccctgggtcaatgacctttccacagttccacactgctccccttttaaaatccggtgatgtctttatgtcttttgttatgttatcttcaatgtggagggactcgaggtgatctaagcaaactttttctatcttctgcttgcatacctctgagaccaggggactcactcacttgcatgactgggccctgcaggtcacactggccaggcagatgtggtggaggaactggcagaggactttttctagactgtgactacatttagtccacccagcggcccccctatgaagtccagttgagaactaggactctgggggcctgtggacagagaagagggagggttctctcccttactgacttccttctgtggccagacattgagcaaggcctctgtacagcatgtcctggggctggccttgccgtagctgctaaatagttgacgaaaccagtccagagaggggaggtgactgccagggtcacacagctcaagctggggaactcgctgggaaaactgtcagctctgggcagcagcttgacttccattgtaagccccagcccccagggtcaaacactggctctggtgctggcagaggcagcccactagcctgtttcaaaggctgagaaggcccaggagtctgccctgtgctccaccagttctgccctgagactttcctacagagtacaggttttgatgttcagttttaaaggcaagaatcaataaccttctgccccatcaggtgaccccttgtgcctgtcccacccctttattgactgacctcggctcagtcaggtcagttcctgaaggtcagtgtgtggaggggaggctgttctttcccagaaaggccttccccaggcctggtgctctggcctctggaggacttcctggagaagtcccttctttggggtcccagtcagtgtatgggaagcccttattgcatgacctggcacggggtaggggctcaacagtcactattgccttccttgccactgccatttcctcctctgtaagcaggtgattgtgtgtccagtctgagcacagagataagcacacagcaggtgcttaataactagcagctgtaggctgggcgcggtggctcatgcctgtaatcccagcactttgggaggccgaggtgggcagatcacctgaggtcaggagttcgagaccagcctgttcaacatggtgaaaccccgtctctactaaaaatacaaaaattagccaggcatggtggtgggtgtctgtatcccagctacttgggaggctaaggcaggagaatcgcttgaacccaggaggtggaggttgcagtgagctgagatcgtgccactgcaatccagcctgagtgatagagcgagattccatctcaaaaataaataagtaaataactagcagctgtaaatgtggctgttgttcttcacctccacactcagtgccactccactccctccctccgtggtgtgaggggcctcactagctgtctcctaggaggagcatggctgtgagattccagctccatccttgaccacggctcctggagacatcttagaggccaggatccagaaggctcccacaccccatttgacaggggagaagctgtcagttccaggtccccttgcacatcagggccagagctgcgttaggcctccagtctccaggccactgggccagagctcacaggctggcagagggttagaactgttactggtggctgggtgcactggctcacgcctgtaatcttagcactttgggagggcaaggcgggaggatcatgaggtcaggacatcgagaccatccttgctaacacggtgaagccccgtctctactaaaactacaaaaaattagccgggcgtggtggcaggcgcctgtagtcccagctactcaggaggctgaggcaggagaatggcgtgaacccgggaggcggagcttgcagtgagccgagattgcgccactgcactccagcctgggcaatagagcgagactccgtctggaaagaaaaaaaaaaaaagagctgttactgttgacagtagcatgaggtagaccatggcctgcaccaaaagggggagtggagtgccactgaggccagaaggaaccacaccctcaagggtggggagttatggtagggggggtcctaggcatggagtcttttattctttagacaatcctgggagcagctgtccctgttcacagagggcggggccacacagctggtgagtgggcagccaagactctgttcaagtttgtgtgggtccaacacttgcggccacggtggaggggcatctgagccaggcctcagagagtggcggggggaagttgggtggggaagtgtnngccttctcattcctctgaggctcatcctcttggtgcctctctttcatggaaagggataataaggttattgtgaggatcccctgagttcatatattcagacgcttagacagagccaggcacagagaagggcccggggttggctagtttgattgctggtgtaattgctaatatcttccagtttgtattggtcaaggttctgcagagaagcagaaccagtaggaggtatatattaagagtttcaagctcatgtgaccgtgcgggctggcaagtctgaaatccgcagggcaggccatgcaggctggcaattcctgcagaatttgatgttgcaatactgagtcctaaggcagtcctggggcagaattccttcttccctgggaggcctcagtctgttctcttaaggccttcaactgattaaatgaggcctgcccaagttatagagagtaacctgccttactccgtcttctgatttaaatgttagtcacatctaaaaaatattttcgcagcagcatttccactggcttttgaccaaacatcaggccacaaagttgatccccaaaattaaccatcactctgtgcctgtaagggaggggctgggaaaggggagcaggtctccccaaggggtgaccttggctttgttcctcccaggcctggagtttattcggaaaagccagctggtccagcctgtggggccactggtggtgctgctgcccctggcgggtgggtacagccgcgtcctcaacgccgcctgccagcgcctggcgagggctggggtcgtgctggtcaccgctgccggcaacttccgggacgatgcctgcctctactccccagcctcagctcccgaggtaggtgctggggctgctgccccaaggcgcgggtagggggcggagggcggagggagggcgggcgggcaggcgggcttcttgtggcacgtgggcttcttgtggcacgttcctggaggccgaacccttctggctttggaaggagtcgtcagagacccccgccatgcgggaggctggggaggaaggggctcgaaacctccatcatcgcagagtctgaatagcagtggccccgccatgcgcccacgtagcggcgcctacgtagccacgcccccacgccccgtcctggccactctccctcctgaaggtcttctggtacccgccccctccccatctccatccccaggccctgcgtcctctgcccaatactctttgggcctccctgttgtccagctctctccgcggctccatgactgacaacttgagcaaggctaatgtgaatgggagcggttgagggctcagacctctcacccgaggaacatccacagagtgtgccgcatgcccggtgcagtgtggctgcggggacacagacacggagcctcggccctgaggagctggggggcagtgaccgtccctcctctgacccaccactcctccagtgtcaggacactgcgggtatctaggggaaggaatcttgttccacttcaagtctggaacttcaagtctgtgtgtgtgcgtgcgcgcgcgcgcgttgggggtgggggttgcagagcagatgcgtacctgacagcggtaacctaggtccccccggcctatcaaggcttccctggcggccgaatttaaaggcatcaagcaaacaaagcccaacacatctctgccttgtcctctcagtttccccccgtggcacttagaaccacttgatacaccgaatagtttccggtctatctcccccactaggatgtaaactccacaggggcattgggaatgctgcctggctatggtagggacagaggggagcaccagggcggggcaggggtgccagagttctgcctgggcagtcagattttccttaggaggggacatttgagtgggacccaaacaggtgtatagcagttgtccagcccagctggcaaggcctgagtctgcctctgcaacccctctcttgggctcctttctctgccacccacctcctcacctttccaggtcatcacagttggggccaccaatgcccaggaccagccggtgaccctggggactttggggaccaactttggccgctgtgtggacctctttgccccaggggaggacatcattggtgcctccagcgactgcagcacctgctttgtgtcacagagtgggacatcacaggctgctgcccacgtggctggtaagtcaccaccccactgcctcggccaccgtgatgctaacagcccctttggcagtcagggtctgtgccgggacctccagtgccaggctctgtgcagggggaccagagatgaagtaggcctgatggtgccttcaaggacactcagtctgatgagggaggcgagtgcacagagggaacacgaggtcagggctgtattagagggagcccagaggaggcacctgcccagcccgagggtcagagaaggcatcttggaggagggacatttgatcgggagcttgatggatgaataggagtttacctggccgataagacagcaactaccaaggcttagaggtgtgagaggaggctgtcttacctcactgagtaaggactgcaggcggcttaccttcgagaagagagcttagtgtctgtgtgcacgtgtgtttgtgtgtatgtgtgtgcgtgtgtgcactggcaggagtcccctgctggggcaggagggccgggccatcaccatctttcaccattcacccctgcaccaggcattgcagccatgatgctgtctgccgagccggagctcaccctggccgagttgaggcagagactgatccacttctctgccaaagatgtcatcaatgaggcctggttccctgaggaccagcgggtactgacccccaacctggtggccgccctgccccccagcacccatggggcaggtaagcaggatggcagggtgggcaagtccaggctggggcttgggaggtctgtgtgaccttgacagtctctcccttctcccttgtctgtgtaaggaggatgatgccaccttaaataggattaaatgagaatggggctctgaaagggctgtgcaatattttcataacgtgtttttatagagacagttgagtatgttctttaagccctcctctctcctaccatgaactaaagatttttgtggaggtcccctcactcccagcaccccctcctcatcccaggccctttttgcaggttggcagctgttttgcaggactgtgtggtcagcacactcggggcctacacggatggccacagccatcgcccgctgcgccccagatgaggagctgctgagctgctccagtttctccaggagtgggaagcggcggggcgagcgcatggaggtgactgtacccctccttcgtgtgtgtgtgtgtgtgtgtgtgtgtgtgtgtgcgtgtcagtgctgggccctcagggacccccagcaagcccctccatcctccagactccagctcttctgtaagcttacagggctggccagaccaggagtggggcactcctcacttcacgcggctgggggctgctggagagagccacagcgggaagggtttcctagaggctgcaggacagtgctggatggattttcaatgctcacctgggtgtgagcatgcggcagggccgcgtgagggtcagcgatctgctactctggactcagccatctctaggcccctctcactcaggtgctccatggttctgggagctgagaaatctcaaaccagcaaaaaagtggaattgatgttgatgctacaggatagtgcacagatgccatctggttgcagcattttggtggaagggcagtgcccagctaggagagtgaggaggggcaggcatttctggcttgaggagatagggtcttaatgctcgtgtgagaggcagagtgggtggagtggagctggctggatccttgctttggcctcctggatttctctctatctccattttgaaaccactctgtgtttggaagaacttttgagtattcagagctgcccactggcagaacagtcttccttgggcaggagtgagctccttgtccccagaaggctgggtctggctggcccctggcagggacactgatgagggtgcttgagttgatcctgtctagtccctttctgtgttttcaaagcccattctaaagcagattcccatttccgtctttgactctaaggcccaagggggcaagctggtctgccgggcccacaacgcttttgggggtgagggtgtctacgccattgccaggtgctgcctgctaccccaggccaactgcagcgtccacacagctccaccagctgaggccagcatggggacccgtgtccactgccaccaacagggccacgtcctcacaggtaggaggctgggcttgccctggggtgaggaggggtctctttctccttatgcacccactgcccacgaggcttggtcctcacaagtgtgatccatgagactcaagcctgacttgcagttccatactctggttctgccacttccatgccctttgagcctgggcaggtgaccttacttctcctcatctcagcttcctcctccataagagggaaaaaggtattacctgcctcattgtgttgcaaggagatgggcagcatctagggcactggcctggagtatcgcaggtgctttgcctaaggtggtgcagtccaggagaggcagctccagagagaggcccccggctggggctgaaaggagggcagacctcggtttgaatttcaccctgccgctcgatagctgtgtgacttgggcaaattacttaacatctctgtatgaggaaatgatgagtgctaagcacttagcttagtgccgggacaatataaattctagctatcgttactattgttttcatcacccgttgctttaaaatccagtctctggtataggcaactattgacgggctaccctgtgtcgaaaacatgcccaggcaggtagcaggaagtcacagatggggacctcttggggcatcaagggatggtgccctgaggctgagctgttctggttgggtggagcatgagaggtctgggaagacagtgggactccagcctggaataagaggctcagagttgattctcgtctgagcacgtccaggggaaccactgagggtttgggaacaggagagtgagggtgagaacctggttctgggcacagcaggctggcatgtaggatggatgttcaggaaagatgagcatagtcaggtggctggtgcccttgtccaggggagaggctccgtcaggttcaggggtcctggcttggagggaagtccgccatgctctaatcacgctcccctttggaagtgctcggccgatgagctcacaggcacatgtcagtttgaagtcatggaatctgactccatgaagcgcacctcaaagagcaccattttgcagctaagggaactgcaggctggacatgctgagtggctgccccgagcccttgcagctaggacatagagaatgctagtaaccacaaccctaccatgttcagagcacatgccaggctccatgctggggcttcgcacgtgtcatcttcacagtgtccctgtgagtaggtgtggtttctctttccatcttacaaatgagtaaacagagcctcagtgtagctaagtaaccactattttaggtttcttagccaatgggtgtgtctgactcctaagcccatggagggcattctgaggtggttcagacagaccccagcttacccttgaacttctgcctgctggctgcatagggaggggctggggggagtttgagcatctcaggccatagagcccctgcctcactgtctccatctctgggtggaaagatggtgttttccctgagaaactaaggctcagagaggttgaatggctctcccaaggtcacacagctggtcagctgcagagttgagaacacaggagtcctggtgctcaggccagcatctctttttttctttgagttgtttctaggtttcctagctcttgcctcagaccttaaagagagagggtctgatggggatgggcactggagacggagcatcccagcatttcacatctgagctggctttcctctgccccaggctgcagctcccactgggaggtggaggaccttggcacccacaagccgcctgtgctgaggccacgaggtcagcccaaccagtgcgtgggccacagggaggccagcatccacgcttcctgctgccatgccccaggtctggaatgcaaagtcaaggagcatggaatcccggcccctcaggagcaggtgaagaggcccgtgaggccgggtgggtggggtgctgcgtgtctctcctgcacagcttttctgtgtcagtttgtgccaccaccataccgccatacatcagggtggcggtttgccaggtagatgctgtgggcagcttccgccattgtgtggacagcatgtatatgtgtctctgtgtggctgggtctgtttttgcttttgtccagatcagtaaggtttgctacctgggtaccccactccacttggagtagagtgtgcataaatatggcataaagaaatgcaatatgcatgcatttattgattgatctatttttttctgagatggggtcttgctgtgttgcccaggctggtctcaaattcctgggctcaagcaatcctctggtctcagcctccccaagtgttgggattataggcatgagccgctgcacctggcctctctgatctatttaacaaacctgctgggagggtctcagggtcaggagcagcactgggctctgaggacacagagctcactcagccgtgacccagagggggtgcctgagctgcatgctgaaggttgttagcatgaccagcaaggcaagaaaaggccctgccgagattagcaaggcatgtgccaagccctggaatgtgacagccgggccttctagaaacctgagtgtataactctccttaaaagccagtaggagctccttaaaaggcagccctaaggagtccactcttaaatgaactcagagtcagttttaaaatgcaagtctgtgttgattctggtctggatggtgcattcctcgagagcaaaagacagtcttggtcttggatccacttgccctgggtacactgagggctgctaggttccaggtgctcttcctggcactggggagggatacaggcccaagagacatgctgttctccctcctggagcatctattttagtggaggaagacagaaaacaaaccattaatatagagtactgaaaagatgcgatggagaaaactatagcaaggaagggaatggggtgggagagaggtcaggagaggtctcgctgacaaggtggacgaaacaggccatgaggcagagaacatgttccaggcaaagcaaaggcccccaggtggggatgtgcagggagtaccaggaaaccagagaggtgggaatagttatgagatggggggtgcctcagaggggacagggccaagtcaggtgagacctgagggccacagtcagcagtgagctggggccatgcaggggtctggcctcagaggagtgtggtctggcctggatctgaacctctcactgtggcctagctgctgagctgagaagagatgacaaggaccttgggcagaagcagggagactggagggaggcggtggagggtccaggcgttggggcggggctcaggctggagtctgaagggagcctgcaggcctggtgggtggatgtgggtgggagagggggaggatggcaccaaggctcgggcccctggacagatggagttgccattaagtgggatggggcaggctatggggccatcagtttcagagggatgagtttggcactggcatggtaggcatctgtctatctccacggccctcaaaccaggcatgaagcaggagctcacgtgtttggtcagccatggtgcagaaccgcctgggtgggaggtgcggggtgggagatacacggttgtgtcccaaatgggctctgagccagcgagggccgtctgcactttggcctcacagaaggatgtcggagggagaaatgaagtgtgggtgggggtcccgggccacgctagacatgtgctttcttttcctcgggctctggcaggtgaccgtggcctgcgaggagggctggaccctgactggctgcagtgccctccctgggacctcccacgtcctgggggcctacgccgtagacaacacgtgtgtagtcaggagccgggacgtcagcactacaggcagcaccagcgaagaggccgtgacagccgttgccatctgctgccggagccggcacctggcgcaggcctcccaggagctccagtgacagccccatcccaggatgggtgtctggggagggtcaagggctggggctgagctttaaaatggttccgacttgtccctctctcagccctccatggcctggcacgaggggatggggatgcttccgcctttccggggctgctggcctggcccttgagtggggcagcctccttgcctggaactcactcactctgggtgcctcctccccaggtggaggtgccaggaagctccctccctcactgtggggcatttcaccattcaaacaggtcgagctgtgctcgggtgctgccagctgctcccaatgtgccgatgtccgtgggcagaatgacttttattgagctcttgttccgtgccaggcattcaatcctcaggtctccaccaaggaggcaggattcttcccatggataggggagggggcggtaggggctgcagggacaaacatcgttggggggtgagtgtgaaaggtgctgatggccctcatctccagctaactgtggagaagcccctgggggctccctgattaatggaggcttagctttctggatggcatctagccagaggctggagacaggtgtgcccctggtggtcacaggctgtgccttggtttcctgagccacctttactctgctctatgccaggctgtgctagcaacacccaaaggtggcctgcggggagccatcacctaggactgactcggcagtgtgcagtggtgcatgcactgtctcagccaacccgctccactacccggcagggtacacattcgcacccctacttcacagaggaagaaacctggaaccagagggggcgtgcctgccaagctcacacagcaggaactgagccagaaacgcagattgggctggctctgaagccaagcctcttcttacttcacccggctgggctcctcatttttacgggtaacagtgaggctgggaaggggaacacagaccaggaagctcggtgagtgatggcagaacgatgcctgcaggcatggaactttttccgttatcacccaggcctgattcactggcctggcggagatgcttctaaggcatggtcgggggagagggccaacaactgtccctccttgagcaccagccccacccaagcaagcagacatttatcttttgggtctgtcctctctgttgcctttttacagccaacttttctagacctgttttgcttttgtaacttgaagatatttattctgggttttgtagcatttttattaatatggtgactttttaaaataaaaacaaacaaacgttgtcctaa

SEQ ID NO: 11329 - DNA, 6501 bp, Homo sapiens
tctgtttttgaaaaatttattttatactcttagaagctaagaactttgccacacatgaaccaaatttagaattaaggttcttccctagtgtatctacttccttttgaaattttataaacaagattttatacacaagaggtagcagaggaaaattccagtctgcttgttccaagctcagaaggtaactgcacacacctcgatgttagcagggaaggtggggcaggacagggtaagtctgatgatacggcactctagttcctaaaactgactgtagttgtcagtgaccgtgtgaggactccaggagaagtcgtggtgagatgcccgctgggatgcttgttttctttcccaggatgccttcaacgggcagaatcggccatcttaagatcggcctcactaagggagcttcttgagaacacacagcattattgagttaattgtgcaattcctgctctgtttgcagaccattttgaaaggtttataaaaacatcttcatccaaaaaattggcagtaaaaatgacaactcttccaaggtaagcctgtcataactgtcactgttgtactacattaaaaaaagtcatcagcaggttcattgactgtagctgtcagcaatcaagtggttaccagcaaagtgaaaacgatggtcattgcagcaacaatataagcaacatgatctgaagcgtataatatacacggtggacgatcctgatgaacctttacagtgaggacggcaggtgctaggggtgcggaaggcgttgtttccataggaaataaggggactagaagtggcaatttcactcctgattttgggctcctgagagtgcagtcgccagcgatgatatcccagtgtggatcatcgccagcatttcaaggtcatgtcccacacaatctcttggtgaggatgtgggcggagagaaggtgagaatagggtaggggaaacagtaggacaggaagtattcacgtactcaaaaccaatggtagaacatcacatttcaaactgcaagaccattggaaccgtctgaagtttgccactcgcctctgtccgtttctctaagggtacagttctgctcttaagtgctggcccttccatcttctcagtgtgtttgacaaaggccactgccaacctccagcaagtcacagaataacaatgaagtctgacagcacagaaaccctcactgccagagaatgaaaagactgggccatggcgagagcacagtaatgagatgccatctgcctggccacatgcccacacaatgccacagcagccagacaggcacttcagggctggctgcgcctctgtgacttggcaaatctgacagtgaaaacctggcacttcctaggctccctagttctgtgcatggtgagatgaaaataaggcaggacctgtaactaaaggcaaaacagggccgaaaatgtgagcaattcaaaatacaaaatgtacaaaatatatatgaaatatgtgggtgtaaacctctcccccacaccataaaagggagctggtataaatgagtgaatggtgctatactttggaaatacgactaaatggatggttattcaattgctttatatttatttctgggaaaataaatcttaaaccttgactgacttttcagtgttaattagtcatgttgaggagaaacaaattctcaaattccttctctgcattacaataactatgaaactcacaagcagtgtgtaccaactcaaatagttaacttcatatacaaccaataccaagggtttcagtaattatgttttaagcaaaagcaaacgattgcagatcacatgatttaagactacagtttattcaatatgtctccaagcattaaaaagataattctgtgaagttaaactcagtaaaattatatcttaaagtgcttttattttgctgtttttaaaatctgtttggggaacaactcataacttctttaagtaattgatgtcaaataatgcaccctgtacttctggagaacacagcattttcaaaattgctcttttcaatctaattatatcagaaaaatatcttcaagagcttagtatttcccaatttttgatcctgatcctggtaacctttcatcaagatccaagcttatgcatagggttctcatctagacccatctgaaattctatacaaatagggagacatattaaatacaaaggtctgtgtaaattgacttaattactattttacaatgaaaaggaattttattacatctttacatcattttaaattggatattcctgtttaatattactgcaagattaaaaatttgcccccacatatctaaaagcagcttgctttttcttaaaatataaaaaccaaaggaatttcttttgtagcatcgtagagaaagcaacagctttatgctcactcttgtatgttcgtgtaacaaaaaagtctgccactggctctatttccgaaaatctccacagaaatgtgaatccacatatagaccacgctcccgggacagctgatccacatgccggagttctcccactgccaaacagctcccaaaccttctagtggcttaaaaatgctttccttgagaaatacacgatccgcccaagtcacagcagctttcccagtccaatctccaggctcttccaaagggttcgagattctgattccaagaaggtgctgagcatccagtattgtgtcttgactcctctcaggctgggcatgttcctctagggatcaacatcatcaaggtcacttctcaactcaccaatcatcatgggagattctgaaccctgcagaaaagaaaaggaagttaaagttcatacggttagagaaaaggttttctatgctgacttgtgttctgcaatttaaacatgtcttcatctggcaacttaatgcaatgtttatcaaagggtaataaaatgtgataactattacatctaatatttgacaattcatgattatgtaaaacatgtacatttctatgatctcatttagtcagtgaaacaacccagcgacttgtctaaagtcacaatgctactctgcacccatgtgagaacgcagagcagtgataaagctgggagaggcattgatggccattgtgcccgcttcacgttgggcactgtgtgagcctccctgccctgcacctgccaaatatgggctctgggtcactcctgggtctgaaggctacctctgttaccatctgtgtggcctttggcttacacacttggcgaatcgttctgaatactcaccgtgtgccatggggctgatctagttggagctggggtggggaggagcaaggacagtctctctaaagtgacaacctaagctgagtgagagttgggggtgagtaggggggccctgaggtggaaggaagagagtacatttgataaataaaattcagaaaatgggccaggcacagtcgcttatgcctgtaatcccagctacttgggaggctgaggcaaggagaatcgctggaacctgggagaaggaggtagcagtgaggtgagattgcaccactgcactccagcctgggtgacagagcaacactccatctcaaaaaaaaaaaaaaaaaaaaaaaaaaatcagaaaatgggggtggggaggtgcgcaggtgctagatcaagcaggactgtgttgaggattctggcttttctcctcatacaaagcctttgaaaggttttagtgcatgaaccagagagaagcaggggtggaggtgaggggatccttacagacgtaggcagagaggggctgatgacaggtggaggagagggacgagcaccctttcaaagggagctgtccgggatgacatgggggtgctgtgtgtgagataaggaacactgacggagggccagctttggtgggcgcagggaggaggggctgggcacatcgagtctgaggtctttaaggtatgccaagtggagaacgtcaagaacaagagagctggatgttcatgttcagaaatccaaggtgggtgcggagagaatatggagtgagggcaggaggatacaggttagagactccacaaacctttactggtggtccagaagaggcagtactaggaaggagacagagaaggaacagccagaagggtttgaggaaaactacgagagagaagtgtcaggaaagccctggaatagtgtttcaaacgggaagagcgccaggagcgctagatgctgccgagcagtcggctaagatgaggcctgaaagctgcaggccacctgtcaccccaactgctgagttggagagaagagggagttagcagggaagaggctgaagagcgagtgagagataagaaaatggggaaagttaagtttagagaattagtcgaagtttggctgcaaagaagagaaaagaaggcaggggcaacagggagaagagaggctttgacagggcagaagagaggctttgacagggcagaagagaaaccagtgtgctgagacgtcgctgggaagggtctggcagggtggagcgttctggatattgaagagttacatacacattagaacgcaaagctctgccaaggtgggcggggatgagcgctaggggctttgggtggacagaggcaaacttcccactgtcacaggagaggagacaagaacagtgcagatgcttgggaattagtggccgcaggagctctcctgtgacagcttttattttctctgcaaatgaagtaggtgatgaggtaatgtgtggagtgaccttgggctaagtcacatcactgtgctgggctgcagttacctttctgtaaaatcagggtgacagctgcctcacatagtgcttatgaggatccgaaagataacacttaaaaaaaaatgacacctactacatcagtaacattcatttaatggggcctattctgtaccaagtactgtgaagggaccacagaggagactgctgttaaggaaagttacagactattggaaagacgtaatgattaactgacacttagttcagtgtttgcacacagtgggtgttcaatacatatttattttctttttctactataatgattggtattaaagctgtttttttttctttttttaaaaatacatgtcaaaattttcttggactcccctggcaagcaggtatacttcaagagcacgggagcttttctttcaagagtccacatttccaggaaggctggtgagagcaaacgagggactttcagtaacctggcaaggcagaataaagtgaacaagctggaacgaatccccctgtgccctggcttcatcgggactacctgcaggctgatcagggtggccagccacaaacacctcgaggccttccattcacttcacactgcagcactactcagccctgtaaacacacggttagtgcatatgctgagctgagatcactagagggcagcgctggtaactctttggactcacattccagaggaagcatcttgttttccctcagctgtggaaattctttttggaaagcttaagagcaaggctgccctttgcacacaaggacatgctgaccgttatacctgctgtagatgcctgtctccgttctcattggcaggactactctccgacccattactgcttcctgattgctctttttcattcaacaaagctgtggcatacgctaacgtgtcctgcagaagattcaaacacaagacgacaaagttagggcccattcagtggcagcagcaaccgccagggaagactacctttcatctgaccttcagtgggaccggaggcctgagagtgaggccttcatcacagtcaccagaaccccctcaacccctgtccctttttgtgaccagactgcccaacctgtatgactttccttctagacaaataatctgcacaaatttgtgtaagtgtacaccaatctgttttcttttcatagaaatccaattgtttcttctgcttgttctcatcttcaactcatacctctcttctcagaggttgcagtttctgagaaacacactgaaaatcctccataagtgatttagaccacgcaaaaacaagagacaactctcacctgagctgaaatggttcgctgaaaggtttttccagttgatgtttcattagagacattactctgtggtgtccagtaatgttctgacatctgagatgaaaggtcaaaaatgccatcagaggtgacaaataagcccccatgggttcacagtttctaccattagatattgagtcttaaaagcatcccaagtagggtacaagtctacccagaccttccatcacataaagcgattcaagacctcagtcaagtattgcttcttatatcatcatccctaccttttcccctatgaagttaagacatatgtattaggacaaatttaatgcacacaagatataaactgtagcaaagaaatgtttgaaatctgaaaacactttaaggtcagtctccatattcagttccagagatttttcctgacaagatgtgctattattgattcctatgttacagctagaaaaattcaatgttcagttaccttcttctgtagccactgcacagcccagctccagtggtgggaattctccttgaagtactccttagctgcaggacac

SEQ ID NO: 11330 - DNA, 3968 bp, Homo sapiens
gcagtgaacactctttgctaaatttctgactgaatccaagatttttccttagaatagattcttaaaagtgggggccaggtgcggtggctcacacctataatcccagcaccttgggaggccgaggtggccagatcattgaggtcaggagtttgaaaccagcctggccaacatggtgaaaccccgtctctactaaaaatacaaaaattagccaggtgtgtggggcgtgcgcctgtagtcccagctacttgggaggctgaggcaggagaatcgcttgaacctgggaagcagaggttgcagtgggccgggatcacaccactgcactccagcctgggtgacagcaagactccatctaagaaaacaaaaaaaaaaagtacgattggtgcgccagagtgaacacaaaatgtaaagacttgtgtatttgtgagacccttttgaagcatgctatctccccagctacaccctcttcaggtgccccttccctgcctcctcctgcttttcacactgtggctcgtggttccaggctcaagcacggacatcagtgaggactgggagaaagactttgacttggacatgactgaagaggaggtgcagatggcactttccaaagtggatgcctccggggaggtgagtgggcctggtgggtcagagggaagcgagcctaatggtcctgggtgtgagagctctccccagccagcccagctgtcccctcaggagggtccctgctcctgtctgaggtgacaggtggtgggaaaggagctggagcttcctgctcagacccacaacattggtcatcagcaggctgcacttttcctcagttccagggtggatagagggtcaagttcttgaccttagctctgtatcaaaattgcctgagaaactgcttaagaaaacagatgtcatgctgagcgcggtggctcacacctgtaatcccaacactttgggaggccaaggtgggaggattgcttgaggcgaggagttcaagaccagcctggccaatatagtgagaccccatttctgtttttgaaaaaaaaaaaaaaaggaaaaaagaaaacagacatcaaaccctgcctgaccttctgagttgtggtcctcaggtatgaggcctgagtatatacttggccttggagacaaaagaccagtgtgatcaagggcaagggcaagttacttaacctgagcccctggttcctcatctaaaacatggaattgatcattataagacctggctataagctgtaatgaggtgatccatgtagacaccttagggctattgcctgagacatggtgaccagcactcaggagacattagtgataaaccccacaaaacccattccagttattaagctcaaggaggccttagtactgttattcttcactacctctcagaatcaaaagtggctcatttagattgagaggctggaacagtccaaagctctcccagctaataagtgacaggactgaggctgcaacccagacatctgattcatgtcagcgttagttccactgtcacataagaaccacatgagtccttccatcatgtaacttatgagcctgttagaaagaggtggacagattagagagacatgtgaagggcctcctttttcatgatgggaaactgaagccttgggggagtattttacctactcaggagtattttgcacttgtgactacctcactatacccaggacagagaaagcccatagtgccctgtcaggccacaggggcttgctggctttttgtgtctttgcagccccctttaaaacctgacgtgcagtacacgtgagcattctagaacctgctataccagggcttagccgacagcaggccaagagtaggaacaaagcaagaaaacgttccgtggggagacttgagctgggaattagggtgttggtgcccctagtgaagacctagtgggcatctgtaggccactgccacctctgcttttggccacagtgccactcaggcagtggcctccattcacccaaagactaagtaacttgcccttgattacactggtcttttgtgtccagggccaagtatctgctcaggcctcctgagttctctgcttctcagagccatggcattatctgctcagcaggaggcaagttctccttaaaggactgaggctgacttggttcctgtaggcagccatcaccttgtggtgtctggtgttggttgggggaagtgtttcctttaggtctgaggtaatcagagcatcaggcccacccctcaggcagagggcagctctgcccctcagacacattccttaagactaggggttcactctcagtgggacctcagagtatggcctggggtaggggatgggaggtggctctgctcagcaagtggaggttaggtctgggcctgactcaggagtaactatgtgtttgtgatttccattaccccctcccatttgcagctggaagatgtagagtgggaggactgggagtgagggagccagagggagcagctcccccacccatggcatctctcgcctccctcgctcgtctcagcccagccctggaagactgagaatgttcccccaaatctcctctgccaaccagagctctgggcacagattctggtggctccctgctggccctcttgggcctctgctcacacctgggaaggggctctctaaatcccggccagaaactctgacttgtgccaacaataggatgacccaagggagaggaaacctatcctcctcaccagaagagcctgtgtttttctgctgaacacccactgttcctgaggactcctgctgggaagtcccaagggatagttctagcccttctgcctgtgtagacagaagctaaaccaccagtctctctcggaggaagctgagacaacatactctgtccatacataagcaggcagggagggccatgccacctacccttggctaaacagggacagtgaacacattttggttcctatcccagtgggtaagaggcacttatctctgggaaatttgcctctcttgggactctccccctcccaggcattttccattcctggaaaggctcctttggggttcagaatccagagaccaaaccctgacccacctccttcctttcctccagcccacgctggtctgtccccatgccttcccagggcttcttcatgtcagatgcacccaagtccttagcccagctgtgccacctgcaggagttcgctcttgcgtttcttcccctccccaagaagggagggggctacttcaggcccttctgtgtgttgcctggcaggataccttgtccaaccagctacccacctcaactcccctgtagtttaggacacaaaacagctaccagcggtacagagcggtgatcaaagccgagtacttacaactctggtaagcctagcttctccgcctcagcccttctgcttctggaagggctatcctgggggtgaacttgaaactctcatcaggcttctgcaaaagctcttcttcctgaagacagacccagcctttgtgctctcaccctccactctggtaaagctgcacctctgggggaatgaggggctgcaggaatctctggagagcctggtgcttcacgatgctgctctggtgattcttgtacctaatctggtgtgctcaccaatgagtgaaagggatcgtgggtcagggacaccgagagagtgaggtcacttccacttcaaaccttcagtgagggggtgggatggagagaatgctgaatcttttttttgacgggatggggtttttctctttgtaattatttctttagtttaattaaccttttggttgtttgtgcaatattatatattttaaattataatgcatctccccagagtattttgtagctgggaaaagaaaaaaggaaaaaaagaaaaaaagattctaacagctgttagttttataattaaaaaagaaagaaaaaagaactttgtcctgaaccttttacagacttgccgttaacagcattaaagtgattcacccgaagctgaaa

SEQ ID NO: 11331 - DNA, 3968 bp, Homo sapiens
gcagtgaacactctttgctaaatttctgactgaatccaagatttttccttagaatagattcttaaaagtgggggccaggtgcggtggctcacacctataatcccagcaccttgggaggccgaggtggccagatcattgaggtcaggagtttgaaaccagcctggccaacatggtgaaaccccgtctctactaaaaatacaaaaattagccaggtgtgtggggcgtgcgcctgtagtcccagctacttgggaggctgaggcaggagaatcgcttgaacctgggaagcagaggttgcagtgggccgggatcacaccactgcactccagcctgggtgacagcaagactccatctaagaaaacaaaaaaaaaaagtacgattggtgcgccagagtgaacacaaaatgtaaagacttgtgtatttgtgagacccttttgaagcatgctatctccccagctacaccctcttcaggtgccccttccctgcctcctcctgcttttcacactgtggctcgtggttccaggctcaagcacggacatcagtgaggactgggagaaagactttgacttggacatgactgaagaggaggtgcagatggcactttccaaagtggatgcctccggggaggtgagtgggcctggtgggtcagagggaagcgagcctaatggtcctgggtgtgagagctctccccagccagcccagctgtcccctcaggagggtccctgctcctgtctgaggtgacaggtggtgggaaaggagctggagcttcctgctcagacccacaacattggtcatcagcaggctgcacttttcctcagttccagggtggatagagggtcaagttcttgaccttagctctgtatcaaaattgcctgagaaactgcttaagaaaacagatgtcatgctgagcgcggtggctcacacctgtaatcccaacactttgggaggccaaggtgggaggattgcttgaggcgaggagttcaagaccagcctggccaatatagtgagaccccatttctgtttttgaaaaaaaaaaaaaaaggaaaaaagaaaacagacatcaaaccctgcctgaccttctgagttgtggtcctcaggtatgaggcctgagtatatacttggccttggagacaaaagaccagtgtgatcaagggcaagggcaagttacttaacctgagcccctggttcctcatctaaaacatggaattgatcattataagacctggctataagctgtaatgaggtgatccatgtagacaccttagggctattgcctgagacatggtgaccagcactcaggagacattagtgataaaccccacaaaacccattccagttattaagctcaaggaggccttagtactgttattcttcactacctctcagaatcaaaagtggctcatttagattgagaggctggaacagtccaaagctctcccagctaataagtgacaggactgaggctgcaacccagacatctgattcatgtcagcgttagttccactgtcacataagaaccacatgagtccttccatcatgtaacttatgagcctgttagaaagaggtggacagattagagagacatgtgaagggcctcctttttcatgatgggaaactgaagccttgggggagtattttacctactcaggagtattttgcacttgtgactacctcactatacccaggacagagaaagcccatagtgccctgtcaggccacaggggcttgctggctttttgtgtctttgcagccccctttaaaacctgacgtgcagtacacgtgagcattctagaacctgctataccagggcttagccgacagcaggccaagagtaggaacaaagcaagaaaacgttccgtggggagacttgagctgggaattagggtgttggtgcccctagtgaagacctagtgggcatctgtaggccactgccacctctgcttttggccacagtgccactcaggcagtggcctccattcacccaaagactaagtaacttgcccttgattacactggtcttttgtgtccagggccaagtatctgctcaggcctcctgagttctctgcttctcagagccatggcattatctgctcagcaggaggcaagttctccttaaaggactgaggctgacttggttcctgtaggcagccatcaccttgtggtgtctggtgttggttgggggaagtgtttcctttaggtctgaggtaatcagagcatcaggcccacccctcaggcagagggcagctctgcccctcagacacattccttaagactaggggttcactctcagtgggacctcagagtatggcctggggtaggggatgggaggtggctctgctcagcaagtggaggttaggtctgggcctgactcaggagtaactatgtgtttgtgatttccattaccccctcccatttgcagctggaagatgtagagtgggaggactgggagtgagggagccagagggagcagctcccccacccatggcatctctcgcctccctcgctcgtctcagcccagccctggaagactgagaatgttcccccaaatctcctctgccaaccagagctctgggcacagattctggtggctccctgctggccctcttgggcctctgctcacacctgggaaggggctctctaaatcccggccagaaactctgacttgtgccaacaataggatgacccaagggagaggaaacctatcctcctcaccagaagagcctgtgtttttctgctgaacacccactgttcctgaggactcctgctgggaagtcccaagggatagttctagcccttctgcctgtgtagacagaagctaaaccaccagtctctctcggaggaagctgagacaacatactctgtccatacataagcaggcagggagggccatgccacctacccttggctaaacagggacagtgaacacattttggttcctatcccagtgggtaagaggcacttatctctgggaaatttgcctctcttgggactctccccctcccaggcattttccattcctggaaaggctcctttggggttcagaatccagagaccaaaccctgacccacctccttcctttcctccagcccacgctggtctgtccccatgccttcccagggcttcttcatgtcggatgcacccaagtccttagcccagctgtgccacctgcaggagttcgctcttgcgtttcttcccctccccaagaagggagggggctacttcaggcccttctgtgtgttgcctggcaggataccttgtccaaccagctacccacctcaactcccctgtagtttaggacacaaaacagctaccagcggtacagagcggtgatcaaagccgagtacttacaactctggtaagcctagcttctccgcctcagcccttctgcttctggaagggctatcctgggggtgaacttgaaactctcatcaggcttctgcaaaagctcttcttcctgaagacagacccagcctttgtgctctcaccctccactctggtaaagctgcacctctgggggaatgaggggctgcaggaatctctggagagcctggtgcttcacgatgctgctctggtgattcttgtacctaatctggtgtgctcaccaatgagtgaaagggatcgtgggtcagggacaccgagagagtgaggtcacttccacttcaaaccttcagtgagggggtgggatggagagaatgctgaatcttttttttgacgggatggggtttttctctttgtaattatttctttagtttaattaaccttttggttgtttgtgcaatattatatattttaaattataatgcatctccccagagtattttgtagctgggaaaagaaaaaaggaaaaaaagaaaaaaagattctaacagctgttagttttataattaaaaaagaaagaaaaaagaactttgtcctgaaccttttacagacttgccgttaacagcattaaagtgattcacccgaagctgaaa

SEQ ID NO: 11332 - DNA, 3968 bp, Homo sapiens; identical to SEQ ID NO: 11330

SEQ ID NO: 11333 - DNA, 506 bp, Homo sapiens
gccagggcaggactggcttcccacttggagccagagacagggtagggggatagcctaggtccagaggacgtaccttgtcctcatcccagattcagctttgcctttgggatgagaaagggtcagggctcgcaacaggcctctcactgggacaaggagtcgggaggccatctctgcactcccagtgcctctgctttcctttggaaaggaagttgcaacaagaatggcttcagttgctcttggtcatttttatcctctcttccccctgtttgtatatgattcttgggtctattttaattaactttagtatgaaaatcacttgtcatgccaggcgcagtggctcatgcctgtaatcccaacattttgggaggccaaggtgggtggatcactaaggtcaggagttccagaccagcctggccaacatggtgaaaccccatctctactaaaaatacagaaatagccaggcgtggtgggaggtgcctgtaatcccagctactggggaggctgag

SEQ ID NO: 11334 - DNA, 506 bp, Homo sapiens; identical to SEQ ID NO: 11333

SEQ ID NO: 11335 - DNA, 456 bp, Homo sapiens
  misc_feature (76)..(76): n equals a,t,g, or c
ggtgcctgtaatcccagctactcagggagggctgaggcaagagaatctcttgaacccaggaggccggaggttgcanggagctgaaaatcgtgccactgcactccagcctgggtgacagagcgagactctgtctcagaaaaaaaagaacaactagagcagagtgagggtgatgatgggttgctctttaaactaggatggtcagtgtaggccacatctagaaggtacgatttgagcaatggcatgaaggaggtgaaaagttggtcttgtagatatctgaggatacgagttccaggtgcagggaacagcccatgcaaaagccctaagttgggaatgcgcctggtatgtttctggaggaacaagattagtgtgggcagaatggagtgaggaagaagaggtctactgtttgggggtccgaggggaggtttttgttttctttagagacagggttttgcactg

SEQ ID NO: 11336 - DNA, 479 bp, Homo sapiens
aaaattagctggatgtggtaccaggcaggtgcctgtaatcccagctactcaggaggctgaggcaagagaatctcttgaacccaggaggcggaggttgcagggagctgagatcgtgccactgcactccagcctgggtgacagagcgagactctgtctcagaaaaaaaagaacaactagagcagagtgagggtgatgatgggttgctctttaaactaggatggtcagtgtaggccacatctagaaggtacgatttgagcaatggcatgaaggaggtgaaaagttggtcttgtagatatctgaggatacgagttccaggtgcagggaacagcccatgcaaaagccctaagttgggaatgcgcctggtatgtttctggaggaacaagattagtgtgggcagaatggagtgaggaagaagaggtctactgtttgggggtccgaggggaggtttttgttttctttagagacagggttttgcactg

SEQ ID NO: 11337 - DNA, 506 bp, Homo sapiens; identical to SEQ ID NO: 11333

SEQ ID NO: 11338 - DNA, 15090 bp, Homo sapiens; identical to SEQ ID NO: 11244

SEQ ID NO: 11339 - DNA, 15090 bp, Homo sapiens; identical to SEQ ID NO: 11245

SEQ ID NO: 11340 - DNA, 3830 bp, Homo sapiens; identical to SEQ ID NO: 11246

SEQ ID NO: 11341 - DNA, 20245 bp, Homo sapiens; identical to SEQ ID NO: 11247

SEQ ID NO: 11342 - DNA, 9796 bp, Homo sapiens; identical to SEQ ID NO: 11248

SEQ ID NO: 11343 - DNA, 3844 bp, Homo sapiens; identical to SEQ ID NO: 11249

SEQ ID NO: 11344 - DNA, 1299 bp, Homo sapiens
ttttttttttttttggcaaataaagagtaaaacaggctatttaaaacatccatttaaatgcaaattttgatatcccaagagaaaaatgttaatcatttaaatagacaggattatcgcccacccttaccacttccctcctctcccaagttttagaaaacgtagccttagcccacacaagtcaagtcagccaggagtccttacatcttaagaactcccactcagatgagagggctgaggcagatagagggggacttttccttcttttgaggaaggagatggaaaagagagaaaatagtctaacatatcctataagccaggcatggggcaatattataaatacaaacacacacacacacacacacacatgcatgcacacacacacacccacacttaatcatcacaactgtcttggaacggggaattatcatcctcatctacagacaaggaaactgaggcttagaaaggtgaagcagtttgccccactggtaggtgacccagttgggagtagaggcctccatagccctcccagtccatggtgacctgcggtcctgtccagactcacccagcatccccatgccaagcatgaacgcgtccatggtgtaaggcagtccccgggcccggcctcttgtcccaggtgggaacatgacttctttcggctgagctttcttacattctacctgttaaacagaaaggcgaacaaatgagatgcaaatgaattccacgtaaatgtcaaatgcagaacctgtctggttatgagctaagttatttttagccttgctccttacccactgtaaaaatagccatgccgagtaaatggcctgcaaaataaatacttaagaaaacacgccacttgtgcaaatcctgcttcggaaaaacctacaaggatgaaactgggttctggaggggtggcaaggacgtaagctgcagatatacacacagattgaagctcaggctgacgctcgtgcagaaagcatgacagataaggaggcagacaatggctgttggatgtgtctgtgaataataacaacaatagcaataataataatccctcaggatttttcagccctttacacatttacaaatgcccctgacattctctcaggccagtgactcttcatgccaggccatctgattcaaactcttattaaacagacagaccacttagccttagctccagttcacagatgagaaaacagagcatcagaagttttgtgttggctgggcgtgggggatcatgtttgtaatcccagcactgtgggaggtggaggcaggtgaatcagcttgagcccaggcgtttca

SEQ ID NO: 11345 - DNA, 330 bp, Homo sapiens
tttttaaaaacattttctcatttattctcacttgtttcttcttccagggataagttttagaaacatctggccaatttaaaaaaattacaataggatttctctttgaaactctgttaagcctaaaaaattcatatgaggagaattaacatcatggccatttttaatattctcctggcatctttttctatttcataaagttcctcaaaatagttttacctgcccttgttatttcctcagacaagtagatacaattctttgtcagaccacaagatgttttataaatttaaaattaagccagaagtgatttaaacagcagcaaatctgaaaata

SEQ ID NO: 11346 - DNA, 3328 bp, Homo sapiens
ttgttttgtctcaggttttttttttcttttttttttttgagagggtgtctcgctctgttgacaggctggagtacagtagcacgatctcaggccactgcaacctctaccttctgggttcaagagattctcctgcctcagcctcccaagtagctgggactataggcgcatgccaccacgcccagctaatttttgtatttttagtagagacagggtttcaccattgttggccaagctggtctcgatctctttgaccttgtgatccacccaccttggcctcccaaagtcctgggattacaggcgtgagccactgtgcccagcctggctcaggtttttcaatacagtcttgaccttggcattcagtatcctcacagcatggttctaattaactttctagctctatttcccttttcctgctccctctctctacaactagtctttctctgattgccccgccctcaacccatctaaactagaccccagggaagcaccttggtccccttcctctctcccactcaccatccaaccaatcaccagagcctgtacattctatattttcaacatcgattcaattgtctacttctttctagcctgccctctctgactgggactccttgagccagcctgatcaccccaatccatccctcacactgtgcccatctttctgaagtaggaatctgatcacaccaccctgctaaaaacactctggttctccccacggcatgtggtgcccttgtatagctggcaaagccttgcatggcacggccccagcctgtgcttcaactcaattgcccgactctctccagctctgctgagccacctaagtcacagatggtttctcctctcatctctgctctcttccatgtgccatttctgtggcttggaatgttcttccctcattctctttctggccctttcccgtcacaccttagacgtgcatcttcctctcgaaaacctctagtgaagcctcccagggccaggcagtaccctcctctggcttcttctggatacagaggaagaatctgagcatcgattctccatctcagcaggcctctgtgtgcctgctgactccgactagaccagagatccgtaaggacagggatcgagttttttttcttttaattcactgcctcaaaaatcctctgtgcattacctattcatcctcttctctcccttaacctgaaccagtgatcttactgtctccatcattgtttttttcttttcttttcttttcttttttttttttgaggtggagtctggctcttcacccaggctggagtgcagtgatgcgatctcgactcactgcaacctccatctcctgggttcaagcgattctcctgcctcagcctccccagtagctgggattacaggcatgcgctaccatccccaactaatttttgcctccataattttgccttttctagaatgtcatacaggtggaattactcagtatgctgcctttttcagattggcttctttcacttagtaatatgtttgttttttgagacagggtcttgctctgtcgcccaggctagagtgtggtggtgcgatcttagctcactgaaacctccacctcccaggttcaagtgactctcctgcctcagcctcccgagtagctgggactacaggcacatgccaccatacccggctaatttgtggatttttagtacagacggggtttcatcatgttggccagggtgttgttgaattcctgacctcaagtgatccacctgcctcagcctcccaaagtgttgcgattacaggtgtgagccactgcgccaagcctcatttagtaatatgcatttaaactttctccatgtctttaatggcttgatagctcatttatttttatcatggaatatttcattgtctggatggaccacagtttatttctccattcacctactgaaggacatctcggttgcttctaagttttggcaattatgaataaagctgctataaccatcaagtgcaggtttttgtgtggacctattatcaactaattcgggtaaatctcaaggagtgcaattgctggatcacacagtaagagtgtgtttagttttaagtggctgtgccattttgcattcccaccagcaatgaatgagagtttctgttgctccacattctcactaccattcggtgttgtcagtgttttgcattttggccattctagtaggtgtttacatggtatctagtcatttgaatgggcatatgatgtggaacatctttttttttttaattttattattattatactttaagttttagggtacatgtgcacaacgtgcaggtttgttacatatgtatacatgtgccatgttggtgtgctgcacccattaactagtcatttagcattaggtatatctcctaatgctattggaacatcttttcatgtgtttatttgccatctgtatatcttccctgatgagttggggatgcattctttccatctcagagtccccagaaactaacatagcagttggtacagagttggtgctcaacaaacatcagcttaggaactatgtcctatgtttttttgtttttttttttttttaaaaaggaatgtgagctgttcccaaaacgtatgtccttcccccatgcctctaccctgcccttccacaaactttctgatcttcagcacacactacccaaccatcaaggctgagacttcccgtggccagcagtgtctcatgctggcttcaagccccacagcactgcttttttcaacttctcttgtggtttagactgtctttagcccagcaagagaattcattgtcttatcccccattaaactgtacctacactctttgaggaaaagggtccatcttacttaaaatattttaaaaattcacatgtgataaaactgatgtgtatgtgtatgagagagagagaaagagagaacagttctatgaggcttaatgtatacatgtggctgtgcagcccactgccccatgtcaccattttcaattctgtcattacccctgggacaatgtcttgtcaatatacacttgaggctgggcggggtggttcctgcctgtaatcccacctgtaatcaggagttcaagaccagcctggccaacacagcaaaaccccgtctctactaaaaatacaaaaatttgctgggcgtggtggcacgggcctgtaatcccagctactcaggtggctgaggcaggacaatcgcttgaaccggggaggtggaggttgcagtgagccaagatcgtgccactgcactccagcctaggcaacagagcgagactctgtctcaaaaatacatacatacacacacacatacacacacacgcgcaagagacacagtgagtagaaacaccga

SEQ ID NO: 11347 - DNA, 3051 bp, Homo sapiens
tttttttttttgagagggtgtctcgctctgttgacaggctggagtacagtagcacgatctcaggccactgcaacctctaccttctgggttcaagagattctcctgcctcagcctcccaagtagctgggactataggcgcatgccaccacgcccagctaatttttgtatttttagtagagacagggtttcaccattgttggccaagctggtctcgatctctttgaccttgtgatccacccaccttggcctcccaaagtcctgggattacaggcgtgagccactgtgcccagcctcggctcaggtttttcaatacagtcttgaccttggcattcagtatcctcacagcatggttctaattaactttctagctctatttcccttttcctgctccctctctctacaactagtctttctctgattgccccgccctcaacccatctaaactagaccccagggaagcaccttggtccccttcctctctcccactcaccatccaaccaatcaccagagcctgtacattctatattttcaacatcgattcaattgtctacttctttctagcctgccctctctgactgggactccttgagccagcctgatcaccccaatccatccctcacactgtgcccatctttctgaagtaggaatctgatcacaccaccctgctaaaaacactctggttctccccacggcatgtggtgcccttgtatagctggcaaagccttgcatggcacggccccagcctgtgcttcaactcaattgcccgactctctccagctctgctgagccacctaagtcacagatggtttctcctctcatctctgctctcttccatgtgccatttctgtggcttggaatgttcttccctcattctctttctggccctttcccgtcacaccttagacgtgcatcttcctctcgaaaacctctagtgaagcctcccagggccaggcagtaccctcctctggcttcttctggatacagaggaagaatctgagcatcgattctccatctcagcaggcctctgtgtgcctgctgactccgactagaccagagatccgtaaggacagggatcgagttttttttcttttaattcactgcctcaaaaatcctctgtgcattacctattcatcctcttctctcccttaacctgaaccagtgatcttactgtctccatcattgtttttttcttttcttttcttttcttttttttttttgaggtggagtctggctcttcacccaggctggagtgcagtgatgcgatctcgactcactgcaacctccatctcctgggttcaagcgattctcctgcctcagcctccccagtagctgggattacaggcatgcgctaccatccccaactaatttttgcctccataattttgccttttctagaatgtcatacaggtggaattactcagtatgctgcctttttcagattggcttctttcacttagtaatatgtttgttttttgagacagggtcttgctctgtcgcccaggctagagtgtggtggtgcgatcttagctcactgaaacctccacctcccaggttcaagtgactctcctgcctcagcctcccgagtagctgggactacaggcacgtgccaccatacccggctaatttgtggatttttagtacagacggggtttcgtcatgttggccagggtgttgttgaattcctgacctcaagtgatccacctgcctcagcctcccaaagtgttgcgattacaggtgtgagccactgcgccaagcctcatttagtaatatgcatttaaactttctccatgtctttaatggcttgatagctcatttatttttatcatggaatatttcattgtctggatggaccacagtttatttctccattcacctactgaaggacatctcggttgcttctaagttttggcaattatgaataaagctgctataaccatcaagtgcaggtttttgtgtggacctattatcaactaattcgggtaaatctcaaggagtgcaattgctggatcacacagtaagagtgtgtttagttttaagtggctgtgccattttgcattcccaccagcaatgaatgagagtttctgttgctccacattctcactaccattcggtgttgtcagtgttttgcattttggccattctagtaggtgtttacatggtatctagtcatttgaatgggcatatgatgtggaacatctttttttttttaattttattattattatactttaagttttagggtacatgtgcacaacgtgcaggtttgttacatatgtatacatgtgccatgttggtgtgctgcacccattaactagtcatttagcattaggtatatctcctaatgctattggaacatcttttcatgtgtttatttgccatctgtatatcttccctgatgagttggggatgcattctttccatctcagagtccccagaaactaacatagcagttggtacagagttggtgctcaacaaacatcagcttaggaactatgtcctatgtttttttgtttttttttttttttaaaaaggaatgtgagctgttcccaaaacgtatgtccttcccccatgcctctaccctgcccttccacaaactttctgatcttcagcacacactacccaaccatcaaggctgagacttcccgtggccagcagtgtctcatgctggcttcaagccccacagcactgcttttttcaacttctcttgtggtttagactgtctttagcccagcaagagaattcattgtcttatcccccattaaactgtacctacactctttgaggaaaagggtccatcttacttaaaatattttaaaaattcacatgtgataaaactgatgtgtatgtgtatgagagagagagaaagagagaacagttctatgaggcttaatgtatacatgtggccgtgcagcccactgccccatgtcaccattttcaattctgtcattacccctgggacaatgtcttgtcaatatacacttgaggctgggcggggtggttcctgcctgtaatcccacctgtaatcaggagttcaagaccagcctggccaac

SEQ ID NO: 11348 - DNA, 3029 bp, Homo sapiens
  misc_feature (1)..(1): n equals a,t,g, or c
  misc_feature (4)..(4): n equals a,t,g, or c
  misc_feature (150)..(150): n equals a,t,g, or c
ntancccattgtgcccagcctggctcaggtttttcaatacagtcttgaccttggcattcagtatcctcacagcatggttctaattaactttctagctctatttcccttttcctgctccctctctctacaactagtctttctctgattgcnccgccctcaacccatctaaactagaccccagggaagcaccttggtccccttcctctctcccactcaccatccaaccaatcaccagagcctgtacattctatattttcaacatcgattcaattgtctacttctttctagcctgccctctctgactgggactccttgagccagcctgatcaccccaatccatccctcacactgtgcccatctttctgaagtaggaatctgatcacaccaccctgctaaaaacactctggttctccccacggcatgtggtgcccttgtatagctggcaaagccttgcatggcacggccccagcctgtgcttcaactcaattgcccgactctctccagctctgctgagccacctaagtcacagatggtttctcctctcatctctgctctcttccatgtgccatttctgtggcttggaatgttcttccctcattctctttctggccctttcccgtcacaccttagacgtgcatcttcctctcgaaaacctctagtgaagcctcccagggccaggcagtaccctcctctggcttcttctggatacagaggaagaatctgagcatcgattctccatctcagcaggcctctgtgtgcctgctgactccgactagaccagagatccgtaaggacagggatcgagttttttttcttttaattcactgcctcaaaaatcctctgtgcattacctattcatcctcttctctcccttaacctgaaccagtgatcttactgtctccatcattgtttttttcttttcttttcttttcttttttttttttgaggtggagtctggctcttcacccaggctggagtgcagtgatgcgatctcgactcactgcaacctccatctcctgggttcaagcgattctcctgcctcagcctccccagtagctgggattacaggcatgcgctaccatccccaactaatttttgcctccataattttgccttttctagaatgtcatacaggtggaattactcagtatgctgcctttttcagattggcttctttcacttagtaatatgtttgttttttgagacagggtcttgctctgtcgcccaggctagagtgtggtggtgcgatcttagctcactgaaacctccacctcccaggttcaagtgactctcctgcctcagcctcccgagtagctgggactacaggcacatgccaccatacccggctaatttgtggatttttagtacagacggggtttcatcatgttggccagggtgttgttgaattcctgacctcaagtgatccacctgcctcagcctcccaaagtgttgcgattacaggtgtgagccactgcgccaagcctcatttagtaatatgcatttaaactttctccatgtctttaatggcttgatagctcatttatttttatcatggaatatttcattgtctggatggaccacagtttatttctccattcacctactgaaggacatctcggttgcttctaagttttggcaattatgaataaagctgctataaccatcaagtgcaggtttttgtgtggacctattatcaactaattcgggtaaatctcaaggagtgcaattgctggatcacacagtaagagtgtgtttagttttaagtggctgtgccattttgcattcccaccagcaatgaatgagagtttctgttgctccacattctcactaccattcggtgttgtcagtgttttgcattttggccattctagtaggtgtttacatggtatctagtcatttgaatgggcatatgatgtggaacatctttttttttttaattttattattattatactttaagttttagggtacatgtgcacaacgtgcaggtttgttacatatgtatacatgtgccatgttggtgtgctgcacccattaactagtcatttagcattaggtatatctcctaatgctattggaacatcttttcatgtgtttatttgccatctgtatatcttccctgatgagttggggatgcattctttccatctcagagtccccagaaactaacatagcagttggtacagagttggtgctcaacaaacatcagcttaggaactatgtcctatgtttttttgtttttttttttttttaaaaaggaatgtgagctgttcccaaaacgtatgtccttcccccatgcctctaccctgcccttccacaaactttctgatcttcagcacacactacccaaccatcaaggctgagacttcccgtggccagcagtgtctcatgctggcttcaagccccacagcactgcttttttcaacttctcttgtggtttagactgtctttagcccagcaagagaattcattgtcttatcccccattaaactgtacctacactctttgaggaaaagggtccatcttacttaaaatattttaaaaattcacatgtgataaaactgatgtgtatgtgtatgagagagagagaaagagagaacagttctatgaggcttaatgtatacatgtggctgtgcagcccactgccccatgtcaccattttcaattctgtcattacccctgggacaatgtcttgtcaatatacacttgaggctgggcggggtggttcctgcctgtaatcccacctgtaatcaggagttcaagaccagcctggccaacacagcaaaaccccgtctctactaaaaatacaaaaatttgctgggcgtggtggcacgggcctgtaatcccagctactcaggtggctgaggcaggacaatcgcttgaaccggggaggtggaggttgcagtgagccaagatcgtgccactgcactccagcctaggcaacagagcgagactctgtctcaaaaatacatacatacacacacacatacacacacacgcgcaagagacacagtgagtagaaacaccga

SEQ ID NO: 11349 - DNA, 224 bp, Homo sapiens
gaccaacatggtgaaaccctgtctctactaaaaacacaaaatttagctgggtgtggtggtgcgcacctgtaatcccagctactcaggaagctgaggcaggagaatcacttgaacctggtaggtggaggttgcagtgagctgagatcatgccactgcactccagcctgggtgacagagcgagactctctctccaaaaaaaaaaaaaaaaacctagaccagatgca

SEQ ID NO: 11350 - DNA, 468 bp, Homo sapiens
tcagcattaaaatttggggaaaaaaatgtttgaagatcaatgaaaaatagcactggactctatatttacttatataagattttttttttaaatcttgatgaaaatttttattaggctagaattgcagagctgcaagagaattctgagatcaacaggtctttttccttcatttaccagctgagaaacttggggtcataggagattaagattgtttatcttaccagttgaattcaatactttcagaaataattgttagaattcagtgaaagttattctcttaaaagtacactgcttttcagctcctatcaagtgtttccctatgcttccacaatcctgattatcaatttgggtatgggccactctgggaaaggctgtcaaatgtttattctagaatccagcaactcccagatgtccatctccatctcaggttctggtcaaagtctgatgtagcaaagaaacagagtaaca

SEQ ID NO: 11351 - DNA, 222 bp, Homo sapiens
ccaacatggtgaaaccctgtctctactagaaacacaaaatttagctgggtgtggtggtgcgcacctgtaatcccagctactcaggaagctgaggcaggagaatcacttgaacctggtaggtggaggttgcagtgagctgagatcatgccactgcactccagcctgggtgacagagcgagactctctctccaaaaaaaaaaaaaaaaacctagaccagatgca

SEQ ID NO: 11352 - DNA, 468 bp, Homo sapiens; identical to SEQ ID NO: 11350

SEQ ID NO: 11353 - DNA, 224 bp, Homo sapiens; identical to SEQ ID NO: 11349

SEQ ID NO: 11354 - DNA, 1854 bp, Homo sapiens
ttttttttttgagactataaacatatatatacacgtagtattttctatggttgccaattcttatgctagatgttagcattacaaattcgtataaaatctgtgtccgccttcatagtccaacaacaaacgtttgctgagtgtagaactcccaggagttctctcatggacacaacagccacactcaccctcacattagctggcagaggccctttataccagtgatacgcttgggccaagggcccctgggttgaaaatcattaggtagacaccatccagtgccctgtctcatgtgctgaacagggctagtaatgccgactttcactttgggaggccaagtcgggtggatcacttgaggccaggaggtcaggaccagctagccaacatggtaaaaccctgtctctactaaaaatacaaaaattagctgggcatggtggcatatgcctatagtgccagctactcaggaggctgaggcatgagaatcacttgtacccaggaggccgaggtttcagtgagccaagatcatgccactacactccagcctgggtgacagagtgatatagatctcaaaaaaaaaaaaaaaaagtgtcaacctttacttctattttatcaagttcttgttccagcctgtccttttcaaaagataccctccttggtaaagattccaaagttttgggttttctttaaatgtatgcatccaatgtctttttcatttcattaaggtcaaataaatatttgtcctgggtttccaataaggtatttgagattttcctgtgccataatgactgtatttggtacaggcaaggcaatatactaaggtctctctacagatcttgaaaatcagatcagccttggaggatgaaattagtaacaactaatacaccctggaggacaccagccctttggaaggcattcattggaagagactagaaaagcagttgaggttgggagtttctcatttcaggcaaagtgacaagggagtggtatcagaaaatacgatcttaactaagaaagctagaacctatatcactctagaagactgttcacaaacggtagcagggcccatgtgcagcttggaaagaggaagcttaatgtgcaaaaatttaatatccctgcaactctctggaaattggcaagatggtccctcagaagagcagatctgtgtggtgagtgagatatcacagctccatgaggtgaacaccaaaccttccaatcatcagttgtctcccatgtacttatggagaatggtagacaaaactcactgaactgcttcatttgtacattgatctcttgtgaccttgctttgtgggagttagtcccagagaatctttataaactggcaagattttctgacctaaagaggtaggatctgtggaaaatgatgacctaccaaagtacaaatctagagaactgaggtttggagaacatgaaaaccatggtcaaacacgtgaaggcctgccactgggaagaggaattcaactagcaatacacaggcccaactaatatgtaagaaagacactacaaagtagtagttaagaacacaggctctggagccaaacgacttggctctaacacttactggctccatgaccttgaacaacttaggttccatgtgccttaatttctccatctgttaaataaagtgattgtgaagatttaatgagataatccaaataaatgcttagtacaatgtatggaacacagcaagttctcaagagactagccattacatcattattatccaaagaagaaacagaccaccctgtaagatttggaagggagctcccccaggactcctcccaccccctgccaggggtacagagagactagtttattgagggccaaacacaaaacttg

SEQ ID NO: 11355 - DNA, 1583 bp, Homo sapiens
ggatctgtgtggcatggtatgtgtgtttatgtgtattgtgggtgtctgtgtggcatgctgtgcgtgtgtgtattgtggatgtttactgtcccgggcagtagaaaggacgtcggggaagcagccccagcatcagggacaggccaggagtgcagaatgcatggaagctggtcaggtcggagcccgggatgaaggaagcacagagatgcaagggtgccagggcccatggaaccaagagccgatgatcaaggccacagtgcacacagccctggaggcaaaggacatattcatttcacaaggattaaaaagcatgggccaaggctgggccccaggccaggactggggatacagagtggatcagtccccatccctgcccccaggtgcttacccacacccattcacctcacaggtttccccaccccagccccttggcgagctcctcctcattcctcaaaacgtcgctgaggtcacgctccttcccgaggcctctccccatcctctaaaacaccctctccctgctgcccacttgcagcacagtcagagagctccgtggcctgtttccactggactgagtcttctggggggtgctggtgcagagcagaaccctgggctgggagtcccggcacctcgttccactccctcacccacagcctcgctgtttaacctcaggcaggccgtgtccctcctcagcctcactttccccttgtgtaaaatgagggaagggactgcgccttctaagtcatctttcagcttaaaacctctttgaccttctatctggctaatggaggtgctgaccaggggcaagaagggatttgaaaaacgctttgaaaaattcatagcaggaggcaaaggagaaagagtctttattttcgtagagcgggaggcaggaggagttatggacagaggctgtcgatgaaaaggacagcatctcagagcactttgtggcatttaatgtctaatgcctcctcccattaaagcagtggcatcaaatatttaccaaagcagcattaaaaattaacctttaccatggggatgtataaaggccctaagttccctgagaagtgaccgaacatcaggagggtaaagtgacaggaaggaaggctacaagcgggttgtgaataatggaagcccccaaaggtcccccaacacagctccctgttgaccccactcccaaagccagggcagcctccggccgtgtctctgcagaggctcccagcccttcggagactcccagagggcctgcaggataaggacaggccctcagctgggcatccacagccttccatggcctggccctgcctctctgggcagctgggatctgtaggatggaaaggaatgagtctgtcggagttggaagagaccaggggaggaagtggggagtggtccgggcactggaaatagcacgtgcagaggcactgaggcagagacagctgcacatcaatccatcagaagagcagccaggtggcatgagtgtgggggaggaaggaagcgcaggaggggacaggtgggagatgcaggtaggtctgactgtgcagggccatggtaagatgtgggcttctcggtccagggacaggggtgccctcgag

SEQ ID NO: 11356 - DNA, 4443 bp, Homo sapiens
cagagattatctcatcattgactccgagttgattggatggatgcagacagtatacagaagagcctttagagcttcatacaattgtgagctgataatctttcttagaatcatccaattggatgcacagtcaacaagcagccttctggtagttcattcatttgttcattcattctctattgagccttcaagcaccttcagtgtgacagatgtcacactaggtgctagacacacaaagataaattatgtttgtgcactgcttggagcagctcattccctcctcagaggttttgttgcagggtggagaacaggatggccagctgacaggtattccaggccctgcagctatgattttctgcactgtgatttaacaaaataacgctaggtgcaatcagtcactctcttgtgaattgcttagcaaagattattaccccagacagagtacactgagaaaaaataataaaaccctaggactggaccccaaactgaagacttcagtgaggaattgcctctttgtgacattccaccctatatcgtaacactgatgattcactttggaacctaaaagttagttacttttatgttcaacctacactcagcaattctactgcaatttgtgtctctccgtgttggctacctcttatgatctgcaatgccacatactactatcttcaggctgcaggctgagcctaggaactgagtctcagccatgctttccttccatcacccctcccatccccagctggcagttagtgttttgcaaatgatactgcaaatgattgtagtttgtgtttatgagaaaagggggttggtaaggaaaagacagaaagaaaggggattggggaaggggagagagagagaaagagagagggaggggtttaagctacttggaatttggagtttaagttgcccttaagtaaagcatatttttaataggctactataagaaacacacttttcaagggaaaaaaagtgggtttgaattttggctgccactcattagcaatattatctttatagggtaattatcatctccgggccttgatttttctaaactgtaaaatgaaatgtttggagttagagaatttttaaatattctggtatcattgattcttgtatttcttgagacaaaatcctctctttcacattctgctaattttgtaatttgtttcaccattctctcttgacacataaaaggactctgtgaaaactatcagtatcggagaagatttcctataaccatcatatcatctatgtttcctattagggcttctgacattccacatgttttcaaaggtaattggaaatactggagacaatttaagggtcattattgtgttagccaagaaaatagctaatgatgactttagctactgggctattcagcctatcatagagcccattagctcaattaagtaaatcaaataggaaaaaacatttagacttaaaaagccacccaccactacctattacttgcctgtgaggcttctatttcatggtgaattcaaattgcttgttcattgtaggtagaagaaaatgagcaatcatctgattcagcagatgcagtgattcaagatcacttagcatttataatgataaaccaaaaattatgttaaatagcaattttaaggaagcaggtaagactagaagccttctgcataaatcaggcttgagctttgcggaagtggcttctttccctgtactgaggtgtgagaagcagcacatggatttttattcctttaaaggattttcttcaagcaacagtctgtagttcaggttaatgggaaggcaaggcagtagcattgggatgaacatttatgatcccaaacattctaattctaggtgtctacagcattcaaatattgagtaggcacttacacttccaaagaccaattcttcaagataatgctgaggttaacttacagttttatatattattcaatggggcagttcacaggacatttgaagtgacttggagagaaaaaagaataccgccgttcatattattaatatttatggtacagttattatattcaggccatgctattgctggagagagttggtccattgaataaatgtgcaatgttcatgaagcagtgaatatatcattcaattaaaaattcagcaactgatgtagtcagggatgtgctggtaaatgtctcacaactggctttccaggaccggtttgcagcatttgctgattttcatggtgtagacccttccctcatggctgacatcaagctaccaatgggttggcatctggcttgcacaactgctggaaatttagcaatcaactcgagcacgctggcacaagttgctccagccccagtaccggacatgacttaaagagtgagggggtggaaaattacagtcaaagggggtccactacctacccaaatcctataaaacggccccacccctatctccctgcgctgactcctttttcggactcagcccacctgcacccaggtgaaataaacagccttgttgctcacacacacacacacacacacacacacacacacacacacaaagagtaaggggtgaaatggctttgcttgtaactggattccaagagaatcattcttagaccgcacacctaagtgtttactttattaccaactatcatctcaaagtgggagagaggatggggattgggtccccttttcagaaaacccctatgaaagagccctttagaaaaaggctgggcttgaggaagtcttaattctaaatatcgcggatcaggggaaggagcaggtcattccatttccttgggactcacatgtataataagcagatttcatatctgagaggcgtaagttcccttctatttttgctgctcagtgtgcaatttagtccaaaaattgactccggtgcagatcattaaattgtcaacagccagtgggtcctgaaacataagcaaggactacccagacaggaggtcgggagtttctaatgcatccccggggacctgctaggatcttgacctctctctaagagaggctttggactgattcggcataacagtgggggcagatctgctttctccaaggctgtctcttcccttctatcagtgatctccaccttgctcagcccactcaatgctgcctttgctgttacagtctaagaaatgtggctcctttttcctaacctctcttctcctttcacctgcatgtcataaggtggtcatggatatattctttcatattcttgctaaaatactcattgctggaagtaacacaagggtatcaaatttgtataaacaacagtatgatttagttctctaatataataatgcaatataacaaaatgagtccattcaactgttgtccattcaactataccttaatatatattattttattgatgcttatctatgtatacattagttctgtgcacagtctagtggatagtgatctgttaaatggataaatgaatgaatggctgaagttttatccttctgaatggatgagtggcctctctagttcattttcaagcctctagggctatgatacatgtttcctatttccagatttttctttatgttctctctttatttctagaaaacacaaatagcttctcgcccatgggggggatttttggcaggaaaatcgcactctttacctgtcatccaccttccagaaatgcaggaactgaaagactgagaaagtggaaaacacgccatgcaattgctaacagttggcagagcagcaagtgcactccagtgggtggcatttgtccctgtttctatgctctgatctgaagcttgtacaacagatgtaccaggggctggaggatggcagtgctcatttgtggaggtgataatgctagaaaacagctcaggccatgactagcatagtgccacaggctgatgaacctgttggtcctgctgggcagttttagctcagcagcattttaaccatttgcaacgctagaagcaacggcaaacattgctaatgtaacatttctttatatggctagagtgctggaactagatgtcatggaacttttcaaaaatactgaggctttatgttcagttctgaataaaattttacctccaaattttctttttttttttgagatggagtctcactctgtcgcccaggctggagtgcagtggcatgatattggctcactgcagcctctgcctcctgggttcaagcaattctcctgcctcagcctcccgagtagctgcagttacaggcacccaccaccatgaccagctaatttttgtatttttagtagagacggggtttcaccatattggccaggctggtctcgaactcctcacttcaggtggtctgcccgcctcgacctcccaaagggctgggattataggcgtgagccaccatgctcagccaatttttattttttatttttcaaaattctattttattttaggtcctgggatacatgtacagaacgcaggattgttacataaggaaa

SEQ ID NO: 11357 - DNA, 604 bp, Homo sapiens
acctctcttctcctttcacctgcatgtcataaggtggtcatggatatattctttcatattcttgctaaaatactcattgctggaagtaacacaagggtatcaaatttgtataaacaacagtatgatttagttctctaatataataatgcaatataacaaaatgagtccattcaactgttgtccattcaactataccttaatatatattattttattgatgcttatctatgtatacattagttctgtgcacagtctagtggatagtgatctgttaaatggataaatgaatgaatggctgaagttttatccttctgaatggatgagtggcctctctagttcattttcaagcctctagggctatgatacatgtttcctatttccagatttttctttatgttctctctttatttctagaaaacacaaatagcttctcgcccatgggggggatttttggcaggaaaatcgcactctttacctgtcatccaccttccagaaatgcaggaactgaaagactgagaaagtggaaaacacgccatgcaattgctaacagttggcagagcagcaagtgcactccagtgggtggcatttgtccctgtttctatgc

SEQ ID NO: 11358 - DNA, 4442 bp, Homo sapiens
cagagattatctcatcattgactccgagttgattggatggatgcagacagtatacagaagagcctttagagcttcatacaattgtgagctgataatctttcttagaatcatccaattggatgcacagtcaacaagcagccttctggtagttcattcatttgttcattcattctctattgagccttcaagcaccttcagtgtgacagatgtcacactaggtgctagacacacaaagataaattatgtttgtgcactgcttggagcagctcattccctcctcagaggttttgttgcagggtggagaacaggatggccagctgacaggtattccaggccctgcagctatgattttctgcactgtgatttaacaaaataacgctaggtgcaatcagtcactctcttgtgaattgcttagcaaagattattaccccagacagagtacactgagaaaaaataataaaaccctaggactggaccccaaactgaagacttcagtgaggaattgcctctttgtgacattccaccctatatcgtaacactgatgattcactttggaacctaaaagttagttacttttatgttcaacctacactcagcaattctactgcaatttgtgtctctccgtgttggctacctcttatgatctgcaatgccacatactactatcttcaggctgcaggctgagcctaggaactgagtctcagccatgctttccttccatcacccctcccatccccagctggcagttagtgttttgcaaatgatactgcaaatgattgtagtttgtgtttatgagaaaagggggttggtaaggaaaagacagaaagaaaggggattggggaaggggagagagagagaaagagagagggaggggtttaagctacttggaatttggagtttaagttgcccttaagtaaagcatatttttaataggctactataagaaacacacttttcaagggaaaaaaagtgggtttgaattttggctgccactcattagcaatattatctttatagggtaattatcatctccgggccttgatttttctaaactgtaaaatgaaatgtttggagttagagaatttttaaatattctggtatcattgattcttgtatttcttgagacaaaatcctctctttcacattctgctaattttgtaatttgtttcaccattctctcttgacacataaaaggactctgtgaaaactatcagtatcggagaagatttcctataaccatcatatcatctatgtttcctattagggcttctgacattccacatgttttcaaaggtaattggaaatactggagacaatttaagggtcattattgtgttagccaagaaaatagctaatgatgactttagctactgggctattcagcctatcatagagcccattagctcaattaagtaaatcaaataggaaaaaacatttagacttaaaaagccacccaccactacctattacttgcctgtgaggcttctatttcatggtgaattcaaattgcttgttcattgtaggtagaagaaaatgagcaatcatctgattcagcagatgcagtgattcaagatcacttagcatttataatgataaaccaaaaattatgttaaatagcaattttaaggaagcaggtaagactagaagccttctgcataaatcaggcttgagctttgcggaagtggcttctttccctgtactgaggtgtgagaagcagcacatggatttttattcctttaaaggattttcttcaagcaacagtctgtagttcaggttaatgggaaggcaaggcagtagcattgggatgaacatttatgatcccaaacattctaattctaggtgtctacagcattcaaatattgagtaggcacttacacttccaaagaccaattcttcaagataatgctgaggttaacttacagttttatatattattcaatggggcagttcacaggacatttgaagtgacttggagagaaaaaagaataccgccgttcatattattaatatttatggtacagttattatattcaggccatgctattgctggagagagccggtccattgataaatgtgcaatgttcatgaagcagtgaatatatcattcaattaaaaattcagcaactgatgtagtcagggatgtgctggtaaatgtctcacaactggctttccaggaccggtttgcagcatttgctgattttcatggtgtagacccttccctcatggctgacatcaagctaccaatgggttggcatctggcttgcacaactgttttttatttagcaatcaactcgagcacgctggcacaagttgctccagccccagtaccggacatgacttaaagagtgagggggtggaaaattacagtcaaagggggtccactacctacccaaatcctataaaacggccccacccctatctccctgcgctgactcctttttcggactcagcccacctgcacccaggtgaaataaacagccttgttgctcacacacacacacacacacacacacacacacacacacacaaagagtaaggggtgaaatggctttgcttgtaactggattccaagagaatcattcttagaccgcacacctaagtgtttactttattaccaactatcatctcaaagtgggagagaggatggggattgggtccccttttcagaaaacccctatgaaagagccctttagaaaaaggctgggcttgaggaagtcttaattctaaatatcgcggatcaggggaaggagcaggtcattccatttccttgggactcacatgtataataagcagatttcatatctgagaggcgtaagttcccttctatttttgctgctcagtgtgcaatttagtccaaaaattgactccggtgcagatcattaaattgtcaacagccagtgggtcctgaaacataagcaaggactacccagacaggaggtcgggagtttctaatgcatccccggggacctgctaggatcttgacctctctctaagagaggctttggactgattcggcataacagtgggggcagatctgctttctccaaggctgtctcttcccttctatcagtgatctccaccttgctcagcccactcaatgctgcctttgctgttacagtctaagaaatgtggctcctttttcctaacctctcttctcctttcacctgcatgtcataaggtggtcatggatatattctttcatattcttgctaaaatactcattgctggaagtaacacaagggtatcaaatttgtataaacaacagtatgatttagttctctaatataataatgcaatataacaaaatgagtccattcaactgttgtccattcaactataccttaatatatattattttattgatgcttatctatgtatacattagttctgtgcacagtctagtggatagtgatctgttaaatggataaatgaatgaatggctgaagttttatccttctgaatggatgagtggcctctctagttcattttcaagcctctagggctatgatacatgtttcctatttccagatttttctttatgttctctctttatttctagaaaacacaaatagcttctcgcccatgggggggatttttggcaggaaaatcgcactctttacctgtcatccaccttccagaaatgcaggaactgaaagactgagaaagtggaaaacacgccatgcaattgctaacagttggcagagcagcaagtgcactccagtgggtggcatttgtccctgtttctatgctctgatctgaagcttgtacaacagatgtaccaggggctggaggatggcagtgctcatttgtggaggtgataatgctagaaaacagctcaggccatgactagcatagtgccacaggctgatgaacctgttggtcctgctgggcagttttagctcagcagcattttaaccatttgcaacgctagaagcaacggcaaacattgctaatgtaacatttctttatatggctagagtgctggaactagatgtcatggaacttttcaaaaatactgaggctttatgttcagttctgaataaaattttacctccaaattttctttttttttttgagatggagtctcactctgtcgcccaggctggagtgcagtggcatgatattggctcactgcagcctctgcctcctgggttcaagcaattctcctgcctcagcctcccgagtagctgcagttacaggcacccaccaccatgaccagctaatttttgtatttttagtagagacggggtttcaccatattggccaggctggtctcgaactcctcacttcaggtggtctgcccgcctcgacctcccaaagggctgggattataggcgtgagccaccatgctcagccaatttttattttttatttttcaaaattctattttattttaggtcctgggatacatgtacagaacgcaggattgttacataaggaaa

SEQ ID NO: 11359 - DNA, 872 bp, Homo sapiens
cttcaaaaggcaaattctctatttcccccactttgattatctgcttatgctcctaaaataatgtaaatatggtcattaatcatctacaacattgtcaattaggagagtaaagccagtaatgaactctacatccctgacctcatatggtatgttgcattttaagggagctgtttttatcaatgacaatcgtattatttgtgctcataacctgggctctacatccagtgaaaggattttgatacagaatctttatttgaagagaactacacaaaaacaccatcaccatcatacctgatgtctgctattgttgaaataggcttcagcactgtagctggtggaaaccaggtcaccaaagacactgcccttgtacctggaaggcccgtccctgcccccattcacacagtgaattcatttagaagagaggaatgctgtagacagagtcattagaaaacccttcatgactgtggcgtggaaaagggctggcaaggatcacaaacagctttcctgggtttggtcttacagcatggacttcttcaccctcatctacacgtaaaatttattaacttcaaggagaggagatcagggttgcctctaccttgcattcctatgtagccatgaattaattcccaaatgccagtgtgagcctgttttccttttcatacatcgtatttgaggaaacagctggaaatattactctgtgtgccacacatcccgattcagcacagtctcttgttcccagagtggagtaaatgagtaaagaaattattcatccgccttttacctaacttggtgtgtgaccaataaattctctcaagattgattcaggttcctatattcatggaaacaaaaaaagaaaattgggcagaaaataa

SEQ ID NO: 11360 - DNA, 2128 bp, Homo sapiens
tctacctccgggctgaaacgtcaccatgcctccccacagacagacggatggacagatgggcctccctgcacctgctctgtgggtgtgggggctcctgctcagcagcagtttccagacccttctccctgctttccccaagccacccgccttgaatctggggtgctctaccagacccatcccctcatttctaaagatttgagccactagtcgtgtccctctccctcagaaatgccttggtgacacttggctgctttcaactcttccacccatctgcctcttggtctcatctttaccttctgctaaaggtcctgacccccacccccgccacgccatggggcaccccatggtggtgcgtccttgggagcagctctgtccctttccccgtggcctttgccccgcctcctatgacttcgattcccacctgtccccgacccctgggaccactgaccgggcccgatcaccctgtcactgccctgtcatctgcttaccccacacggtgctctgctgacccaggtcttgctgtctcccaacagccccacgaggcttcccgtcgctcctggacactgcaggctgagcccgctgccccgccgcctccatgaggaaggcttttcctctgtgagccccaggccaccctttccctcctttaagtaattacttaagtcccttgccagggccctcccagtaccctttctaaagacacccctgccccagcatgctgcaggctcctgctccactttcctctcaggccctcgtcgctgtggtgctgcctttgttttctgtctctgccacggcagggggtcagctccttggaggtggggcttctgcccttgctgtaccactgcctggcacacagtaggtgctcaataaagacttgcagggtgagctgcctgaagaatagtcaccagaggccagaaatgtctagagctctgccggtagggtgactggccgaggagcctggcctgcatgtgtgcgtgtgtgtgtgtgtgtgtgtgtgtgtgagtcagggtttatatgcaggtgtctacaggagacatgctgggttctgtgctgggtgtgaggaatatgggagcagaaccccagggaggtggcagagacttgggggccaaagggctggggtgcaggggggcaacagccaggtgccactggccaccccagccgcagggagccctgcccaccctccaggtgcctggatgtccaacctcactgctattcccacctcaagccaggcctggagatggaggccccatgactcagccagggccggtttgcagctgcggctgacccagacgggcgggcagcccccagcccccgggcctgcacccaggacagggccgccctccctccctcccccgcttctggctcctaggacaggattctctgaattcagctcccctgaggctggggccaggttggaggccaggcctgggggctctgggctggggtcccagataggggctgggcggccaggcttggaatctggaatccagccccattcctggcatctgcaggagcctcgtggggagggagacttgggatggacttcaaccagccagggctggattcttgccccggaacctgcattcctggggcagccaagggatccttcccacttctgggcccagcttggccctgcctggcattcgaggcccatctggggcttgggggtgtctccccaactctcagacataaggacacccttccaagcttgttccttcacctggcggggccctgagccccacacccctcccctgtcctttctccatccgacatcaagcgcctccctgcctctgctcgcacagtctctgagatggggaactcagcacctcacaggtgggcccagctctggtgctgtctgtgttgggggagctggggcagcccccaaaagaccttggagacagaccctcagaggcaggagcagaggctggcagtggatgctgtgcctggaggccttgagggcgaggtgtgatgatgaggcccaggctgcagggctctttctggctctccagctccggagaacaagggatttcctcctgctctgcccaccctccccagccagtgcatgctcagcctcagcaccgcacctgggcgccctccatgatctgccccacctggacacatggctcgaggg

SEQ ID NO: 11361 - DNA, 2129 bp, Homo sapiens
tctacctccgggctgaaacgtcaccatgcctccccacagacagacggatggacagatgggcctccctgcacctgctctgtgggtgtgggggctcctgctcagcagcagtttccagacccttctccctgctttccccaagccacccgccttgaatctggggtgctctaccagacccatcccctcatttctaaagatttgagccactagtcgtgtccctctccctcagaaatgccttggtgacacttggctgctttcaactcttccacccatctgcctcttggtctcatctttaccttctgctaaaggtcctgacccccacccccgccacgccatggggcaccccatggtggtgcgtccttgggagcagctctgtccctttccccgtggcctttgccccgcctcctatgacttcgattcccacctgtccccgacccctgggaccactgaccggggccgaatcacctgtcactgccctgtcatctgcttaccccacacggtgctctgctgacccaggtcttgctgtctcccaacagccccacgaggcttcccgtcgctcctggacaatgcagggtgagcccgatgccccgccgcctccatgaggaaggcttttcctctgtgagccccaggccaccctttccctcctttaagtaattacttaagtcccttgccagggccctcccagtaccctttctaaagacacccctgccccagcatgctgcaggctcctgctccactttcctctcaggccctcgtcgctgtggtgctgcctttgttttctgtctctgccacggcagggggtcagctccttggaggtggggcttctgcccttgctgtaccactgcctggcacacagtaggtgctcaataaagacttgcagggtgagctgcctgaagaatagtcaccagaggccagaaatgtctagagctctgccggtagggtgactggccgaggagcctggcctgcatgtgtgcgtgtgtgtgtgtgtgtgtgtgtgtgtgtgagtcagggtttatatgcaggtgtctacaggagacatgctgggttctgtgctgggtgtgaggaatatgggagcagaaccccagggaggtggcagacacttgggggccaaagggctggggtgcaggggggcaacagccaggtgccactggccaccccagccgcagggagccctgcccaccttccaggtgcctggatgtccaacctcactgctattcccacctcaagcaaggctggaaaatgaaggcccactaatccgccaggggcgggttggcacttccggttaaccaaaacgggcgggcagccccagccccctggcctgcacccaagagaagggcggcctccctccctcccccgcttctggctcctaggacaggattctctgaattcagctcccctgaggctggggccaggttggaggccaggcctgggggctctgggctggggtcccagataggggctgggcggccaggcttggaatctggaatccagccccattcctggcatctgcaggagcctcgtggggagggagacttgggatggacttcaaccagccagggctggattcttgccccggaacctgcattcctggggcagccaagggatccttcccacttctgggcccagcttggccctgcctggcattcgaagcccatctggggcttgggggtgtctccccaactctcatacataacgacacccttccaagcttgttccttcacctggcggggcccttagccccacacccctcccctgtcctttctccatccgacatcaagcgcctccctgcctctgctcgcacagtctctgagatggggaactcagcacctcacaggtgggcccagctctggtgctgtctgtgttgggggagctggggcagcccccaaaagaccttggagacagaccctcagaggcaggagcagaggctggcagtggatgctgtgcctggaggccttgagggcgaggtgtgatgatgaggcccaggctgcagggctctttctggctctccagctccggagaacaagggatttcctcctgctctgcccaccctccccagccagtgcatgctcagcctcagcaccgcacctgggcgccctccatgatctgccccacctggacacatggctcgaggg

SEQ ID NO: 11362 - DNA, 2132 bp, Homo sapiens
tctacctccggcctgaaacgtcaccatgcctccccacagacagacggatggacagatgggcctccctgcacctgctctgtgggtgtgggggctcctgctcagcagcagtttccagacccttctccctgctttccccaagccacccgccttgaatctggggtgctctaccagacccatcccctcatttctaaagatttgagccactagtcgtgtccctctccctcagaaatgccttggtgacacttggctgctttcaactcttccacccatctgcctcttggtctcatctttaccttctgctaaaggtcctgacccccacccccgccacgccacggggcaccccatggtggtgcgtccttgggagcagctctgtccctttccccgtggcctttgccccgcctcctatgacttcgattcccacctgtccccgacccctgggaccactgaccgggcccgatcaccctgtcactgccctgtcatctgcttaccccacacggtgctctgctgacccaggtcttgctgtctcccaacagccccacgaggcttcccgtcgctcctggacactgcaggctgagcccgctgccccgccgcctccatgaggaaggcttttcctctgtgagccccaggccaccctttccctcctttaagtaattacttaagtcccttgccagggccctcccagtaccctttctaaagacacccctgccccagcatgctgcaggctcctgctccactttcctctcaggccctcgtcgctgtggtgctgcctttgttttctgtctctgccacggcagggggtcagctccttggaggtggggcttctgcccttgctgtaccactgcctggcacacagtaggtgctcaataaagacttgcagggtgagctgcctgaagaatagtcaccagaggccagaaatgtctagagctctgccggtagggtgactggccgaggagcctggcctgcatgtgtgcgtgtgtgtgtgtgtgtgtgtgtgtgtgtgtgagtcagggtttatatgcaggtgtctacaggagacatgctgggttctgtgctgggtgtgaggaatatgggagcagaaccccagggaggtggcagagacttgggggccaaagggctggggtgcaggggggcaacagccaggtgccactggccaccccagccgcagggagccctgcccaccctccaggtgcctggatgtccaacctcactgctattcccacctcaagccaggcctggagatggaggccccatgactcagccagggccggtttgcagctgcggctgacccagacgggcgggcagcccccagcccccgggcctgcacccaggacagggccgccctccctccctcccccgcttctggctcctaggacaggattctctgaattcagctcccctgaggctggggccaggttggaggccaggcctgggggccctgggctggggtcccagataggggctgggcggccaggcttggaatctggaatccagccccattcctggcatctgcaggagcctcgtggggagggagacttgggatggacttcaaccagccagggctggattcttgccccggaacctgcattcctggggcagccaagggatccttcccacttctgggcccagcttggccctgcctggcattcgaggcccatctggggcttgggggtgtctccccaactctcagacataaggacacccttccaagcttgttccttcacctggcggggccctgagccccacacccctcccctgtcctttctccatccgacatcaagcgcctccctgcctctgctcgcacagtctctgagatggggaactcagcacctcacaggtgggcccagctctggtgctgtctgtgttgggggagctggggcagcccccaaaagaccttggagacagaccctcagaggcaggagcagaggctggcagtggatgctgtgcctggaggccttgagggcgaggtgtgatgatgaggcccaggctgcagggctctttctggctctccagctccggagaacaagggatttcctcctgctctgcccaccctccccagccagtgcatgctcagcctcagcaccgcacctgggcgccctccatgatctgccccacctggacacatggctcgaggg

SEQ ID NO: 11363 - DNA, 290 bp, Homo sapiens
gatgtgtgtttgtgtgtgtgtgtggtgtgtgtatgtgtgtggtgtgtgtatgtgtgtggtgtatgtgtgtgtgtggtgtatgtgtgtgtttgtgtgtgtgtggtgtgtgtatgtgtatttctttgaatgagaaattggctcccatgattatggagctgacaactcccaaggtctgcaggcagcaagctggaggcccaggagggccggtggtgtggctgcagccggtgtctgaaggcctgagaaccaggagggcgggtggtgcagctgcagtgtgaaagccggcaggctcg

SEQ ID NO: 11364 - DNA, 96 bp, Homo sapiens
ccaacatggtgaaaccccgtctctactaaaaatacaaaaattagccgggcatggcggcacgtgcctgtaatcccagctactcaggaggctgaggca

SEQ ID NO: 11365 - DNA, 7881 bp, Homo sapiens
ccacaccaggagtgtccagtccttgggccttggtcagcctggagcagttgctcggccccctgtggtgggggcactatggagcgacatcggacttgtgaggggggtcctggggtggcaccatgccaggcccaggacacagagcaacggcaggagtgtaacctgcagccctgccctggtaagtgccctgggcggcaggtgactgactccctccattgctgctgagcccaggccctgccccagctgtggggggtaggtgtggggagaggaggtcggacccagggcagctccctccctgggactggagatgctgggtccctcccatctccctacctgtgtgctccccacagagtgcccccctggccaggtgcttagtgcctgtgccacctcatgcccgtgcctctgctggcatctgcagcctggtgccatctgtgtgcaggagccctgccagcctggctgtggctgccctggagggcaggtgggtacggggtgctgtgtcctgactccctgtgggggaagccggcaggtggggagggaagaggcggtggtctgagtgtcactgagcctgccctgctgcagctgctgcacaatggcacgtgtgtgcctcccactgcctgcccctgcacccagcattctctgccctggggcctcaccctgaccctggaagagcaggcccaggagctgcccccagggactgtgctcacccggaactgcacccgctggtgagggcctggccctggggtggggagcagggatgaggaagggtagggaggaggacatgggaggcatctgagtgtgcttctgtcttctcagtgtctgccacggtggagccttcagctgctccctcgttgactgtcagggtgagatgtggctgtccatgccctgctgcacctccaaagtcaaggcccgggactggcactgaggaggagagacgggccctgctcacagactagacagagcttcagaaagccctcccctgtctgtccacactgacctctctctaactggagacccagcaccccctgccgagggctccctgggcactcagtgtggtctgccccacttgtgggggcattccctagcacacagtatacacagagccagggctgtgatgccaggaagtggaaggttctttccctgccagtgaggaaactgaggtctggaggggtgagcggaaatgaggggcctggcctggcagcccccgggctgatagcatttgccctgtggggtgcagtgttacccccatctgatcaagaccaagggcccacccaccgtgttcccagctctgccacgctgggctctgtgaatgcagacatgcagcatggccagcctccgggcagaccacccacccccagaacaggcagagacagggcacagtctctaggtctctgacaggcaggtagaaccccagagggtgagacatcagtgctgagaatagaggccgagtggacaggattggtcagggagccttttctggaggaggtgagacctggcctgggtccagctagtgtttgggtgggtggataagaaagatcaggaggtgtggttggaggctgctgtggctgagaaggcaagatggggacgtgtgggtgctcagcttgggaggggaggaatcgaggctggatccagggctgacctgaaagctgggttggatggtcttccctggcagagtgccccctggggaaacgtggcagcaggtggccccgggggagctggggctctgcgagcagacgtgcctggagatgaacgccacaaagacccagagtaactgcagttcagctcgagcctcgggctgcgtgtgccagcccgggcacttccgcagccaggcaggcccctgcgtccccgaagaccactgcgagtgctggcaccttgggcgtccccacctggtgagacaccgaaccccctctgctaccactcacccattcctgaccccaagcctccccatctgtctgtaactccactggctcctccccctactccaggccctgcagcagccggcagggctccgctctccccctgggacagtctctggccccaacagttcatctccttcctgggtctcttgttgcctgactccatccaagcccattgccccggctaggcactcacaggctgggcttggggatcagggatactattatagaaaagtctgcaagttggagccgggcacggtggctcatgcctgtaatcccagcactttgggaggctgaggtaggcggatcatgaggtcgagagatcaagaccatcctggccaacatggtgaaaccccatctctactaaaaatacaaacattagctgagagtgctggtgcgtgcctgtagtcccagctactcgggaggctgaggcgggagaatcacttgaactggggaggtggaggttgcagtgagccgagattgtgccactgcactccagcctggcgacagagtgagactccgtctcaaaaaacaaaacaaaacaatacaaaacaaaacaaaacaaaacaaaacaaatctgcaagttgggagagaccaagaggaggctctcccctactctccccagcctggatctgaatggcaggaggcctgtgagagctgcctctgcctcagtgggaggcctgtctgcacccagcactgctccccactcacctgtgctcaggtacgccctgcatccctgctactctccggggtggttccccccttacctgggctccggtaccccctgcagccctaccaccctccctggttcctcgggctccttcctgggaccctcctccgaggttggtcttagggtctctgagtggggagggcgggccgggctccaggtgtcaagaccaccttgggactctctccctctgcagggcgaggagatggtgctggagccagggagctgctgtccctcttgccgcagggaggctccgggtatggagggaacctgggtgcattgtggggtgcctctccctggtctagacccttctcccctgccaccccacacctggcctttgcagcctggcagctgcctgactcccccaggccaacccaccatggggatttgaggagtgaagaccccagcacatatcatagcgcctggtcacctcgccccacacgcttccctcagacccaggccctgcccctcttcccacagtcccctcagtcccctcctcctcctgtgctctgtccccccccccacagtctcctcagtcatcccctcctcctgtgtcccctccacagtcccctcagtcatcccctcctcctcctgtgctctgtcccccccacagtcccctctgccatctcctcctcctgtgtcctctacagtccccttagtcccctcctcctcctgtgtccccctccacagtccctcagtcacctcctcctgtgccttcccgcacagtcccctcagtcacctcctcctctgtcccccccacagtcccctcagtcccctcctcctcctgtgctgtcccccacagtcccctccatcatcccctccacctgtgtcccctccacagtcccctcagtcccctccacctcctgtgtcctcccacagtcccctcagtcccctcctcctgtgtcctcccacagtctcctcagtcatcccctcctcctgtgtcccctcagtcatcccctcctcctgtgtcccctccacagtccccgcagtcatcccctcctcctgtgtcctcctccacagtctcctcagtcccctcctcctgtgtcccccccacagtcccctcagtcacctcctcctcctgtgccctcccccacagtcccctccatcatcccctcctcctgtgtcccccccacagtcccctcagtcacctcctcctctgtccccccgcacagtcccctcagtcacctcctcctcctgtgccttcccgcacagtcccctcagtcacctcctcctctgtccccccacagtcccctcagtcccctcctcctcctgtgctgtcccccacagtcccctccatcatcccctccacctgtgtcccctccacagtcccctcagtcccctccacctcctatgtcctcccacagtcccctcagtcccctcctcctgtgtcctcccacagtctcctcagtcatcccctcctcctgtgtcccctccacagtcccctcagtcatcccctcctcctgtgtcccctccacagtcccctcagtcccctcctcctcctgtgtcctcccacagtcccctcagtcccctcctcctgtgtcctcccacagtctcctcagtcatcccctcctcctgtgtcccctccacagtccccttagtcacctcctcctcctgtgccttcccgcacagtcccctcagtcacctcctcctctgtccccccccacagtcccctcagtcacctcctcctcctgtgccctccacaacagtcccctcagtcatcccctcctcctgtgtcctcctccacagtcctctcagtcatctcctcctcctgtgtcctcccacaacagtcccctcagtcatcccctcctcctgtgtcccctccacagtcccctcctcctctgtcccccccacagtccccagtcccctcctcctcctgtgcctcccctccacagtcccctcagtcacctcctcctcctgtgtcctcccacaacagtcccctcagtcatcccctcctcctgtgtcctcccacagtcccctcagtcacctcctcctcctgtgccgtcccccacagtcccctcagtcacctccttctcctgtgcctcccctccacagtcccctcagtcacctcctcctgtgtccttccacagtctcctctgtcacctcctcctcctgtgcctcccctccacagtcccctcagtcatcccctcctcctgtgtcctcccacagtcccctcagtcacctcctcctcctatgcctcccctccacagtcccctctgtcacctccttctcctgtgccctccccacagtctcctctgtcacctcctcctcctgtttccccctgcattccccctgtcacctcgttctcctgtgcctccccacccccacagtcccctcagtcacctctgcctcctgtgccccacccccacctcctgccactcaatgcccctccccacagaggagcagtcgccctcctgccagctcctcacggagcttcgaaacttcaccaaagggacctgttacctggaccaggtagaagtgagctactgcagtgggtactgcccatccagcacccatgtcatgccagaggtgagccagggacctgctgtccaggccaggggaatcacgttggccagtggccaccgagggctgccctgagcctgggacctgggcagaaccagagtccatgaggcacaaggtgcttctgatggagataacagtggagttggggaggcagatggtcagagctttccccaaggcagtggtgtgcacctgcaggttggcccagaggtttcactgggtgcctgaccccctcccacagaggtcttctgtggccccacaccattcccagagtgtgcccgctgtgcccttcaaggcaatgagccaggagcccagcaaagaaaggcatggaggagctaagctagcctctgacatcagaacccatcacacggtgcatgagagcatgagagctctgccggaatgcactttctacagagaggatcaccgcacacatttcctgcaagctgtccgagccaggctggctctgagtcttgggcaggtggctccgctctgcgtttgccctctgtggacccagaagcccctgatccttcttaggatcttccaaggggctctgtgcccaccctgactcccctcagcctgatgagctgtaacctgagctgcctcctgccagggtcctctctccagcttcactcacactactcctgcctgcccctaggcccacctcccagcactctgcggccatcccttctgcttcagcctacctggtttacctcatcctggaagacaaggatactttcctacctggtccccaaagacacagcccctcaaccctcggccgctctacggctcccccaggcgcgccctggacctcctggaaatactttcccaaatcactttcggaattttttttcacacttttagaatttttaaaacatagagtgagaaaagagagaaagtaattaagagatgcttttttttttttcctgaggaaagaaattgatagtgggatacaaattggagggaaattttttcgctgaaaaacctcttgcagtttttgaacctggcattgtatgaatgtactacccatttaaaagtaaaattataaatagaattatacataaaattaaatgatatgcttataggactctgatataggtgctttaaccacagtgcacagggatctgctttggagtgaaaactcactttgcacttgggatcagaactatgcagttagaactgacttatttgtagtttcatagattataactctgtctgtccaactagactctaagccccttgcggtagaagtatgtccttccccctgcagccaggaggcactgatgggaacgttaaaagtattcgtttaacctgtaggttgttggacattcagacagtgggggtgaaggaggtgggcttcttgcaaaaggggcttggcagtggcccagccaccctgctcagtgaagagggtgggatctggccctcccaccatcccaccctgcctaagatgggaaaggccaagggaggggaggaaactccatttggccctagttcacccgctccctctcgcccaggagccatacctgcagagccagtgtgactgctgcagctaccgtctagacccggagagccctgtgcggatcctgaacctgcgctgtctgggtggccacacagagcccgtggtgctgccggtcatccacagctgccagtgcagctcctgccagggtgggtctgggcagggaggggacggggcaggagcctgggcaaggacccagtgttgtgaaccagacccaggaacacacgtgtagctcctcactccatccttcttccttgagtccttccagtccacgtttttccttcttctcggtgttcttgttaatttcatctcctatcatgcatacttgtgggtgtctggggtagttgcacctagttcaaaccccagctcatctgtttcctttgtttccttgctcagcctccctgacatcatctttttttttttttttttttgtgatggggtctcactctgtcacccaggctggagtgcagtggtgtgatctcggctcactgcagcctggaactcctggtctcaggtgatccttccgcctcagcctcctgagtagccgggaccacaggtcacaggtgtgagccaccatgccgggctaatttttcttttccttttttttttttttttttttttctgtagggacggggtttcgccatgttgcccaggctgttcttgaactcctgggctcgagtgatccacctgcctcagcctcccaatgcgctggggttacaggcaggaaccactgcacccagccccctgacctcatcttttaagcaaggctgacattgctatgcaggcttgttgggtggacttggtgagggcacgcgtgtgaagtggctggcaggtgcctagttctgttaagcacctgccatatgataacctgaggtcccactgtgtggcagatgaaggggaaacagaggtggaaggcacccgtgccacctgggtggagcacagtggaaggcctggtgttggctctgggcgtcctcctggcaccagcctgaccactctgcctctcttactaacccatctctccctcacgtgtcccctgggaggtgacttctcaaagcgctaacaggctccgctgggtgagtccacagctgtccctcttgtgatcatgggactcagcagcactgaccacgtccttccacgctctctcacctgcccccaactgggggcccatgacttggcattagcatgttccaaataaagtgatactggcaacaaat

SEQ ID NO: 11366 - DNA, 2304 bp, Homo sapiens
cttcctccacctggacacccagggctgctactcagggccctgcccaggtgagtgttcaggggaagtgaaatcacctctctacttttcctaccttgggagattcagaaaataaatgttcctagttcccggatcatcccttaaaataagcctgccctgtctgtgcccccatgttttgctcagttcctttcctcttcccaccatctcttccctcggggccctccttgtagggtgagagggcgtccagccagctgggcctttcaggcccctcttgcctgtttcctgtgcagggtctcggcagggctggggtgagagggagggcaggcaggggagaggtgggctgacacacccctccggtccctagaggagtgtgtgtggagcagctggagcagctggacgcgctgctcttgccgggtgctggtgcagcagcgctaccgacaccagggcccggcgtcccgaggggccagggcaggcgccccctgcacgcggctggatggccacttccggccttgccttatcagcaactgctctggtgaggctccagcagcaagttaaccagggagctgcgcagggcagcagccaccaagggtccctgctggaactccctgctcccctcccctcacagccaatgtagtgccccaagacctcagagcagctgcctgcgcccgtgcctgccctcaaacccagctgctcccctgctccccccagatactccctcatcacagctgcgaccccaatccctcaccacaatttgtccaccctgcagctgccggcccgcctgtggctttggcccatgtagctgccctctaggagggtgtcttacccagctcctgctgcggctgccctccatctctgcccctctgtctcccatctctgcccctctgtctcccatctgccaatttctggagcacctgccaaggcccctcactcctgcagccccctcctcagctgcctcctccaggcatcttcctggctctccaaggcccaacccatcctgatccttccctggaggtgcccacaggtgctgagtggatgccagatgggggatactggtctgttccaacttgcggagggtgggcatcttgtactctcaccaggtgaccccaagggcctcagtagagccacgcggcatgtgctctgggctttgggagtgatgtctctgggctgttcccccacaagcctgcctctcccccatctcccccagaggacagctgcacgcctccctttgagttccatgcctgcggctccccctgtgctgggctctgtgccacacacctgagccatcagctctgccaggacctgccaccctgccagccgggctgctactgccccaaggtgagagctgggagctggagcaacttccaaggagaagggggtcttctgcccacactcctgctcctccttctttctgtgatgtccatggcggccccacctccttcaaaccccttggaactcggtgcctcctcccagcttgccattcactcggcatcatgcatatgcacctgctgcaggcggggcacagtgctgggtgctgggatgacacgatgatcactgccccatctctccttccacccaggggctgctggagcaggctgggggctgcattcccccagaggagtgtaactgctggcatacctcagcagcaggagccgggatgaccctggcccctggggaccgcctgcagctgggctgtaaggagtggtgagtgatggtggaagggagacagagggctggggccagggaatagggcagggaggcctggggggcccagtccagcctcaggacagaggaccctgagatgctagagtttgcagctccctcatcttgccccaaatgtgcctaggggtcaggttacccttgcatgaccacccccaccccccggaggtcctggactgggtcctgcctcccttagtctaccctgactaccccctcccacagtgaatgccggcgtggggagctgcactgcaccagccagggctgtcaaggtaaccctgacctatggagacaacagtccccattgcttgggactgggggagtttctgggatgcagaactttcagtgctaagacggggacagtcccaggcaaactgggatggtgggtcaccttaccctgcccccacaccaccctcagcctttctgtttccagcacttcctggtcatgaccctgagcccctcctgcctgtccaccagggtctctgggcccaggggtggtcactgggaagggcacccacaccctgtccttccaggtcttctgcctctgagtgagtggtccgagtggtcgccctgtgggccctgcctgccgcccag

SEQ ID NO: 11367 - DNA, 4410 bp, Homo sapiens
ccacccagggcctgagtcctgtccacaccccaggtgacggccggctccacaaggcagtgagcgtgggcccccgggtgcacatcattgaggagctgcagatcttctcatcgggacagcccgtgcagaatctgctcctggacacccacagggtgagcaggccaacgaggaatcctggcagggtacttggggggtgccctccattagcaccaagcagtccccacccagcttctcctcccttgcctcaggaggatggaaagataaaggatccagtcatgaactattagaaagtggggtcgcctgttacgtaacaggcctcttgggggtggctctgggaggcatacaagccgggtggccatgggtgatggccctggctgcccatgcccgcttctcatccccgtgtctggctgtgcaggggctgctgtatgcggcctcacactcgggcgtagtccaggtgcccatggccaactgcagcctgtacaggagctgtggggactgcctcctcgcccgggacccctactgtgcttggagcggctccagctgcaagcacgtcagcctctaccagcctcagctggccaccaggtgagcactcccaaaggccccttcccatctgtccagccctgcacaggtgacctcggagcaccatcctgggccctccttgggaccgccacacagcctcgtttatgtccactgtctcagcataattattaattagctctcctgcttcctctcaagtgcaattcagacaggaaattgtgtgtttatcttggctacctgtaaaacgaggacatgatttggtaaagtatgaaatagcacagctttgaaaagccttgcaggaaaatgtggattagcgtgtgaacgtgctttagtaatagtagggctaggaaacagtccattaacaaacccagtaaaaattggtttcagaataacctatttggattataaaatgttcatttagaaaatagggatgaacacaaagcaaaactacccctcatcccaccacctagagagaatcgcagtgagattttgatatattatcctctcaggttttactacatatgtgtatagataacaaaaatccttttattttatttcatttcatttcatttatcttgtttggagactcgctctgtcgcccaggctggagtgcagtggcacaatctcggttcactgcaacctccacgtcctgggttcaagcgattctcctgcctcagcctcccaagtagcagggattacaggtgcccgccaccatgcccagctaatttttgtatttatagtggaggcagggtttcaccatgttggccaggctggtctcgaacttctgacctcagatgatccacccaccttgggctcccagagtgccgggattacagccatgagccaccgcgtctggccaaacattcatatattttatataacattggcaactgtcctgtttgtagtgttcttgcttcacatatggatacacctggtgtcagtttttacaaaaaccaagtgagttttggtgcgtatgccaggagggacaccccagaatgttaactgtcatgatcactggctggtagatgctgtgatttttgtagtgttttcatccttcgtgcctggttgacttatctgtctcctgagtgtatccagaattactgtcctttattttttattacacagatgtatgcatgtgcactgtttaaaaaaaaagatgagaacacatcaaaaaaaattttaattaaaaaaaagaaaaagagagatctatacatacagatcccagctgtccttctaatctttttctgagggtacatactattttttattattattttttgagacagggtctctctgtgttgctcaggctggagtgtagtggtgtgattacagctcactgcagccttggcctcctgggctcaagcaatcgatcctccaacctcagcctcctgagcaggtggaaccacaggcgtgcgccaccatgcctggctaatttttctattttttgtagagatggggtctcgctatgttgcccaggttgtcttgaattcctgggctcaagcgatctaccggccttggcctcccaaagtgctgggattacaggcgtgggccaccatgcctggccactgagggtacatactgtttatgtaattaagggaagtgttatcttagctttgacttgaaataatgtgtagacagaggagatgctgactcctgtgggtggggaatcagctcaggaaaggcccttgcccaggcccaagtctgcagtgaggggtgagggaatgtgagctcaggggacttcctggccaatcccagaattctctctggccctcaggccgtggatccaggacatcgagggagccagcgccaaggacctttgcagcgcgtcttcggttgtgtccccgtcttttgtaccaacaggtgaggtgccccctcaaaaggtggaggagagaggtggggacaagtgtgcttggaaggctcccccaggcacagatgttgtaaatgcctttcctcacttccttgccccctacccctgtaagcaggtccccaggaagactcagtcccaggggtccccggagttgcccatcgtggcaccaggggcatagccagagggaggcaggggagcttggagctactgtggacgctggcacccccctaccccatgccttttctgcctacaggggagaagccatgtgagcaagtccagttccagcccaacacagtgaacactttggcctgcccgctcctctccaacctggcgacccgactctggctacgcaacggggcccccgtcaatgcctcggcctcctgccacgtgctacccactggggacctgctgctggtgggcacccaacagctgggggagttccagtgctggtcactagaggagggcttccagcagctggtagccagctactgcccagaggtggtggaggacggggtggcagaccaaacagatgagggtggcagtgtacccgtcattatcagcacatcgcgtgtgagtgcaccagctggtggcaaggccagctggggtgcagacaggtcctactggaaggagttcctggtgatgtgcacgctctttgtgctggccgtgctgctcccagttttattcttgctctaccggcaccggaacagcatgaaagtcttcctgaagcagggggaatgtgccagcgtgcaccccaagacctgccctgtggtgctgccccctgagacccgcccactcaacggcctagggccccctagcaccccgctcgatcaccgagggtaccagtccctgtcagacagccccccggggtcccgagtcttcactgagtcagagaagaggccactcagcatccaagacagcttcgtggaggtatccccagtgtgcccccggccccgggtccgccttggctcggagatccgtgactctgtggtgtgagagctgacttccagaggacgctgccctggcttcaggggctgtgaatgctcggagagggtcaactggacctcccctcgctctgctcttcgtggaacacgaccgtggtgcccggcccttgggagccttggggccagctggcctgctgctctccagtcaagtagcgaagctcctaccacccagacacccaaacagccgtggccccagaggtcctggccaaatatgggggcctgcctaggttggtggaacagtgctccttatgtaaactgagccctttgtttaaaaaacaattccaaatgtgaaactagaatgagagggaagagatagcatggcatgcagcacacacggctgctccagttcatggcctcccaggggtgctggggatgcatccaaagtggttgtctgagacagagttggaaaccctcaccaactggcctcttcaccttccacattatcccgctgccaccggctgccctgtctcactgcagattcaggaccagcttgggctgcgtgcgttctgccttgccagtcagccgaggatgtagttgttgctgccgtcgtcccaccacctcagggaccagagggctaggttggcactgcggccctcaccaggtcctgggctcggacccaactcctggacctttccagcctgtatcaggctgtggccacacgagaggacagcgcgagctcaggagagatttcgtgacaatgtacgcctttccctcagaattcagggaagagactgtcgcctgccttcctccgttgttgcgtgagaacccgtgtgccccttcccaccatatccaccctcgctccatctttgaactcaaacacgaggaactaactgcaccctggtcctctccccagtccccagttcaccctccatccctcaccttcctccactctaagggatatcaacactgcccagcacaggggccctgaatttatgtggtttttatacattttttaataagatgcactttatgtcattttttaataaagtctgaagaattactgtttaa

SEQ ID NO: 11368 - DNA, 1251 bp, Homo sapiens
tgcagtaaaatagactttactgatgtacggttctttacattttgatgcatgcagagactcatctaaccaccaccccaatcaggatacaggcgagtcccacacctcctgctgccccttcatcctcacaccctcccacggggacagccagcgtgggtgcggcttgacttcccgctggcctctgctcgatatgctgcttattcctaggatgattgaaggctcttagaagagaagtccagtccttcctcataccagtgtatctcatgtcacacatagggtcaaacttctaaacctttattactgattagtacaaacacaaacggagcaatgacaacagcagtgaggagaggccctgacaacgagggccgcccctgcccggggtgaggctgcacagcgccagctccaggctgggccagcttggcgacactggcaacacaggcttgaccttggccacagctcagcagtagaaaggttcttggacagggtgccaggacacacgctggggctgctgtcacaggacaatcttaaaggagctgaacaagagaaaagcggtgggttttctgctggaagaggagggcagggactaaacccgaacttgcccccttctccctttagacccttctttggaacgggctatgttccgtgtgtcagccccctctgcaagaactccccgagacatccagagggagctttctggacccacacactgggtcagagcttctaaacctttattactaatgagtacaaacacagagcaatgacaatggcagtgggaaggggagaggtcttgacaaggagggctgcccctgcccggggcgagactgccagcttagccggccctgtgtgtggggactggggctttctctcaccctggcaccacctcctgtagccatgccctaggcccagaggcagcaggtcggaacctgcaggtacccagaatgaagggggaccactgtcatacctggcaaagtctggagaacgggagatgacgtgctggaactcagagaggttgatggttccatccctgtcaatgtcagactcctccaggatctgggaaagggagagtttcaggccagagccccaactgctccctcccgctcccaggcctgctcagctgctcacgttgtcgatgagctgcttcatctcagacgcactaagccgtgtgtcctcgccctctcccgtgaggcagttcaccagccggctcaggtcttctctgttcaaggttccgtcatcatcaaagtctagagagcagac

SEQ ID NO: 11369 - DNA, 7421 bp, Homo sapiens
agtatgagccgcacagcctacacggtgggagccctgcttctcctcttggggaccctgctgccggctgctgaagggaaaaagaaagggtcccaaggtgccatccccccgccagacaaggcccagcacaatgactcagagcagactcagtcgccccagcagcctggctccaggaaccgggggcggggcaagggcggggcactgcatgcccggggaggaggtgctggagtccagccaagaggccctgcatgtgacggagcgcaaatacctgaagcgagactggtgcaaaacccagccgcttaagcagaccatccacgaggaaggctgcaacagtcgcaccatcatcaaccgcttctgttacggccagtgcaactctttctacatccccaggcacatccggaaggaggaaggttcctttcagtcctgctccttctgcaagcccaagaaattcactaccatgatggtcacactcaactgccctgaactacagccacctaccaagaagaagagagtcacacgtgtgaagcagtgtcgttgcatatccatcgatttggattaagccaaatccaggtgcacccagcatgtcctaggaatgcagccccaggaagtcccagacctaaaacaaccagattcttacttggcttaaacctagaggccagaagaacccccagctgcctcctggcaggagcctgcttgtgcgtagttcgtgtgcatgagtgtggatgggtgcctgtgggtgtttttagacaccagagaaaacacagtctctgctagagagcactccctattttgtaaacatatctgctttaatggggatgtaccagaaaccacctcaccccggctcacatctaaaggggcggggcgtggtctggttctgactttgtgtttttgtgccctcctggggaccagaatctcctttcggaatgaatgttcatggaagaggctcctctgagggcaagagacctgttttagtgctgcattcgacatggaaaagtccttttaacctgtgcttgcatcctcctttcctcctcctcctcacaatccatctcttcttaagttgatagtgactatgtcagtctaatctcttgtttgccaaggttcctaaattaattcacttaaccatgatgcaaatgtttttcattttgtgaagaccctccagactctgggagaggctggtgtgggcaaggacaagcaggatagtggagtgagaaagggagggtggagggtgaggccaaatcaggtccagcaaaagtcagtagggacattgcagaagcttgaaaggccaataccagaacacaggctgatgcttctgagaaagtcttttcctagtatttaacagaacccaagtgaacagaggagaaatgagattgccagaaagtgattaactttggccgttgcaatctgctcaaacctaacaccaaactgaaaacataaatactgaccactcctatgttcggacccaagcaagttagctaaaccaaaccaactcctctgctttgtccctcaggtggaaaagagaggtagtttagaactctctgcataggggtgggaattaatcaaaaacctcagaggctgaaattcctaatacctttcctttatcgtggttatagtcagctcatttccattccactatttcccataatgcttctgagagccactaacttgattgataaagatcctgcctctgctgagtgtacctgacagtagtctaagatgagagagtttagggactactctgttttagcaagagatattttgggggtctttttgttttaactattgtcaggagattgggctaaagagaagacgacgagagtaaggaaataaagggaattgcctctggctagagagtagttaggtgttaatacctggtagagatgtaagggatatgacctccctttctttatgtgctcactgaggatctgaggggaccctgttaggagagcatagcatcatgatgtattagctgttcatctgctactggttggatggacataactattgtaactattcagtatttactggtaggcactgtcctctgattaaacttggcctactggcaatggctacttaggattgatctaagggccaaagtgcagggtgggtgaactttattgtactttggatttggttaacctgttttcttcaagcctgaggttttatatacaaactccctgaatactctttttgccttgtatcttctcagcctcctagccaagtcctatgtaatatggaaaacaaacactgcagacttgagattcagttgccgatcaaggctctggcattcagagaacccttgcaactcgagaagctgtttttatttcgtttttgttttgatccagtgctctcccatctaacaactaaacaggagccatttcaaggcgggagatattttaaacacccaaaatgttgggtctgattttcaaacttttaaactcactactgatgattctcacgctaggcgaatttgtccaaacacatagtgtgtgtgttttgtatacactgtatgaccccaccccaaatctttgtattgtccacattctccaacaataaagcacagagtggatttaattaagcacacaaatgctaaggcagaattttgagggtgggagagaagaaaagggaaagaagctgaaaatgtaaaaccacaccagggaggaaaaatgacattcagaaccagcaaacactgaatttctcttgttgttttaactctgccacaagaatgcaatttcgttaacggagatgacttaagttggcagcagtaatcttcttttaggagcttgtaccacagtcttgcacataagtgcagatttggctcaagtaaagagaatttcctcaacactaacttcactgggataatcagcagcgtaactaccctaaaagcatatcactagccaaagagggaaatatctgttcttcttactgtgcctatattaagactagtacaaatgtggtgtgtcttccaactttcattgaaaatgccatatctataccatattttattcgagtcactgatgatgtaatgatatattttttcattattatagtagaatatttttatggcaagatatttgtggtcttgatcatacctattaaaataatgccaaacaccaaatatgaattttatgatgtacactttgtgcttggcattaaaagaaaaaaacacacatcctggaagtctgtaagttgttttttgttactgtaggtcttcaaagttaagagtgtaagtgaaaaatctggaggagaggataatttccactgtgtggaatgtgaatagttaaatgaaaagttatggttatttaatgtaattattacttcaaatcctttggtcactgtgatttcaagcatgttttctttttctcctttatatgactttctctgagttgggcaaagaagaagctgacacaccgtatgttgttagagtcttttatctggtcaggggaaacaaaatcttgacccagctgaacatgtcttcctgagtcagtgcctgaatctttattttttaaattgaatgttccttaaaggttaacatttctaaagcaatattaagaaagactttaaatgttattttggaagacttacgatgcatgtatacaaacgaatagcagataatgatgactagttcacacataaagtccttttaaggagaaaatctaaaatgaaaagtggataaacagaacatttataagtgatcagttaatgcctaagagtgaaagtagttctattgacattcctcaagatatttaatatcaactgcattatgtattatgtctgcttaaatcatttaaaaacggcaaagaattatatagactatgaggtaccttgctgtgtaggaggatgaaaggggagttgatagtctcataaaactaatttggcttcaagtttcatgaatctgtaactagaatttaattttcaccccaataatgttctatatagcctttgctaaagagcaactaataaattaaacctattctttctgtgtgtgtgagcgtgcgtttgtgtttggtagtgttcctagggcagaggtggagcagggatgcacttatcatgggaagggaggtagaaaagagaattggatagcctgtgatctttggtggaatttattccttttgcctaggcctttcagaccctgcttgatttccgtagacacttcaggttgtggcaagggagagctggtctgcaatcggaagtaccagcctcttccctagagcacaactagaaagaagaactatagagtgttataagggaggccctgagatggaaggaccatcacacagaaatgataatatcttcatttcagggtgttccaggggaaaagcaggagaaagatttggggctcagtagaaggaaaagcttcctagtggtaagagtgattggcaataccatgaggtacctttaaaagatagtgaactcctgtccttggaaatattaaaccacaggctagatatcatttaatagggatgtgaagtagagtaagtcactgcccttggtgtgcaattgtgaacttgtcaatttctgaggtccctttctacttagatatataatacaagatttctattaggtatgggtgctctgatgataatgaaaatcccagcagctatgtatgggatggttacaccagacactgtgctaaggattttctttgaattgtttctcactcaatcttcacggtagctcagtgaggtaggtaccattatcactgctagaaagcagtgaacttatatggtcttactgtggcactgggtccttaaacattatgcaaaactgtgagcaacttttatcggtttgttcttttaagaacataacacagcactctaaaaatagatctaactagattgttcacatctagcgattaaggccaccctgagattatagctgcatcatcaggaacccaagatctgaagcattcagtcaaagcctcttggccacctctctttttgtcatggccttcttggacttggagggggagaatggaagcaagtaccaaggagaaagtgttctcagaaaagccacacccattagaaaaatacaaggcctgaaaggtgtgagtgggacttgacacggaagagcatttcaagcttaagaaaaaaaaaaaaaagaagaatgtgggaggatgtcagcaacaatgcttgagattccctggtcccccaaagagtctctcctccataaaactaatgagaatgtgacaaaaatagattcaacttcttatagctctggaaattaactgaagatgtatagcaatttgcagagcatttattcaagaaaaagactaaatctctgtgagcactgtgatattgtaacttgcactactctcatctccccctctccagctccacaatagctttgaaaccaacagcctgcaattaccatgaaaatcagcagtctggcagccactgaaggtgacagaatggagttggagttctttcaaagtcccattcctagacaattgtcactatttgacctgtttggcaggccctggaagctccacttgcaaggctatatttgacctgactggaagcttcccagggtaaaaaactttgtcaaaacaactagaggcaattgattctctttgtggctgcctggggtaatgtataacagttggggaaagcaattggctaaataaaaagcctaaaaggagaagctggaaaaagagattttcatagggactttgaaaagctccaaagtgttattggcaatctagactgccaaatgcataaataggactccatccatgcccaggactgtgcagatgctcaggaaaaacccaagaaagccttaagctctcacttcaagctgatcttgaggctctgcacaagccataagtaaagggaatgcagagttgtcaattgcatggcggagtgttgagtgtgcctcagcattcacacagagctccttggcagagactggttgaattattgattccaagtgtttgaggaaatccgtgtacaactattagatgactactaaccaagcagagacttcagtgtccacacacaacaaaaaatacagactttacagaattagttcagaaaagtcattaaacaaagaaacaacaacaaaccctggggaaatgacagtacgatcaaaccatgcatggccctgcctgcatgtgggaatcctcatccaagtcatactttctaaacatcataaaaagcccaaaccagtctcctttcctggctctctcaagtcattttcagaccaggttaggagacgtgagctgctctccacaaaaagcctcatgtgagtaataaatgtttcatactctcttggggtgtgtgtaacatcatcagtctcagcatctaaaccaaattttggtgacatttcatcttgtttatgcagatgtccaccacacctataaataaacaaactactgaaactgattcaagaaaaaataaaaatctgaatagagctatcacaagtaaagagattaaataagcaatcaaataacttcccagaaagaaaagcccaatttaggatgtcttaactgattaatgttagcaaatatttaaagaagaattggtacaaattcttcacaaactcttccagaaatggaagaggaggaaacactttccaccttattttctataactagtattaccttgataccaaattctgacaaatacatcaaaaataaaaccatagaccaatatctcttttaagtgtaaatgcaaaaaaattcaacaaaatgctagataactgggtccaacaacatatggaaaggattatataccttgaccaagtgggatttgccccaggaatgcaagattgatttaaccatcagtgtaatgcatcatattaatagaataaagacagaaaccacacaatcatctcgatacacgcagaaaaatcatttggcaaaattcaacacccctttgtaataaaatcactcaacacactaggaagagaagggaacttcttcaacctcacacatggcatctatgaaaaacccacagctggccgggtatggtggctcaagcctgtaatcccagcactttgggaggctgagccaggcggatcacctgaggtcaggagttcgagaccaacctgaccaacatggagaaaccctgtatctactaaaaatacaaaaaattagcccggcgtggtggcaaatgcctgtaatcccagctgcttgggaggctgaggcaggagaatcggttgaacccaggaggtggaggttctggtgagccgagatcacgccattgtactccagcctgggcaacaagaacaaaactctgtctcaaaaaaaaaaaaaaaaagaaaagaaaaacccacagctaacatcatacttaaaggtgaaagactgaaagctttcccccaagaggaactaacaggatatctgctgtcactatttttattcaatattatactggaggttctacctagggtaattaggcaaaaaaaaaaaaaaaaaaaaaaaaaaaaaa

SEQ ID NO: 11370 - DNA, 298 bp, Homo sapiens
ttcttttttttgagacagagtctcgctcagtcacccaggctggagtgcagtggcgcgatctcggctcactgcaagctctgactcccgggttcacgccattctcctgccttagactcccgagtagctggcactacaggcgcccgccactacgcccggctaatttttttgtatttttagtagagatggggtttcaccgtgttagccaggatggtctcgatctcctgacctcgtgatccgccgcccatctgggcctcccaaagtgctgggattacaggcgtgagccactgcgcccggccaa

SEQ ID NO: 11371 - DNA, 2371 bp, Homo sapiens
tatttttatgtgttttacgtaagtgcatgtgtaatttattgatagcaaggtttgcatgcatttattctgtgaatcagctcgggctggacttcctgggaatcccaggcgaagatctcagggtctctttctgctgatggctctcccttccacgaccggtcccttcccttccctgggcttcaatttccacgttggtaaatgaaagggttaagctatttctacaatcccttccttcttgggcattgttgattcctgggaagccctgacgaagagagaggacggtaagagtttacctaaacgtctctgcaccccatgcttgaaaactcaaagatcagccccgaagcgtccatgaatcctgggacaaagaaaaggacttcaaggcctcatacctatcaacaagagagattcctgctcctccagcccctccaccccttcacttttgtgctgaggaaccccccatcaccaggaggaaggaagcctgcccagtaaaggggcactcccaacagcccaccagctcctgcgcccagatgcccctgaaatcctcggactcattttgtccagcagccttgactttgtcaggggtaccagtcatgtaatccctgaggtgtctacaaaaccccgcagtcatgggctccatgcacactcaagaacaatgaggagcttcaaaagctaaggaggcttttcccaatgcttccatggtgtctcgatggttcctgaggtcttgatactctgccatggcttggcagtttggaaatggtttcctggtctggctgtcctaaggatccctggttgtgtgactgggaacaaacccttcaaccttccaggcacagttttcttctgtaaaatgagagggttgggtgcaagtttcctgaggccctggggccttgtggctgagtttatctccccgactccctgtccatcctcctatggaagtactcataaagcatttcacagccacaaggaaaaggcacacaaggtcccccagcccccacacacacaggagccacacctgcacccctccctcaaggccaggcttcctctcccccagcacacgcaagttcttctcggcctcccagctcttttcagcagctccccagaatggaacggcccagccatggcttctcagaggacagcttcttggcagagctgggagtgggtggagtagagcacattttttcctttgaggtccaaagggctgtcaaccctcttcagctgccctggggcccaacagccacagagagagatttatgacctggatagctttgatcccagtctccgataaacatcaggaacagctcgaccctaaaccccgaggagaaggtttatggatcagaatgcagcctcctggagaaaacgagcccaggagggggtgcccagggactgattgggcccttaaagttctctcatcaacagacccactgccatctgcccttgctttctggggagagggacacagctgggtggctgaggcctttgaacaagaagcaatgctgatcagagagaggtgaagatcctgtcaaaggttaaactggggaaggggtggaggcggtgggcccaggcctctgaaattccccaccctcgctcacctgttcttccaaacagcgttgtccatgtttctctaaaccacacaccaagacaaagcagagagagaacgcaccagataagatctgagctgagaaaggaatgtttcatccgtgggttttgttgtccctgttcttcttgttgatactgttgttcttggtgatgatgggggtggttaattgcttgattatatttcatccctgtcttctttccaaaaggacagggggccaggagagtctgtgtggtcacaaacccttcatagctttttcccgtcccctccacttgaccatgtgggatggcagggaatccacaccctcttggaacatcccctgttttgctgattgaaaagagatcctagaaacagcactacatccaaggtgaaggaggggccagccagtctcctctggatgccacctcagatgggttgcctcaagtttaaggtctcagccacatccataaaactgttcccctctgtgaagcaacttctgccatggggaggtggagaaggatcttctcaaagcaagtccgacaggcagagtcttcactctccggggtccggagtgttctatagacatcgggaaacatacatccatctaaaaagacaccctaataaacctgcagctattcattgcacccaagaaaccagcctgtggcccacgcatgcaggaataaacacatatttgctgagaaccaaattgggtctaatgaccctggcctgtctcgcagggtcatcctgagaaatagctgatgtcagacgacgagcgtgagcagctgttctccatttgcactcaac

SEQ ID NO: 11372 - DNA, 129 bp, Homo sapiens
acgcctgtaatcccagcactttgggaggccgaggcaggcagatcacgaggtcaggagttcaagaccatcctggctaacatggtgaaaccctgtctctactaaaaatacaaaaaattagacaggcgtggt

SEQ ID NO: 11373 - DNA, 2236 bp, Homo sapiens
  misc_feature (996)..(1995): n equals a,t,g, or c
tgcagggagctgagatcgcgccactgcattccagcctgggtgacagagtgagactccatctcgaaaaaaaaaaaaaaaagaatctgaggtttaattcaaggagcagtggaagccattcattccaaattgtcaggatctatgcaggtatgcccctccctgtcctctctgagcttagggtcaatgcctagaaatgtatgtgattgctaatagatttgctacatgccaggcactactctgagcactttattccttcctttctaatttgtgtgccttttatttcttttccgtgctttattgcattggctagggcctccagtacagcactgaataggcatggtgacagcacgcagacatcccttccttgttcctgatcttaggagaaaaacattccacttcccactcccaccaggaaggataagattcgctgtagttttgggtgttattattattatttttttggtttgcttgagacagagtcttgctctgttacccaggctggagtgcagtggcacaattttgactgactacaacctccacttctcaggttcaagcaatcctcctgcctcagcctcccgagtatctgggactacagtgtacaccaccacacccagctaatttttgtatttttagtagagacagggtttcaccatgtttgccagtctggtcttgaactcctgacctcaagtgatctgcccgcctcggcctcccaaagtgctggaattacaggtgtgagccactgtgcctggcctagttttgggtggttttttgtagatgtcttttatcaagttaagaaagtttccttctagttctagtttgccgagagttttcttttttaaaatcatgaatggatgttgaattttatcaaatgcttctacatttattgatatgataatatcatttttctctaataactatacatttatttaagcctcccaacagtcttatgaggtagatactgggttcacaccaatttaaaaaaaaaaaaaaaaaaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctgagtacagaagttcaacaccatcctggccaacatggtgaaacctgtctctactaaaaatacaaaaattagttgggcatggtggcatgtgcctgtaattccagctactggggaagaggcaggagaattgcttgaatccaggagacggaaattgcagtgagcccgagatcatgccactagcactccagcctgggtgacagagcgagactctatctcaaaaaaaaaaaaaaaaaacaagg

SEQ ID NO: 11374 - DNA, 1329 bp, Homo sapiens
ttttttttttttaaaggatattcttagtagactatatgttcacatgactcgatattcaaatggtgcaaaagtcactccatgagttatctagtgctccccattgaaggtaaaaaatactaccagttctttctggagattttatgcaaataaaaagaagggacacttatgattctcttccctattactggtggagtatgggtcactcctaatgtaggatgggatgattgccccaagctctgtcgtgagtggttgattgacggttttcttaagggaacaatgctgggaaagatgataggcgcccgccactgacccctcccgcctccctgcccctccagtaaactcccacacaaaatagcagtatgaggtgtggggaaataatcttggcctccgtcctgggtttacttttgactctgccacctacaagctgtcacctgaacaagtcctttccgttcctgtgtcttccctggtcacaagctctaagcctgaacccacactctgggaatgaagcagggtagcggcctctgcttcagcaactctgaggggtctaccttgggtggggagttggcctcatccagagggctgctggagggccaagacaaggctctggtggggaggtgtgctgagaggggattgcttatcccaccaccagcttttctgggggaggtggggaagtgatggttaaaaaatggagttcctgctatcagccatgtcctgatgaattggaaagtccccttctttctcctttcctcttgcatctcctgcctgcttcccctgcctgccctcctgtgacatgtgccctctccagcaggtatgtcacacagcaccccaagggaagggcagtgtaacgctcttttccatgatggactaccacagccagaggaagacaggccttcccttcttttctagttctttttggtttgaaaacaaggcactcttattttccccttccaagaagctggtggttcacacgggccagcacacgcattatcaaagacctagtttgtttctagtaaatgagtccattgaagtgggagccttggccgggcaaggtggctcacacctgtaatcccagcactttgggaggccgagatgggtggattgagatcgagaccatcctggtcaacatggtgaaaccctgtctctactaaaaatacaaaaattagctgggcgtggtgacacacacctgtagtcccagctactcaggaggctgaggcaggagaatcgcttgaacctgggaggcggaggcaacagtgagccgagattgcgccactgcactccagcctgggcgacagagtgagactgtctctccaaaaaaaaaaaaaaaaaaaa

SEQ ID NO: 11375 - DNA, 115 bp, Homo sapiens
gggcgcagtggctcacgcctgtaatcccagcactttaggaggccaaggtgggtggatcacgaggtcaggagatcgagaccatcctggccaacatggtgaaaccccatctctacta

SEQ ID NO: 11376 - DNA, 3502 bp, Homo sapiens
cccagctccctccccgggaccctaagagcacccccacccccacctactatggctccctggccaggttctcagccttatcatctgctacacccacgtccacccaatgggcctgggattcagggcaggggcccaggctcccctcctctgtggctcaaacggtggacgacttcctgttggagaagtggcgcaagtattttccatgtaagccccactctgggcggagccttcccacctgcctcctcctcctcctcttccttccttttcttctaccctctttctcctgctccttttctcctcttcctcttttgcatccctttgccacacctctcctcccccaacgttaccatagtccattggtccattgactctacctgtgggtccctggggaaggagacattgcaggtggccctgcagccaggagttctatgggttgggacggtttagatggagcctggctgactggggcctttattgtggattctggagctcagtagaacctaaaaggtcattgtcgtcattatcttaatagctaccatcttgtgcaatacatgatgggccaagcagtttatatatattttttcatttagttcttaattctctgaggtagtaattatttatccccattttacagatgaggaaactgagtttcagagagtttaagtagtatgctccagggtacccagtgagtgagtaacaaactcagttgtgaccccatgtctctgtgactccaggattctgcttggaacctcttggctgtgtggctaattcttgcttctgagccaggtggcctccccaggtctcagccctgctgaggattatgaaaagccataaaacaaggcatttgaggggaaacaaaatatcttctttttgccctaacccaaattgaaaagtagattaagttttaaaaataaaataaataggaccattcctgtctctcacctgtctctggcctccagccactgaagcttttccttttattgtttattctggggaggcaagaggtgctggtgggcagggtggtgaccactgcccatttctgagtcctgtccccatgctcttccagctggcatcccgctgctcagcaacagccccaccccgctggagagcaggctgggttacatgtctgccaggtgagcctccctgggggctggttggggtggaacgtcatagtcgagctgctcactgtgcctccctgggcaggtggacctctgaggggagcagacctcctggtcttaccccaagaaatcaggcaggcctctagtccacagagctgtccccgcttgcctgggtctgaggcgcccctccatgaccaggggaaagtcaagttcacaccgccaaggtcccagtggggaagggctgggcttaccctgccaaccccctgaggaagctgccctctggcccctgtggggaggagtcagcccctggtgggaccctgcccccgcccctccctctagcccctccagccccggagtctggcctttgtctttgcccttgagctcttgtttgcttcctgtggctcccttattcccccagtcctgctgagcaacatctggagtgagagggacaccctgtggaggagacagacgggcaattatttaaacctgttattaattttccattcatctcattccttgccaaatgttttcccctctccctcccttaggcagctaacagtgagtaccccccactaaccctttggccaacttgagagctgatgctggccaaggattgagttgacagaggggagcgctttgctgatgagattggcgggagcaggcggatgtgggagcccagagccttgtatcagtagcacccagcaagggggcagagggcctccaccactttcccgtttgggaactgttctggaggggcagatgttttgaagctttgaattgctagggacctcggagaagctgctctggtagctgagagaaagagggaggaggtgacagatgtgatggcctctgtgcatcctctgtcacttccgcgcctcctctctcccctcgccatgctctcctcttccttcccagtgagcagctccggctcctacagcactcccattcgcaagtccctgaggcgggcagcaccacctttcagggcataattgaggccaaccggaggtggctggaacgtgtcaagaatgaccccaggttgtatccttttacctggttcccaaactgggctgggctgtggggactgtgcttgtgccctgaggggctgaggaggatcctgttcagcctttgaccctttcatggcccctgcctggctatgcccagcgactgcagttttccttcaccttgtggccagacctctcttctcttcaacacccaagccaaaagctactttgagcctcctgcagctgggccttgatgagcacaacagagtgaaggtgtatcgcttctgaggccctgagcaggggcttggggcagcccagcctctcctccacccagaccaagtgcctgaggagctgcctgccttcttccatctgagaaagcaccgtccttccccctttgacttgcaggagccaccagggaccagggggttgagtggaacagtaaagccacacattctgtgactatataacctatctcaggctaaaatgtgtggactcgtacgagctcttgtcattgacatggcaagctgatggcgtgcggtggctgcggggtatcagggccgggagccctttgggaggaagggaggcgttagaggagctgccttcggaggctcagggagtccctttggagctggttgtttccttggccctgcagcgcactgctcggggctcccaaggaggttgtgtgtatggttcttaattcatcaggacaaagacccccagcatgtgtgtaccctgggacccgatttctctgggcccacatctatctccaatacctcagcctcagatcagaccctttcttttttgtctttcttctcttaatttttaaatgcctcttttcttgagcattccatctctctttttgaccctctcaggattgggcttagctgtccagagccctgccggagggtgctgggggctgtccctctgcaggcactgtgttttcctcaggggctgtcctcagaacacccctcctgctccctggggctcctcagggagccatttcagctggagtctcaggtctcaaaaacagcttctccgggaggccaaaaaaagactgggttggcttctggtcctcatgacggcttttatcctcctgggacactttgggtatattcatgggcattgtttccatctgtcttttctacctgtgccacccctgccctgattccacggctgcctcaggcaggcaggcaaggagctaggccggtgcccggccctggcagcaaggggtctttgtgcagttggagatgctgccgttgtggcagagcgtcctgcagccccgcttccatcagcaggctctggggtgggggctttgcaggggatgctctctgatgtttgttccgttgtttaaataaaatgcacttatttttgtttttttttttgcaa

SEQ ID NO: 11377 - DNA, 2649 bp, Homo sapiens
cttgtaggtactcattgaggtttattgtgtaagatgaatgaatgttgcaaattcctaaacatgtgattcagatgcccaatcttactctgttactttatgaaaattttttaaagctatatgatgttatatcaaaatatgttgttatactttaggataatcggtgtgttagccctgaatttcagcataagtcccatttttttccatgggagtctaggaaagctatatgtttattcagcagcaaaatacagtttggaacttaaataaactattgatcaatttctggtcttatgctagaaggaataaagcatcaagaaaaagaaaagatttgctgtcaagaccaggaaaatttgacaatagagtattagaatgcaggaaatgaggggaagtggaaaggcagcaagtaggagagaaaaagtgcagggacagtagaaagtgaatgtaggagctttctgacccatgcacttcaggaacgcaattcatccctaaaatgctgtttgctgtcttaggttgcaagtaaccaaattaaaaccagtttgaaagtagagtgagacagctgtcatcataagagtcatttgatctgtttaaaggtggctgcttgtatgcagggaccaacagtcatgttcagggcagcagctggtgcacacttcaagcacagaccataagagctaccccaggcagcacctgctaccaatagtgcaaacaactcagagagacctcgttggcataagggaatactctatcctttctgagtaaagagcaagtagaactaaaggtttcacattttaaacatactttacattcctcctcttctggggctcaagcctacttttgggccaaagcggatgttatatctgacatagagtcctcggagcagcagttgttcctgaaagttcctttttgcatctttgtgcctcatgcagtggcttacaagtcaaccagacttctcccctgacttttgatgtgtaagagcttgtgtttcaaatgggtttggttttcttaatgtcaccctaggttggtggaaaggagagtaaatggaaatggggggagcagggtcccctggggaggtttaaacagatggaagtcaattgtctcttgagaatagaggaggctattgagttttcattccacactctgctcctgttctgtcagcaaagaacaagcactactctccagcaattgctttccactggactcccccacctcggcctccctacaaaaacctagggatcaacttagttcactccaaattagaaaatttaatagtcatttgtttcttcttgtccacagggagaaccattttctttccttctttcaaaattgcccaggtcttgtgaagggttattaacaccggaaagaaatacattttaataagcttaaatctcatttctacatgaaaccatcagattttagtactgtgatattttggtccctctgtcttttaggctctgacaccaaaattgccataatgaaggtgtttcacttcttctcatttatttttatgggatcttttattcccaaatgccttttcatcccagccaaagggagaaatgttgatagatctgccatcaagaaggttccaaagctggcctgtcaggttttctgttttcttgtttattatctttgaacttttgttttaaatgttttaaacacttatttaccatgtaactaaatgtctgatagtattgaaaatactttgtgggttttaatttatttaatgctcatgaaaccctatgaggtaggtactgatattatttttattttactgatgaggaaagtgaagcaaagagaagtgaaatgaaaggtagtgagtgatgggaccagggtttggacatgggcagtctggctctaaaatgtatgcttttaactactatgtaatgctgcctcacaaacaacttgtctcacaaattgatattctggatcagaggatgtcgactggcccgcaaatgtattttgtatggctcatacacagttcagaagttttaaaaatttacatagaaatctgcatttcctgacttcttttgaaaatgggaataccaaacatcattaggcttgaattcccaatacggcaacaacagctgagcaacaagcagctgtttagactaggcactcgctctccaatttccacagtccccaccaatgcagatcatagtatcgacttaaatttcctgcctgccttagagaagcttctgagcttgtgacctctattctagctgctctatgaatggacgctgccccagtacagcgaggacctgctgcaaaatgcatttcttagtcttcaatacttattcctccttgtaactggatttctggtaagttatgtctcatggtggatctgccccaaagatggagactgaatggcagtgagtcactcgccctggcctccattgttctggagaaggttccagccacatggttgatgtcagctggttttccagagccagagctgggttgcgggacagacacacctgcatctaatagtgaaaggcaaagttgaaaggccaagaccagcctgaggtctgagggaccaagggcttcacagaggccagaagttcagaggtggacataaaaggtgttaggagaataaggaagtgaaaagaacatagtacagtgtatcagaggaggagctccaggctggcaaatatcactccc

SEQ ID NO: 11378 - DNA, 2649 bp, Homo sapiens; identical to SEQ ID NO: 11377

SEQ ID NO: 11379 - DNA, 190 bp, Homo sapiens
atgagaaagtaaacatacaacacagtaaaagttgttccaagtatttaaaaatgttctatatcttctaccttattatggctcaagatatagtaacttttgtggggttttatcattgtttttgttttattttgtgaaaacatccaagagcccgcaacagcctatagatttgcagatccttttctttcctggg

SEQ ID NO: 11380 - DNA, 190 bp, Homo sapiens; identical to SEQ ID NO: 11379

SEQ ID NO: 11381 - DNA, 13077 bp, Homo sapiens
atcccatttgaagtggtggagaaagtttacccaccagtgcctgagcagctacagctccgaattgctttttggagcttccctgagaatgaagaggacattcggtgaggccaaaggactgatggtggggagcggggtcctgatactccacactgtctgctgggtttcccatagaacaaaggagacattgtatttggggcagtggtaagaggaagacaagggagggattgcctgggattccactccctcccccccaccccccgccctggggaaggaatgaggctagggagagagtgcctagggcattgtggtctctgacagggtctgccaaaggttatttgctgagttgtggctgtgtcctcttcttcacccccaggctgtattcgtgcctggccaatggcagtgcggatgagtttcagcgaggggatcagctcttccgcatgcgggctgtgaaggacccattgcagataggtgagtgggccatcatgccatgtggcacatcctgctcctcccatcccctggcttatgaagtaagaacacaccgcaagaagctggagcatgttgtctgaataactgcagggccagggtcaagggcagagacccaggtcctgacagcactccctgaccatgcccccatttctccccagggttccacctgagtgctacagtggtgccacctcagatggtccctcctaaaggggcctacaacgtggctgtgatgtttgaccgctgccgggtcacttcctgcagctgtacctgtggggctggggccaaatggtgcacccacgtcgtggcactctgtctcttccgcatccacaacgtgaggccctcccaatttatcccggccctatcctacactccatcccccccttctctgctgcatgcctggctacaatgtgagccccctcgcctcgcctactctgcctctctgtcccccagctccagctccagcaaacctgttctcagattgttccatttttctctgtgtccccttcaggcttctgcagtctgcctgcgagccccagtctcagagtccctgtcccggctacagagggaccagctgcaaaagtttgctcagtacctcatcagtgagctccctcagcaggtgggtgaggtcggcaccccctcctgcaattagctccgggccaggccgcataacagccttcctgttaggcccaggcctccatgggttcacctaggccgtgttctgcctgcctccgtctctttctccctcagatcctccccacagctcagcgtctcctggacgaactcctgtcttcccagtcaacagccatcaatacagtgtgtggagctccgggtgagtgtggtgagaaagattggcagtaggaagaaagccagcttgtagtacagagcgccatttactcaaggcttgctgttgtcaggcaaatccaggcccctatctctagatgactgactgcctgtcatcctcagaccccacagcagggccctcagcatcggaccagagtacttggtatctggatgaatcgacactcactgacaacatcaaaaagacactgcacaagttctgtggcccctcccctgtggtcttcaggtaaatcggatctctgcatacctgtgtctgtggtggagggggagcgtccctcaggctgatgacagatcctttcttctattcatgcctgtgacccctaccttttattccctgaactggcacagtgcctggcacacagttgtcactaacgaattgatggaagatgatgaccttgtacagtcacagagtggtctgctcttacctagcaagagttccttttcttcttttgatagatcaggaaatggaaacagagaaagattttttaaagagtttttgtggctgggggcggtggctcatacctataatcccagcattttgggaggctgacgtgggcagatcacctgagatcaggagttcgagaccagcctggccaacatggcgaatctccatctctactaaaaaaacaaaaattagccaggcgtggtggcgggcgcctgtaatctcagctacttgggaggctgaggcaggagaattgcttgaacccgggaggtggaggttgcagtgaggtgagatcgcgccattgcactcaagcctgggcgacagagcaagacttggtctcaaaaaaaaaaattttgttacagatgtctttttccctctatcttctgtattttggggccggaagcccttttaggtttcattcagccccgtcttactgtcatggttttctgttcctctgcttttacagtgatgtgaactccatgtatctgtcttccacggagccgccagccgctgctgaatgggcatgtctgctgcgccctctgaggggccgtgagccagagggcgtctggaacctgctaagcattgtgcgggagatgttcaagcggagggacagcaatgctgcccccttgttggaaatcctcactgaccagtgcctcacctatgaacaggtaatcactcagcgttggggagccccgtggtagctcattctttccctccccctgcctcatcctcctcttgctgaaatggactctgggagggctactctgcctttctctgagctctcaggtgcagctcacagccttctttgtctccagataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggtgagtctcccctgaggctcaccacagaactgagcctgggccagctcaggacagactgagccttcatctccttgtttgcagagacataccatgattttagtcctcgggaaacgggaggtgctgagcactggtgttagcagtgatttacgagtcctttttctgagaggctttcatccttccttcccctaaataacacccacttttcaaaattctccagtgtttcagtgatgcttatggggctgggtcaagaagtactttcctgtatcctttccccatgcctctctttggggtgtacacctactccatgcccatcctttcccagtagcccctcagcagcctcctgccccttgttcccacaggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacggtggctcccgaggcccttccactttccttcctgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtgaggggatggaaggagggagggctgggtgctccttagccacaactgggaggggctatctagctctagttgggagtgtcaggaccatcagcaggattgtgagaaccctgttgcaggcgccgaactggtctccctgctttcagtctactcacttttctgcttccacgagattttcctgaaatgtgatggtgtcactctgctgcttaaaacccttcaatgggttcctgttgcccttatgataaaatgaaagtggttggcatgacctgtgagggtccacttgatctggtctttgcctgctttgccagcctcacttggctgctctgtcctttgcactccagtcagctgaatcactcatgtatctgccatgctctctctcttgcctccaggattttggacagattgacctttctgcctggaatgctcttccccattagcccgtgtttctccttcaggtctcagggatcttaaagatcacttcctctagggagtctctctgatactgtccctgtgccccaagatatcccacctgcttccccttgacctttccctgtaatagctggcatcacggtggcatgtgtgtttatgtgtctgtctttctaaccagagctcctatggagcggcacagggcctggcatgtagcaagtgttcaaggaatgttggctgcatgagtgagcatgatgtcctgctcctggaagttgggactttaacctgtctggtcccatgtcctccttccaggtactgtttgcctgtgctgaggccctgcatgcgcatggctatagcagtgaggcctcccgtctcactgtggagcttgcccaggatctgctagccaacccacccgacctcaaggtagagccgccccctgccaaggtgagagacccccttcctctaccttcccctcccccacttacccccaacctgctcccatgccccaccccaagtgagagcatccttctacctccaccaaggtaagtcagaatcatctgcctgtctcctgtgtttcttccctttctagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtcagaggctccatctcagccttgtatttcagtctctttagagccttgcaccttgatctctattgacacaccagaggtctgagctccttcctgtgccctcaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccaggtatgatgcctgaccctacagtaagtggggaactggggtaggggtagctttctctaagaaagaccaagagccccaagtttctgaatcacctttaggacccatcaggcagcttcatgggtaggtctgtgatgatgaggattttgggttcccctgtattttttcccatgcatgatacttctgtctgcctgacttaccccaacttttatacagtggtttctcccacaggttcccggcccccaagtcgcaactggaacagcgagacacctggggatgaggagcttggatttgaagcagcagttgctgccttgggtgagtcttgagcatatcaacgagctaagcctggttcaggtcttgaaggacatgagacctgtgccttgttgtgaagggctgtatggtaatgggaaggtcaggatgacatgtgtgagccaactagtgcctgtaagacaggaattcagggcaaaaatgtgtgctatatggctgggcgtggtggcccatgcttgtaatcgcagcgctttgggaggctgaagcaggaggattgtttgagctcaggagttcatgaccagcctgggcaacctagcaagacctcatctttacttaaaaaaaaaaaaaaaaaaaaaaaaaaaattagccaggtgtggtggcacatgccttgtgctgccagctactccagaggctgaagtgggagaattgctttagcctggagattgaggctgcagtgaactgtgattgcaccactgccctctagcctgggcaacagagtgaaaccttgtctcaaacaaagaaaaaaaaaattgtgtgctatgggtattgggtattgtaagggcagcaaaacaaaaatctagagaaaggcctaagggaagtggtagaatatggaatgtgggttaaaagatcagtaggtcctaaaccagcgaacaccatgagtaaatacacaacgcaatcaagttttcatgagaatgaggaggccagcttccctaaaatgataagtacatgctgggtaagcagattggacctggttatgaaggttttgaaaagcacaccagagcttaggctggatataatagtcaacgaagacttctataggtgatgtgggttggaccaagggaaccccttacttcatatgctgatggcttgggaaccctggcctcttacctttgctgtcttgggaattatgactactctcaatccccataaggtcctctttctcgcaggcatgaagacaacagtgagcgaggcagaacatcccctcttatgtgaaggcacacgtcgggagaagggtgacctggcattagcactaatgatcacttacaaggacgaccaggccaagcttaagaaggtaagagactggggctgggtgcggtggctcatgcctgtaatcccagcagtttgggaggcagaggcgggcagatggcttgagcccaggagtttgagacaagcctgggcaacatggcgaaaccccgtctctaccaaaaaatacaaaaaattagcagctgggtgtggtggcacatgcctgtagtcccagctactcgggaggctgaggtgggaggattgcttgaacccagtaggcagaggttgcaatgagctgggttcacgccactgcactccagcctgggtgacagagcaagaccctgtttcaaaaaaaaaaaaaaaaaaaaaaggcaaggtactggggcctttgacaggcagagaaagagagcacattttactacctttctcagggagtttccagtacaatgagaaaagtgctattttaggctgggtgcagtggctcatgcctgtaatctcagcactttgggaagcagaggcgggaggatcgtttgagaccaacctggccaacatagtgagaccctgtctctacaaaaaattagaaaattagccgggcatggtggcgcgcgcctgtagtcccagctactcgggaggctgaggtgggagaattgcttgagcccaggagtttgaggctacagtgagctataatcataccactgcactccagcctgggcaacagagcgagaccctgtctcttaaaaaaaaaagaagaagaagaaaaaaagaaaagtgctcttctgcccataggaggtaagtagggaatcttggggacatctcataaagaataagagaagaccaatggttcttataggagtgcttgggcatggggtggaagaagagaagcagagggcataaagtcattcattcacttatttcagtatttattgactatcagtatattctgccctgtggtgttaatggaggataccaagatatgttggggttaaataagttacaaaaagacatgtaaaccaggaggtcatcctgtggttgtaagtggggaaggctccctgaggatgtagcaattggctgtttcaaggagaaaggaaggtaatagaagtcaggagctaaagggcatcctgtcactgcttctctggaggtcactgcttctgtcttccagatcttagacaaactcttggaccgagagagccagacacataagccacagacgctgagttctttctactcatctagccgcccaaccacagccagccagaggtctccttcaaagcacgggggcccatctgccccaggggccctgcaaccactgacctcaggctctgcagggcctgctcaaccagggagtgtggcaggggctgggccaggccccactgagggcttcacagagaagaatgtgcctggtgaggtgggggcactgggcaggggggatgaatggtgtggacctatgttgaggtcccctttcctgggctcatcccagcgtcctgttttcctcacctagagagttccccacattccccctgtgagggtcttccatctgaggcagctttgaccccaaggccagaagggaaggttcctagccgcttggcacttggcagtcgtggaggctataatggacggggatgggggtccccaggacggcctaagaagaagcacacaggtaggatagcctgtgggctagcatagagggaaggataatcctgaaggttggagtcttaacatctgggactcctgacttctgagactgacttctcttgggggttaggcatggccagcattgacagcagtgcccctgaaacaacatcggatagttcccccaccttaagccggagaccacttcgagggggctgggcccccacctcctggggtcgaggtcaggacagtgacagcattagcagctcttcttcggactccctgggctcctcatcctccagtggaagtcgccgggccagtgccagtggaggagcccgggcgaagactgttgaagttggcaggtcagtgggaagaactccccatcttccctgatctggcccaccctcagagccacacccctagtgcaatccaaccattgtctcccagcatcctcactttccctggtccttcccaacctacccggatgcccatttcaaagaaaccccaacccccgtccctaccccattgccccttcaggtacaagggccgccgccccgagagtcatgcccctcatgtacccaatcagccatcagaggcagctgcacacttctacttcgagctggcgaagacagtgctgatcaaggcagggggcaacagcagcacttccattttcacacatccatcttcctcagggggccaccagggtcctcaccgcaacctgcacctttgcgccttcgagattgggctttatgcccttggcctgcacaactttgtttctcccaactggctctcacgtacttattcttcccacgtttcctggattacaggtaaatcatttgacctgacttgggtatgggagggggattaattggtggggataagacccttatctttgtggggttactgatctgataaaaagacattattctcacaccccagtggtgcccacactaacccaactctgcccttctctcctttcccctaaggccaggccatggagataggcagcgcagccctgactatactggtagaatgctgggatgggcacctgacaccccctgaggttgcatccctggctgacagggcatcacgggcaagagactccaatatggtgagggcggcagcagagctggccctgagctgcctgcctcacgcccatgcattgaaccctaatgagatccagcgggccctggtgcagtgcaaggaacaggtatttctacgggcaatctgggaacctcttctggggcatctgggcagggaggttgggcatgggaaagctaagggcccagctcttgattcccgtatcctggagtttacagatgattgttggtcctctcatggcaacattttacccattaatgtgctttcacacccatctttcctttaccttacaactcaaaggttaggtttatttctattttacagataaggaaatggaggcctacggtttagggaccaagatgatcactcaggatagaaaacttagggaaggcctcatacatctaagacttgaatgggagggggctgttaaattagtttggaactgggactataacctgggtcttgactcattttggtcagtatttactcagtgtgtgaagcactcactgctctgataatggactctaagcattgacactgacctctgatgattccctgggaatgagacagctctgagggagacattggaatctcatctaacaccttccatgtggtaaaggcctttcccccttaacactctgtgcccctctcttccaggacaacctgatgttggagaaggcctgcatggcagtggaagaggcagctaagggtgggggcgtgtaccctgaagtgttgtttgaggttgctcaccagtggttctggctgtatgagcaaactgcaggtggctcatccacagcccgtgaaggggctacaagctgtagtgccagtgggatcagggcaggtggggaagctgggcggggtatgcctgagggtagagggggcccagggactgagccggttacagtggcagcggcagcagtgacagcagcagccacagtggtgcccgtcatatcggtggggtctagtttatacccgggtccaggactggggcatggccactcccctggcctgcacccctacactgctctacagccccacctgccctgtagccctcagtatctcactcacccagctcaccctgcccaccccatgcctcacatgccccggcctgccgtcttccctgtgcccagctctgcatacccacaggtgagaccagtgttctgctggggggtaaggcatgggaaaatactgggaattcatagggggttggagtgggtactctgggagtataattggtcagtcggagagtcctggtgaggtggtgggagtctgggggacccagcccaactaaaataagaaatgacggccgggcatggtggctcatgcctgtaatcccagcactttgagaggccgatgtgggtggatcacttgaggtcaggagttcgagaccagcctggccaacatggggaaaccccgtctctactaaaaattagctgagtgcacgcctgtaatcccagcttcttgggaggctgagatgggaatcacttgaacctgggaggcagaggttgcagtgagccgatatcgtgccactgcactccagcctggaggacagagcgagactctatctcaaaaaaaacatgtcaggatagcagcttgtgggggtgaagcacgacagcaacatcctaatcaagtttggcatcttcccctttcttctccctgcccctagggtgtgcatcctgcattcctaggggctcagtacccttattcagtgactcctccctcacttgctgccactgctgtgtctttccccgttccttccatggcacccatcacagtacatccctaccacacagagccagggcttccactgcccaccagtgtggcctgtgagttgtggggccagggaacaggtgaatggaggggaggcacactgggcaggggaggtggggagggaatgttctttgtctctctttgggctctgagttcctcacatggctctcaccccacttagtgagcagtgtccatccagcatccacgtttccagccatccaaggtgcctcactgcctgccctgaccacacagcccagccctctggtgagcggaggttttccaccgcccgaggaggagacacacagtcagccagtcaatccccacagcctgcaccacctgcatgctgcctaccgtgtcggtgagaggacatccctttctgtgctcctacctgcagttgtgccagtggctcttgcagaggacccttcctctagctcttcatttgtttactgtggggtcaggtgacaggttggggtaaagggtgaagaggatacaccgtaccatgtgcccacccttatctatctcccaggaatgctggcactggagatgctgggtcgccgggcacacaacgatcaccccaacaacttctcccgctcccccccctacactgatgatgtcaaatggttgctggggctggcagcaaagctgggtaacacctcccctccctaggaccattgccccccccccacctgctctccccaccttccttatcccagacctccttcctagctcttgctcagagttgaggccttggtcgggtatgtgtgcgtgcgcggggggcggagggttacctcagctcctggggtggagggaggctctctgccaggccagagctgagatctgtaagttgggtccctagggcagaggtggccacccccgtctcatgcccctccccctgccccccaggagtgaactacgtgcaccagttctgtgtgggggcagccaagggggtgctgagcccgtttgtgctgcaggagatcgtcatggagacgctgcagcggctgagtcccgctcatgcccacaaccacctgcgtgccccggccttccaccaactggtgcagcgctgccagcaggcatacatgcaggtgacaacctagaattatggagcagggtggagcacttcctgggtggtcttggaccagagggaggcagggcctgtttctgtgctttgtactaaggctcatcctgcacacatcctcctccagtacatccaccaccgcttgattcacctgactcctgcggactacgacgactttgtgaatgcgatccggagtgcccgcagcgccttctgcctgacgcccatgggcatgatgcagttcaacgacatcctacagaacctcaagcgcagcaaacagaccaaggagctgtggcagcgggtctcactcgagatggccaccttctccccctgagtctttcacccttagggtcctatacagggacccaggcctgtggctatgggggcccctcacacagggggagtgaaacttggctggacagatcatcctcactcagttccctggtagcacagactgacagctgctcttgggctatagcttggggccaagatgtctcacaccctagaagcctagggctgggggagacagccctgtctgggagggggcgttgggtggcctctggtatttatttggcatttataaatatataaactccttttttactctagtcga

SEQ ID NO: 11382 - DNA, 13076 bp, Homo sapiens
atcccatttgaagtggtggagaaagtttacccaccagtgcctgagcagctacagctccgaattgctttttggagcttccctgagaatgaagaggacattcggtgaggccaaaggactgatggtggggagcggggtcctgatactccacactgtctgctgggtttcccatagaacaaaggagacattgtatttggggcagtggtaagaggaagacaagggagggattgcctgggattccactccctcccccccaccccccgccctggggaaggaatgaggctagggagagagtgcctagggcattgtggtctctgacagggtctgccaaaggttatttgctgagttgtggctgtgtcctcttcttcacccccaggctgtattcgtgcctggccaatggcagtgcggatgagtttcagcgaggggatcagctcttccgcatgcgggctgtgaaggacccattgcagataggtgagtgggccatcatgccatgtggcacatcctgctcctcccatcccctggcttatgaagtaagaacacaccgcaagaagctggagcatgttgtctgaataactgcagggccagggtcaagggcagagacccaggtcctgacagcactccctgaccatgcccccatttctccccagggttccacctgagtgctacagtggtgccacctcagatggtccctcctaaaggggcctacaacgtggctgtgatgtttgaccgctgccgggtcacttcctgcagctgtacctgtggggctggggccaaatggtgcacccacgtcgtggcactctgtctcttccgcatccacaacgtgaggccctcccaatttatcccggccctatcctacactccatcccccccttctctgctgcatgcctggctacaatgtgagccccctcgcctcgcctactctgcctctctgtcccccagctccagctccagcaaacctgttctcagattgttccatttttctctgtgtccccttcaggcttctgcagtctgcctgcgagccccagtctcagagtccctgtcccggctacagagggaccagctgcaaaagtttgctcagtacctcatcagtgagctccctcagcaggtgggtgaggtcggcaccccctcctgcaattagctccgggccaggccgcataacagccttcctgttaggcccaggcctccatgggttcacctaggccgtgttctgcctgcctccgtctctttctccctcagatcctccccacagctcagcgtctcctggacgaactcctgtcttcccagtcaacagccatcaatacagtgtgtggagctccgggtgagtgtggtgagaaagattggcagtaggaagaaagccagcttgtagtacagagcgccatttactcaaggcttgctgttgtcaggcaaatccaggcccctatctctagatgactgactgcctgtcatcctcagaccccacagcagggccctcagcatcggaccagagtacttggtatctggatgaatcgacactcactgacaacatcaaaaagacactgcacaagttctgtggcccctcccctgtggtcttcaggtaaatcggatctctgcatacctgtgtctgtggtggagggggagcgtccctcaggctgatgacagatcctttcttctattcatgcctgtgacccctaccttttattccctgaactggcacagtgcctggcacacagttgtcactaacgaattgatggaagatgatgaccttgtacagtcacagagtggtctgctcttacctagcaagagttccttttcttcttttgatagatcaggaaatggaaacagagaaagattttttaaagagtttttgtggctgggggcggtggctcatacctataatcccagcattttgggaggctgacgtgggcagatcacctgagatcaggagttcgagaccagcctggccaacatggcgaatctccatctctactaaaaaaacaaaaattagccaggcgtggtggcgggcgcctgtaatctcagctacttgggaggctgaggcaggagaattgcttgaacccgggaggtggaggttgcagtgaggtgagatcgcgccattgcactcaagcctgggcgacagagcaagacttggtctcaaaaaaaaaaattttgttacagatgtctttttccctctatcttctgtattttggggccggaagcccttttaggtttcattcagccccgtcttactgtcatggttttctgttcctctgcttttacagtgatgtgaactccatgtatctgtcttccacggagccgccagccgctgctgaatgggcatgtctgctgcgccctctgaggggccgtgagccagagggcgtctggaacctgctaagcattgtgcgggagatgttcaagcggagggacagcaatgctgcccccttgttggaaatcctcactgaccagtgcctcacctatgaacaggtaatcactcagcgttggggagccccgtggtagctcattctttccctccccctgcctcatcctcctcttgctgaaatggactctgggagggctactctgcctttctctgagctctcaggtgcagctcacagccttctttgtctccagataacaggttggtggtatagcgtacgtacctcagcctcacacagcagtgccagtgggcacacgggccgtagcaacgggcagtcagaggtggcagcccatgcctgtgccagcatgtgtgacgagatggtcacactgtggaggctggccgtgctggaccctgcactcagcccccagcggtgagtctcccctgaggctcaccacagaactgagcctgggccagctcaggacagactgagccttcatctccttgtttgcagagacataccatgattttagtcctcgggaaacgggaggtgctgagcactggtgttagcagtgatttacgagtcctttttctgagaggctttcatccttccttcccctaaataacacccacttttcaaaattctccagtgtttcagtgatgcttatggggctgggtcaagaagtactttcctgtatcctttccccatgcctctctttggggtgtacacctactccatgcccatcctttcccagtagcccctcagcagcctcctgccccttgttcccacaggcgccgggaactgtgtacgcagctgcggcagtggcaactgaaggtgattgagaacgtcaagcggggccaacacaagaagacgctggagcggctcttccccggcttccggccagcggtggaggcctgctacttcaactgggaagaggcctacccacttcctggtgtcacctacagcggcactgacaggaagctggcactgtgctgggcccgggccctgccctctcggccaggtgcctcccgctctgggggcctggaggaatcccgggaccggccccgaccccttcctactgagccagctgtgcggcccaaggagcctgggaccaagcgaaagggcttgggtgagggggtcccctcatcacagcggggtccccgccgcctctcagctgaagggggagataaagctctacataagatgggtccaggtgggggcaaagccaaggcactgggtggggctggcagtgggagcaagggctcagcaggtggcggaagcaagcgacggctgagcagcgaagacagctccctggagccagacctggccgagatgagcctggatgacagcagcctggccctgggcgcagaggccagcaccttcgggggattccctgagagccctccaccctgtcctctccacggtggctcccgaggcccttccactttccttcctgagcccccagatacttatgaagaagatggtggtgtgtacttctcggaagggcctgagcctcccacagcctctgttggcccccctggcctactgcctggggatgtctgtacccaggacgacctcccttctacagatgagagtggcaatgggcttcccaaaaccaaagaggcagcccctgcagttggagaggaggatgatgactaccaggcgtactatctgaatgcccaggatggggctgggggcgaggaagagaaggccgagggcggggctggggaggagcacgacctgtttgctgggctgaagccactggaacaggagagtcgcatggaggtgaggggatggaaggagggagggctgggtgctccttagccacaactgggaggggctatctagctctagttgggagtgtcaggaccatcagcaggattgtgagaaccctgttgcaggcgccgaactggtctccctgctttcagtctactcacttttctgcttccacgagattttcctgaaatgtgatggtgtcactctgctgcttaaaacccttcaatgggttcctgttgcccttatgataaaatgaaagtggttggcatgacctgtgagggtccacttgatctggtctttgcctgctttgccagcctcacttggctgctctgtcctttgcactccagtcagctgaatcactcatgtatctgccatgctctctctcttgcctccaggattttggacagattgacctttctgcctggaatgctcttccccattagcccgtgtttctccttcaggtctcagggatcttaaagatcacttcctctagggagtctctctgatactgtccctgtgccccaagatatcccacctgcttccccttgacctttccctgtaatagctggcatcacggtggcatgtgtgtttatgtgtctgtctttctaaccagagctcctatggagcggcacagggcctggcatgtagcaagtgttcaaggaatgttggctgcatgagtgagcatgatgtcctgctcctggaagttgggactttaacctgtctggtcccatgtcctccttccaggtactgtttgcctgtgctgaggccctgcatgcgcatggctatagcagtgaggcctcccgtctcactgtggagcttgcccaggatctgctagccaacccacccgacctcaaggtagagccgccccctgccaaggtgagagacccccttcctctaccttcccctcccccacttacccccaacctgctcccatgccccaccccaagtgagagcatccttctacctccaccaaggtaagtcagaatcatctgcctgtctcctgtgtttcttccctttctagggcaagaagaacaaggtatccacgagccgtcagacctgggtggctaccaacaccctgagcaaggcggccttcctgttgacagtgctaagtgagcgtccagagcaccacaacctggccttccgagttggcatgtttgccttggagctacagaggcctccagcttctaccaaggccttggaggtcagaggctccatctcagccttgtatttcagtctctttagagccttgcaccttgatctctattgacacaccagaggtctgagctccttcctgtgccctcaggtgaagctggcataccaggagtctgaggtggctgccctgctcaagaagatccctctgggtccaagtgagatgagtaccatgcggtgccgggcagaggaacttcgggaggggacactctgtgactatcggcctgtgttgcctctcatgctggccagtttcatctttgacgttctctgtgctccaggtatgatgcctgaccctacagtaagtggggaactggggtaggggtagctttctctaagaaagaccaagagccccaagtttctgaatcacctttaggacccatcaggcagcttcatgggtaggtctgtgatgatgaggattttgggttcccctgtattttttcccatgcatgatacttctgtctgcctgacttaccccaacttttatacagtggtttctcccacaggttcccggcccccaagtcgcaactggaacagcgagacacctggggatgaggagcttggatttgaagcagcagttgctgccttgggtgagtcttgagcatatcaacgagctaagcctggttcaggtcttgaaggacatgagacctgtgccttgttgtgaagggctgtatggtaatgggaaggtcaggatgacatgtgtgagccaactagtgcctgtaagacaggaattcagggcaaaaatgtgtgctatatggctgggcgtggtggcccatgcttgtaatcgcagcgctttgggaggctgaagcaggaggattgtttgagctcaggagttcatgaccagcctgggcaacctagcaagacctcatctctacttaaaaaaaaaaaaaaaaaaaaaaaaaaaattagccaggtgtggtggcacatgccttgtgctgccagctactccagaggctgaagtgggagaattgctttagcctggagattgaggctgcagtgaactgtgattgcaccactgccctctagcctgggcaacagagtgaaaccttgtctcaaacaaagaaaaaaaaaattgtgtgctatgggtattgggtattgtaagggcagcaaaacaaaaatctagagaaaggcctaagggaagtggtagaatatggaatgtgggttaaaagatcagtaggtcctaaaccagcgaacaccatgagtaaatacacaacgcaatcaagttttcatgagaatgaggaggccagcttccctaaaatgataagtacatgctgggtaagcagattggacctggttatgaaggttttgaaaagcacaccagagcttaggctggatataatagtcaacgaagacttctataggtgatgtgggttggaccaagggaaccccttacttcatatgctgatggcttgggaaccctggcctcttacctttgctgtcttgggaattatgactactctcaatccccataaggtcctctttctcgcaggcatgaagacaacagtgagcgaggcagaacatcccctcttatgtgaaggcacacgtcgggagaagggtgacctggcattagcactaatgatcacttacaaggacgaccaggccaagcttaagaaggtaagagactggggctgggtgcggtggctcatgcctgtaatcccagcagtttgggaggcagaggcgggcagatggcttgagcccaggagtttgagacaagcctgggcaacatggcgaaaccccgtctctaccaaaaaatacaaaaaattagcagctgggtgtggtggcacatgcctgtagtcccagctactcgggaggctgaggtgggaggattgcttgaacccagtaggcagaggttgcaatgagctgggttcacgccactgcactccagcctgggtgacagagcaagaccctgtttcaaaaaaaaaaaaaaaaaaaaaaggcaaggtactggggcctttgacaggcagagaaagagagcacattttactacctttctcagggagtttccagtacaatgagaaaagtgctattttaggctgggtgcagtggctcatgcctgtaatctcagcactttgggaagcagaggcgggaggatcgtttgagaccaacctggccaacatagtgagaccctgtctctacaaaaaattagaaaattagccgggcatggtggcgcgcgcctgtagtcccagctactcgggaggctgaggtgggagaattgcttgagcccaggagtttgaggctacagtgagctataatcataccactgcactccagcctgggcaacagagcgagaccctgtctcttaaaaaaaaaagaagaagaagaaaaaaagaaaagtgctcttctgcccataggaggtaagtagggaatcttggggacatctcataaagaataagagaagaccaatggttcttataggagtgcttgggcatggggtggaagaagagaagcagagggcataaagtcattcattcacttatttcagtatttattgactatcagtatattctgccctgtggtgttaatggaggataccaagatatgttggggttaaataagttacaaaaagacatgtaaaccaggaggtcatcctgtggttgtaagtggggaaggctccctgaggatgtagcaattggctgtttcaaggagaaaggaaggtaatagaagtcaggagctaaagggcatcctgtcactgcttctctggaggtcactgcttctgtcttccagatcttagacaaactcttggaccgagagagccagacacataagccacagacgctgagttctttctactcatctagccgcccaaccacagccagccagaggtctccttcaaagcacgggggcccatctgccccaggggccctgcaaccactgacctcaggctctgcagggcctgctcaaccagggagtgtggcaggggctgggccaggccccactgagggcttcacagagaagaatgtgcctggtgaggtgggggcactgggcaggggggatgaatggtgtggacctatgttgaggtcccctttcctgggctcatcccagcgtcctgttttcctcacctagagagttccccacattccccctgtgagggtcttccatctgaggcagctttgaccccaaggccagaagggaaggttcctagccgcttggcacttggcagtcgtggaggctataatggacggggatgggggtccccaggacggcctaagaagaagcacacaggtaggatagcctgtgggctagcatagagggaaggataatcctgaaggttggagtcttaacatctgggactcctgacttctgagactgacttctcttgggggttaggcatggccagcattgacagcagtgcccctgaaacaacatcggatagttcccccaccttaagccggagaccacttcgagggggctgggcccccacctcctggggtcgaggtcaggacagtgacagcattagcagctcttcttcggactccctgggctcctcatcctccagtggaagtcgccgggccagtgccagtggaggagcccgggcgaagactgttgaagttggcaggtcagtgggaagaactccccatcttccctgatctggcccaccctcagagccacacccctagtgcaatccaaccattgtctcccagcatcctcactttccctggtccttcccaacctacccggatgcccatttcaaagaaaccccaacccccgtccctaccccattgccccttcaggtacaagggccgccgccccgagagtcatgcccctcatgtacccaatcagccatcagaggcagctgcacacttctacttcgagctggcgaagacagtgctgatcaaggcagggggcaacagcagcacttccattttcacacatccatcttcctcagggggccaccagggtcctcaccgcaacctgcacctttgcgccttcgagattgggctttatgcccttggcctgcacaactttgtttctcccaactggctctcacgtacttattcttcccacgtttcctggattacaggtaaatcatttgacctgacttgggtatgggagggggattaattggtggggataagacccttatctttgtggggttactgatctgataaaaagacattattctcacaccccagtggtgcccacactaacccaactctgcccttctctcctttcccctaaggccaggccatggagataggcagcgcagccctgactatactggtagaatgctgggatgggcacctgacaccccctgaggttgcatccctggctgacagggcatcacgggcaagagactccaatatggtgagggcggcagcagagctggccctgagctgcctgcctcacgcccatgcattgaaccctaatgagatccagcgggccctggtgcagtgcaaggaacaggtatttctacgggcaatctgggaacctcttctggggcatctgggcagggaggttgggcatgggaaagctaagggcccagctcttgattcccgtatcctggagtttacagatgattgttggtcctctcatggcaacattttacccattaatgtgctttcacacccatctttcctttaccttacaactcaaaggttaggtttatttctattttacagataaggaaatggaggcctacggtttagggaccaagatgatcactcaggatagaaaacttagggaaggcctcatacatctaagacttgaatgggagggggctgttaaattagtttggaactgggactataacctgggtcttgactcattttggtcagtatttactcagtgtgtgaagcactcactgctctgataatggactctaagcattgacactgacctctgatgattccctgggaatgagacagctctgagggagacattggaatctcatctaacaccttccatgtggtaaaggcctttcccccttaacactctgtgcccctctcttccaggacaacctgatgttggagaaggcctgcatggcagtggaagaggcagctaagggtgggggcgtgtaccctgaagtgttgtttgaggttgctcaccagtggttctggctgtatgagcaaactgcaggtggctcatccacagcccgtgaaggggctacaagctgtagtgccagtgggatcagggcaggtggggaagctgggcggggtatgcctgagggtagagggggcccagggactgagccggttacagtggcagcggcagcagtgacagcagcagccacagtggtgcccgtcatatcggtggggtctagtttatacccgggtccaggactggggcatggccactcccctggcctgcacccctacactgctctacagccccacctgccctgtagccctcagtatctcactcacccagctcaccctgcccaccccatgcctcacatgccccggcctgccgtcttccctgtgcccagctctgcatacccacaggtgagaccagtgttctgctggggggtaaggcatgggaaaatactgggaattcatagggggttggagtgggtactctgggagtataattggtcagtcggagagtcctggtgaggtggtgggagtctgggggacccagcccaactaaaataagaaatgacggccgggcatggtggctcatgcctgtaatcccagcactttgagaggccgatgtgggtggatcacttgaggtcaggagttcgagaccagcctggccaacatggggaaaccccgtctctactaaaaattagctgagtgcacgcctgtaatcccagcttcttgggaggctgagatgggaatcacttgaacctgggaggcagaggttgcagtgagccgatatcgtgccactgcactccagcctggaggacagagcgagactctatctcaaaaaaaacatgtcaggatagcagcttgtgggggtgaagcacgacagcaacatcctaatcaagtttggcatcttcccctttcttctccctgcccctagggtgtgcatcctgcattcctaggggctcagtacccttattcagtgactcctccctcacttgctgccactgctgtgtctttccccgttccttccatggcacccatcacagtacatccctaccacacagagccagggcttccactgcccaccagtgtggcctgtgagttgtggggccagggaacaggtgaatggaggggaggcacactgggcaggggaggtggggagggaatgttctttgtctctctttgggctctgagttcctcacatggctctcaccccacttagtgagcagtgtccatccagcatccacgtttccagccatccaaggtgcctcactgcctgccctgaccacacagcccagccctctggtgagcggaggttttccaccgcccgaggaggagacacacagtcagccagtcaatccccacagcctgcaccacctgcatgctgcctaccgtgtcggtgagaggacatccctttctgtgctcctacctgcagttgtgccagtggctcttcagaggacccttcctctagctcttcatttgtttactgtggggtcaggtgacaggttggggtaaagggtgaagaggatacaccgtaccatgtgcccacccttatctatctcccaggaatgctggcactggagatgctgggtcgccgggcacacaacgatcaccccaacaacttctcccgctcccccccctacactgatgatgtcaaatggttgctggggctggcagcaaagctgggtaacacctcccctccctaggaccattgccccccccccacctgctctccccaccttccttatcccagacctccttcctagctcttgctcagagttgaggccttggtcgggtatgtgtgcgtgcgcggggggcggagggttacctcagctcctggggtggagggaggctctctgccaggccagagctgagatctgtaagttgggtccctagggcagaggtggccacccccgtctcatgcccctccccctgccccccaggagtgaactacgtgcaccagttctgtgtgggggcagccaagggggtgctgagcccgtttgtgctgcaggagatcgtcatggagacgctgcagcggctgagtcccgctcatgcccacaaccacctgcgtgccccggccttccaccaactggtgcagcgctgccagcaggcatacatgcaggtgacaacctagaattatggagcagggtggagcacttcctgggtggtcttggaccagagggaggcagggcctgtttctgtgctttgtactaaggctcatcctgcacacatcctcctccagtacatccaccaccgcttgattcacctgactcctgcggactacgacgactttgtgaatgcgatccggagtgcccgcagcgccttctgcctgacgcccatgggcatgatgcagttcaacgacatcctacagaacctcaagcgcagcaaacagaccaaggagctgtggcagcgggtctcactcgagatggccaccttctccccctgagtctttcacccttagggtcctatacagggacccaggcctgtggctatgggggcccctcacacagggggagtgaaacttggctggacagatcatcctcactcagttccctggtagcacagactgacagctgctcttgggctatagcttggggccaagatgtctcacaccctagaagcctagggctgggggagacagccctgtctgggagggggcgttgggtggcctctggtatttatttggcatttataaatatataaactccttttttactctagtcga

SEQ ID NO: 11383 - DNA, 207 bp, Homo sapiens
ccttgagtggtaactttatcttagtccaggtgattccagttgcagcagtagctaggtgccctgcgataactctctccccttgagggtttccagtgtgggaagttgtcatttaggcgcgccaaaagtggtctggcctctcgtgcttcttgagatcccttccgggctctggtctatcttgtctccttagctgggggcctacagtcatct

SEQ ID NO: 11384 - DNA, 2124 bp, Homo sapiens
aaacagaaaaataaggatgtttattaaggacatttctagcccacagctagggctcatactcggctctatgagccactgtccgacctcatccccattcaatgtgaatgacattagggaggccgggccacaggtagatcccactgcctggctaaaggggccatagcaaggggtccctcccatgcaaggggtctctcccatagccaggtatagaatagatacactgctgcggatgaagagggaaatctcattggactaatacattcccctacaccctgcctggaccctctcattcctccccacctcccaagatgatgggtcaaaggtacctagcactattatgtggggtaccaaaggaagcccctttatttgtcccagaactgtgggaaaaggatacccttcccttctcagccatctcaggcctgggggctactgaggtagagggggaggggccaggccactctaatcccccttgtgggccctgctctggacctgccccttagggaagcagggggcattttgctggtatgggaggctgggacatcagcccagactggaatgctgcagttcttcccgaagccacgagggcactggctgtccaagccggctcagcagcttcgacaactccaaattatggttccggaaaaaatccgtaaggaaaagacgggactgacaggagaaaatgaaggcagaaatggtaagaagtgggacacagaatcagatcctggaagtggagagggattcccctgcccctggctttacttacctcagtgtccatatctggatacctccggcctttgctccggcctagacagcgagtcttaccaccttcaagtccctggcaccaaaatcccttatcatcatcaaacctgctcaacaggaagaggccatgaggtggcagggaaaagagaaactcaagttccataaatgcacaatgcccttccctgcccacagggacatgtctctccttgtgagacagagtaaatctatgtctctaacagacatggtcaacctgcttccccatttcccatacagtactcctcccctgggtcatgctctcccacctgagggtccgtgtgtagttcagaaagggtgtgatacccaggaacttctggatgctctccattgaggctgctgggttggtacgcagctcttgcccatccacaatcagcaactaaaaggacagggatgtggttccctctatattcctaagaagcctctgggctgaagggaagaagaggggaaggggaaccccactgagggctcttgtggggattatacctgtccagaggggtagtaagtcagccagcgttgtagatgggtagaatagtagccagggacaagacagcggttctgcagggagcgtagtgccagaggggtctgggaggaggctgaaatcacctgatagaaggtatagttcagagcaactgggtctccatgggctcgctgatgctgaaggacaaagagaaggaaggtgaaggactggtgatttgacagtattctgcccttacgcttggtctggagacagacagcacagcacgggtacccgtccccaaggcactagttaagtttctcaaacctcactcctttctccctctctagcagtcactgtcccctcccccctccccccaacctttagcctgtgtgtccctagcttcaggcagacctggtaccaggagtaggccctgtcagcagggttggtgagcactgtgatgatcttggctcgtggcaggagggcagccccccgccgtggtacaacttcagagtcaaagtaggtggcacttttttcaaataggaaatcagtgctggcattggaaggaacagggaagaaatccatgtacctaggaagtagcacagaagagagagaagcagaaaaatatgcagagtgaagtggccagaagtctgtgctgagggaagctggaatggggtattttgggggaagggagtgttcctctgagaaacattcaaatggggcccagtctcaccagtcaatacccttgtggtaattagggctgttgaagaactgaatctcctcaaatgtgctggggctagggaagctgctagttacagctgggtgcaggctcaggaagaagtgaatagctgtagtccctaaatgggagagaaaga

SEQ ID NO: 11385 - DNA, 207 bp, Homo sapiens; identical to SEQ ID NO: 11383

SEQ ID NO: 11386 - DNA, 2971 bp, Homo sapiens
aaacagaaaaataaggatgtttattaaggacatttctagcccacagctagggctcatactcggctctatgagccactgtccgacctcatccccattcaatgtgaatgacattagggaggccgggccacaggtagatcccactgcctggctaaaggggccatagcaaggggtccctcccatgcaaggggtctctcccatagccaggtatagaatagatacactgctgcggatgaagagggaaatctcattggactaatacattcccctacaccctgcctggaccctctcattcctccccacctcccaagatgatgggtcaaaggtacctagcactattatgtggggtaccaaaggaagcccctttatttgtcccagaactgtgggaaaaggatacccttcccttctcagccatctcaggcctgggggctactgaggtagagggggaggggccaggccactctaatcccccttgtgggccctgctctggacctgccccttagggaagcagggggcattttgctggtatgggaggctgggacatcagcccagactggaatgctgcagttcttcccgaagccacgagggcactggctgtccaagccggctcagcagcttcgacaactccaaattatggttccggaaaaaatccgtaaggaaaagacgggactgacaggagaaaatgaaggcagaaatggtaagaagtgggacacagaatcagatcctggaagtggagagggattcccctgcccctggctttacttacctcagtgtccatatctggatacctccggcctttgctccggcctagacagcgagtcttaccaccttcaagtccctggcaccaaaatcccttatcatcatcaaacctgctcaacaggaagaggccatgaggtggcagggaaaagagaaactcaagttccataaatgcacaatgcccttccctgcccacagggacatgtctctccttgtgagacagagtaaatctatgtctctaacagacatggtcaacctgcttccccatttcccatacagtactcctcccctgggtcatgctctcccacctgagggtccgtgtgtagttcagaaagggtgtgatacccaggaacttctggatgctctccattgaggctgctgggttggtacgcagctcttgcccatccacaatcagcaactaaaaggacagggatgtggttccctctatattcctaagaagcctctgggctgaagggaagaagaggggaaggggaaccccactgagggctcttgtggggattatacctgtccagaggggtagtaagtcagccagcgttgtagatgggtagaatagtagccagggacaagacagcggttctgcagggagcgtagtgccagaggggtctgggaggaggctgaaatcacctgatagaaggtatagttcagagcaactgggtctccatgggctcgctgatgctgaaggacaaagagaaggaaggtgaaggactggtgatttgacagtattctgcccttacgcttggtctggagacagacagcacagcacgggtacccgtccccaaggcactagttaagtttctcaaacctcactcctttctccctctctagcagtcactgtcccctcccccctccccccaacctttagcctgtgtgtccctagcttcaggcagacctggtaccaggagtaggccctgtcagcagggttggtgagcactgtgatgatcttggctcgtggcaggagggcagccccccgccgtggtacaacttcagagtcaaagtaggtggcacttttttcaaataggaaatcagtgctggcattggaaggaacagggaagaaatccatgtacctaggaagtagcacagaagagagagaagcagaaaaatatgcagagtgaagtggccagaagtctgtgctgagggaagctggaatggggtattttgggggaagggagtgttcctctgagaaacattcaaatggggcccagtctcaccagtcaatacccttgtggtaattagggctgttgaagaactgaatctcctcaaatgtgctggggctagggaagctgctagttacagctgggtgcaggctcaggaagaagtgaatagctgtagtccctaaatgggagagaaagaccagcttcaggcagccattgtgggagggaagccagctcaacagcataagcttgaaggaagtgaaaaaataaccactctgggtaggaaaatcccctatggccaaactacaatgataggaggcaagtctgagagaggcccagggaagggctaaaacagtggttctctgctttaactgtgcaccagaatgacttgtgatcttgtaaaaacaccacagatgattctgatatacaaccagggttaggaatcactgcctcaagagactggatcaatgaggggtgggtataaaaggagttcctttttttctctcttaaaaattcaaattaaggccgggtgcggtggctcatgcctgtaatcccagcactttgggaggccaaggcaggcggatcacttgaggtcaagagttcgagaccagcctggccaacatggtgaaaccccgtctctactaaaaatacaaaaattagccaggtgtggtggcacctgcctgtaatcccagctactagggaagctgagcagaattgcctgaacctgggaggtggaggttgtagtgagctgagatcgtgccactgcgctccagcctgggcaaagaagtgagactcttatctcaaaaaaaaaaaaattattaaaattaaaaatacttttttcactcctgtgattacctggagagagaagagagttccttgacaaaaggatcctttgggtttaaggcagggcaagagaagttagctaaggatacttcacctgttttctggggtcccacaatgaggaacttcgggagacgatcacaggttttctccttggaccagatatctttgtgcctcttgtcatcacagggattctgaagccaggg

SEQ ID NO: 11387 - DNA, 1821 bp, Homo sapiens
cctcgagcctagtagttcaaggttgcagtgagctaggatcgggccactgcactccatcctgggtgacagagtgtgaccctgtctcaaaaacaaacaaaaaacacctttggagaaactgcagctctgtggacacccataatcccaagcagcatgcttggcagtgccctcctcccactgcttctgtctagaaactacacccacgtgggcactccccctacccctaaaaaaccaggccactccaaggaggaaattgtctcaaccagcatctcacagtgaggaaaaatctgcatcacaaattgcaggccaccatgaagtttctggagtaccactgccagcctcttccaggcttgggtaccccttcatcacctcctccagggagcttttcatgacttccccagaataagtcactatgcccatactgatgttcccagtcctgaacccactccttcagcactggcatccaggggctgtgaattttcacttccctgtctctctcatcagactccactcttctacgagaagggaagaatttgcatttattgtaaaatgctgattaggtgctaatcattcgacacccaccatctctaattctcaccacagttctgtgagccggatgttatcattcccactatacacactcaggtgaaatgacctgttcaaggtcaaatccaggtccatatggctcccaagcctgggcagcctctctatggtctgatggtgtctcgtcggctccataagccccactccctgcccacacccccagcacatcacttagaaaatgcccctgggttacagtgccacggtcagatgcacagatgtgtacacatggggtcacagtcactgacctggaaacaaagccactttgcccatgcacttatttctcagcgccagagaacccagggtgcaggaaggcctcggcacaccaccacctccactgccaaggcaacgagctggggccggcacgtggtgagcaagaaaggcaccaagctctggagctggacggaacaaggctcaaatcccagtggtaccaaccacacgctcccgggcaagtgatttccaatccctaagcctccccatttggtcatcataaagatcccccctgcctctggaggctgctacagtttgtgaaaaggagggtatacacaggctccgaataaacggaggctctcgtcccttctccgccttccctgtcactggctccagggtctgagagagcagcaaccttgtttctctggtctgtaaaatggtctgtttctttctggctccactgcgctatggaaatcgtggggttgcggggaggctgcagcttgtcatccagcccccaggcactgactgcagagatcccacccctgacccccccagactgggatgccaggaggggcagaggatctgcacttctgagctgtgtgccttgagccaagcacttgaccgcctgtgctccaggtcccctagctttgagcaggggctaacggaagaacctgccttgccaggttgttgtagtaaatgagtcaacacacgtttcacacttagcacagtgcccagctcccagtaaatgctcaatagatggaagctatgattagtcatggaacacggcctttctgctgtcctccctgccatggaaaatgggtaactcagctggagggcagttcctctgtgtagactggccaaggccccggggatgaggcagggtacctgggtgccaaaccagccccctctgctaccaatgctcggcaacacaccgacagtcaagacacacaggaggacgtcccatctcccttgtatccaattcggcaccatatcccagtgcctggcacaagacct

SEQ ID NO: 11388 - DNA, 1821 bp, Homo sapiens; identical to SEQ ID NO: 11387

SEQ ID NO: 11389 - DNA, 313 bp, Homo sapiens
tttctttttttttttttttttttttttttttgagacagcgtctcactctgttgcccaggctggagtgcagtggtacaatcacacaactcactgcacctccacctcctgggctcaagcaatccccctgcctcagcctctggagcagctgggactataggcatgagccaccatgcccagttaatttttaaaaattattttttgtagagacggggtttcaccatgctgtccagcaggtctcgaactcccgggctcaagcaattctcccaccttggcctcccaaagtattgagatgacaggtgtgagccaccgcgcc

SEQ ID NO: 11390 - DNA, 313 bp, Homo sapiens; identical to SEQ ID NO: 11389

SEQ ID NO: 11391 - DNA, 21501 bp, Homo sapiens
gaggctctggtcataatggcgaccacacttttattgaatatctgttgtgtactgtccaggtcttcacatttgtcacctcatttaattctcatgttaagcctgagtggaaagcattatgaagcccatttgaggaaagagaagagtgaagttcagaggcaaaagtcatctgtccagggtcctttgccaaatgacagctggcatggaaccctcctaaggctgattcctctatcctccttctcctaacagcacttcaggggcaaccttctcctctatcttttctccactcaccatcaaagaagccctcaatttcccaggattctaggacatttccctaaggtgggggtggtgggacaggtagtaagactgatgccttttaactttccaagacctttctttatttcctgagatgaataaataagtggcaatggggtgtggggatgtggtgaacacagaacaggaactggcagcatgcagctggcaggagggagctgtgatggccccacccctgtgaggaccacctaatcctaagcaggggccaaagctctagcagccaccattaaggaaaaacttttgaaattcacacattgtgaagcctgccagtccccgccaggtgaagagctcatggtatccaccttcagggctactttttaccccaggggccttgtctgcccgggcctgggtacctgggctgctctgtaaggcaggtaggggtgcttaccccactctcaaaaataaaccaagctgtcctgagtgtccagcaggagggcagcccaagctctgggggcagcgtgggtgggaggaggtcctacaggtggtggccgcgattatctgcccttgatgaagccctccagcacacggtcactgcgctctgacaaccagtagccagtcatggccgccacagccccaatgaagatggcggtgaacaccaagtcgcccttagcagccagcgtggccagtgcacagatgatgatgccaaagaacatctgctgcagcaccaccaactcgtcttctgtcatctctgagaagaagcctgctgactctgcagaggagcaagagatgcagcctggcactcgtatccctgttcctggtagttcttggagtctccccagaactcccacacacctgatcatcatggccaccaggcctgcccagcaagccaggcacactacatttactgctcaaaaccaccctgcaaggggcagttaccatccctgtctcactaaatgggaaagtgaggctcagagaggtaaaggggttggacttgccaaggccatgtggtggacaagttgggggcagagcatttattacgtgtatgagtctcgttccacggtcagactgtctggattgggatcccagctttgcgacttgcttgccatatagccctgggaaagtagcttcatctctctgcatcttcatttttacatatgtagagtggggatgagaacccaacttccagcgtcgggttgtttcaggggttaaatcagttaagatggggaatgcacctagaacagcatctgacacagtaattgctggggaaatggtccctgccatcatcgttgtgattaccctgcatctcaccacacccccggcctaggacagctctcagcaggccagggcaaacactggtcccattggatagatgaggaaacaggttaaggaggcagactgatttgatgccaggtctgattccctttgtaccctggaaggtataaggctgctgagagccaacctggagatcagatgtagagcccggtctcagtgcagcctccagggggctgggtggcagtagggatggggcagggcctggagctgccactgctacctggggaaggggcttgcctgccttctctttgaatgaggacctcccctctcccgccccagggctcacctgggatctgctccttcacacagatgccttccatctgcttgtagccctcggcacagatgcagcgataaccgccctcggtgttttcacactgcttgttctctcccggacacacctctgtctcacactcatccacatcttgaggggagggaggggtcagagtcctgctagggccccccacccagcaccctgactccatcttgtccatctctcaacactcccctctgcccttgcccaggcaacattccacccttccttcccccacctgcccatattccagcctcttcaccattcatgctgggtgaggcactcccaggtgcctgtgtcccatcagcaggagactcaccgagacacttggagcccacctgctgatagccagggctacacttcttacagcgacctggccctgcccccatgcagcctaggcaggccttggcacagtctggagagaggagagaaagatgagggtgagatgtgcacctaggcccaggggagccacgctccagaagcggaggcctgggggtgctctgaagcctgagaaggggaaggtttggagggacaggtgtggagcagctcttcctccactcctcacgtcccctcctctgcagaagtagacactgacctcggcactcataggagccctcagtgttcacgcagaattggtcagctccacagttggctccctctgtgccacactcatcaatgtctgcagagaggtgagcagggtgagaatttcaatccctatttagtagggaagctgaagccagagccgttggggaatggtcttgcctgggattaaatggtatggcagagactgcaagctgtctaccaacacagaagcagactagctggacttcaggctgcccagccagagaccacatttgccaacctgtcttgaagctaagtgtgtccctgtgattgagttctggccaacaggatgtaaacaggagtgatgagctccaccgttagcttggtcttaaaacaatgcttggactcctcaatgcactttctttcccttctcccttcctgagtgctggcatgtgggacacagagatgcccaggactcagcttcaaccatgcagacaacgcccaaggggatgattgtgcagtaagttacaggaataatctgggtactggaatgattatgactagcagagctcccctgccagcctggactactcactttgggactgtaatatgataaaaaaaaataaacctctaccctctagattcttttttttttttttgagatggagtttcgctcttgtcacccaggctagagtgcaatggtgtgatcttggctcactgcaacctctgcctcctggattcaagcgactctcctgcctctgcctcccgagtagctgggattacaggcacctgccaccatgcctggctaaatttttgtatttttagtacagacagggttttgccatgttggccaggctggtctcgaactcctgacctcaggtgatccaccccacttcagcctctcaaagtgctgggattagaggcgtgagtgagctaccacacccagccaacctctatactctttaagccacagtcttttggggatttttgttacagcagcttagcctttactttagtctatataagtggctaggctgggaccaaaccaagtcttgaacccaggtttcctgaccccaagttcagtgtcctcattctcctagccaacccttcctcatttttttttttttttttttttttttttgagatggagtctccctctgttgcccagactggagtgcagtggtgcgatctcggctcactgcaagctccgcctcccaggttcatgcccttctcctgcctcagcctcctgagtagctgggactacaggcacccgccaccacgcccagctaattttttgtatttttagttgagacagggtttcaccatgttagccaggatggtctcgatctcctgatctcatgatctgcccgccttggcctcccaaagtgctgggattacaggcgtgagccaccgcgcccagccccttcctcaatttttaggacttggccaaagtaacgcctcctccaagaagcctttcctgattccccatcaccacttccactgaactagatcagaggcatctctcactgtacacagggactatactacacagtacctgtgtactggactgtaagtatctggttacttttctgccttcccagccaggttgagatctccatgaaggtggagactaggctagtctagcccaggcttgtgttgagagaataaaggaccaagcccaggcccctgaccatcttcccagacctagctagggccccacttacctacacacttgaggtgatgcagggcccagcccttcttgcattgcaaacagtttgattcctcaggtcctgagcatcgggcacaggggccaaaacaagctgggtggaatgggggcagcatgaggatgggcaggcaggtgccccatctgcccctgcccagtgccacaccttttggctacctacccgaacataccagatggctggcgttgcgttctgcctcaaagtagccaaggccacactggccacaggcctcacccccgtagccggcttggcagtcacagtgcccgctgccccctcgtgtcccttctccttcacactgcccgtagccaccgcagggcctctctgttcccccaggacaggctgtgggaagacaccaaaccaggtgaggtcatctatacaaccttgatatacaagataatattttctccctctccctctccctctcccttgccttccctccctccccccctcccctccccctccccctttccctctccctctccccatggcctccctctccctctccccatggtctccctctccctctctttacacggtctccctctgatgccaagctgaagctggactgtactgctgccatctcggctcactgcaacctccctgcctgattctcctgcctcaacctgccgagtgcctgcgattgcaggcgcgcgccaccacgcctgactggttttcgtatttttttggtggagacggggtttcgctgtgttggccgggccggtctccagctcctaaacgcgagtgatccgccagcctcggcctcccgaggtgccgggattgcagacggagtctcgttcactcagtgctcaatggtgcccaggctggagtgcagtggcgtgatctcggctcgctacaacctccacctcccagccgcctgccttggcctcccaaagtgccgagattgcagcctctgcccggccaccaccccgtctgggaagtgaggagcgtctctgcctggcggcccatcgtctgggatatgaggagcctctctgccaggctgcccagtctggaaagtgaggagcgtctctgcccggccgccatcccatctaggaagtgaggagcgtctctgcccggccgcgaccccgtctgggaggtgaggagcgtctctgcccggccgccctgtctgagaagtgaggagcccctccgcccggcagccgccccgtctgggaagtgagaagtgtctccgccgggcagccagcccgtccgggagggaggtgagggggtcagccccccgcccggccagccgccccgtccgggaggtgaggggcgcctctgcccggctgcccctactgggaagtgaggagcccctctgcccggccaccaccccgtctgggaggtgtacccaacagctcattgagaacgggccaggatgacaatggcggttttgtggaatagaaaagggggaaaggtggggaaaacactgagaaatcggatggttgctgtgtctgtgtagaaagaagtagacacgggagacttttcattttgttctgtactaagaaaaattcttctgccttgggatcctgttgatctatgaccttatccccaaccctgtgctctctgaaacatgtgctgtgtccactcagggttaaatggattaagggcggtgcaagatgtgctttgttaaacagatgcttgaaggcagcatgctggttgagagtcatcaccactccttgatctcaagtacccagggacacaaacactgcggaaggccgcagggtcctctgcctaggaaaaccagagacctttgttcacttgtttatctgctgaccttccctccactattgtcctatgaccctgccaaatccccctctgggagaaacacccaagaatgatcaataaaaaagacaaaaaaacaaaaaaaacaagataatattttctgctctgcatatcagtaaacatttttggagaagaaaattaattttaatgacataatattttgtcataaaactgacatttacttaaccaatttcctcttgtggaacaattagattttacagaccttttatttatttatttatttatttatttatttatttatttatttatttttagtgacagggtctcgctctgtttcccaggcaatgacatgatcatagctcactgcagcttcgaactcctgggctcaagcaatcctcccacctcagcctaggggaacaacaggctgcactaccatgccccactattttttttttaagagacagggtcttgctctactacccaggctggtctctcaaactcctggcctcaagtgatcctcctgcctcagcctcccaaagtgctgggtttacaggtacgagccactggaccaaatattttcttttttttttttgagacagagtctcgctctgtcgcccaggctggagtgcagtggcatgatctcggctcactgcaagctccgcctgccgggttcatgccattcttctgcctcagcctccagagtagctgggactagaggcgcccgccaccatgcccggctaattttttgtattttttagtagagacggtgtttcaccatgatagccacgatggtctcgatctcctgacctcatgatccacccaccgcagcctcccaaagtgttgggattacaggtgtgagccaccgcgcccagccaatattttcttttacaaagactgaatttgccatctttgtagctagctctttatctgtagcttcaggaaagactgctctaaaagaggctggtagtaagttcagctcttgtgccaggactgtgtgtgaggatggatggcgatcatggaggctccaggtcagcacccgcccctccccaggaaggtaccatagtccgatctggcatgggaaatgaaggggctgggaagtctatcatttctttagtacatgatgataactatactgcatatgactcagtctagcccctgtgctttctccaagcctttccccactgatttgcccatctccccagccctgtcaggcaggcaagaactgaggtccagagaagtttatctgagtagcctgagttcacacagcgaactagggacagagccaggactggatccctggactcggtggtcccctcccatccccaagagcaacttaaaaactcacgaaggcaggagggcccgaaggtgcctgcggggcagcagagcttcagggaatctgagcacagccactggaagaggtccggggcctcctgctgcctgaggcaggggcagggtggagggaggtggggaggaggtgctgagatagtgtcataagtgctgttcccattcccccatgcctgaatctgtgattcaacccagcttggacataagacccaaaaggccatctgaccaatgccctttccccatttggcagaagggtaaactgaggctcaaagtggagcgcaagtcccccggcaagttcttagcagacctgggtttggaaggagcacaaccaggacatgggccccagcatgcacccccctgcttctcggccaaatcaggccttatcaccaggcctcacctgtgacccacttccagggaaggccctttgccactcacttgtgaaaccaccagctctccaccagctcctcactcagctccagcaggcggtggcactcgaagtctgacttgctgcacacaccctccagcacctctaccaggcgggtctcactgatcggacagggcagggctggtgggaaacatgccccaccccacccaccaccctcctcaagtctctctccacccttcctcgtgcggtgaaaatatcaaaggagaggccatgaggtataatggaaggggtcatggttctgggaagcagagagacctgggttcaaatctagtggtagatctagtgggcaagtcacttaacctctctgaacctctttgttttgtcatctgtaaaatggggatgacaataccttccctgcaggtttgttgtaacatacatcagttcctgcatctgagcaatggaatataatacccttgctgggtagatatggctaaaaatacatcctataacaagtgttggcagggatgtggagaaattagaatcctcccacactgcaggtgggaatacaaaatggcatcaccactgtggaaaagcagttcctcaataagtaaaacatggaattgccataggacctgccaattccactactggatatagacccaaaagaatggaaaacaggtgttcaaacgaaaacttgtagacaatgttcatagcagcactattcacaacagccaaaaggtagaaacaatgcagatgtccatcaactgatgcatggttaaacaaaatgtggtacagccaaatgagaatattattcagccataaaaaggaataagtattgatatatgctacggtatgggtgaaccttgaaaacattatgctaagtgaaactagccagacacaaaaggccacatattttatgattccaatgaaatcagcaaatccataatttctgcttgactaacacaaattagtgattgccaagagccgagggaaggggagaatagggagtggctgtgtaataggtataggattttttgggggggtaatgaaaatgttctggaactacatagtggtgatggttacacaacattgtaaatattattaaatgtctttaatgggaaattttttatgtgtattttaccacaaatatatacatatatatatatatatacgcatatatatacgcacatatatatacgcagacatatatgcacatatatatacacacacatatatatatacacacacacatatatatacacacatatataaatatttgatgtcttatatcctgtatttaaagggtctggcacagtgcctggcatataggaggtgatttaaaaaagcaagcaacgcaggagccattacaaagctggaagtgcctctggggttgtcttagccaatcccctcattcctgaatgaggaaactcaggcccggcgaaggaaaagagaaaatgaccaatgttacataataacaaaacctttatttctagtgggcatcccagttaagccttttccacacttctatgaaataggcaaaccaggtattaatatccccattttacaggtgaagaaactgtggctctgagaggttaagaaccgacaaccaggtctaactctgagcctttgctgactcctcttccatctgactttgaaaagctggagggctcagggctcgcctttctgtatccttcccatgcctttctttacatactgactatataaatggctttctgtattacatatattgactatataatggctttctgtatccttcccatggctttctttacatactgactatataatgacaactctcaaattcctgtttccaattcctactcttttctgaattccagatttgtatggagtctacctggatgtctaatggacatttcagcccaatacgttcaaagaacaccacatcccacccctcccctaaaccttctcggtttcgcatctcaccatcttagaaaacagctgcactactcacccagttgctcaggcccaaaatctagtaagcatcttttattctactgtttctctatacccataatgaatctatcaccaggtcctattgttctctctgcaaaatatacccagactgtgacctcttcatcatgtcctccactagataccacactagcttgtgttgcctttgtacctagatgatgcacttgcctcccaaactggtctccctgcttcctccgcccttgccccttacaatccgtttgctacatagcagtgtgagtaatctttaaaggtgtagagaagacagtatcactttttctgctcatagccttccaagagcttcccattacactccaaaaaaaatctaaactcttttctgtagccctcgaggcttaagcctttgccttcaccttctagcactctccccttggctcactccactccagccacttctcaaatacaccaagctcagtcccatcctctgcccaattccctccctgtcacatagctcgcttcttcacttcctgtctctctgttcaaatgccaaaccttgaacaccttgcctcccaccgtcctgcagtctaccgtgcttcactgtttgttcttcatctgacataatattattcacttactcattcactgcttgtcttctctactagaatgtgagctccaggaagggggcattttgcttgccttgtttactgctatactatagatgttcagtgctatttgttgaatgaataagtgctccccaagagttcctagccctacaccagcagagcagagatttggcggggaggggaatatacaccccttcccccagcagccccttacctgtctttgtatttggacaaattctcttcctcccaggcagtgtttccacctccaaagttgtcccggatggttctctccaggccctggaaacagaaaattagtaatagctaagtacagtgcctggcacatgctagcacttcactgttctactgactaggaaactgaggcacagaaaggcaacctgcctagggccatacaactagtaagagaccaagatgaaacttaaatccacgcagatttgcatcccagagttccccactctaaatcgctgtgttcccctctaacgaggctgccggtgcacccaccttgttaaagctgtcaaccagtccccggcaggtatgacacggatggggctgaggcgggggagaagactggggaggtggagagggctggagccagataggtcctgggaggttgaggaagaggctgaggccccagagcacagctgggactaggcccttcgggggccatggggccatctttacccaggctggggacctgcagatagagggcgtggagaggcttcactgaaggagtcaggccccacgcgagaaagaaaaaggtctgttctaaggtgccgtggcgctgggatctgcgttattacaagcaaaagaggccaaactgggtattgcaggggctgtggggatgggtggggaaaggcgcataagatgcaattccagaagagaaataagttatcctcgctagcatggggtggagaggaaagtggcctcgctccttgacaagggggcagaagtcagcctcttgtctgagggtctgataaagaatattaggggccggatccgcagaattagggagaagagatcagattccaagtactgaaggagaggaggccagaggggttgtcttgggggaggtgtccggaaccccgggcttggagggaggagcccggatccggatatgaagggaagggatcagattcagggcctcgcagaagggcaaaggcacggcccacgagccggcagagaaggatccagaccctcgtaggccacggagaaggaagaagcgaccgccccagcccgcgggcgccgtgggccgtctcctcaccgcgtcgctgccacagcctgcgtaaaacgcacaacccccacccgcgccgcagtccagggggcggagcttgccgcccagccaatggcgacgggccatgtgccattacgtcaccccacgccagccaaccagaggcggcaccgagctgcacctgtccgggctttaaagggccgcggggctagggaacgacgtttgccagccccgccactgaaacggagacgcgtgtgggccacatgggtagaaaaacagcgtctgcctttatttaagtcccgtcccccgccccaggtcccgcccctggtcccaccccgcgtcccggcgcgggagtccccgggggatggaagtagctatccagggctggctgaagggcccgggacacttgctccgctctctcttggagccgcccggaacgcggggcgcgaggctgctgcagggcccccaggaagtctggcagttgggagggcagtgtgaagacgggcacggtgcggaaaagggcgggtacggcgtccgggtggagcagcctgtcgaagcaggcccccacgtagctgccgggcgcccggccctgcaagaagtcgggcagcacgcagctgagcgaggcgcggaaggcgtcgtgcgggccgtgcgccccgggcccggacaccccatcctgtagccactcgctgcacagcgccaccgcaccgggagagaagagcaagaccaccacgccgccctcctgcagggtctggcgccgctgcgcgtgaaaccaagccacgggcccctgcgcgctcagttcacgacggctccacaggtctacggccacgcgcagcggcagctggcacagggccgacgccagggcgcccaccaggcgctcgaaacccgagtcatcggctgagtagaggagcagagccgcgcggcccctggcggccgctgccggagaaaacagatggggagggaagaggtgagctggcacaggcctggctccccgggggcggccctccgcccagcgcttgctcccactcaccccccgagcggacgtcctgtttcaagagcctcagccaccctgttaggggagaggggcggaggcagccagtgagctcggccgccgctttccctcggagaactcccacagccactctggtcctcccccaggggaatggggagccgggaagcgctcacctttcgcgtgatcctttttgagaaggaggatgagggaaagcgcagcggcaaagagtaggcaggccagccacacgagggcccagcgcttgtggatgtctgggagacccagagaagaagagttagaaacttaccctccacagagaagaaaaactgagacttaacagaaatgaattgggccgggtgcggtggctcatgcctttatataatcccagcacttcgggaggccgaggcgggcagatcacgaggtcaggacatcaagaccatcctggctaacacggtgaaaccccgtctctactaaaaatacaaaaaattagccgggcgtggtggcacacgcctgtaatcccagctactcgggaggctgaggcaagagaatcgcttgaactcgggaggcagaggttgcagtgagccgagatcgcgccattgcactccagcctgggcgacagggtgagactcctctcaaaacaaaacaaaacaaaacaaaaaacgaagaaatgatttgcccagagtccacagcacagtgtcagagccagtggatgaatatagctccatctgtttaggggtctttgaataagtaatgtcaccctctgcctcagttttctcctctgtaaagttgtacctatgtcatagggttggtgtgaggactaaatatattaatacatataaagcttaacacaatgtgttaatacatacttaacacaatgccgagcatcttaagtgctaaaatgtcagctgtttttctcccctaagctagggttgctgggcccttgatcttgctgtcctgggtgtctgcaactacctggtgtccctgccctgtctttttttttttttttttacctccaattgatttgccttgaattgattcatgacagcctcagagatcttttaaaaatataaatttgggccaggtgcggtgactcacgactataatcccagcactttgggaggccgacgcgggcggatcacgaggtcaggagttcaagaccagcctggccaagatggtgaaaccccatctctactaaaaatacaaaaattagcagggcatggtggcaggcgcctattaatcccagctacccgggaggctgaggtagagaattgcttgaacccgggaggcagaggttgcagttagccgagatcgcgccattgcactccagcctgggcaacagagtgagactctgcctcaaaaataaataaaaaaataagtgtatatatatatatatatgtgtgtgtgaaatatataaaaatttgatcgtagctcctgctgctctcaacataagatccaaatcccctacatgtctcctgcatctttatctcatgacagaaacctgcctgtccaagaccctgtatctctacccccttcccctagctcagtcttcagagttttgctggaaccttccccctgagcccctcacccctcaccccacccaggtcaggtccacattgtatgcatttacagcactgaacacttggtggtgcttcagtagctcccactttaaatgtaagtgactggctcatgtcttgctagtcttctaggggtggggcgggggcaaggatttatatttttggtgttcctgcgatccctgcaagctctcatcattttttgagtgaatgaaggaatgaccctctgtttatctgatctcagggaaggacaaggccattgcatgtgctgtgcccaagagtggtccctgtcaagatccccactcctggtacagaaaggaaaggcagttcttacaatactcacatttgtccatggggcaggcccatagcgctcccaagtcatcgtcccatagctgtaagatacaaacagaaccaaatccagggcaccagccaggtgttccaatattcaccaagctctggtggcctgatctccaaatttccagcatcaactatgcatatctcccggctaaggttcctgcagctgctctgcctttgtgctgtgcccactgactagggtatgacttcttccataccaaatctggcttataggaagaaattcttcccggaagctctccctggaacccaaaacttagcacctgtaggtgtggttatctgtttatgggtgtctagccaacagtgtgctccttggggataggaactgtgcttcttctactcttaactttcccagggctgaacataaaataagcctaaatagacagtaggtgagtgctagttttaggcctgttgcccctaggcattgaggtggggcccttcttccaccagctcacctgcagacactggcctgactgcaggtcttgtagtaagtactctccaaggcgagctgccctctgccaagccaaaggatgggggcactgttacctggaggtagcacccttagggcagcacctaccaggctacagctgggtagaatgaggtagaggggactgggagactttggtgatgccgctgaatatggccctggtctgagtcaccccccatgttcccagagaccggcacagggtggatggagtgaaaatttgaggccagatgtgagatgcatttggagagatctgtggaggagggtcgcccagtcctaaccgtggaggctttgctgggtagtgaagtacagccactgggttccaaggcacagagggatctgttgtcctgggggcctcgtgtctccaacagtagcacatcgtctttgagaggccccagggagtctggaaggggtgagaggccactctgaccaagacccatccttgctgggattggccacttgcctgcctcccatgccctgaccttcacccctaggaggtggccctgccccagctgcccccaggcccaactcaccagcccacaagcactcctgcagctgcagcttctccgagctgttcacctgctgggaagagaccatggttagggccactaagaaaagcaaaagccaaaggcagaaagaccagaatggggcaggcaacagaaggcctgttgggttgggaatctgcactcaatctgacctgaggcagatgtggattcaaggctgggtgattaggaatcactacatctttctctgccccagccttgtgagatcatctgtataaagcgtcttctgaccctaaagctgtttttatgtcttacggagcatggttcccctctcatctaaccttctcaaagagattcctttctcacatgaccaccctgctaaaaattgcaaccccagtcccaccttatccctttcccatggtatttgtatgcaattttaagatactatatgatttatttacaatgtctgttgcctgcctttctccattacaatataagttctatgagggtagagatgttagggtctatcacaagtgcctaaaacagtgacttgtgctgctcaaaaaatcttgaatgagtgaattttttttttttttgagacggagtttcactctgtcgcccagtctcactctgtcacccaggctggagtgcagtggcgccctctcagctcactgcaagctcagcctcccaggttcacgccattctcctgccccagccttcctagtagctgggactacaggtgcccaccaccacgaccggctaattttttgtatttttagtagagatggggtttcaccatgttagccaggatggtcttgatgtcctgacctcgtgatctgccctcctcggcctcccaaagtgctgggattacaggcgtgagccaccgcgcctggccggatgagtgaatgttcttataatcaccctttgaaactgtagagcaacccattctacaggtatggaaatagaataaggatagcaataataaaagtggctacatttatggagcatttagtctgtaccgattcctaaggggaagcacttctcttatttcattgtcacaaccactccatgaggtagttactgtattatcatctgcattaaacagatgaggaaactgacgttcagagaggtgaagtgagttgcccagggtcccgcgcactactaaagtaggcagtggaactcccatagaggaagctggcaaccactatgctttagcggcccaagaactaagacccccttggctggggggtctgcccaggtccagcctccagcccagcactatgcacccctttctgacctgaacacagaggttagggtggcctttcagcaatgggaactcgagaaccttctgtggaaagagaggaatgggtgggatcacaaaaggggacccccggttccccactctcccctcaccacgggaggtgccctctgcttcacttacgtccacagtgacgttctcccaggaaagcggtgggaccagtggctggcaggggtccccacccggagcccgccagcacagtgccgcttctgcgggcagcgagcacggtgcgtccagcagccagctctgcagggtcagcagtcgcagtcgggcggcttgccagaggttctggtgtgcgcgggggtctgcaaggaaagggcacagtcaccgcaggccaggtacccatcgctcgcaacaccccaaccccagccccaggccggtcggctcaccctccctgaaggggcagatgttcgtcctaacggagtcaggttccagaggccacacctggaaaggaaatgggggtctgctcaggtcccctccatgggcatgtgcctggccctctgctggacagtggggatgcactcattcagcaggtatttcacaaacacttgctgggtcttcctgccttttacaaaacctggaggtgctcacatctattcttccagcaaacataatgctgggcactggcaacatcttcattaacaaacttttttttttttttgagatagagtctcgctctgtcgcccaggctggagtgcagtggtgcaatcttggctcactacaacctccacctcccaggttcaagcgattctcccatctcagtctcctgaggagctgcgattacaggaacatgccacaacggccggctaactggttaatttttgtatttttagtagagatggggtttcaccacattgatcaggctggtctcgaactcctgacctcaagtgatccacccgtctcagcctcccaaagtgttgggattacaagcgtgagccaccgcgcctggcccattcaacagacttttaatgagtgcctaccattgtgtcttagcagtatggcaagcacaagagaccttggataattaaatttttattatttttttattttttgagatggaatctcactctgttgcccaggctggagtgcagtggtgtgatctcagctcaccacaacctccgcctcctgggttcaagtgattctcctgcctcagcttcccaagtagcagggactacaggcgcacatcaccatgcctggctaatttttgtacttttagtagagactgggtttcactatgttagccaggctggtctcaaactcctgacctcgtgatccacccaccttggcctcccaaagtgctgggattacaggtgtgagccactgtgcctggtggataattaattttaattcattccacaatcactttgtaagcacctgctatgtgttggggaatgtgctaagttctaaggacacattcatttattctttcaacagacatttcaagagtgcctattatgtgcatagctctatgctaagcactagaggtaatacattaatttatccatcaagcctttagttaggaacaccgactatgtggcaggcactgtgtttggcaatgaagccatttaaatcacagcatacatctcatgaacatctgctgtgtcctatggctgtgttaggcagtaacatttattcactcattcaacagtgaggacctcatactgttaccttgtttaaaaacaaaacaaggctgggcgcggtggctcacccctgtaatcccagcactttgggaggccaaggtgggcggatcacgaggtcaagagatcgagaccatctggccaacatgctgaaaccccgtctctactgaaaatacaaaaattagccgggcatggtggcatgcacttgtagtcccagctacttgggaggctgaggcagaagaattgcttgaatccaggaggcagagattgcagtgagccgagatcacgccactgtactccagcctgccaatagagcgagactctgtctcaaaaaagacaaaaaaacaaaaaaaaaacaaaaacacaaaaaaacaaaaaacaagtaggcgctatgtgcaaggctcttgcaaagctattacatttgaattagatatgatttgcttgccttcaaggaaatcacaaactcacacttgtagtaaggataaaatatttatataaattagtaaaacactcattcatttcataatatttattgagcatctgttgtgtacaagaagaaattagatgcccaaataagaaagtaagtgattgagctgggtgtggtggcccatcgccacaaaacattaaaaaatgaaaacaggctgggcacagtggctcacgcctgtaatcccagcactttgggcggccgaggcgggtggatcacgaggtcaggaatttgggaccagcctgaccaacatggtgaaaccctgtctctactaaaaatacaaaaattagctgggcatggtggtgtgtgcctgtaatctcagctacttgggaggctgaggcaggagaatggcttgaacctgggaggcggaagttgcagtgagccgagatcacgccactgcactccatcctgggcaaaagagtgaaactccattaaaaaaaaaaaaaaaaaaaaaggaaacaattagccaggcatggtggcgcatgcctgcagtcccagctgcagaggctgaggcaggaggatcccttgaacctgggagcttggggctgcaatgagacgtgttcatgccactgcactctaccatgggtgacagagcaaaatgctgtctctaaaaaaaaaaaaaaaatttaagaaaataaaagaaatgaagtgataaatggacaaggaaagatagaagtgcaaggggatttggagctaggagaggccgggtggttggggaaaagctttgggaaggaggtgagggcatttgaggtaatgggaaccacctgagaaaaggcagggagctagctgtatcttggtaagtagctccactggatgtaacaatgttctcatgaaggggaatcatggggaaaatagagtgaaaaggcaccgttgggggcagaatatgggcccagaatgccaggaaagtgatgggaagggaggggagcttggaggtgttgaaacagtctagaaaacagatgatagagccctaagctggactgagatggagaggagggggaaagaaaatgagagacattaatgtcagaggtaagatggatgagacctgatgaccaattaaatgtgcaatcagcggctgggcacagtgggtcatgcctgtaatcccagcactttgggaggacgaggcttgtggatcataaggtcaggagatcgagaccatcctggctaacacggtgaaaccctgtctttactgaaaatacaaaaaattagctgggcgtggttgcaggcacctgtagtcccagctactcaggaggctgaggcaggagaatggcgtgaacccaggagaagcagcttgcagtgagccgagatcacgccacggtgctccagcctgggcgacagagaaagactctgtcttaaaaaaaaaaaaaaaaaaagtgcaatcagggcaagccacagtggctcatgcttataatcccagcacttggtgggaggctgaggtgggaggatagcataagcccaggaattcagaacagcctgggtaacatagcaagaccccgtctctacacaaaacaaaaaaaaactagctgagtatggtagtgctcaccagtagttccagctacttgggaggctgagacaggaggatcacttgagcccatggggctgaggctgcagtgtgccatgattgtgccactgcactccagcctgggcaacagagtgagaccttgtctaaaaaaataaataaatgtacagaggaagaggaaagagccagcatatttaagcctgggtgtggcacacattcttataacagccccatgaggctgttactattattattcccattttacagatgagaaacaggctcacagaggtgaagtgacttgcccaaggttacacagctagcaaatggcaagagccaagattcaaaccagtccaagttcgtagcacatgctctgcccgccaggggaacacaaagacagaactggaggagtagggaaaggtttcaaggagaaggtgacatttgaatggggccatgaagaataagcaggagttctgtggaggatcagggagagcattcagggaatgtaatagacagaaggcataggacagcaagggtcaagggagggccagccaccccagggagccacagtctccacctcaatgaagggtttgaagaatggtgagaccaggaaggcagggatcacccccatcatcatcttcccactcctcttctggcacccagctagactctgctcctacctgaatacagaggcagggaaccaggtctgtgtggttcaaggtaatgatctgcggtccagtctgtggaacaaataaaggaaggaggttggagaagataaggaggaagaggaggaggccaaagtcaaggaaaccaggaaggcagaagttcccccaccaattttcccttgcttggggtgagtcctcttcaaggatcctctctgatatggcactgcgtcctttgcacaggcatcggcctacagtgggaatggacttgggaagggggaggcctcaccaggtttttgtgccaccggggttttggggggccctggacctgattccagtacagggagaggccgaagtgctgctcctcagagacattcagaaccagatgcacgttgtcaccatctgctgacacgttgagccagggcagggctgg

SEQ ID NO: 11392 - DNA, 308 bp, Homo sapiens
ttttttttttcctttttttttttttgagatggagtctggctctgtcgcccaggctggagtgcagtggtgtgatctcggctcactgcaagctctgcctcctggggttcaagccattctcctgcctcaggctcccgagtagctgggactacaggcgcctgccaccatgcccagctgatttttttgtattttttgtagagatggggtttcaccgtgttagccaggatggtctcgatctcctgacctcgtgatccgccagcctcggcctcccaaagtgctgggattacaggcgtgagccaccgcgcccggcc

SEQ ID NO: 11393 - DNA, 1024 bp, Homo sapiens
gcggccgctgcaggtcgctcagcgacgtgcgcgtgcgcgggccggtcccacagcacgtagtggaagcacccgacggggcagccgctgcggcttctggcagctccctcgacagcttctccaggggttcactcaagatcagttggaacccctggcgccacgggctgtcatcagtggacagtctgcccctagatgagttgcccagcacggtacagctactgcctgccccgaccccagcccctgattctaccgccgctcggcagggggacggccagggagaggtccagccgcgcggcaagcctggggaatcccgcagcgcctccagtgataccatcgagctttgaagagcggtcctgacgcagggccaggaccctgcccgatgcccacatggcatggcctactgggacagttgagcctttaaaaaatgggcatcctggccaggcgcggtggctcacgccaggaatcccagcactttgggaggccgaggtgggtggaacacgaggtcaggagttcgagatcagcctcctggtctcgaacatagcgaaaccctcgtctctactaaaaatacaaaaaaattagccaggtggcacacgcctgtagtcccagctactcgggaggctgaggcgggagaattgcttgaacagggaggcagaggttgcagtgagccgagaccacgccattgcactccagcctgggtgacaagagtgagactccgtctcaaaaaaaaaaaaaaaaaaaaaaaaaaaaggcatccccaggcctctctacctgacggcaacccccgggggacagccaggtttgaactcaccccacccccatgccgttttttgcttttaatatttctatttttttttcagccggcattttgcacagaggccgtgtcttatgcggaatacagggtgggtgtgcatggattcgggcatgaagaacagggagcaggtgccccagactccccaacgtggagtgatgagcctcgcttgtctagattgtcctctttgtgccaaagaaataaacccttaggacttgg

SEQ ID NO: 11394 - DNA, 1399 bp, Homo sapiens
ccttgagctagcatttcattatgaccgtgatttttccccgcatcactttccagccttgtggtccacaattccactgggccctaagtatgtactgaactttcctgcctccctcattttgctctgcttgtgcaattttttccaccctccatctctgtcaaacataagccttcctgacctctaagacctacctttgtcatgtgcctttaccctcaggcaaggggcaatctcttctattcctcttctaccttcctgtagcttctcccccagggtttatcacattctgccttgaatcctagggaacaacatgtgtagtggaatgaacacaggcctctgaatccaagatgtgagtttaaatcccagctttggaggtggttacttaagttctcagtgccttcattcttcttcctatataaagtagatattacaatatctaacttacagagtcattgggagctatacatgcagtgattgggtaaagcacctggcacatggcaagcaattagcaaatgctggttacttctacttctttctcttctcttttcccagtgtatcataagttccttgagagcaggcaccatgtctgatttacccttgtatttcccacagtacttcccgtagtgagttacccttagtaaatactcagtaagttgaattgaatttaaattacctgtaagtcttaaaatgtgggattaaattaagagtatgttgccctggaaatacccaaatgtctaccgatggatgaatggataaacaaaatgtgatatacacataatggaatattattcagccttaaaaaggaatgaaattctgacatgtgctacagtatgatgaacctggaagacattatatgtgaaataagccagacagaaaaggacaaatactctatgattccacttatatgaagtacctagagtagtgaaattcatagaaatagaaagtacaggttgacatcgcaaatctgaaatgggaaattctccaaaatctgaaactttttgaatgctgacatgatgctcaaagaaaatgctcgttggagcgtttcagattttggatttttggatttgggatgctcaactggcataatgtgaatattccaaattctgaaaaaatctgaagtctaaaacacttctggtctcaagaattttggataaaggatactcaatgtgcaacatgtagaatggtggttacaaggtggtaggagagaatggagagttactgtttaatggtacaatgttcccatttgggaagatgaaaagttttggaggtgtgtgatggttatggttgtgcaacaatgggaaggtacttaatactgcttaactgtgcacacttaaaaatggtaaaaatgataaattttgtgtatgtcttacaacaataaaagaagttttttttttcaaaaaggaaa

SEQ ID NO: 11395 - DNA, 1399 bp, Homo sapiens; identical to SEQ ID NO: 11394

SEQ ID NO: 11396 - DNA, 788 bp, Homo sapiens
ggaaacattgcttctgtaccagccaaccttctgctcctgaagaatatctctgctatgggcctgtactgtggtcaatacaaaaaatgaactttcccgtcttctccaagagcctatcttcagtgcttcggtactgccagcaagggcgcatccaaccatatgtcggaatggttttcaagctggatgaggtcaatgatgccttccttcatgtgatacaggggaaatccgtgggcaaggtgcttctcgctcttaaataaatcctcacctgagcagcaaagttaacatgtccagatcaaaactccacatctttccccaaaacctgatttcccttctgtgtttccaaaggtgttaccactttccttaccaatccaggtttaaaatcttggagtcacctttgattctgtttactaattgcccctaattaatatgattatatagtttattgtccaaacctttttgagagtaaaagggtgccattagtaattacatcaggaaaacatatcccaggcaaaccaggatatatggtcagcctactcgatgcattatgaaatgcagtgattgccaagttctgtcattcccacctctaagatatctcttacctccatatcctcttttccattctgactaattaagcctcaactgctgtcaccagtgaccttctaactgcttttcctacctttaaactaccctcaccccctccattcttgtgatgcattattgccatggtgatcttcccgaagcatagctctgactatggcccatctcagaaaacctacagtggctcaccgttg

SEQ ID NO: 11397 - DNA, 788 bp, Homo sapiens; identical to SEQ ID NO: 11396

SEQ ID NO: 11398 - DNA, 7365 bp, Homo sapiens
gaaagcgtgttggccaaatctgaatgatgaaagccaattacaaactagaaaatgaaaacagaccccagatgcaaggagatgagacagttaaatttacttcctcttttctaatctgagaggtttcatgttgaagaaaatcagtgttggggttgcaggagacctaaacacagtcaccatgaagctgggctgtgtcctcatggcctgggccctctacctttcccttggtgtgctctgggtggcccagatgctactgggtaagtaaaatatttgaatattggtgtgggaatggagctttgcttaccttgggagaaaggaccagaaggaaagaaacatggactaattctggccctccaaagaagcagtattcaggtggaataagaagggtaggtataagaaagtttggtgtacaggattgaattactttctgaatataaaaatcttccatcctgaaagtcccctctgatcatgatatcctctctagctctaatctcaactcttttctttcacttgtgagacaagttttcttaaaagaatagtttgcacttgctatctccacttcctcacttctcacacgctcctcaatgcttgcagcctggcttccactggaattggttttgtctagggcacaacgatctctatattgactgggttatggcatgcttttcagttcatatcctgctggacttctctgctgcactgggctctgttgatcacttactccttcttgcattctctactaccctggcttccatggcaccattttctccttgtactacatggacttctcttgatcccttaatagcttctcttctcttccccttaaacactagtgttctctatagttatagccttgcctctgtactcctctttctttacacaatctccttcatgagcttatttgtctgtttaatttttgccactataactctgtatttaagagtcccaaatcatatccccaaccctaaccatgcttttgagcttcacattcaaatatcaagcttcataccagacatatctacctacatatctcacaagtgtctctgcaccatgtgactagagttgaacttatctgtccttttggcccctgcctcatctaattcattttccactttctgatctcagctaatgacaccagcatctacccttacaaggccataaacctcagaaacaacccagactcttccttctttttcattctctaaatctgatcaatcattaggtttggccaattttaccttctaaattgttcatagaagcagtcccttgcctggatcatcactaatgtcttaggacaagccctcatcctctatgacttgggctattccagtaaattcctaactaatctcctcgtccaaaccttgtgttcttgaaatgaattctgtaccctgcagacagagtaatttctaaaactcaagtttaccagcccaaattctttatcatggcacaaaaggccaagcagcctctacttttaccctctcagccttgtaacttatgctctaataaatctcaatcagttcatatttacatactcacacaccagactcttgcctgtctctaaggctttgcttataccactatctctacctgaaatgagttctttccatggcaccctactctccttctccttgcaaatgtgtaggtacccctaaagactcagcttaaatggtatcttttccaggtagcttttcttgaatgcttctttctgctccaatggctgcttgcgatacatttttcttattataatattttcctacttatgctgaaataatattttcatctacctgtgtcttccactaaattgagagctatttgtgggtagtgacaatgtttttttgtttttgtcttgtgataagaactgcagacttggaatcagatactcctgtttcaagcccctcttctatttaccagctctatgtcactttagaaaatcactttttctatttctggttcagttttctcatttgtagaatgaaaataataatacctaccacctaaggtttattgagtgagttcccagtaacccaacaagattttattttattttattttatgttttgagacagggtctcgctctgccacccaggctggagtgcagtggtgcaatcactgctcactgcaaccttgacctcttgggcttaagcaatcgtcctatctcagcctcccaagtagctgggaccacaggcaagtgccaccaggcctggccaattttttaaaaaattatttgttgagacagggtctctctatgttccccaggctggtctcaaactcctgggctcaagggatcctcccacctcaacctcccaaagtgctgtgattataagcatgagccaccacgcctggataagattttatttttaaaaagaaaaaatggagaggaggcagagcacagatgagtgacagtggaggaactgaaaagaggtagcattacagtgaagggagcggagaaaggatggaaagaaaacacctggtactgatgtgatgagaattaggaagtagggaggggtcttggtaagggacatgacaaaatcaaagaagaacgctgggctattgggagtggaagagaataaaggcaagtggggcacgaaatgacagtcagatggagtgaagaagtatgcacatgtgaatggccatgaggctggaggagggggagaatagttagggagataaagagcagtcccagagaagggagaaatgtcacttcccttgcctaggtctaccatgaaggtaagagataggttgaggagatgtggtgagaaatggataattctaaatttcaatctggagcaaagaattgttccacagttactaatatggactgggaggaggggaaaaaagacagagaaagctctgtgccactgccagggaaaattcaagtggcagaggacattaaagtaaagatggctgaaaagtgaagacctgcaagggggaggaagaaaggaggagagacactgctgggtactgaaagctctttgttagataacatattcaaggctgaggagccaagtgaagtttgggaaaatcagaatatgaaagaaagtccccgaggaaggtctgaggactgaagtagaccatatttgcacagtgaagtaaaaagaacattgattttggactcagacacacctgcctttcccgatccattgcttagtctctttttaagctttgggtatgttaatttggttttctaagtgtgtttctttaagattataaaatgaggataaagtcacctacctggaaagtttgtgaggatgaagttagatactgcacacaagtgctagcagggtctggcacccagtgaacattagaatctgatgtctccctttcattcctgtcctatgcctccctgcttcgagttaccattgtctttgctcctggtttcccgtaccagcagctggatgtcatgccggtgagtttcaccattctttcattctctcccctccctcttctccaaaccacagtgcatttgctgagagcacctggacgccagtgaatcaaggtcaaaactatccccctgagacactctcaggggtctttccgaaaaaaaaaaaggttttgatgtcttactagtctcattctaaaaaggatgattatcctgggagatggaggaaccctgtcctctttctccaagttgcatcatcattttctggttctccctgggccatgccctcttcagctgccagttttgagacgctgcagtgtgagggacctgtctgcactgaggagagcagctgccacacggaggatgacttgactgatgcaagggaagctggcttccaggtcaaggcctacactttcagtgaacccttccacctgattgtgtcctatggtgaggtcctgggaaggcctgagcagtgccccaaaccccttctttcagcctcagagcccacccaggaaagtgtccctaggaaattggctatgggatgaggtacttccttcccagtcttcagcccacagcaaccagggtgctctaagtcctaggccctagggaagttgtcccatactcccaaccaggggtgagagtttacctggaccctcagagaaagtttaggggagtaggcatgcttgggggtggcccccaagggaggccctgggtgacactcagctctttctctggaccatagactggctgatcctccaaggtccagccaagccagtttttgaaggggacctgctggttctgcgctgccaggcctggcaagactggccactgactcaggtgaccttctaccgagatggctcagctctgggtccccccgggcctaacagggaattctccatcaccgtggtacaaaaggcagacagcgggcactaccactgcagtggcatcttccagagccctggtcctgggatcccagaaacagcatctgttgtggctatcacagtccaaggtgagagctagaagcagcattgtcatggcaggggagggtaaggagagacagggagcccaaattgtctttctttagcctggaggtagcaagatcatcaacagactatggagcaggttgctggcaaatgcccaagttgggcttcgaaagggacgagacctcagccttttgaagtcatccagccccactcagagtccagcatagttcctaccacccagatctatgcttcctagtgctcactgattgggtgtctggacaactatcagatttgcccatctgtggatctttcctagtcctgtctacttacagaaagaacttgacagattcaaatggaatctaagagagcccattcctgctggaaacaggggaaaggaagtatgactccccaagtctcttcacctgcatgtgtctacctgtatataagatggctgagctcttctttcctgcctatctttttcccagaactgtttccagcgccaattctcagagctgtaccctcagctgaaccccaagcaggaagccccatgaccctgagttgtcagacaaagttgcccctgcagaggtcagctgcccgcctcctcttctccttctacaaggatggaaggatagtgcaaagcagggggctctcctcagaattccagatccccacagcttcagaagatcactccgggtcatactggtgtgaggcagccactgaggacaaccaagtttggaaacagagcccccagctagagatcagagtgcagggtgagttcgcatcagagtgcaggttgtctgtttggcatgcgtgtgagtgaaaaggagggataggataaattgacctgtgagctggggttcagtgtgagcaggttaagaagggacacagagggggcaggaacaatgggccagaatccctgatgatgagagacagcacaaatagagaacttctccctcagactgtggtgcacacctcaccagaccaagagctgagccagctccacacctgctgccccacaagccttagcatcccccccaacatgctctctgggcatttataggaatttaatatctggaatgaagatgggatagtctgaagtctatgttcaattctgggagccactgttaagaggctgcacttgacctgaaacactcccagaagaggtgtccagggtgataagggggcttaaagtcatgtcatatgaaaaataatggaaggggctggagatgctatcctgaagaggaggtgactcagaggccagcagaggtgtcctcaaaaagctgaaggctggcattagcacaaggaattggactaatgtcttatataataaagaggctgacctagaaccagttaccacattcatgcttcagggaattagattcagccttgatagagaaagaactggctaatagttatagctgtccagtggtgaagcctcactgctgaagaatttcaaacagaagtggccaagcttcagattaaaatttggaccaggagggacactagagtcctcaagtccctgctgccattgggccccacagccactttcagagaacaagaaagattggccagggatgggagggaagggccagagtcagacttcactcttgtatgtgcctcctgccccataattcaggtgcttccagctctgctgcacctcccacattgaatccagctcctcagaaatcagctgctccaggaactgctcctgaggaggcccctgggcctctgcctccgccgccaaccccatcttctgaggatccaggcttttcttctcctctggggatgccagatcctcatctgtatcaccagatgggccttcttctcaaacacatgcaggatgtgagagtcctcctcggtcacctgctcatggagttgagggaattatctggccaccggaagcctgggaccacaaaggctactgctgaatagaagtaaacagttcatccatgatctcacttaaccaccccaataaatctgattctttattttctcttcctgtcctgcacatatgcataagtacttttacaagttgtcccagtgttttgttagaataatgtagttaggtgagtgtaaataaatttatataaagtgagaattagagtttagctataattgtgtattctctcttaacacaacagaattctgctgtctagatcaggaatttctatctgttatatcgaccagaatgttgtgatttaaagagaactaatggaagtggattgaatacagcagtctcaactgggggcaattttgccccccagaggacattgggcaatgtttggagacattttggtcattatacttggggggttgggggatggtgggatgtgtgtgctactggcatccagtaaatagaagccaggggtgccgctaaacatcctataatgcacagggcagtaccccacaacgaaaaataatctggcccaaaatgtcagttgtactgagtttgagaaaccccagcctaatgaaaccctaggtgttgggctctggaatgggactttgtcccttctaattattatctctttccagcctcattcagctattcttactgacataccagtctttagctggtgctatggtctgttctttagttctagtttgtatcccctcaaaagccattatgttgaaatcctaatccccaaggtgatggcattaagaagtgggcctttgggaagtgattagatcaggagtgcagagccctcatgattaggattagtgcccttatttaaaaaggccccagagagctaactcacccttccaccatatgaggacgtggcaagaagatgacatgtatgagaaccaaaaaacagctgtcgccaaacaccgactctgtcgttgccttgatcttgaacttccagcctccagaactatgagaaataaaattctgttgtttgtaagctattcagtttgtgtattttgttatagtagcccaaatggactaggcagttggcctctgccacatgactgagtttatgatatgttaaaaatactcataaaacagtg

SEQ ID NO: 11399 - DNA, 1344 bp, Homo sapiens
tgattgtaagtttcctgaggcctcctcagaagccaagcagatcttagcaccatgcttcctgtaagccctgcagaaccatgatccaactaagcctcttttctttataaattatccagtcccaggcatttatttatagtaatgcaagaacgaactaacacagcatggaaggctcttgatgatctagtgtattactttcttgtggctcctgtaataaattatcacaaacttagtggcttaaaacaatacaaatttatttattctcctgcagatcaggcatcagaagtccaaaatcagtcttctggggcaaaaatccaggtgtcaacagggctgtgatacttctgaagactgcagggagaatccgttttccagcttttttcatccaccagaggccacctgtattccctatcccacaaccctagccccttcctctatctttgaagtggactatttcatcccctgtttctatcatgacagtgccttctctcatattgaccctcttgccttataagattccttgtgattacactgggtccacctgcataatcaaggctaatctctccatctggagatcttaatataatcacatctacaaagtccctttggccattgaagtaacatatttatatgttttcattattaggatgtgggacactttgtcagggacagggatttttcagcctaccttttttcttcaccttttgccaccactctcagcctgtggtctcaattgccagcctttacacttgctacccccattgtctgggtagttcataccagtccctcaagactagcctcaggcattgcctcttctgggaatacatcctcttacaggccaggatatgactcatgggtgcattcctaatagcacttcacttatttctactgtcaccacactgatctgtaattacttgatttgtctgactcttctgggggcttgtaagcattctggcacagagaactatgacttactggggcttacatctcttgctaaacacagtacctaaaatttagtaggcattccctcataaacatgaatgaatgaatcaaagaatgaataaacatttaggaaatgatgttgtgttggtcaacttctttcctcatcactgttaaagataaaagaatgccaagccaggttgttcagacagaagcaagcaccacatccctgagagagcagcacatctgggcagccatgtgtgagaagtcggttgcattccccatacacagttgtctttgcagctgtactcttaaccactgtaaccacagaagtggggaaacaatagggtggggtgaagtgaaaagaaaattttccaaaacttcatttatctaataaatacagatatttaa

SEQ ID NO: 11400 - DNA, 1344 bp, Homo sapiens; identical to SEQ ID NO: 11399

SEQ ID NO: 11401 - DNA, 340 bp, Homo sapiens
agaaaaggaagagctattctgacagagaaagatggcacaaagaaccacttggtcttagtctcagactcacctttgacctggttgtggtgtcccctaagtgtgtacagcagtcacaaaagtccatctgaccctgccctagtctggctgtcatatgacctatcccccacccccactgcgagtatctttctaaagaggaaatctgatcaagctacctccctaactaaaatcccttagtggctttccagcatggcacgtgacatagcttggattcttgtccccatccaaatctcatgataaaatgtaatccccagtattggaggtggaccctggtgagagcacc

SEQ ID NO: 11402 - DNA, 340 bp, Homo sapiens; identical to SEQ ID NO: 11401

SEQ ID NO: 11403 - DNA, 2593 bp, Homo sapiens
tgggcacctgtaatcccagctagttgggaggctgaggcaggagaatgaatcgtttgaacccaggaggtggaggttgcagtgagctgagaccgcaccattgcactctagcctgggcaacaagagcaaaactccgtctcaaaataaatacatacatacatacatgcatacatacatacatacatacggggattaaaatagtctagtagtgacacctgaacagagagattgatccaagaaatgaaacagaaattccggaagttgacctgaatacacacacacacacacacacacacacacacacacacacgaaggcgtgaaagactccatgaccctcaaggtataagatgcattttttttttttttttgagacagggtctcactctgtcacccagactgggtgcagtggtgtactatcccagctcagctctaccctccatccccccaacctcccccaaccaccctgagctcaagcaattctcatgcctcaaccctcagcctcatgagtaactgggactacaggcgtgcaccaccatgcgcagctaattttttgtatttttagtagagatgggtctaaccatattgcccaggctggtctcgaactcctgagctcaagcgatcctcttgcttcagcctcccaaagtgctggcattacagctgtgagccaccgcacctggccgcattcttctaaatcacagtacatctggctcccagtgcccaggctctcagggcagaaggtccagtgtgatcactttgcatggcctctctcccctcctgagcttgtgccagggccccagggctgacctggagaaggaaaatggcagagggtgaagatggggtgtctggtttggggaccatcctggccccccttgtcactgttgacatctcttctgcacagtggcattgctgggaggtgcttactgtgcctattcaaggggctggcagccgcagcctcactgcagatcagggacttggcttcccagttgaccacaggtccaagaacctgcagggtccagcctcccccccatccccagtcttccccaccctggcccggccctccaggtgcagaaacatgcaggcccctctccaggactgtgggaggagcgtgtccctcagactggcctgtgtcctggctcctcttaccacctcttccacaggttgtcacctgcagctgccccaggataaaggcaaggccagagaggactcctgaactcctgtgtgcctggggtggcaggggcaaacatagccaactggtggcctgagcggggccatggtgaggacacccttggtggcttgtcccacatcaagctgggaggtgacactgaggatgcattagtctgcagcgtatgataaaaacggcatttcaggccaggcgcggtggctcatgcctgtcaccccagcaccttgggaggccaaggtgagcagatcatatgaggtcaggactttgagaccagcctggccaacatggtgaaaactcatctctactaaaaaaacaaaaattatgtgggttggtggtgtgcgcctgtaatcccagctacttgggaggctgaggcaggagaatcacttaaacctgggaggcagaggctgcaacgagccgaaattgcaccactgcactccaggctgactccgtctcaaaaaaaaaaaaaaaaaaaaaggcatttcagttcaaatagggaaaggatacatctttctttcttttctctttctttctttctttctttctttctttctctttctttctttctttctttctttctttctttttctttcctcccttccttccttcctttctctctctctctctttctctcgttctctctttctttttgagatggagtttcactctcgctgcccaggctggagtacaatggcgtgatctcggcttattattattctccatgttggtcaggctggtcttgaactcccaacctcaggtgatccgcctgcgttggcctcccaaagtgctggtgtgagccactgcacccggcttaggatgcatttttcaatattttagtgtttgaataacgggctaacttgagaaaaaaataatttgaatcacacatcacaccaaaaataaattctaggtggattttaacactttcaaaaattattattattattagtttagagacagggtctcactccgtcgctcaggctggagtggagtggtatgatcatggttcactgcaaccttaaactcctggcctcatatgatcctccagcctcagcctctcaaaggactggaactacaaacatgcaccaccacgcccagcctaggtgggtttttaaaatccattcaagggcgggtgcagtggctcacacctgtaatcccagcattttgggaagccaaggtgggaggatcacttgagcccaggagttcgagaccggcctgggcaacatagtgagactacatctctacaaaaaatttaaaaatgagccaggcatggtggtgcacacctgtagtctctgctattcaggaggctgaggcgggatcattgtttgagcccaggagacagattgcagtgagctatgatggcaccactgcatggcagcctgggtgacaaagggagattcagtctcaaaaaaaaaaaaaaaa

SEQ ID NO: 11404 - DNA, 149 bp, Homo sapiens
ggctgggtgcagtggctcacacctgtaatcccagcactttgggaggccgagacaggtggatcacctgaagtcaggagtttgagaccagcctggccaacatggtgaaaccctgtctctactaaaaatacaaaagttagccaggcgtggtg

SEQ ID NO: 11405 - DNA, 8996 bp, Homo sapiens
gacggggtttggccatgttggccaggctggtctcgaactgctgacctcaggtgatccgcctgcctcggcctcccaaagtgctgggattacaggcgtattccactgtgcccagcctgagtttctgtttagaaacaacagtctatgatagtataatcctctcttttttgtacacagagtaaagaggacaaataggtgaaagaataaatgaaaggctggaatcccacttcccccgctgtcccagggcattggatattgacggataggaggcagcaaaccactcacagagccaggaagaaatgaaggcgttggtattgccaggaggggaagccggctcggctgaaatacgctatgaccatagcaaggagatactgatggagagaaaggaacacagagagggagaggtcacatcttggaagaggaagattgtggagagggggaatgagggtctggggaggggctgcccatcagagaagggacctcagtgttggggtgactgtactcatttggaaattgcgggatggaggggtattcgaaggtcggatgcaaatccgagaagccagaggaagggttttgggtgatgctcccaggatggtgggctccgatgggatctttggagggggtgtgtctaggttggctggtgtcaggagggtcttttgtgtgccaggcagagaactgtcccgaagagctgagagtagaggggccaggagcttcagggctgcggccagactgtggcccagagctcagatcccaaaggacccataggagaggcaggggccactcattcactctgcaagagaccagcagaatcctgagggagatgctgacaaatcataaaaagaccaagaatagccgggagtggcggctcaagcctgtgatcccagtactttttgagaggtggagacaggaggatcatgtgagcccaacagttcgagaacaacctgggcaacatagtgagaccctgtttccacaaacatttcaaaaattagttgagcatggtggcatgtgcctagtcccagctcctcaggaggctgaggaaagaagattgcttgagcccaggaattagaggctgcaatgagctatgatcatgccactgcactccatcctggggagcagagctagattctgtctcacaaaaaaaaaatttgtgggtgccaagactcaagaccatgggagctggtcgggcacagtggctgacgtctataatctcagcactttgggaggccaaggtgggtggattgcctgaggtcaggtgttcaggaccaacctggccaacatggcaaaaccccgtttctactaaaaacacaaaaattagccaggcgtggtggttcatgtctgtaatcccagctgcttggaggctgaggcaggagaatcgcttgaacccaggaggcatcggctgcagtgagtgaagatcgagacactgccctccagcctgggcaacagagcaagactctgtctcacacacacaaaaaaaaaaaaaaaaaaaagactgtaggagcatctggtgggaggtggtggagggagaactgtgggtttggaagctgcgccctccccccagccatgcgttggaacaggaacagttacatggagaacaaccttaccttgtccgacaccctcagatctttgtcccaggccaggaatcttttaatgacaggatcctctgtgattagagagcagatgtcagtgtgagaagcaggacagggtttccgtgggagcagcagggcagcgaggagaagtgtgcctcccggggggaagtctcaggattgtggccgcgggtgaggtggatgggagaggggagaatgactttcactgggcaagggagagaggctcctgctctgagactcccctgagaagaggccgaaggaggccctgggtgtgagaatctacaggatgtagagctgggaatcagccaggaccccctccagcagacacggagggaccactgcagagtcataaaggaattcccatcatttcctcatgagacagtcacacatcagggtgtgaccatggccttggtatcccccactatggatggagacacttaggtttagaaaagtcagtaagagacattaagtttcagagggcacagctgaaaccactttctttgtttattgattttgtttttctttatttgatttttatttttatttatttattaatttattttgagacagagtcttgctctgtgggccaggctggaatgcagtggcctgatcttggctcactgcaacctctgcctcccgggtttaagcgattctcctgtctcagcctcccgagtagctgggattacatgcatgagctactgtgcccagccttggtttttcttttgagacagggttttgctctgtcacccaggctggagtgcagtggtgtagtcatagctcactgcagcctcaaagtcctgagttcaagcaatcctcttgcctcagcctcccaacgtgctgggatctcaggcgggagccactgcgcctggcccgaaaccaagctttcttatcccaagcgctgacctttatcaagttgacctaatcctttatcatctcctaagtgtccctcatgagtgatcacttcacattcctcccacatggagagctcacccactggggcctatttttcccattggaaaagtgtggttattggaagtttcctgtttttggaaagaacaggattggaggtgctctctggggtgtcctcctaccaagcagcctgttgaaggcctcgtggtgctcagggagcacgagcgacactcgccgtcgcttcagcttcatcttgaggccacacagcatctccgccacccagatctcctcaggctcaggggcgagcaccttccgtggctcctcctccgactcctcagatttgtcccaccactccatcttccttttccagcaaaaggacctatgcggggggctgggatctaccccaggggctgagtaaagaaaccaggccacggtgtaatgcttctgcagttgatcacactagagcccgacccaaaaccccaaaccactctccatcctccccagcctcgcagactgctggcttctccaagccatctttccttctgtctgtctcctctgctgagctccatgtgccgctccttctcctccccattctcccgtttctctgtcctcagaacacttcctcatatccttccctggtccctggctctctgagtccctttttttttttttttttttttgttgttgttgttgagaaacagtcttgctttgtggcctaggctggagtgtagtggtgcgatcttggctcactgcaacctctgcctcctgggttccagtgattctcctgcctaagcctcccaagtagctgggattacaggtgcccaccagaacgcccagctcatttttgtgcttctagaagagacagggtttcaccatgttggccaggctggtctccaactcctggcctcaagtgatctgcctgcctggcctcccaaagtgctgggattacaggtgtgagccactgaaccctgcctcagtacctccattcttcccacacaccctcctcacgtgctccttcctgacttctgggcccgcccttccttcttttttttttttttttgagacagcgtctcactctctcacccagaatggaatgcagtggcactatcttggctcaaaacaacctcttccacctgggttcaagcgattatcctgtctcagcctcccgagtagctgggataacaggcatgcctggctaatttttgtatcgttagtataaatgacgtttcgctatattggtctggttggtctcgaacaactgacctcaagtgatccacccatctcagcctcccaaagtaatgggattacaggcatgagctaccacacccggccttcgtttttcttttgacacagggttttgctctgtcacccaggctggagtgcagtggtgcagtcatagctcactgcagcctcaaagtcctgagttcaagcagtcctcttgcctcagcctcccaacgtgctaggatctcaggcgtgagccactgcacctagcccgaaaccaagctttctcatcccaagcgccaacctttatcaagtctagcctagtcctctattgtctcctaagtgtccctcatgagtgatcacttctgagtcctcctgcgtggagatctcacccactgggggcgtatctttcccattggaaaagtgtggttattggaagtttcctctttttagaaagaacaggattggaggtgctctctggggtgtcctcctaccaagctgactgttgaagtccttgtggtgctcaaggaggatgggtgacactcgctgttgcttcagcttcatcttgagcccacacagcgtctccactacccaggtctcctcaggctcaggggcgagctccttctccggctcctcctcagattcatctgaccactccctcttccttttccagccaagggacctacatggggggctgggatctaccccaggggctgagtaaagaaaccaggccactgtgtaatgcttctgcatctgatcaccttagaccccgacccaaaaccccaaaccactctccatcctccccagactcgcagactgctgacttctctaagccatctttctgattttctcctctgctcaaccccatgtgccgctccttcccctccccattcttctctctctctgtcctccgaacgctgcttcatgtccttccctggtccctggctctctgagtccctccttttttgttttgttttgttttgttttgacacagaatcttgctttgtcacccaggttggagtgtagtggtgcaatctcagctcactgcaacatccatctcctggattccatttattcttctgcctcagcctctcaggtggctgggattacaggtgcctgccataatgcccagctcaattttgtacttttagtagagacagggtttcaccatgttggccaggctggtctcaaactcctggcctcaagtgatccgcctgccttggcctcccaaagttctggggttacaggtgtgagccaccgcacccagcctgaatttctccattcttcccacacaccctcctcaggttctccttcctgaccgctgacccttcttttcttttcttttcttttttttttttttggagtgcagtagcgtgatctcagctcactgcaacctcttcctcccagtctcaagtgattctcctgtctcagcctcctgagtagctgggattacaggtgtgcaccactaccacttggctaatttttatacttttagtagagatggggtttcaccatattggccaggctggccttgaactcctgacctcagatgatccgcccgcctcggcctcccaaagtgctggggttacaggcgtgagccaccgcacccggcccccttccttcgtcttagtcaatcctatcccacctcttcttccaccagtcccctcacctgatggtcccaacacttcatcatccaccacctcctggagggggtaccccgaggtgctccgctggggactctgctcattctggcggtgcggttgacggctggtcgtgatctttcccgtaatctgtcccctcttacggaacctagtctccgttctgtccatggccttcttctggacactgctaggatccagaagagtatgttatcaattctcaagcctaggagaagtcaggagtggagaacagctctgagaagatactgttgtccaactgatctccaggcaccacggagtccggtccctccaatcaggaaggtcggaatctctgatgtcatcgttcatgccaacctggcaaccagtttgaaaaaaaaacacatgtaactgccaggctgatctcttgtcctggagatcctgggtgaatggtatctcctgccactgtcccaacctcagaccattgtccaaaagcatcttcagggactccacatccctctgttccctgtcccagcagaggctgtgtcctctccactcaaagcctgaagcatgttggggtctcttcgtctctgtacgtgcccatttcagagtccagtctggtgggagagggaacagagtgggaaagaaaactagggtaagcagaaacgatgaaaccttataagagtgagattatcatgtacaagagtgagattatcatgtacaagagtgagattatcatgtacaagagatcccaggaatactgacttgatgaaaaagtcacatcagagcactcagtttggcagagcttttctgctgaatgtttactcacattcactgtccaagattctgtactgggggtacatacgtcctctgccctaaggcaattttgagtccaagagacattttgaggcctaaaaatcataggaaactgcccctgagctcacacatatttccaatggagctcacacatatttccaatggtgtccccaatttcagggaatccatggattacctaagccagcccctccagttcggctaagaaactctagtctatatatcaagttttgtatcatatgtattgctctgaactcagaaatttcccttccatttatggattctatgaataaaatatcacatgtacaaaaagactaagtcgaaaaatttcagctgtgcacagtggctcatgcttgtaatcccagcactttgggtggccaagggaggaagattgcctgaggccagcagttcaagaccagtataggcaacatagcaagagcccatctctaaaaaaacaaaaccaaaccaaattagccaggtgtggtggctggcacctgtgttccaactacttgggagactcatgtgacaggaagatcacttgagcccaggagttagaagctgcagtgagccatgatcttgccactgcactccagtctgggcaacacagcaagatactgtgtcaaaaaatttttttttgataaaaaataaaagagttacatgacattcagagaccatccaaaaaacctgcgggttcccggctgggctcagtggctcatgcctgtaatcccagcactttgggaggccaaagtgggtggatcacttgaggtcaggagtttgagaccagcctggacaacatggtgaaaccccatctctactaaaaatacaaaaaattagccaggcatggtggtggatacctgtaatcgcagctactcaggagagggcgctggagaatcacttgaactcatggtgcgcaggttgcagggagccaagatcgcaccattgtgctccagcctgggcaacaagagcaaaactccatctcaaaaaaaataaagaacctgcgagtgagttcccacacgttttcctgatgggctgctgctttcctaggagtctctcgctcatagaaaaggcacaaactgaaagaggaagcagatcccattgctgtggaagtcccattgttaggaagctctgcttttctggagttcaaattcgcattcatgacgctttaaaccgtcagagctgggtgggtcctcctacaacaaaatcgtttgctctctctctcctagttaacaggctttcaaatattagaagatcaatgttctgaccccattaaaatttctcttttgtggaatgaaaagctctgatttaacccatcttcaagcctggtttgatggaggaataggggctgagtcacctgcatttcccctccctgcacaaagtcctgggcccagatctggggtctgtctctgctgagggtggggtgaaccaggaagcacctccctctacatctccttgatgaatgggtataatggttgccatggaactggggcttgtttgatgacctggggctgggtgggcctctgagagcctttatagctgattgccttttgggagagggcaggtgggagccccaccctgtcttatgagtcaccccaaaggtgcatgggcaggcaggtgctggggaatcggctactccccagagcttggcgtggccatccctgtggcccctctgggagtctggagcccattccctcacactggtactctctgcagctggggacatctgcactaggaagacaggacacggcatggaagctggcctctgcccagaagccatgacattctggtcaccagcctgatgctataaaacgagtgtcacggccgggcatggtggctcacacctgtaatcccagcactttaggaggccaaggcgggtggatcatgaggtctggagttcgagaccagcctggccaacatggcgaaatcccgtctctactaaaaataagaacattagccaggtgtggtggcacatacctgtagtcccagctcctctggaggctgaggcaggagaatcacttaaacccaggaggcggagattgcagtgagccgagaccacggcattggactccaggctgggcaacagagcacgactccgtctcaaaaacaaaaaaaaacgagtgtcacctggggctacttggccagacacagagagcaaggagacatccctattatctgtcaaaaataattgttggggctgagcacagtggctcatgcctgtaatctcagcactttgggaggtcggagcaggaggacttgaggcctagagtttgagaccagcctgggcaacatagcgagcaccccatctccagaaaaaatttaaaaattggctgggcgcagtggctcatgcctgtaatcccagcactttgggaggccgagggggatgggtcatttgaggtcaggagtttgagaccagcctggccaacatggtgaaaccccatctctactaaaaatacaaaaattagccgggcatggtggtgggcacctgtaatcctagctacttgggaggctgaggcaggagaatcgcttgaacccaggaggcggaggttgtagtgagctaggatcatgccattgtactccagcctggacagcaaagctagactccatctcaaaaaaaaaaaaaagtaaaaaatttaaaaattagatgggcatggtgacatgtgcctgtaatccaggtactaaggaagctgaggtaggaggatgacttgagtctaggagttcgaggctgcagtgagctctgatcgcaccactgcactccagcctgagtgacacagcaagaccctgcttcaaaaaaaaaaaaaaa

SEQ ID NO: 11406 - DNA, 2406 bp, Homo sapiens
gtaaaagtggaggatatgagtcttgtggggacacagagttgaggcatgagctattagtcagagccgtaaggctgcctgcaggagaagaactttggatggagttttgaaggaagtgaggaaaagatctgaattaacgtattaacacataaagcttgtcatctgaacaggactataagcatctcgagggtaagaacgtgccttttctttcttacacattcccagaagacccacattcctcattgggctctctgtaacagtatttactaagcacttgaataactggacatgggcaccatgttgctaagttgattaaaggttggtcttccactctgccactggccacagcacaaagtgaaaacagatgtcacaagcaccttgtagatctgtcccttttttcttctgatgttcaccctccttttgagctctttctttctccaacattgcttacaaaataatctttatgcatctgagagggagcaaatattcagtaactttctgcagctgtcctcactaaagaggagaatctgttgaatgccactggaaatgtaaggatctcttgtgacagtaacatctcaaggggaaactagtggttaaattgttaattctttgagtctgaaacttttttcatttgcagtgcagataagtgcctgatcttgcagtatcacgtttctgacttctttgttctggcttcattttttttttcccaaaatgccattttcatttgttcttagagttcagaacatgtcaaagagcttctttaagcagtaggtggttttacagagcccacagagaaggaaaactaaatatcatcccggatgcagtccactacgatcgtggaggagtcagattactctccgggctttgctgtgtctgcttgtgaaacaggaaagggagaactgaggcaatgagtcacctcacttgggcccaaagcaccacctacgttgaatatggagaaaatgtgaagcaagagtttctttttatacataatcaccatttgtacataatcaccattttctccatggttcttatccaattcagtgcatcttaaaggatggtttgtggaatcatgacatagcagaaaaatccaggtactatcagtcttgcctgtttctacctaactctttcatttaaactctcactagaatctataggaactgttagcatcaattttaataagttgtcaactaagtgattagtggtatttattggttatttttgacaaaataatggaatcatcaaattttgaagttgagaagtaaagtaaaaatttgtgccaaaccccaaatgtagacaaggtcatattataaacattaatgctgtcccaaactgccaatgcattgcgtagaactgaggttagcaggttaccattgatttcctctacttatgctttaagaggttggcattggtaagccgctacactttcttggtcaatgaggcagaaacccctttgcaaaactctcaactgatgaaaagattagctagaatgactctaggaactgttttctaaggatctgactcattgattcctttttttggtagggttctctgggccaagttagttcgagtatttatcatttaaattaggaaattaccatcaccatcatcatgtacattcataaatcaaagcaagattagagaaggaatatggtggatcacagagcaactcagaaagacgacagcaacaactaggaaatgaaacaccatggttgtatttcaggaaccctacccagcagataggaattaccatagctcctaaaattccatctgggtggttgatggagcctcaattaatctgacaccatagcccatgctcccctcttgctacctgctgaagttagcagggaaaagtcaaagagggtgctgtcagtggggtcaattcttagggatcatagtgaaccaccctccattgcactgactctttcccacaaaatgggctagagatagcagctctccttatgtatttaagaaagaatggtcaaaaaatacaattcacattttattctggtatataccattttgacagtgtttcacaatgtaggtaatatgaatgggagtatttaaacacaatcctgtttaatattcttagccagtacttattaaatgcctaccaagcctggcattgttctagagacctcaaaatacacctttaaaaacatattttattgacagttgtataaatgaagaaaacaagtctcagaaaattaaagtgacttgcacagatacacaagctagaaagtaataaaactgaattttgaacccaggtttgtcagactctaaagtccatgattttctgctccatgtggccaacccagttagaaaggttataaaaaatcttaacagtttttcagcccttctcacacttagctttaggattaaaagtattggtcatgatttgcaaaaaaaaaa

SEQ ID NO: 11407 - DNA, 718 bp, Homo sapiens
cctctatattagagagaagatttacaaacgttggggaaaaaatggaaattgagactgactcctaaggaaacatctgttcactcactcagcaaacatttagcccactctgctaatgctaggcactgtgctagatatttggagagacactggagaaaacttaaggtccctagtcttgtggctcttacattctagagagggattataaatgacggcgtagttattaaaaaaatacagatgatgatttcaagccttataagagcaaagaagaaaagtgaaccaagttaatgtaatggagagtattggagtaggcgaggctgctttagatcagagagtctgggtggacttgatggaggaggtcatggatagccttgcagctggtagacctgtgggcaacattaacagcagataggacaagagggttaggggctaactgagcattcacctttgtcttctttttcccctcggttatgagtgtgacaaggcggaacatccaagggatatgttgcaggtgtcttaagagtcaggtaaaaggcaagatgattcattatatctgttctttttgtgatacccatgtaactacctataagcttcaaagtgaaataaacattacctcttgtaccttagcccgcttctcattcttcattacaaatttaagaaggcagttattaatgtgaatagtcattcttcttttcagcagtgccaactttaaaaaaaaaaa

SEQ ID NO: 11408 - DNA, 351 bp, Homo sapiens
gtaaaaaacaatatgtgaagcctttattccaactaggtaaaataaggaaggctttacaaaggagatgaatgacacttcagctgagccctaaagaatgaataggattctaatagaacagctgggggcaggcgtggtggctcacacctgtaatcccagcactttgggaggccgaggcaggcagatcaccttaggtcaggagttcgagaccagcctggccaccatgcaaaagcccgtctctactaaaaatacaaaaattagccaggcgtggtggcacatgcctgtaatcccagctacttggaggctgaggcaggagaatcacttgaacccacgaggttgaggtttcagtgagcc

SEQ ID NO: 11409 - DNA, 1365 bp, Homo sapiens
cagcatcagcagtgtgatggtacaccaagaaggggctgttgatataaatttttttaaaatattggtatagttaaatacttatattttaaaatattggtgtgttttttggtgctataaattactaacttgtgtgttcctaaaatcaagttgaaactaggataattgtctagttcttgctttgataagaacgcagtagttctgatgcttgtgtccatgtgtatgggtctgttattcttgcaagtgggtaagcaatgcatagctttttttatactgagagcactagaaggccaaagcatctcaaaaccatgggttctgggtatgcataatttttggaaaggcacgataagcaaatctcacagtctggctggtcagcagctgcagggataaggagactaattgccaaggccatgcaaatgcaaagaggaaggtgaggaggattcccagatgtgatcatagcttgcaaagatggtcatctcatggggccagaattcgtgcatgcccacacctacaaagctgagaactggtagtggtcatgtgtccgcttcaagcaatgcatgtattcacagccgccagcatcaagaggggccatcttttgataggatgacacatgcatgttcaaacatattttaaaagattagggagaaaagaatactgtgaacaaatagaaaccaattatgagcaaattcacgaattcggttatgtactattgtggctggcaaaagccacttaaactaggctctctagcctgattttcagccatcattacccctcactaagaatccttgtaaaatttcttccgtaaaagttaattacactcatcaccactgtttgctaatgggagcaaacccctagccaatattttttagaataatatggttgggataactttttttttttttttttgctaaatgaatgcatgattatcttatacaataaaagtataacacaaaatactgttttaagatagtcgctgggactctccttacccttgaagtgtccccctttccctcctccacatccagtcaaccgcaggttcctcccaggtttactatctgacatgttttagctctcttccttcttttccattcctctacaacttctctagttctggctttcattgtttctcaaccaaaacagtctccccttctctctcctccattcttgcgtccttccaaaacatcctctccaccctgccagagcagctcaccttagtcacagtctgactgcaactgcatgtgcttatcaatcctctcatttctcctcatcacctataacagtgcttttgacgctgcaacttgtgagccatttcgcgggttagaaaataagtttcatgggttgtaaccagtagtttaaaaaaaaaaaaaa

SEQ ID NO: 11410 - DNA, 13712 bp, Homo sapiens
  misc_feature (28)..(28): n equals a,t,g, or c
aaaggtcagcaactgtaatctgtatcgncttggaaaaaagaagggactacccagccgcatggtggtgtcaatatttgatccccctgtgaattggcttcctcctggttatgtagtaaatcaagacaaaagcaacacagataaatgggaaaaagatgaaatggtaagtttgtgtgtgtgtgtgtgtgtgtgtgtgtgtgtgtgtgtgtgtaactggagggatttacttttcggtgagccaaataatttgttttattaattttttgtttcattttcttggtatgtttataatagagtagatatttgatatatttaattaattcctttaattacactgtcttttcactgaattcagaaatagtattataattttgatggaggcaaatttctatttttattatttcttttccaaaggcataagagtatgtgatgttttgactttgagttttgctcttctttaaaaaaatttcactttgctgttattacaatttatcctagatccttagctctgttcagtgaaatgacttttcagtgacctgtgatctccagtctgtctgtgaaataattaatttcagtaaaatcttgcttttgtagctcagggttttcccagtcaggactcctgtgaacttaaaaaaaaaaaatcatccataaagattgttattttctggaaataatttaaatcttgccagtgacttaagaagactccaaatatcagcaacagccacttcattttgtcttgtcttgaaggccaccagagggcacttgggagggcctccaaactgcaggaaccagcgcagtggtggttgactgggagagttctagtgcctcttccgaagttaaaggcaatgcttcagacagtttcatttcttggagatttattttgcattaaaaataaattggctcattgttacttcatttttacctcaggccaacaatgataataccgtttttttctttcaaaggttatatttttaaatatccattttctccatgtcttctttgtgatgcatgtatcctatatatctgcctttaagtatttccaggtagcatgttcagtgacactatttggatttttacctatttattgaggatgtttttaactcatgtagtatttgtcttattacagaattagaacttatttggaaaagcattaagggaatattttaatgcaagttaggtccgaacaattatttgttattaatttagaaatatgtagaaccttagaggaaaatgtatagattttcaactttagaaatggtatggtatttctatgaataacattccagtaacagtcatcctcctttgttaataccgtttcataatgtttttggctctttttaaaaacttgtagcatgaaggtgacattggcatgtcattgattttttttttaagatacaacacaaagttcaatttatttttcttaatgtttctgatggcactttggttattggaattcattagaaatactgttcagatttttatttagtaagttacttttattgaaatataggcccttgcattatattgaaaagatacactgtggttttggctggttgcattgccattctccctaccttgctctggcccttcagcaaatgggcttaagtggaaacctttgcatgctaaaacgcctcttaatagacgagagtatcaaagttgacttgaatgatatagaaaaggatttcatgtggctgttttttcttaaaaggcttgaagtgctcttgaaaaacattttatgagacagaaccccactcttttgtagatgaagcatctgaaacccagaggcactaaaaggctttgcccaggatcacacagtttgtgataaaagtcagccctttgtgatttttgtgctctgccacttttggcttatggtggcacctttctaaagatacagaaggtttttttcaataaaaaaaaaatattgtctgattttttaaaaatcgcagtttggccctctttttcttaaggaccaatcaaaaacatcttcatgttgccttggaaagtctaagattgttagcaggaaatgttccttgaggtctgccgctacagttgcttttggtgttccttattcttgaaaaggtgtttctttcttaattaaaaaaatgaaaagataaatagttagagatatggcttggcttactgctatttcttttcagacaaatgtagtgtttatatcttgagtctagtttaaaatatttgtagtatttaaaaaatgcttgaaggttgcaacttttttttgtcagaacactggaaagttgttacaatcaacattgatgcacacccttcgtcttcccccttcacaagttttttggttttttaaaaacttgcataacagaaatttggcatctttctaggattgcaaagaagttacatcattactgaaatctagcccattattaaggttgtcactcacaaataagcttttgccaaagaaattggaattagcaaagatcttttgacagaaattggattgttgtgtttcatgttagtctaaattttcttccatttttgtcagttatgctataatctgttcccctgattaccgtagttcagagtggagggaaaaaacgtaacttctcaaattcatagcttagtgcagtgatcacttttattttttaaggaaagcagtgtagtttttttgtggcaagtatactttgaagtggaaatagggacaaaaagctttattataaaatcctattgtacattttaaaaaatgattttatctgtttttatattatattcttaattgcaaaggtaatgcttttctacatctggaatttcgttttattagtttgaaaatctttttgaaaatcaaattaccacattttcaaattttgtcagcaaaattgaagatctgtgtgatcagcatatgagtgctttcattgtgtgtcctaccagagttagacgacttagttgaagttttgcattgtggacattaattttaactttatatccatgttcaaagtccttaacttaaagcttcatactggataaaggtcattttataacttagaaaacgaacattcaaagaacatgttttactttgtttatatgattaaataacttattttatgttaattgaaaacaaatggccatgattttaaagttgccttttagtatttgtggttgtcatttgaaattatccataacccttgcttttattgagtttcaaacccttttaaaaacagcagctatgtttcccctccttccccattccccctcgtttcagacaaaagactgcatgctggcgaatggcaaactggatgaggattacgaggaggaggatgaggaggaggagagcctgatgtggagggctccgaaggaagaggctgactatgaagatgatttcctggagtatgatcaggaacatatcagatttatagataatatgttaatggggtcaggagcttttgtaaagaaaatctctctttctcctttttcaaccactgattctgcatatgaatggaaaatgcccaaaaaatcctccttaggtagtatgccattttcatcagattttgaggattttgactacagctcttgggatgcaatgtgctatctggatcctagcaaagctgttgaagaagatgactttgtggtggggttctggaatccatcagaagaaaactgtggtgttgacacgggaaagcagtccatttcttacgacttgcacactgagcagtgtattgctgacaaaagcatagcggactgtgtggaagccctgctgggctgctatttaaccagctgtggggagagggctgctcagcttttcctctgttcactggggctgaaggtgctcccggtaattaaaaggactgatcgggaaaaggccctgtgccctactcgggagaatttcaacagccaacaaaagaacctttcagtgagctgtgctgctgcttctgtggccagttcacgctcttctgtattgaaagactcggaatatggttgtttgaagattccaccaagatgtatgtttgatcatccagatgcagataaaacactgaatcaccttatatcggggtttgaaaattttgaaaagaaaatcaactacagattcaagaataaggcttaccttctccaggcttttacacatgcctcctaccactacaatactatcactggtaaggagcccacgaccagacttcatttctgggaaaatgagactttgtgttgatctcatcgtgttggccttgtaaaagtgatctatgcatgtacagtgttcatgcttaatattcaagggatggggcggggaacaaaaggaatagaaagaattcttttccttgttatttggggagcacgtattgctttataactttggttgttgggagtatggctatcatataccctcatcagtgtcattttatatctgcctaattagagaaattttaaccttagtattttgatgtgttttccccattttatcctccgcaaatatctttctcttgcccattcagtgctgcttttggtttttgatttagttgtatattctggatgtatttccacagccttttattgttcttcctggacaaaaagacccctcctttagggtctttttaaagatggatagattaaaagattaaaagcaatgatttcacaagaaggttgcgtggcccttgctgtgactctgctgtcatcttctacttctcactgtgctctgtatttgcccctcttttaatagactgtcaacccattagattagaagggagaacaagcccctcacacccaaatcagcttcaggctgtgaaacacagctgaagtttacatttcaatttctgtatcagaaaaataagtgcctgaattcagaacaccaaagcaaagtataaagtttgtagtttatataataaaagcagcgtaggttaaggtgatcagcaaaatgtaaaaaccaaaaagtgaaaaactatctgactctggactggaaagactgatgaaactaaagcctaattttcgttatggaggaaaaatgatacgtggctttcgactacattctgctggaagttccgagacctgggttctcgcctagcagtccctgcttcttaattccttgcttattctgggacaagtcaccatcggtccctgcctcagtttcctcagctggatatattattttaatcactgtgagaaaatagaggtgttgatttaacattgatcattttcacattttgacaaccagtttacctgcctttgctccctttcacaactcttctttctcaatctcttggtttgtggtaaattcatttctataatagctcaagttaagaagagggtcttcttttcctgtcatcctgtgtaacaaaaatagcccaggaatagtgaggaatggtatcacttatgcacagattccagagtgtgaatgagactttagcgatggcagcacagtgtagccacatggagaggtgtgtgcggccctggtttcacttaagtgatgatgtgtgagggagactcgagaggaaggccccagcacctgcccagacagcacagtgccagagaaaagcattcagtgatcatgatagcacctgtgaggttttgtttttccttcttaacaagcgttagtcttttgaccacttgaagattttatgaccccagtttatataagaaatgtacttaatttgtcattaaaatttagtttccagaggctttttagtatgatatgtcagatatcctttttgaagaatatatgtatgaaaatgattgtaaatacaaatcttcttcggatttggggatcagttgctatgtggggatagtgtaaatgcttctgcacaagcttacggttccacttcggatcccctcagattgttaccagcgcttagaattcctgggagatgcgattttggactacctcataaccaagcacctttatgaagacccgcggcagcactccccgggggtcctgacagacctgcggtctgccctggtcaacaacaccatctttgcatcgctggctgtaaagtacgactaccacaagtacttcaaagctgtctctcctgagctcttccatgtcattgatgactttgtgcagtttcagcttgagaagaatgaaatgcaaggaatggattctgaggttagtgctgttcaaaacgatgttgaaaaaagtggtctaactaggagtctctgtagtttcagagttctgacggcatagtggtctaaagggacagcaggaggtcaggggtgtgggacccagtgtgctgtgttctgtgggagcacgagtgaactgcagtttgcaggtaggcctcttgaacttgtctgcccccactgtgggctgtgtggtcattcaggtgaagagaaggaaccaggcctttcagttaggtacccttcccacgccttcatgagggcttccagcattgaggcatgccaaagaagtggcctccactgccggaccccaaggcaggtttagctttagtaaaagcccagtgtagcttatccttccttttttaaatggatcagaaatatttgctaatatctcagggaagcatcataaatatacattctgcttctacttgaagtgggaaaatctaatttaaaaaacaaacttctaaatttttgaccattggaatttgggaggcttctattgtaagttcagccaaaggctgtctggtgacagagctaattctaatgtgtttgtgagctatttcgaatttttgtaggaaaggatattgcttagatctttccagtctcttaacattcatctgcatacctgtgtcccccagagagactctcatttcctcctcttcccatttcatttcctttgattttcttatttttgtagattttcttataaggagtcaggaaatacaaccttaatactagtagctgttttagttgtcattgctttaatttgtaccttcccctttttaattgcaccaaacctttgttggggagtagtgactttctatgacaaaaattaagagtaggtttgaagtctagccgcagagccgagttcacgccctgccagctgcccagatgtgcactggaggagtcagtaggccctgctcttactttaacgcgcctctgtgctcttgtccaagatgaacagcctgagctggagcgtggcaggctgtgaggcgagaaggcgggaccagctcgtagacttccaagtgttacctagtctcattctttagaaatagctaagcttgaaatttgaggaattagttaaaattagatttaagctctctttggatgccagtggggcatattggttttgttagtttttgttcattcttttccttccctttgtttatataaacatatgtatagaagttacaagaactgattggaaatgtcatggtctggcatttctaacttactatttgatcttaagaaagtctctttacctctctgggcctccgtttcctcagctgtaaaaagagagaattaaacttggtaagttttaaaattcctttctatctcaaaaccataaatatgaacaataagtctgtttttttaagtaatcagcagtataaatgtattatatgtaactttgtatggctaaacaacctattagaaattagtattttcccactttctctttatttttttcacaaatgatttgtgttgattttagaaaagttagtacaagtaaataagaagaaaattagttaaatttgcctgattatgctacctcggaaataaccaatattaacattttgggaggaattgtggatgtgtatagatataaacatatctaaaatgtaaaatggaattctgttatgtataggatactgtcacctgttcttttcacgtataatatattgtggctgactttccgtgtattgatgggtatcgtgatgctcaggggccacacgctagtcaacacgtggctgattgatttaaacgcttctttatggccgagtaattaagtagtttttggttaggatgtttaataaccatggaggtgataaatacgcttatgtatctagttacctccttaaaataagttcttagagatgcaattgctgcatcaaagaattgtgaacttttcaaaggcttttgatgcatgattttcttttattaatttgcatacatgctatgtcagatactcggttatagtgaacacatatctagtggcttaatgaagagggaacttggaggaaaaaatctttcaaatataatttccctatttccctacaacagcgatttctgctccccaaagcagcatacacccgtgccagcaccagaccaattagtactattgaatgcttgccaagcagctagggagtagaactgttttaaagtatagttctttgattacgagtgaatttgaatttttttcatacttttattgactatttctaattctttgttaaggttgtttaaagttagaagtaatcttttttctttgctgggtatatagaataataaatggggtggggatattttttctttttttcttgagaagtttgaaaaacttttttaaaaatataacatttgttttactattacaatatagtaggcataccataaatggtatttccccccttactaaagaagtaacaaaagtcatatatccaagaaaagaaactacatctgtggactgcctgtaaaagtggcctttttgcttacaagtcacttttccctctgtaatagcttaggagatctgaggaggatgaagagaaagaagaggatattgaagttccaaaggccatgggggatatttttgagtcgcttgctggtgccatttacatggatagtgggatgtcactggagacagtctggcaggtgtactatcccatgatgcggccactaataggtattgttggctccctttagaaagaaaaaaacccacaaaattaaaaacaacttcagagatattattcatattattctttcattttgattgcagaaaagttttctgcaaatgtaccccgttcccctgtgcgagaattgcttgaaatggaaccagaaactgccaaatttaggtaagcaaaaaatgtacatggaaaaaacattaacttaaaaacatcaaaggggaaaagttcacaaagatattgtaaactaatgattctgaaaaatatttacactgtggtgtgctgttgtcagatttctgtttgtaatctgattgacttctcttttttccttctgtttttatgaaataatgctgtaataaagactagacggcagccctgtctgtcgggggtatgcaatggcagtaagtcgtaacgcgtgtttcctttgtgtggtgtcagcttatacatgggactcctggcctgagagtgcacactaaatgctgattgacaatgataataaatacttctgacttctaattcaagctgtttggattttttacagcccggctgagagaacttacgacgggaaggtcagagtcactgtggaagtagtaggaaaggggaaatttaaaggtgttggtcgaagttacaggattgccaaatctgcagcagcaagaagagccctccgaagcctcaaagctaatcaacctcaggttcccaatagctgaaaccgctttttaaaattcaaaacaagaaacaaaacaaaaaaaattaaggggaaaattatttaaatcggaaaggaagacttaaagttgttagtgagtggaatgaattgaaggcagaatttaaagtttggttgataacaggatagataacagaataaaacatttaacatatgtataaaattttggaactaattgtagttttagttttttgcgcaaacacaatcttatcttctttcctcacttctgctttgtttaaatcacaagagtgctttaatgatgacatttagcaagtgctcaaaataattgacaggttttgtttttttttttttgagtttatgtcagctttgcttagtgttagaaggccatggagcttaaacctccagcagtccctaggatgatgtagattcttctccatctctccgtgtgtgcagtagtgccagtcctgcagtagttgataagctgaatagaaagataaggttttcgagaggagaagtgcgccaatgttgtcttttctttccacgttatactgtgtaaggtgatgttcccggtcgctgttgcacctgatagtaagggacagatttttaatgaacattggctggcatgttggtgaatcacattttagttttctgatgccacatagtcttgcataaaaaagggttcttgccttaaaagtgaaaccttcatggatagtctttaatctctgatctttttggaacaaactgttttacattcctttcattttattatgcattagacgttgagacagcgtgatacttacaactcactagtatagttgtaacttattacaggatcatactaaaatttctgtcatatgtatactgaagacattttaaaaaccagaatatgtagtctacggatattttttatcataaaaatgatctttggctaaacaccccattttactaaagtcctcctgccaggtagttcccactgatggaaatgtttatggcaaataattttgccttctaggctgttgctctaacaaaataaaccttagacatatcacacctaaaatatgctgcagattttataattgattggttacttatttaagaagcaaaacacagcacctttacccttagtctcctcacataaatttcttactatacttttcataatgttgcatgcatatttcacctaccaaagctgtgctgttaatgccgtgaaagtttaacgtttgcgataaactgccgtaattttgatacatctgtgatttaggtcattaatttagataaactagctcattatttccatctttggaaaaggccccaaaaaaaaacttctttaggcatatgcctaagtttctttaattagacttgtaggcactcttcacttaaatacctcagttcttcttttcttttgcatgcatttttcccctgtttggtgctatgtttatgtattatgcttgaaattttaatttttttttttttgcactgtaactataatacctcttaatttacctttttaaaagctgtgggtcagtcttgcactcccatcaacataccagtagaggtttgctgcaatttgccccgttaattatgcttgaagtttaagaaagctgagcagaggtgtctcatatttcccagcacatgattctgaacttgatgcttcgtggaatgctgcatttatatgtaagtgacatttgaatactgtccttcctgctttatctgcatcatccacccacagagaaatgcctctgtgcgagtgcaccgacagaaaactgtcagctctgctttctaaggaaccctgagtgaggggggtattaagcttctccagtgttttttgttgtctccaatcttaaacttaaattgagatctaaattattaaacgagtttttgagcaaattaggtgacttgttttaaaaatatttaattccgatttggaaccttagatgtctatttgattttttaaaaaaccttaatgtaagatatgaccagttaaaacaaagcaattcttgaattatataactgtaaaagtgtgcagttaacaaggctggatgtgaattttattctgagggtgatttgtgatcaagtttaatcacaaatctcttaatatttataaactacctgatgccaggagcttagggctttgcattgtgtctaatacattgatcccagtgttacgggattctcttgattcctggcaccaaaatcagattgttttcacagttatgattcccagtgggagaaaaatgcctcaatatatttgtaaccttaagaagagtatttttttgttaatactaagatgttcaaacttagacatgattaggtcatacattctcaggggttcaaatttccttctaccattcaaatgttttatcaacagcaaacttcagccgtttcactttttgttggagaaaaatagtagattttaatttgactcacagtttgaagcattctgtgatcccctggttactgagttaaaaaataaaaaagtacgagttagacatatgaaatggttatgaacgcttttgtgctgctgatttttaatgctgtaaagttttcctgtgtttagcttgttgaaatgttttgcatctgtcaattaaggaaaaaaaaaatcactctatgttgccccactttagagccctgtgtgccaccctgtgttcctgtgattgcaatgtgagaccgaatgtaatatggaaaacctaccagtggggtgtggttgtgccctgagcacgtgtgtaaaggactggggaggcgtgtcttgaaaaagcaactgcagaaattccttatgatgattgtgtgcaagttagttaacatgaaccttcatttgtaaattttttaaaatttcttttataatatgctttccgcagtcctaactatgctgcgttttataatagctttttcccttctgttctgttcatgtagcacagataagcattgcacttggtaccatgctttacctcatttcaagaaaatatgcttaacagagaggaaaaaaatgtggtttggccttgctgctgttttgatttatggaatttgaaaaagataattataatgcctgcaatgtgtcatatactcgcacaacttaaataggtcatttttgtctgtggcatttttactgtttgtgaaagtatgaaacagatttgttaactgaactcttaattatgtttttaaaatgtttgttatatttcttttcttttttcttttatattacgtgaagtgatgaaatttagaatgacctctaacactcctgtaattgtcttttaaaatactgatatttttatttgttaataatactttgccctcagaaagattctgataccctgccttgacaacatgaaacttgaggctgctttggttcatgaatccaggtgttcccccggcagtcggcttcttcagtcgctccctggaggcaggtgggcactgcagaggatcactggaatccagatcgagcgcagttcatgcacaaggccccgttgatttaaaatattggatcttgctctgttagggtgtctaatccctttacacaagattgaagccaccaaactgagaccttgatacctttttttaactgcatctgaaattatgttaagagtctttaacccatttgcattatctgcagaagagaaactcatgtcatgtttattacctatatggttgttttaattacatttgaataattatatttttccaaccactgattacttttcaggaatttaattatttccagataaatttctttattttatattgtacatgaaaagttttaaagatatgtttaagaccaagactattaaaatgatttttaaagttgttggagacgccaatagcaatatctaggaaatttgcattgagaccattgtattttccactagcagtgaaaatgatttttcacaactaacttgtaaatatattttaatcattacttctttttttctagtccatttttatttggacatcaaccacagacaatttaaattttatagatgcactaagaattcactgcagcagcaggttacatagcaaaaatgcaaaggtgaacaggaagtaaatttctggcttttctgctgtaaatagtgaaggaaaattactaaaatcaagtaaaactaatgcatattatttgattgacaataaaatatttaccatcacatgctgcagctgttttttaaggaacatgatgtcattcattcatacagtaatcatgctgcagaaatttgcagtctgcaccttatggatcacaattacctttagttgttttttttgtaataattgtagccaagtaaatctccaataaagttatcgtctgttca

SEQ ID NO: 11411 - DNA, 19521 bp, Homo sapiens
cagaaggggaaagcgcttcctttaagcagtgctgagaagaggaaagccaaatgggaaagtctgcagaataaacaggtaatgagttaattgtactagcataacttagtatttgtttgagtattaaagattattaaagataagtttgaattttatcttaccaagttaaatgcatgattcgttaattttttagaagttacctaatcctcaaattttgttttgttttgttttaattagtattatgtgttgaatgttatttgaatgttctttttggtaagtattgagagttttgtttttatacttggcccattaatatatcacaaaatcattctcataaatcctttgataaatcccatttggccttagaggattatttttacaaatattttttaaaattaagttttactagcatttatgattttctttatccattagtgaaattggtctttttttttttcttttgtgtgtgcgctttgtatttatctgtccatttttccccttacttgaagatactggttccagaactctgtgctatacatccaattccagcatcactgtggagaaaagctgtttgtctccccagcatactttatcgccttcactgccttttgactgcagaggagctaagagcccagactgccagcgatgctggcgtgggagtcagatcacttcctgcggattttaggtatgcctgtgcagtcagccagaaagaacacagatcatgagatcctgtttgcaaaagaacagaattaagttaaaattgtatataaaataattcttaaaagagtaaaaagaaaataatggatatcttatgtcttgtcaagtctcagagggagatgagaatctgaggtcagaaataaccattactgcttaagccataacagttggagtgagaatgaaattgttctttgttactgcatcagcattttcagtctgttttttcttttaaaaatccaaatatatgttaaaaagcaatagccttagcatgttctttgtcttcattattttcttcccattagtaaaatctctgcattctaaagaaactgttggcttaaacactcacattagttctggttatccaattggcaatatcaagactgttctagggattgaaggaattttaaaatataataggaataaccacaatatttattggttagttgctatagtgccaaacactagcttaaatgctgtaccctgtgttagttagctcatttaatcattaagacagtgctatgagataggaattgttagcccttttctcaggtgcagaagctgaggcacagagagtttatgtaagttgcccagagttactcagcgggttaaccagagtgcctgggattccaacccgtgaagctaggccccaggtcctgcaggatgcctgcaagcttcgtgaccttcttaactaccacacctagagtctagggccagggattaaagcagtagataaaaccatgtcccactttataatttacactgtaaattaaaaatttggaaacttgcttctattctaaagtttaggagtacatttttgggatctttgtttttgtttttaaattcaaattgctgttgctctcagcctagctgttttgaagaatctgatgtaaagttataaaaatgtctttgcagataccctaacttagacttcgggtggaaaaaatctattgacagcaaatctttcatctcaatttctaactcctcttcagctgaaaatgataattactgtaagcacagcacaattgtccctgaaaatgctgcacatcaaggtgctaatagaacctcctctctagaaaatcatgaccaaatgtctgtgaactgcagaacgttgctcagcgagtcccctggtaagctccacgttgaagtttcagcagatcttacagcaattaatggtctttcttacaatcaaaatctcgccaatggcagttatgatttagctaacagagacttttgccaaggaaatcagctaaattactacaagcaggaaatacccgtgcaaccaactacctcatattccattcagaatttatacagttacgagaaccagccccagcccagcgatgaatgtactctcctgagtaataaataccttgatggaaatgctaacaaatctacctcagatggaagtcctgtgatggccgtaatgcctggtacgacagacactattcaagtgctcaagggcaggatggattctgagcagagcccttctattgggtactcctcaaggactcttggccccaatcctggacttattcttcaggctttgactctgtcaaacgctagtgatggatttaacctggagcggcttgaaatgcttggcgactcctttttaaagcatgccatcaccacatatctattttgcacttaccctgatgcgcatgagggccgcctttcatatatgagaagcaaaaaggtaagagatgatttttttattttgagcagttaattattcagtgtgcctgaaagtggtttgcagtgttggataatctcagaggatgagaacgtatcatgctcagaaattgctacaccggccaagcacagctgctcccttgttctaccagggccagcgaaagcctgtggcagaactacctggcagttgatgagtattgctttacaccaatcccacactcaggttttggggcttagctgatctccacgtgccttactttttgattgaaagtcagttcaaaggaagctatgcaagtgtgtacaccccttgatcctgagggggatatgaagaaatgtgcattgtagtcagtcaaggagcttctgctttgttgagttaaacatttatttgagagggtacgtcttggcttacaaggcatacagacatgagtaagacacaagtcttgtggaggagctcatctccaaagttttggagagtggagcggagaagagtaacaagcttcacagagcttggctgctctccagtgtgaagagggtgacaccagagttctgagtaattaacgctcgatagctcagagaaagggcgggctcttaaactcagcatggactaagacttaagaaaaggaatgaaggtaagatattcaagttatgggggaaaaatggaaaaaagtctcacaaggcaacatgagcctcctggacaaataccttagaaagctgctgatcacttgcagcactcagaaggaaggagcatcactgttgaatcaaggatggcattaatggaggaggcaagttgacagtgcataagcaaagtgaacagatggcagagcatgtcagcgtcagggaagcagccgtggcagcagtcagaagtgtggaaatacctgagaaaaggcttgaaaaggcagctggggtgaagctgtatcgtggaaggccttgaatgctgggctaaggagtttgcacgtgttttgaatgttgtaggcactgttgaaggaatttagagcaaggaactattaatgttaataaagtggtagtttaaaatgattaatctggtagcagaatgtagtgtgagttgaaaagcatatccaaaccaacagcagaagcagagaatgggatagaactagagttctggtagagaggaaggggctgaggtgagtgagaatttcagaagaaataattttagctaacaatttaaaagtgcttactctgcactactctaaaagataaccgtatacgcacacacacgtacacacacccacatatatacacatatatgcatataaacctaatttaatttttataattctgagaggtagaaacttttattttccccattttataggtgagaataggctggagaagttagcttgcccaaggtcacttggcaagtaagtggcagagcttgggtcgaatccagacagcctggctttggagaccttccccttccccatcacactaactgctccggatagaaccatcacaccaggcagcacaccaagcatttcccaagtgctcactcattcactcttctctaagcctctgggaaagagacaacacatccctgttttgcagatgaggggactcacacttagagagtcgaatgggctcctgtcaggtcacctaactgttcatctgggagagtcaggagtgtgtccaaggcctcccaggatgatcttgaggtggactggaggcgcagtcataacaaccacgtaaactggcaacttgggggcagtggcagtagcagggaggtagggagaaatgtgggaagtccatgttagagttgagattttagacctcatggaatatgaagtggaaatgttcagataattgaggctgtaggattcagatacggttttgtagagtagtcgccatacggaagctctgagaatggatgagatttccaagaggtggttgcaggaagaaagtatcagaggcttggacaagtgtggcataggcaataggataggatactctgttagacaagacagaggtgactttctattacaaaactcgtccatttgtctgctcagaaaccttctactccttatttctgcagaaagaatgatcactccctcagcctgctgttcaggccctttcagccctgatgcgttttggatcctaagcaggtggaagccccttgcagctcattggacagactccacgctcagacccccagccttggggcccttgctctgtccttccttctgcagagggcttgcctccatctctacctgtccagaattttgccccatatttgagaccttacgtagctctttcttcatcctgcccaccatttctgtcaacttggaatgtgatttccctcccatgagtccacgttgtactttatcctcttcttggcgcttgtgatgctttgttctcttagcttggaaagggaagctagcatttatttcagcctgctacgtttcaggcagagagggagagtacttttggctatagtggtcacacgtaccctccttttccctgctagcctgtgtgtcacgaggactgcccctctgtcctgctgccatcgttccctcagggttgcccaatcgagtgcctctcatatggggggtgtctattaaacaatagttgagttacatgggaagagggctaatgaagtacttaataataaggaaccgagctttatgaaaatgaaaatgggattgacaattctagaccctagtttccaagtactaacttgacagaaatgcaatgatgtgagaaattaagaaggagatagaggcattaggaaaaacagaccggagtagagggtaagatagtaaagctgttccattaatgtgaataaacagaaaccttttggttcattttttttaagttgaataaaagtgtcttgaaatggctgtaaaacaaaggaataatatttgagagagcattacagttgaaatcccgtttgtggcttcgattctaggaatataacattgtttcagttttgttcggtgccagttttcactttgcagctagagctgatggcatcctccccccatttcattgaaaatattgtgacatcttgactttttctatgggttcttttctactttggtaattccagttagcagtttgcattttatatcatcaggttgtattttcaaggctttgatattgtctgaagtgtttcttctcagtcattcataaggagtatgcatagttatatacattattttttctgctctgcatcttatattcagaaatatttacaccaaaaaagcatagaatatgtgggaatttaatattctttttataacatgaatgggtagaaaaactgtagagcccttataattaattgatgacatataattaattgattaattttaagaacatttaactgaggatatgttaatatgccttgaatgaattccagcagtgatcatttatggataagtatcctaatattttctgctaaaggtcagcaactgtaatctgtatcgccttggaaaaaagaagggactacccagccgcatggtggtgtcaatatttgatccccctgtgaattggcttcctcctggttatgtagtaaatcaagacaaaagcaacacagataaatgggaaaaagatgaaatggtaagtttttgtgtgtgtgtgtgtgtgtgtgtgtgtgtgtgtgtaactggagggatttacttttcggtgagccaaataatttgttttattaattttttgtttcattttcttggtatgtttataatagagtagatatttgatatatttaattaattcctttaattacactgtcttttcactgaattcagaaatagtattataattttgatggaggcaaatttctatttttattatttcttttccaaaggcataagagtatgtgatgttttgactttgagttttgctcttctttaaaaaaatttcactttgctgttattacaatttatcctagatccttagctctgttcagtgaaatgacttttcagtgacctgtgatctccagtctgtctgtgaaataattaatttcagtaaaatcttgcttttgtagctcagggttttcccagtcaggactcctgtgaacttaaaaaaaaaaaatcatccataaagattgttattttctggaaataatttaaatcttgccagtgacttaagaagactccaaatatcagcaacagccgcttcattttgtcttgtcttgaaggccaccagagggcacttgggagggcctccaaactgcaggaaccagcgcagtggtggttgactgggagagttctagtgcctcttccgaagttaaaggcaatgcttcagacagtttcatttcttggagatttattttgcattaaaaataaattggctcattgttacttcatttttacctcaggccaacaatgataataccgtttttttctttcaaaggttatatttttaaatatccattttctccatgtcttctttgtgatgcatgtatcctatatatctgcctttaagtatttccaggtagcatgttcagtgacactatttggatttttacctatttattgaggatgtttttaactcatgtagtatttgtcttattacagaattagaacttatttggaaaagcattaagggaatattttaatgcaagttaggtccgaacaattatttgttattaatttagaaatatgtagaaccttagaggaaaatgtatagattttcaactttagaaatggtatggtatttctatgaataacattccagtaacagtcatcctcctttgttaataccgtttcataatgtttttggctctttttaaaaacttgtagcatgaaggtgacattggcatgtcattgattttttttttaagatacaacacaaagttcaatttatttttcttaatgtttctgatggcactttggttattggaattcattagaaatactgttcagatttttatttagtaagttacttttattgaaatataggcccttgcattatattgaaaagatacactgtggttttggctggttgcattgccattctccctaccttgctctggcccttcagcaaatgggcttaagtggaaacctttgcatgctaaaacgcctcttaatagacgagagtatcaaagttgacttgaatgatatagaaaaggatttcatgtggctgttttttcttaaaaggcttgaagtgctcttgaaaaacattttatgagacagaaccccactcttttgtagatgaagcatctgaaacccagaggcactaaaaggctttgcccaggatcacacagtttgtgataaaagtcagccctttgtgatttttgtgctctgccacttttggcttatggtggcacctttctaaagatacagaaggtttttttcaataaaaaaaaaatattgtctgattttttaaaaatcgcagtttggccctctttttcttaaggaccaatcaaaaacatcttcatgttgccttggaaagtctaagattgttagcaggaaatgttccttgaggtctgccgctacagttgcttttggtgttccttattcttgaaaaggtgtttctttcttaattaaaaaaatgaaaagataaatagttagagatatggcttggcttactgctatttcttttcagacaaatgtagtgtttatatcttgagtctagtttaaaatatttgtagtatttaaaaaatgcttgaaggttgcaacttttttttgtcagaacactggaaagttgttacaatcaacattgatgcacacccttcgtcttcccccttcacaagttttttggttttttaaaaacttgcataacagaaatttggcatctttctaggattgcaaagaagttacatcattactgaaatctagcccattattaaggttgtcactcacaaataagcttttgccaaagaaattggaattagcaaagatcttttgacagaaattggattgttgtgtttcatgttagtctaaattttcttccatttttgtcagttatgctataatctgttcccctgattaccgtagttcagagtggagggaaaaagcgtaacttctcaaattcatagcttagtgcagtgatcacttttattttttaaggaaagcagtgtagtttttttgtggcaagtatactttgaagtggaaatagggacaaaaagctttattataaaatcctattgtacattttaaaaaatgattttatctgtttttatattatattcttaattgcaaaggtaatgcttttctacatctggaatttcgttttattagtttgaaaatctttttgaaaatcaaattaccacattttcaaattttgtcagcaaaattgaagatctgtgtgatcagcatatgagtgctttcattgtgtgtcctaccagagttagacgacttagttgaagttttgcattgtggacattaattttaactttatatccatgttcaaagtccttaacttaaagcttcatactggataaaggtcattttataacttagaaaacgaacattcaaagaacatgttttactttgtttatatgattaaataacttattttatgttaattgaaaacaaatggccatgattttaaagttgccttttagtatttgtggttgtcatttgaaattatccataacccttgcttttattgagtttcaaacccttttaaaaacagcagctatgtttcccctccttccccattccccctcgtttcagacaaaagactgcatgctggcgaatggcaaactggatgaggattacgaggaggaggatgaggaggaggagagcctgatgtggagggctccgaaggaagaggctgactatgaagatgatttcctggagtatgatcaggaacatatcagatttatagataatatgttaatggggtcaggagcttttgtaaagaaaatctctctttctcctttttcaaccactgattctgcatatgaatggaaaatgcccaaaaaatcctccttaggtagtatgccattttcatcagattttgaggattttgactacagctcttgggatgcaatgtgctatctggatcctagcaaagctgttgaagaagatgactttgtggtggggttctggaatccatcagaagaaaactgtggtgttgacacgggaaagcagtccatttcttacgacttgcacactgagcagtgtattgctgacaaaagcatagcggactgtgtggaagccctgctgggctgctatttaaccagctgtggggagagggctgctcagcttttcctctgttcactggggctgaaggtgctcccggtaattaaaaggactgatcgggaaaaggccctgtgccctactcgggagaatttcaacagccaacaaaagaacctttcagtgagctgtgctgctgcttctgtggccagttcacgctcttctgtattgaaagactcggaatatggttgtttgaagattccaccaagatgtatgtttgatcatccagatgcagataaaacactgaatcaccttatatcggggtttgaaaattttgaaaagaaaatcaactacagattcaagaataaggcttaccttctccaggcttttacacatgcctcctaccactacaatactatcactggtaaggagcccacgaccagacttcatttctgggaaaatgagactttgtgttgatctcatcgtgttggccttgtaaaagtgatctatgcatgtacagtgttcatgcttaatattcaagggatggggcggggaacaaaaggaatagaaagaattcttttccttgttatttggggagcacgtattgctttataactttggttgttgggagtatggctatcatataccctcatcagtgtcattttatatctgcctaattagagaaattttaaccttagtattttgatgtgttttccccattttatcctccgcaaatatctttctcttgcccattcagtgctgcttttggtttttgatttagttgtatattctggatgtatttccacagccttttattgttcttcctggacaaaaagacccctcctttagggtctttttaaagatggatagattaaaagattaaaagcaatgatttcacaagaaggttgcgtggcccttgctgtgactctgctgtcatcttctacttctcactgtgctctgtatttgcccctcttttaatagactgtcaacccattagattagaagggagaacaagcccctcacacccaaatcagcttcaggctgtgaaacacagctgaagtttacatttcaatttctgtatcagaaaaataagtgcctgaattcagaacaccaaagcaaagtataaagtttgtagtttatataataaaagcagcgtaggttaaggtgatcagcaaaatgtaaaaaccaaaaagtgaaaaactatctgactctggactggaaagactgatgaaactaaagcctaattttcgttatggaggaaaaatgatacgtggctttcgactacattctgctggaagttccgagacctgggttctcgcctagcagtccctgcttctaaattccttgcttattctgggacaagtcaccatcggtccctgcctcagtttcctcagctggatatattattttaatcactgtgagaaaatagaggtgttgatttaacattgatcattttcacattttgacaaccagtttacctgcctttgctccctttcacaactcttctttctcaatctcttggtttgtggtaaattcatttctataatagctcaagttaagaagagggtcttcttttcctgtcatcctgtgtaacaaaaatagcccaggaatagtgaggaatggtatcacttatgcacagattccagagtgtgaatgagactttagcgatggcagcacagtgtagccacatggagaggtgtgtgcggccctggtttcacttaagtgatgatgtgtgagggagactcgagaggaaggccccagcacctgcccagacagcacagtgccagagaaaagcattcagtgatcatgatagcacctgtgaggttttgtttttccttcttaacaagcgttagtcttttgaccacttgaagattttatgaccccagtttatataagagatgtacttaatttgtcattaaaatttagtttccagaggctttttagtatgatatgtcagatatcctttttgaagaatatatgtatgaaaatgattgtaaatacaaatcttcttcggatttggggatcagttgctatgtggggatagtgtaaatgcttctgcacaagcttacggttccacttcggatcccctcagattgttaccagcgcttagaattcctgggagatgcgattttggactacctcataaccaagcacctttatgaagacccgcggcagcactccccgggggtcctgacagacctgcggtctgccctggtcaacaacaccatctttgcatcgctggctgtaaagtacgactaccacaagtacttcaaagctgtctctcctgagctcttccatgtcattgatgactttgtgcagtttcagcttgagaagaatgaaatgcaaggaatggattctgaggttagtgctgttcaaaacgatgttgaaaaaagtggtctaactaggagtctctgtagtttcagagttctgacggcatagtggtctaaagggacagcaggaggtcaggggtgtgggacccagtgtgctgtgttctgtgggagcacgagtgaactgcagtttgcaggtaggcctcttgaacttgtctgcccccactgtgggctgtgtggtcattcaggtgaagagaaggaaccaggcctttcagttaggtacccttcccacgccttcatgagggcttccagcattgaggcatgccaaagaagtggcctccactgccggaccccaaggcaggtttagctttagtaaaagcccagtgtagcttatccttccttttttaaatggatcagaaatatttgctaatatctcagggaagcatcataaatatacattctgcttctacttgaagtgggaaaatctaatttaaaaaacaaacttctaaatttttgaccattggaatttgggaggcttctattgtaagttcagccaaaggctgtctggtgacagagctaattctaatgtgtttgtgagctatttcgaatttttgtaggaaaggatattgcttagatctttccagtctcttaacattcatctgcatacctgtgtcccccagagagactctcatttcctcctcttcccatttcatttcctttgattttcttatttttgtagattttcttataaggagtcaggaaatacaaccttaatactagtagctgttttagttgtcattgctttaatttgtaccttcccctttttaattgcaccaaacctttgttggggagtagtgactttctatgacaaaaattaagagtaggtttgaagtctagccgcagagccgagttcacgccctgccagctgcccagatgtgcactggaggagtcagtaggccctgctcttactttaacgcgcctctgtgctcttgtccaagatgaacagcctgagctggagcgtggcaggctgtgaggcgagaaggcgggaccagctcgtagacttccaagtgttacctagtctcattctttagaaatagctaagcttgaaatttgaggaattagttaaaattagatttaagctctctttggatgccagtggggcatattggttttgttagtttttgttcattcttttccttccctttgtttatataaacatatgtatagaagttacaagaactgattggaaatgtcatggtctggcatttctaacttactatttgatcttaagaaagtctctttacctctctgggcctccgtttcctcagctgtaaaaagagagaattaaacttggtaagttttaaaattcctttctatctcaaaaccataaatatgaacaataagtctgtttttttaagtaatcagcagtataaatgtattatatgtaactttgtatggctaaacaacctattagaaattagtattttcccactttctctttatttttttcacaaatgatttgtgttgattttagaaaagttagtacaagtaaataagaagaaaattagttaaatttgcctgattatgctacctcggaaataaccaatattaacattttgggaggaattgtggatgtgtatagatataaacatatctaaaatgtaaaatggaattctattatgtataggatactgtcacctgttcttttcacgtataatatattgtggctgactttccgtgtattgatgggtatcgtgatgctcaggggccacacgctagtcaacacgtggctgattgatttaaacgcttctttatggccgagtaattaagtagtttttggttaggatgtttaataaccatggaggtgataaatacgcttatgtatctagttacctccttaaaataagttcttagagatgcaattgctgcatcaaagaattgtgaacttttcaaaggcttttgatgcatgattttcttttattaatttgcatacatgctatgtcagatactcggttatagtgaacacatatctagtggcttaatgaagagggaacttggaggaaaaaatctttcaaatataatttccctatttccctacaacagcgatttctgctccccaaagcagcatacacccgtgccagcaccagaccaattagtactattgaatgcttgccaagcagctagggagtagaactgttttaaagtatagttctttgattacgagtgaatttgaatttttttcatacttttattgactatttctaattctttgttaaggttgtttaaagttagaagtaatcttttttctttgctgggtatatagaataataaatggggtggggatattttttctttttttcttgagaagtttgaaaaacttttttaaaaatataacatttgttttactattacaatatagtaggcataccataaatggtatttccccccttactaaagaagtaacaaaagtcatatatccaagaaaagaaactacatctgtggactgcctgtaaaagtggcctttttgcttacaagtcacttttccctctgtaatagcttaggagatctgaggaggatgaagagaaagaagaggatattgaagttccaaaggccatgggggatatttttgagtcgcttgctggtgccatttacatggatagtgggatgtcactggagacagtctggcaggtgtactatcccatgatgcggccactaataggtattgttggctccctttagaaagaaaaaaacccacaaaattaaaaacaacttcagagatattattcatattattctttcattttgattgcagaaaagttttctgcaaatgtaccccgttcccctgtgcgagaattgcttgaaatggaaccagaaactgccaaatttaggtaagcaaaaaatgtacatggaaaaaacattaacttaaaaacatcaaaggggaaaagttcacaaagatattgtaaactaatgattctgaaaaatatttacactgtggtgtgctgttgtcagatttctgtttgtaatctgattgacttctcttttttccttctgtttttatgaaataatgctgtaataaagactagacggcagccctgtctgtcgggggtatgcaattgcagtaagtcgtaacgcgtgtttcctttgtgtggtgtcagcttatacatgggactcctggcctgagagtgcacactaaatgctgattgacaatgataataaatacttctgacttctaattcaagctgtttggattttttacagcccggctgagagaacttacgacgggaaggtcagagtcactgtggaagtagtaggaaaggggaaatttaaaggtgttggtcgaagttacaggattgccaaatctgcagcagcaagaagagccctccgaagcctcaaagctaatcaacctcaggttcccaatagctgaaaccgctttttaaaattcaaaacaagaaacaaaacaaaaaaaattaaggggaaaattatttaaatcggaaaggaagacttaaagttgatagtgagtggaatgaattgaaggcagaatttaaagtttggttgataacaggatagataacagaataaaacatttaacatatgtataaaattttggaactaattgtagttttagttttttgcgcaaacacaatcttatcttctttcctcacttctgctttgtttaaatcacaagagtgctttaatgatgacatttagcaagtgctcaaaataattgacaggttttgttttttttttttgagtttatgtcagctttgcttagtgttagaaggccatggagcttaaacctccagcagtccctaggatgatgtagattcttctccatctctccgtgtgtgcagtagtgccagtcctgcagtagttgataagctgaatagaaagataaggttttcgagaggagaagtgcgccaatgttgtcttttctttccacgttatactgtgtaaggtgatgttcccggtcgctgttgcacctgatagtaagggacagatttttaatgaacattggctggcatgttggtgaatcacattttagttttctgatgccacatagtcttgcataaaaaagggttcttgccttaaaagtgaaaccttcatggatagtctttaatctctgatctttttggaacaaactgttttacattcctttcattttattatgcattagacgttgagacagcgtgatacttacaactcactagtatagttgtaacttattacaggatcatactaaaatttctgtcatatgtatactgaagacattttaaaaaccagaatatgtagtctacggatattttttatcataaaaatgatctttggctaaacaccccattttactaaagtcctcctgccaggtagttcccactgatggaaatgtttatggcaaataattttgccttctaggctgttgctctaacaaaataaaccttagacatatcacacctaaaatatgctgcagattttataattgattggttacttatttaagaagcaaaacacagcacctttacccttagtctcctcacataaatttcttactatacttttcataatgttgcatgcatatttcacctaccaaagctgtgctgttaatgccgtgaaagtttaacgtttgcgataaactgccgtaattttgatacatctgtgatttaggtcattaatttagataaactagctcattatttccatctttggaaaaggaaaaaaaaaaaaacttctttaggcatttgcctaagtttctttaattagacttgtaggcactcttcacttaaatacctcagttcttcttttcttttgcatgcatttttcccctgtttggtgctatgtttatgtattatgcttgaaattttaattttttttttttttgcactgtaactataatacctcttaatttacctttttaaaagctgtgggtcagtcttgcactcccatcaacataccagtagaggtttgctgcaatttgccccgttaattatgcttgaagtttaagaaagctgagcagaggtgtctcatatttcccagcacatgattctgaacttgatgcttcatggaatgctgcatttatatgtaagtgacatttgaatactgtccttcctgctttatctgcatcatccacccacagagaaatgcctctgtgcgagtgcaccgacagaaaactgtcagctctgctttctaaggaaccctgagtgaggggggtattaagcttctccagtgttttttgttgtctccaatcttaaacttaaattgagatctaaattattaaacgagtttttgagcaaattaggtgacttgttttaaaaatatttaattccgatttggaaccttagatgtctatttgattttttaaaaaaccttaatgtaagatatgaccagttaaaacaaagcaattcttgaattatataactgtaaaagtgtgcagttaacaaggctggatgtgaattttattctgagggtgatttgtgatcaagtttaatcacaaatctcttaatatttataaactacctgatgccaggagcttagggctttgcattgtgtctaatacattgatcccagtgttacgggattctcttgattcctggcaccaaaatcagattgttttcacagttatgattcccagtgggagaaaaatgcctcaatatatttgtaaccttaagaagagtatttttttgttaatactaagatgttcaaacttagacatgattaggtcatacattctcaggggttcaaatttccttctaccattcaaatgttttatcaacagcaaacttcagccgtttcactttttgttggagaaaaatagtagattttaatttgactcacagtttgaagcattctgtgatcccctggttactgagttaaaaaataaaaaagtacgagttagacatatgaaatggttatgaacgcttttgtgctgctgatttttaatgctgtaaagttttcctgtgtttagcttgttgaaatgttttgcatctgtcaattaaggaaaaaaaaaatcactctatgttgccccactttagagccctgtgtgccaccctgtgttcctgtgattgcaatgtgagaccgaatgtaatatggaaaacctaccagtggggtgtggttgtgccctgagcgcgtgtgtaaaggactggggaggcgtgtcttgaaaaagcaactgcagaaattccttatgatgattgtgtgcaagttagttaacatgaaccttcatttgtaaattttttaaaatttcttttataatatgctttccgcagtcctaactatgctgcgttttataatagctttttcccttctgttctgttcatgtagcacagataagcattgcacttggtaccatgctttacctcatttcaagaaaatatgcttaacagagaggaaaaaaatgtggtttggccttgctgctgttttgatttatggaatttgaaaaagataattataatgcctgcaatgtgtcatatactcgcacaacttaaataggtcatttttgtctgtggcatttttactgtttgtgaaagtatgaaacagatttgttaactgaactcttaattatgtttttaaaatgtttgttatatttcttttcttttttcttttatattacgtgaagtgatgaaatttagaatgacctctaacactcctgtaattgtcttttaaaatactgatatttttatttgttaataatactttgccctcagaaagattctgataccctgccttgacaacatgaaacttgaggctgctttggttcatgaatccaggtgttcccccggcagtcggcttcttcagtcgctccctggaggcaggtgggcactgcagaggatcactggaatccagatcgagcgcagttcatgcacaaggccccgttgatttaaaatattggatcttgctctgttagggtgtctaatccctttacacaagattgaagccaccaaactgagaccttgatacctttttttaactgcatctgaaattatgttaagagtctttaacccatttgcattatctgcagaagagaaactcatgtcatgtttattacctatatggttgttttaattacatttgaataattatatttttccaaccactgattacttttcaggaatttaattatttccagataaatttctttattttatattgtacatgaaaagttttaaagatatgtttaagaccaagactattaaaatgatttttaaagttgttggagacgccaatagcaatatctaggaaatttgcattgagaccattgtattttccactagcagtgaaaatgatttttcacaactaacttgtaaatatattttaatcattacttctttttttctagtccatttttatttggacatcaaccacagacaatttaaattttatagatgcactaagaattcactgcagcagcaggttacatagcaaaaatgcaaaggtgaacaggaagtaaatttctggcttttctgctgtaaatagtgaaggaaaattactaaaatcaagtaaaactaatgcatattatttgattgacaataaaatatttaccatcacatgctgcagctgttttttaaggaacatgatgtcattcattcatacagtaatcatgctgcagaaatttgcagtctgcaccttatggatcacaattacctttagttgttttttttgtaataattgtagccaagtaaatctccaataaagttatcgtctgttca

SEQ ID NO: 11412 - DNA, 126 bp, Homo sapiens
agggattcaccagcctcagcctcccgagtagctgggactacaggcgcccgccaccacgccaggctaattttttgtatttttagtagagaaggggtttcaccatgttacccaggatggtcttgatct

SEQ ID NO: 11413 - DNA, 126 bp, Homo sapiens; identical to SEQ ID NO: 11412

SEQ ID NO: 11414 - DNA, 10417 bp, Homo sapiens
aaagttttgaagaagaccttaaaacctacaaagctattgaaaaggtaagatcaacatattaacatgtgccggcagattgggaaaaaaaattaatgtggcttctttgttattctttgtatccataggaacagataatgagttttatctacaggcaataatctcaaaagaggtgtactctgtgtacattgtaaggaagttgagaatgatcacaaagacccggcagtgttatacaaagtgtttgaaagggcacaataagataacagtgaaaatgatcatcacatatgttatttgggatgaacgtctgggaaattgcattgcaaatatggacagtaactgttgactgcttaagttattgagtgattggaaaatgatgacatggtagttacattcagaaagactaacagtcgtgtgtgtgtgtgtgtgtgtgtgtgtgtgtgtctgtgtaggcacggtacagtatagactttgtaccatatggtaagggtctccatacgattggaactgggagggattcattggaagaaggtgtctgcagcaggttactttggagtactgaagtatgtttaggagagagagagatattttcaggagagttttttctgtaggtacagaggcagacagcatacagcagagaggatgtgttttcatcataagttctgttttttaaatgttcagatcttgagaaacaagtgttccaagtcggttgatactggtgagactgacattgatcctgtcatggatgatgatgacgttttcccaccatatgtgttgaggcctgacgatggtggtccacgagtcacaatcaacacggccattggacacatcaataggtatggcatcatatcatttgtgtggaaaacctgggaatgttgcacagtttaagtctaaacctgtacattttgtattgttgacattttgcggttaccagtctttacttagacttgccatattttcgataaagaaaagttacttcttttttcatttttttttaaatcaaaaggcaaaaacagtatcgtgcagcaataaaagttcagtattccttggcaaggctaacataatgaaggcattttaaattaggtttaatttaattttataattctcaccaatttttttctaaatcctgaaattttttgttttgtgccataaccattgggtaatgttgaattttcccctagcaataaagtaagattgtgataaactaatttatgtttttgggtacattgtaatttactttgtccagagctgataataaaatttctaagagctaagaacagcaaatgcattcctggattatataccaggataatttctattcagagacaaaagagcaagtataagattttctttgtaaccttttattttgaaacaatttcaaactttaaagtgttgtaagaatactagaattccgcatatgcctttcacccagacaccaagagagactcattcagtttcatgagaatgttctttgtagccaaagtatctaccttagagtcaggagttgtcctcaactcctgttgtcacatcttcctagtctccttcaatctggaaccattctttagtctctccttgactttaatgaccttgaaactttggaagatagataggctgtcattttgtagtcttactgtcagtctgggtttgtctgctattttcttatgatgagacccaggttacaaatttttgggcagcacatcactgagacgatggtgtcctctcctcatcctagcttaccaagtcgcacaccatgttgatttgtgcccttaccggtggtaacttagatcacttgagtgaagtctgccagttttctctactgtaaagttccctttcaccccttttataattagtagatatttcatggggagatactttgagacggtataaaatttgttccttttcccagtttgactcattagtgtaagcattctttgatatttctggcccaaattgattattactatgatggctactaaatgattttctaactccattatttctgtatttattagttggcattctaccatccatttcttctctccgtttattcattcttatattatcattttttaatgtcagtgtgaacttatggactcctgttttatttaatgggttataatctatcattatcatttactgtttgttttgatgttaaaattgtttcatatttggccagtgggaaccccttaaagctggtttctttgtctttttaacatctcactattattccttgaatacttccttgttttatggcgcaagacattctagactgccccagccttgatgttggcaatttcctcgaatttagtggagaaaaagttgtagttagaaaccaagaactggatactaggtttattcattgctaccggtgtgttgctgctgccaggcgttttagtggacagagctagaatgtttgtttgttcatgtttacatctgtatttgtttcagtgtctatctgttgatatctctattttcagtgtgacactagaggtttcattctagatttcctcctttctgtctttgtacctcctttctctaataatcagaaatttggctcccattgtcctcaaaataattagtgttcagtcttcctgtatgtagccagtctccctgctctgtagggctgcaactgtggtcaggtgcccttgctgcacaggtcgcaacctcacagggctgctgcccattccagcaccctcctgatgtgggtcctgtcccagcatccctttctgggctagctttctgccctgttccaaccttccctggtgctgttgctcagtgagttgctagttctactgtcctttttgtgtcagcactgggctgtcccgccctctgctgatgccttccttatatgtgtgctggtagttggtgggaaatgtaagatgattaaggaaaaaacattggcagtatgttttcttactggattctgaacaatactttgtgctctattatggtaacactcgacacatgttactatttaaattcaaaattcaatttaaaataaaataaaaaatggagtttcgtagttgtacttctcacatttcaagtgctcaccagccactgccctgttgggcatcgaagatatagaacatctttgcagaagttctgttagacaacactattctgtcttattcgaagtttgaagcagtaaagtttaaatgccacatataaatacaaattcagtagaggggaagaggcacatgacaaatcaaactcgaggttataaatatcaatattttctcagttgtagattcagcctcagaatttctttttcttcacagatactgtgctagattaccaagtgatccgtttactcatctagctcctaaatgcagaacccgagagttgcctgatggtacattttattcaactctttatctgccaattaactcacctcttcgagcctccattgttgtaagtttagaagaagaaatgattgttatcttttaaaatgtgtcattagtggattttttcagcttttctaagacttgcaagttataggtaaatttgattttaaaatctactttcatgagcaggagccttgtgttgacagaccaaaaataaaaataaaaaccaaatttactttcaaaagtagatttatagattgcttttgtagtcatctacatgttcatatttgtaatagactgtctaatttacagatacttagaactggactaggtgatctctgaagtttcttctaaggtgttactaacatgcacatttttgacagaatcattcaactgtggcttagacacttagagtaatataaaacttattatagatcgttgcgttgtcctagttattttgttggtgactcaaaaatctgctttttgtaaatactgttcttggtctcagtactgatttccaagtgttccaaggtgactaatttctattgcacataaaaagctgctcaatactgttaatgttatagctatgttttgataaatctttctttttgttacatatttattgattagtaaaaataagatactttaaaatcttactgaaatttaaattcatcaaaattgtaaaatcttaattatgacttagtttttactaggcaggacttttaaagatgaatatttcaaatatggagattagaatttttaaaaacttgctggaatttttcaaaataaagaattttgttttggtaaattgaactttaaaaatgttggggcagtggtttcataggtgtttcatgtgctagaggtaatacagcgatgtgcatatataatggaaaggtttttgttattttcagggtccaccaatgagctgtgtacgattggctgaaagagttgtagctctcatttgctgtgagaaactgcacaaaattggtaaggatgtttgaaaagcatatacgaatgaaaataaattgcaaccattgtaaaaaaaaagcatatagaggactttatagatctgtaaggattttgtagagctattcacttgctgatcttaatgtgctttggtgaatataaacataagtgttagtaacttgaagatcctacattgttgtgggagctctttgttttccatagcttgactgcaaacaactgtcatttatttgctctctttaatgactccttttaagtacataaaggtcttttcgtaattgttgaatcatgcaccatgaacacttgtgttttaatatgtcagtctctcaaattagtctatactagtatagaaattaatccttttttaaaaaatgaactcagtttcttttttttttttttctcaatcctgctcctgtataagtggacccattttctatggccattttatttagcattgatatgtggtgatgtcatgtttagatgtttttgtttctgaaccttagaacagaatttgcagtccagctcatattggaatatatggatgccaaaatagactttgcctgaagtgtgaatctgattacttttaaattgtaaaaggcaaaggtgctttagtttccattacttttccaggtccttctaacatagttctgttctaaattctttactaattaatcaggcaaaatctggattgtgttaattctctctttaaatttgttaggcgaactggatgaccatttgatgccagttgggaaagagactgttaaatatgaagaggagcttgatttgcatgatgaagaagagaccagtgttccaggaagaccaggttccacgaaacgaaggcagtgctacccaaaagcagttagtattggttagaacagagtaaaaacctagcatttctgactttgttttccgctacatcaaatctcagttcctctgcttggctggcttcccacacccttacagtttggcccactctggatctcagctcctttctccgattcacagcttctctcagatcagcctctttccttcctaatgtagaatgtgtgctcttccacttcagaggttgcttttgtttttcttctcaaaaggattcttggacccatctgtcatattctatccagaatgagattatttcatttaaatagacattctttgtttcattcagtttagtggtgtgattcttgttttacttatgatttggggctaagacagaagaggatttgtgtgataaaataagcaagtgaaaagatgccctctcaagatgacaggtacactggaaggtagaagcacaaatatctgtcaggagttatgtcagattcccagtgtgggccattgggaatcgaaataagttatttccatggagtgtttccagctcaatctgtgggcatcctagcagagttcacacatgaaagcatctctaaatctaacttctagtaatagacaaacttggctgaagtatttatttttaaaatatttgttaatatttttacctcataagaaccccaagcaaaagcagaattttgctgtgtgtagtagtcccgcttacccttggagggtatgttccaagacccacagtggaaactgcagatagtaccgatcctccagcagctcaacgttgtttcattagaacgttgacaaggaaaaaaaaaatcgttcccagccagggccactgtctctatgtggggttggcacattctcctcatgtctgcttactccggtttcctactacatcccaaaactgtgcacatcaggtgaactggcgtgtctgcactgccccactgtgagtgagcatggggatgcatgtgcgtgtgccctgccacagagtggtgtcctgtccgggatgggttcctgcatggggccctgagctgccaggatagactctggcacccttggccctgaactggaataagtgggtgaataatcatcttccttgtttttattcatctttcttaagtgtatctatagctcacatttattttaatgcttaatattaaaagtgtttttttttaatttagaaatttggtgatgtttttgtgatcagaaatgtgctggaggaatttaactgatttatgtcaattagcctgtgggaaaattggtttctttctaccaattggttgtttcccttagccagtttctaagaacctgccgaagacattaagtgaggacttacagcatatattatgctttttaaaatacgtttgtacatatttatgatagtttaagatataaattaggcacagtaataacaaaatagaacaattgtaaccatatactgtaataaaagttatgtgaatgtggtctctctcaaaatactgtactgtacacacctgttattggaccgtgactgacctcaggttactgaaaccatggaggctgcagataagcggggactgctgtgcctgtatgttagcctaaatatgtgtttctttggttttgcttatgcagttttaccaagtttttactttataaaattttgcacccagcttagcattttcaagattcagaatcatgtttttaaaaaatcatgaatgttacccattttcccaaaatgcatgttttcctcataccaaattttcacgtgagactagtttcatgtgataaagtcgttaatgataagtgtttctaaaagcatagtattggctgggtgtggtggttcacacctgtgatcccagcattttaggaggctgaggcaggaggatcacttgaggccaggaatccgagaccagcctggtcaacatagtgagaccttgtctctacaaaaaaagaaaagcatagtactgcctggcatcctgtttaattaatagatacattctttattttctgattctctattaaatataactgtctcttttaccagcatttttgtaccttttaactacagatgcagttctttttcattgaacctcaggaactgcaagaccataatctgaaggattgtgttaatattgaaagcctagcagcaatgtccatttaattatggttcactcacataatgaggtagccattacaaatgatgatattggctcatattgactcggacagatattctctttacagtaacgggataaaaatcaggctatctcacaaacacagatacacacataccctaatatacaccagtgttgtgtgattttatttgtattgaaaaatataaatgtatatatgtttctatgtatttatgcatagaaaaagagtctaggaattatacagtgtatcaaaatgttaataaaggctgtctttgagtgataggattatatgtgattttttaaaaatttgcctaacttcattttctgatactctacagttaatacataaaaagcccaaggaagagatgagttttcttgtcagaagaaatagatcaaatgaatagtatttttaaaaaggccctacagtgttggattgttttatgtataattttggtattagctatgtagtcagcactgcattataatgtatgtgaacttgggccaccgtcagcagccctgtcctgagatccgctgacttacccagcagggttaagtaattaagaagtgtcatgcctcgggtattttcttagcttattctcatcagcttttagtaaagccagaattaatttgttttcttgctgacatctggaaaagaggctaatatgcttgagcatgacgcttaattttcctttccaactctagattccagagtgtttgagggatagttatcccagacctgatcagccctgttacctgtatgtgataggaatggttttaactacacctttacctgatgaactcaactttagaaggcggaagctctatcctcctgaagataccacaagatgctttggaatactgacggccaaacccatacctcaggtaggtatttcataatgagtacttatgtcaaaaacgtcttgcttaggaaaaggaaaaaaaaaaaaactagtagtaagtaccttttgttacctcagtatgtttaatatttaaagatcgaggtgcctcttctatttctccactagaaagcatcatttctgttctgaagttaactgtaatggaataaaatacctgttaattttgaggggtgctttacatttccttttgctaagattccacactttcctgtgtacacacgctctggagaggttaccatatccattgagttgaagaagtctggtttcatgttgtctctacaaatgcttgagttgattacaagacttcaccagtatatattctcacatattcttcggcttgaaaaacctgcactagaatttaaacctacagacgctgattcagcatactgtgttctacctcttaatgttggtaagaaaaaaatctcttactttgataactctagacacatatacaaacatacagctttggtatgaaacttatctgtatcatgttttaacaagctaaagagtcgtttttctcttctaagttaatgactccagcactttggatattgactttaaattcatggaagatattgagaagtctgaagctcgcataggcattcccagtacaaagtatacaaaagaaacaccctttgtttttaaattagaagattaccaagatgccgttatcattccaaggtaggtatttaaatggaaaggaaaatggtggtgatactttgttttaaaagatgcactaggtcgggcacggtggctcacgcctgcagtcccagcactttgggaggccaaggcgggcagatcatgaggtcaggagattgagaccatcctggccagcatggtgaaacctcgtctctactaaaaatacaaaaaattagccaggcgtggtggtgcacgcctgtagtcccagttactcgggaggctgaggcagggcaatcacttcaagctaggaggcggagattgcagtgagctgagatcgctccactgcactccagcctggagacacaccaagactctgtctcaaaaaaaaaaaaaaaattcacttattcacatgggaatataagtgggctgtgattttagcattgtaattactaataggaaatatattagtcagtcaggcatggtgatgcgtgctgtaatcacagctactcagggctgaggtgggaagattgcttcagcccaggatttctaggctgtgcagtaagctgtgatcacaccactacactccagcctgggcaacagatcggggaaaagaaagaaactcttaaggtcgacccgttctctccagtatacttgcttaaaaaataatacctaaaacgttatagataaggaattttcctttgtaaagggtcagataatctaatgttgataggctttcttcttaaaatctccatccttttagtctccagagtcttatagaatttgattataaataatgatttcatttcttaaaatttttataaggaatattaagctctgtgaaaatagtaaatccagaatgatttttttccttattttataaaaatttagggaatggagttttggggcaatacaatacaggcagttttcaaataattataatactagttgtaattcaatctttgattttttttttctttttgcacctcaaaaccatattttaaatgttagttatcaggaccatcactatcatagatgatgcagtaatacgttttatatgacaagtgtctttaatgtttagcattagtaatatacaaagtatttactctttggatagtgtaaattttttatactatttatatagatgaaatagatatgtaaaggtgccatttagcttcatgtgttatcaaaatgtagatatttagaacaagaataataataaaatgggacaataatgtgtccatttttacttgataaaaatacagttcttacatacttgaaatatatttggaatacagatgtttattgttacttatttttaatcttttgaattcttaatcatcatttccatactacaaacagttgtattttgagaatagttgatttaaatcaaaaagcaactgattgtttttttgtttttcttttttagatatcgcaattttgatcagcctcatcgattttatgtagctgatgtgtacactgatcttaccccactcagtaaatttccttcccctgagtatgaaacttttgcagaatattataaaacaaagtacaaccttgacctaaccaatct

SEQ ID NO: 11415 - DNA, 2471 bp, Homo sapiens
gtactgtgttggcttgttttgcagtgagacttattctgagattaagagctgcatttagcttcttggccaccaggatcccagagtaaattacttttcaggactctaaatagtacgcaggagatttgaaagaactgatgcaatttctaaagcagcctgacttcctcccaggaggttactcccacaccaagcctctgacttcatgaccaccagatttagaaattgaagtatctatgtaagaagttgcctcctaggcagaaatcaagaaatccaactataacataggttagagtccattttggtttttatatccttccacagaggaaagaggaggaagaatctggagatgcgtttttggtttttggttttttgtttttttttttttccagaggctcatgtatatcctacatcatggtcagtttcagagcagggctgtgccaccatctcagtgactcctggaatactaaattggatctttgtagaggaagaaaataacacagttctagattttccctagctgttaattagttttatggcataattaaaatagctcaggagtaaaaacaaagtccagccttaacagcctgttaagtcttcttttcttatcttgaaaagaggtaagataatgaagtttaaacagttgaagaagttaaccggaaaggaattaacatttcaaggccttgccgcttcttcctcctcttgtgatatgaaccagaattgagggaaaataggcaggagggaacccacactgaattttccagactctactgctgaaagacattgtatatttttattgtaatcatatgtgatgcaagataatattgctcatatctgaatcccaaaagaaaagaagatgtttgtctgagcatcccatgaggtaagcagccccatggaaggaccagctgcatccagcaaagggctccaggtccctgacgtagttgacggtgatggcagaagtaaatctttgtattcttgcagagactttgtttctgaaagaggccaaaagtcatttcaaactgaatctgacggataagataggggccatagctgagaaaaataagtagcgaagccgatctaaaccaaggtgtaactgtgaaatagtaaccatcttctttgcacgtttcaaaattggccctggacgccatcgcaagaggaaaattccaaagctgtgcagcagcggcagtaccattggaagagtttacagcctaccaggactacttagaaggggatcatgtttatttggatatataacccctgattggtttgttttaaaaataaacgttattatgttagtgtcatacctcatggtttccttggaacattctcctctaatcctctttgagagagtgggagggagagattgtgaggggagagagaagtgttaaacagagatgttcctaaggaggaccaggaatcctaaattacctaaataacccacttggttatctccactccttgatagcactgtgtgaggtatgatgcagtcaggtaaaggacaatttatctttgaagacaaagataaattcgagtccccattttcaagagtcagtgagaagtaacagcttgtttgtgtggcactgattgatccttgtccgggcaagtggtccctccacaggttatccggcttggcacacaacagacagaggtgctggcggactgtggaaccagacccgctgtggttcccctcctcaccctgccacttcctagctgtgcatcttggacaactgattgaatcttgtgcctcatttttctgtagaattgaaacaataccctgacccattgggcaatggagatcaaatggcattgatgcaggtaacatgcttaacacagggcctggtatgtagtgggcattcagtaagtggaagttacgattattattaggtatcaaagaacaaaacttaattgtcagaataagcaaaccagttggaataataaacgtagcctttagagttaaatggcacaaccctgatagccacacataaactgttttggttatttttcgttggatattcccagtctttatttctacatccctcttcaggctgagtgcttaaaatacatttatatgtagtctcaattagattatgctgtttcccccaaaagactacagtgactattattttaatttatagaacctcgaattgcatggaatagctaccacatctccctttaaacctggtagcttccaaaacttcctgatggcgttttcgcaaatgggtccctatgtgtcattgaaggagacagtgtatctaggaaaagaaatgaggatactgagcaaggtgttggtggctcatgcctataattccagcattttgggagactaaggcaggtagctagcttgaggccaggagttcaagaccagcctggccaacacaatgagaccccatctccacaaaaaaaaaaaaaaaaaaccctaaaaattatccaggcataatggtgcatactagtagtcctaactactcaggaggttaaag

SEQ ID NO: 11416 - DNA, 2471 bp, Homo sapiens
gtactgtgttggcttgttttgcagtgagacttattctgagattaagagctgcatttagcttcttggccaccaggatcccagagtaaattacttttcaggactctaaatagtacgcaggagatttgaaagaactgatgcaatttctaaagcagcctgacttcctcccaggaggttactcccacaccaagcctctgacttcatgaccaccagatttagaaattgaagtatctatgtaagaagttgcctcctaggcagaaatcaagaaatccaactataacataggttagagtccattttggtttttatatccttccacagaggaaagaggaggaagaatctggagatgcgtttttggtttttggttttttgtttttttttttttccagaggctcatgtatatcctacatcatggtcagtttcagagcagggctgtgccaccatctcagtgactcctggaatactaaattggatctttgtagaggaagaaaataacacagttctagattttccctagctgttaattagttttatggcataattaaaatagctcaggagtaaaaacaaagtccagccttaacagcctgttaagtcttcttttcttatcttgaaaagaggtaagataatgaagtttaaacagttgaagaagttaaccggaaaggaattaacatttcaaggccttgccgcttcttcctcctcttgtgatatgaaccagaattgagggaaaataggcaggagggaacccacactgaattttccagactctactgctgaaagacattgtatatttttattgtaatcatatgtgatgcaagataatattgctcatatctgaatcccaaaagaaaagaagatgtttgtctgagcatcccatgaggtaagcagccccatggaaggaccagctgcatccagcaaagggctccaggtccctgacgtagttgacggtgatggcagaagtaaatctttgtattcttgcagagactttgtttctgaaagaggccaaaagtcatttcaaactgaatctgacggataagataggggccatagctgagaaaaataagtagcgaagccgatctaaaccaaggtgtaactgtgaaatagtaaccatcttctttgcacgtttcaaaattggccctggacgccatcgcaagaggaaaattccaaagctgtgcagcagcggcagtaccattggaagagtttacagcctaccaggactacttagaaggggatcatgtttatttggatatataacccctgattggtttgttttaaaaataaacgttattatgttagtgtcatacctcatggtttccttggaacattctcctctaatcctctttgagagagtgggagggagagattgtgaggggagagagaagtgttaaacagagatgttcctaaggaggaccaggaatcctaaattacctaaataacccacttggttatctccactccttgatagcactgtgtgaggtatgatgcagtcaggtaaaggacaatttatctttgaagacaaagataaattcgagtccccattttcaagagtcagtgagaagtaacagcttgtttgtgtggcactgattgatccttgtccgggcaagtggtccctccacaggttatccggcttggcacacaacagacagaggtgctggcggactgtggaaccagacccgctgtggttcccctcctcaccctgccacttcctagctgtgcatcttggacaactgattgaatcttgtgcctcatttttctgtggaattgaaacaataccctgacccattgggcaatggagatcaaatggcattgatgcaggtaacatgcttaacacagggcctggtatgtagtgggcattcagtaagtggaagttacgattattattaggtatcaaagaacaaaacttaattgtcagaataagcaaaccagttggaataataaacgtagcctttagagttaaatggcacaaccctgatagccacacataaactgttttggttatttttcgttggatattcccagtctttatttctacatccctcttcaggctgagtgcttaaaatacatttatatgtagtctcaattagattatgctgtttcccccaaaagactacagtgactattattttaatttatagaacctcgaattgcatggaatagctaccacatctccctttaaacctggtagcttccaaaacttcctgatggcgttttcgcaaatgggtccctatgtgtcattgaaggagacagtgtatctaggaaaagaaatgaggatactgagcaaggtgttggtggctcatgcctataattccagcattttgggagactaaggcaggtagctagcttgaggccaggagttcaagaccagcctggccaacacaatgagaccccatctccacaaaaaaaaaaaaaaaaaaccctaaaaattatccaggcataatggtgcatactagtagtcctaactactcaggaggttaaag

SEQ ID NO: 11417 - DNA, 467 bp, Homo sapiens
attggaagctaaaagttataaagtaaaatacccaaagatttaattaaatcagtaagcatttgttgcatttttaaccagaattctttaatcatttcctgacagaatgactgtgtattagatctctgcctcattgaaattgtctaggccccctgcatctgttttgagcaagacttcagttgagttccatcttttcattcttttacagtctgtaaaggcctggtgagtcagcgcattgaaaatcagtcatcatcttctgtctatgagttcttagtggcccgtacattattttctcagatccctgcatcattacaatttccatgtgtttaagtctcttctttatgttttttaaaaaaacaagtgaagccagtttctcaaacaggaggtgctcacattctatttattctccaagtgtggagtttgtgcccagcatgtgaccgacaatacagaatgaaaagcacatgacaagc

SEQ ID NO: 11418 - DNA, 467 bp, Homo sapiens; identical to SEQ ID NO: 11417

SEQ ID NO: 11419 - DNA, 25426 bp, Homo sapiens
  misc_feature (8427)..(8427): n equals a,t,g, or c
  misc_feature (22142)..(22142): n equals a,t,g, or c
aagaatacaaagttccagatggaatggttggattcagtaagtaacttgatttttaaagttttgaaaacatgatcaaaacatactttagaatctttcaaccaaaaaaaaaatttttttttttctaactagtaattggcagaggaggtgaacagatctcacgcatacaacaggaatctggatgcaaaatacagatagctcctggtaatgttacattctcatggtattttcagtgtgactagaaaactagcttttttttttttttaagccttctagtaacaataatgctacttttaatcttttgacctgaagttatctgtttgttttaaattgtagacagtggtggccttccagaaaggtcctgtatgttaactggaacacctgaatctgtccagtaagtttgaaaaatcttaaaaatctacttaagtaacaacagcagaactctttgaattttgtctcttctctttgttactgctttattttacactgtggtttcgctgccaccttccctcaaagtcctccaactcctttgaagtttatgcctcatgcctttctcaggtggggttcatcatctgaatcattaaacacagaaaatggttaaaacaactccatatctactccagtctctacttgtaaagccacgtgtagcctggagaagaatgcacagtcaggtcgactggtgacacttaaaactcagacattaagctcaagtggactgttgtgttgcctgcatttccctagttccattcacttttccactcctctcccaggctctttaatactgtatttccccacctccaaatcttcagcatctaaccccacgctctcccacttaagcttatttactgagaaaatggaagcaaatgataagaagcttttctttttccctaccactaaacctaccagccttcatttttcctctgttcacatagtactcaggtaattgctttccttttgtgttcgagtgcctaaagccagccctttcttcctactgaaggttcagcttgcagttgtactttcttctgcattgttagttctccctcattactaggttttttcttttcttttttttgagacgaagtctcgctctgttgccaggctggagtgcaggggcacgatctcggctcactgcaacctccgcctcccgagtagctgggactaccggtgcatgccaccacacccagctaatttttgtatttttttagtagagacagggtttcaccatgttggccgggatggtctcaatctcttgacctcgtgatccacccacctcggcctcccaaagtcctgggattacaggcgtgagccacttcccccagcctgattttctttatggcactttccaaataatgtgttattcatttgacatgttatttttacttatttaatgaaatgaagccactctagcaggaaccctgtttctttgagtgctattaccccattacctagaatagcacctgcacatagttgatatttaaatatttgttgaatgaataattgtagcatatgagtaagcaaaatggtagtttaaaaatgtaaataaatcatttagttcttggaagaatcagtttaattctgagataactttagcattagagttctttcttggaaattttggactattcttaaaaataaaaattgtatatctagaaaatttttttgcataatctctcaatctttgacccttgatggcattttctttcagttaaaagtaaaagcattgttaaagttagcatcaaggcacctaatcctgaactgggataggaggagtacttggttatattgttttatatttctctatttgaataagcttgggtatgctacagcttactatttaaatattaatttgttaacaggtcagcaaaacggttactggaccagattgttgaaaaaggaagaccagctcctggcttccatcatggcgatggaccgggaaatgcagttcaagaaatcatgattccagctagcaaggcaggattagtcattggaaaagggggagaaactattaaacagcttcaggtattgttatttttgtgaaatggctacttttgatctgttttgatgcccatttttgtccacttcttttgttaatatatattatttctatgattgtaacaggaacgggctggagttaaaatggttatgattcaagacgggccgcagaacactggtgctgacaaacctcttaggattacaggagacccatataaagttcaagtaaacttaactttatactttataaagaaagagtgggttgaatggggttgggcaaaatatgcatgaataattaaaatgttttgagacatgctttctaaattagctaactttttctgctttagcaagccaaggaaatggtgttagagttaattcgtgatcaaggcggtttcagagaagttcggaatgagtatgggtcaagaataggaggaaatgaagggatagatgtaagtaaaaatacccattcagaaatggttgtatgctaattcataaatataatagtgttttctgttttgtgttaagtagctctaacattgttatccttttatttcacctttatactttagaatacagaattctatatatcttgttaccctatttactataaatatagaattatatgtacttttatgatttgaggcagattttcaggaaatggcgcttttttaaaatacttttttttactttaaaccctgagaagctagctttcttaatacttagtcttttttacataaggtccccattccaagatttgctgttggcattgtaataggaagaaatggagagatgatcaaaaaaatacaaaatgatgctggtgttcgcattcagtttaagccaggtgagtacatataataatcttgtaagtgttggcagcagtgagttttgacatacatttattgtttaattaattttgtttctttgttttgaagatgatgggacaacacccgaaaggatagcacaaataacaggacctccagaccgatgtcaacatgctgcagaaattattacagaccttcttcgaagtgttcaggtttgatagaaagttaacattttcattttttgtttttatggaaaagtattttccttcatgaaatctgaagttacctctatatcagagtctgcttgatgatgctttattaatggagaaagtttaaattgctttaaggtaaagatcttggagcaggaagaactactaccttaagtgctaccttatttactcttgtagttttaaaaaatgttattactttattagggcccagttcatctctacatttcctgatcaggtatatgagagctgggaaaaataaacttaataattttatcatgaaacaaaagtatttctgtgctgactcttcgttcttgtctttccctctctataggctggtaatcctggtggacctggacctggtggtcgaggaagaggtagaggtcaaggcaactggaacatgggaccacctggtggactacaggaatttaattttattgtgccaactgggaaaactggattaataataggaaaaggcaatgtattttaaactcttaatgttttaacacattattcatttttctggacactttctgttgctgtcgtaaacaagtggcaatgctttttctctgaccgtattttagtagaaaagaattcttatgttaatatgtaacaagtaaaacataaatgagggatctcatgtatatttagagaaagagcaggattttaatcttactagcttctagagaaagcgaactaagagataattattagcataagaaatgtcttttgacccaaaaagtggtttgagtgtttttgtttgtgcattttggtttttcccgactcatattttaaaaatttgaatgtttataagtgtattagtttatatttacactgcttttaaaagcagttaattcaaatattttattataatcacattaagtttatgtttaaacatactaagtaaatgtaaatgtattttaagagaagcatgaaatgcttcctaaaatttgattttcagtgtagaatattaaatgaaaaatcttaatacaatattgtcaattaggatactgaccaaaccatatttttaatggcccatttaattgtgaccattttcttctaaatagctcctagtacacccttgaaacctttagagaaattactgtcttttgattttaggaggtgaaaccataaaaagcataagccagcagtctggtgcaagaatagaacttcagagaaatcctccaccaaatgcagatcctaatatgaagttatttacaattcgtggcactccacaacagatagactatgctcggcaactcatagaagaaaagattggtgtgagtatactttaaacttttaatttttagtgtagacccttagactgtagttaaattaagacgtttattcaaatacatcaaaggaaaatgtatcattactagtcagcatttatagatttcatgatatgtataatagatacaacgtgaagattttccagcaatgaaaataacctaattaaatgtgtagttacaggttttgagaacaaccttacatttgggtgtggctagataagaggagggtagtgttacctgtaggcatgatattagtgttggtgtaggattgtggaacatacttgaaggacatagttaacgggaattcattatttattaagattttactctactgaaccccagcgaggcaaacaagataaatcagatacatctgccactctacagtagaaattcataaatcctaggttttggactggctcacagatcatctgggggtattaaaatgtagactatttgggtgcttcccactcctacacataatatacagagacagacctgactcaaaatgtctgggatagggcccagcatctaattttacatagatgtttgggtgattctggtgcacagacaaatttggaaatttttcctccaggaaagttttctgttagaacaaaaaagtatgaaacgctttgactgcttttttgtaagtgaggcagacagtgtcttactggagtttttaacacaaagtgtgcagggggcatcttaaattattagaattgcctaggaaaaattatttttggtgtttgccatgctgtgaatggggtgcgtgcaaaacaaggttgacactgtttctgtcacacttgggaagaacacaaatagatgtacaaaagacgcttaaggaacgtcttactaaatgtacacaaacattgtgagttctgttgtatggatagtttaatggttcaaaaaatgaagaggatgtttgtagagtaatgatagaggttgatgccatggcaaaaaaatgaatagcactcatcttggttttttattttacagtattagcctaacatgcatgcgtcaggatttctgttggattcatggaaaaacaagatagattgttttggagaagcaatttggtgtggtgattaagagcatggactctgtagtcgggttgcctcagttcagaattctgtgaatcatttactggttctgtgaccttggagaagttactcaggcttttctgtgccttggtttcctcctgtaaaatgaagataatggtatctacttcatagagttgtagggattaaatgaatgttcatgtgtgtgtcacttaaaagaatgcctgccacataaccctaaaaaatgttgctactttttcagtattatttttactacttggaaagaataggtcatggatagtaagtgagagatgacagcaattggagatttaaagagacaagttaatagaagaactttaaaggtcatgaagtttagtttccctattttgcagtgagaaattgacgaccaaatgtagtgttagcattttgtccaacatgtcgcctggttgtgttaactactcagaaggagcattttaggacagttaagtgtaatgtctttgttggcttaaccaaacagaaatcagttaagcgttattaatgatgtggcatgcatgcatgataaggatataaaatatcctgatttattgaaggaattaaaaagggaatttttgtgctattaaacatcatgatacatgaaaggccaaaaaggatataaattattgatctgaatgggattttagtgacagaaataggttgtgaggtggattttagtttcatagtgaaacaactagctattaacgttatcagtgaaatgttcagaagacgatgatacaggacccaagcggtttgggaatatattgtcaagacggttgtctcatgttaggcaagtagatatagagagaagagctgaagataaggacctgatttctgtgagtaagatggaaaaagatagtaaaagtaagaatgataaaaggaaagggaactactgctgtccgcaaacaagctaaaggaaatttaattgctaatttaaatttaatttaatttaaattgcatttaattgctactgctattgattttagtgaattttacatgtctcattattatggcagatgaaatagtttttgcaaaatgaatgaggaaaggaaggaaaacctaaaatttgttatttgtgactataagagggtagaaatggatgattatttggccgtagagttgtttaaccattactgtgtttttctgatttttctatgtcatccttttttttgtagggcccagtaaatcctttagggccacctgtaccccatgggccccatggtgtcccaggcccccatggacctcctgggcctccagggcctggaactccaatgggaccatacaaccctgcaccttataatcctggaccaccaggcccggctcctcagtaagtattgggtttagttctgggctttccccaaagattctagttttgggactgttttttatgctgatttttcttttcagtggtcctccagccccatatgctccccagggatggggaaatgcatatccacactggcagcagcaggctcctcctgatccaggtagaagatgcttattatttgtgtgttatctgtattattttccactcctgttacattattaaattttctagtgttgattctacatttgtatgcatcaccttcactcactttactctttcaacagtgttaggcactgcctctaccccagtgtataggactgacatgaatatgagctctgcttttatggaatttctttctacttgcctttggcttatgagttgatacagtagaatgataaaagctaaaagctgcaggaaagagcacagtgtcataggttttggataccagtgctgtcaaatgtgtagtatgttcattgtgacattatctgtggaaaaatagtttttacttatttagaaaagtatgtgataggggctgggcactgaggctcacgtctgtaatcccacctattcagaagtctgaggctgaggcttgagaccagcctgggcaatatggcaagacccatctctaaaaaaatttgttttaaattagccgggcagggtggtatgtgcctgtacttgaggctgaggtgggaggattgcttgagcctagaagttctagattgtattgagctgtgggcacaccattgcactcccctgggcaacagaatgggatcccatctcttaaaaaattatgtatatatgtaacagtctatataaatatatatatataacagtccaacagagtgttaagtattggggcattaaacttccaaattgtcaaataagatatctgttctagtactcctcatatgacaacttcatgtgagtaaaaatcaggcctgtatttaataactgcatgctaaagcccaaatacgtttaattattttctatattcagatttatttttatcctattatattctggcatctttccataccctgtagtttgctttccatcttggtcaaagagtcattctttgaaaccaattaacatttatttatgatccttttttctcacctgctacctaccttttaggcctctttcactcgtgtagtttcaaggaaaatatactcaattatggaatactttctacacataatacatttatcccaaaaaaacttgaagtaatttatgtaaatgaaattgcttgattaacttcataggaagtgtgctgtttggaatatgatgacacagcatgacagttaccaagcatgacttgagttgtgctaggatataggtgtgcaaagttggggttgtgttctatagcaaaagaatgcactcccagcgtaagcaacactgatggaaggggctcacagggtacaggatataatactcttaacaactaatttttggagaatgaaagggcttttctttccctcttgttggctgattgggatggtataattaatgggattgaagagtttgagtaggttaaaaggcagattcatattgggtaacttggatctgcccaagattgtatttttgaaccactactggggtgttagcatgattgaggaaaaatgatgggaataagaagtggaagtggtctttggtattcacaagttgaattcctccacttggagntagtagtgaaatccattactgtaagagctggtcagtgaaatgtggttgcagcatggcctttgggcaagaagtaacccatttaactaaaaccagctggttggccccactcagatttatcaaagggttactgggtccctgggggtggatattgcttatattagacttagaatagcatactgttttaatattatatgaactaaaatgtttctttaaaaaaagagtggtctgttaatggatttatgtagtggtcaagaatttagacttcagagtcaaataaacctatatcagtcctagtcctacagtttactaattgtgagatgtcaagcaagtttttgaactcctctaagcctctgttttcttatctataaattaataaatgaatgaatcgggttgagtgaatatttagtaaattcttagtacatactagttatttgtaactgtgagactggttttttggtatggttttcacatttgggagtagaaataccacttcctaaagtctgttttatctcaaattctctatccaggcatagtgtaaagtgaaatacctagatttcttgattaatatacagataatggccagacgccatggctaaaacctgtgacgctagcacttcggaaggctgaggcgggcggatcacttgaggtcaggagttggagaccagcctggcaaacatggcgaaaccctgtctctactaaaaatacaaaaattagctggatgtggtggcaggtgtctgtaatcccagctacttaggaggctgagacaggagaactccttgagaattgctccactgccctccagcctgggcaacagagtgagacacttcatctcaaaaaaaaaaaaaaaatacagataatgacactattgagatatgtaaacatccaacataaaaaagcagtacattgggcaattgagaaaagtttggcaggtgtcctaataacaccttacaattatattaccttgcaattttctttttctagaaattcttgctcatttttctcaaacttgactaacctttattaagcagctgagaattgctactgttcagaatgaaggtataatagaaaatttaaaagttttaattgtatggtattcctagtataaaagacaatcaagttttttctggtttctagaagattgaaaggtctcaaactgttcgcacttcagttgatgtgggagatgagtgagggtcagtcaagtgtagaggagacaacatagctaaaagccgagacacgggcatagtgatttctgaaaagtacaagcactgtgttgtggctggagcttgggtgttgaagagatacaaccaaagggagagatgaggctgaaatggaaaggataagccaggggcttcaggctgttaaagatgttgaatgataggctgtacttaagctttgaacatcctgaagattgcagagaatgaagaatttcaagtaggatgacatcaagtttataacattcaatgtgaaataggatgaaatgtggctaatcttttttaagatttttatattttctcttcattgaaaataaggacaaagttcattgttctaaaataattttctttcttatacaggttagtccctagaaatgtttttctttagtcatcttctagatagagctgtttgtgcttgaggcgaaaccaatttagaaaaaaacaagggcacaggatggtttgagacagagcattggatttggagccaaaagacctgtattcatatcccagttatgccactcagtagtttttaacctaggaaagtcacttagtctctgagacttggttttctttaataaaagctgatggtgacaacaaaaataatagaaaatttaagttttcatatactttttttaatgttctagttaattttgggggctgtatatttgccagagagctgggcgggggggtggtgtgtgtgtgtgtgagagagaattacagacttcacatgcaaaccttgaactttcatttattttagctaaggcaggaacggatccaaattcagcagcttgggctgcttattacgctcactattatcaacagcaagcacagccaccaccagcagcccctgcaggtgcaccaactacaactcaaactaatggacaaggtaactacagaacttattgtatgtgaaagccaaaagttgtgcttggaattatatatgaagtacatcactgtataatacctaaaatttctgacattatttaattataatttaagcagacttttccttttttaaattgttactttgaaatagtttcaaactttcataaaagttgtaagaagaatacccggagcacccagatagcccagctgttaatgttttattcccttgtttactctgttaccatctatatcatacatgtgtatctgtatttattttaaatatccattataattagttctgaaggaagctaattatatccagcataattagttctgaaagaaatcactgaagactaaactgtagacatgatgtcctgttgggtacttcttcaaaaatacataaccatcatacagccctccaaatcagtaagtcaacattgatatattaagttctttatatcattatggatttctgatttttgcagtaggttatatttttaaagtatttttataattttgataatcagattatcctggatttggccagtcagggagtatattcagggtggtgcctatatccttttgaaatacctgtcattcttttaagcacttccatactgtctggcacagtaagattgttattttgtgctttctgggctccagccctcgagtcagctatttcttcaaggagctcttattccttttagtagagtatggtagttagaaacgagacttgagtatgcttgttgctactgaggtgtaattgcttctagcttctttcaacaggcagaactaggaaatatatttacatacatgcatacctacatacacacaccaaaaaacacataaacatcgatatatgtatatatttttaaaaactatgttcatatcaccacatccgtttcagcattttggggttttcaagccttttccttttttgtacttgtttacaaacgtgagaaacctggtgtcctcagtgtatttccttatttgacatgcatttacttatatgttcaacataaccagtcttcaaacaggttggttttcttttctgtccaccacctctgtacccccagtaccttctatctttggcactgttagggatgccaccaccacatagtacttccctcctaccctcactgtcacattgcaggcccctgccagctcctgcacccaaggaaacggccaaaattgccttttaaaaactttaattctgttttttgttttgttttgcttgaacaaggagatcagcagaatccagccccagctggacaggttgattataccaaggcttgggaagagtactacaagaaaatgggtatgttttatacatttcttgaaaatacatacttaattaaattgaaacaaattattctcttcaggaagagaataattgaataaaatcactggacttgtaaacatatcaagacagttgtaaattatagtttttaaatttgtggttatatggcaaggaaatttttttttctaattgcatttgtcaaccagttattaattgaaactagaaatgtccttactggtacatacaatattaacattactatacttttgacaatgacagttatatatattatcagtctaaatgacataaggttaaattttaatgtgtcaggcgaaaattgtgtgtgataccattatttttgctgcaagataagcaggtaagaagtaatctgcagtgacggaaagtaaccaagtgatggaaccagaatctggcttcaagagggtctgagtcccaagcttgtctcccaaatttgtctctttaggaaccatttggaacctgatactatacttctggacaaatcactatatttcagctgcttttgctcttagtcatttaaaattattacataccacagctagatgtcacaaatgaaagctaaattggtaagcttggttatccttcactagcagaaaaagaacctataggtggtagagttttgtcataagagaacggtctacttgggattttcaatgttttctttgccaaagaatgtttctcattctccacagaaagaaaaatttccagaaaggtgatgattttaatcttctagatgtaaaattacatatacctgatgataaagttgttttgcacaactggtttctttttaaagaaaaattgtttttcctcttagaatggcttcctaggagagtcatgttccgtctctttctgaggctttaacagattatgtttttgtgacctagcttaggcagatctacagtagctacaattcggcaaaaagaaacttttaacttaaaaacagcatactctgattaaggttggttacataatttattttctgaactgggatcctttttagaatgaatagggatgctattaataatcatgccctgacagcattgtggtcaggacctgtaatcaacttaactttaattaaatagcatcaccattttaaaagacttgagcatgagccacgtgcggtggcacacacttgtagtcccagctgcttgggaggctaaggtggaaggattccttgaacacaggagattgaggccagccttggcatcatagtgagacctggtcacgtgtttgggttaaaaatcactaacttcaacttctattttctcaatgggtaatgtcccctagatagggtccctagttattattaagtaggtaaaaataaaggcttgttaatggatttaggtaattatggaggaatgagtttggcttctgtgctttattttaccatattgattatttgtaatatggccattaatacatttactgtttagtcttttttgtattactttttatgttttactcaaaatgagtgggtgggtggaattctaatttttattgttaagggaagacattttaccttgtctttaattttttatttttttttaccatttccctgccagttagagatactatactatactgtcttgaatcctctgtaggaaaacatggcatagaaataattaaataataattagatgttaaataataatgctgtatgactaaagaacctccttaccccaccttttctgttgttgttctgtagtaccacaataatcacttgttaattttatttatttatttatttgagagggagtctcactctcgcccaggctggagtgcggtggcgcaatctcagctcactgcaacctccgcctcccaggttcaagcgattctccggcctcatactcccaagtagctgggattacaggcgcctgctaccacatccggctgattttttgtatatttagtagatacgggctttcatcatgttggccaagctggtctcaaactcctgacctcaggtgatccacctgcctcagccttccaaagtgttgggattatgggtgtgagccactgcacccagcctcacctgttaattttatgagcaaaacagattagttgggcaagtccttcacatgcatatctcgttgttgttgttttttttaagacggagtcttggtcttactccccaagcaatggtgcgatttcgtctcagtgcaacctctgcttcctgggttcaagctattctcctgcctcaacttcccaagtagctgggattacaggcgcccaaccacacccagctaatttttgtatttttagtagagacagagtttcaccatgttggccaggctggtctcgaactcctgacctcaggtgatccacccgcctcagcctcgcaaagtgttgggattacaggtgtgagccactgcgcctggccacatgtgtatatcttaaaggaaataatgctaggtaatttagtcaggtgcttgatgagcatttgtcatcatcatacggagtcaatttgtctttttctataaaagttctttttgtaaatgattagttgcttaactgctttaatttcttctaggtaccttacctgtcatcaggatctttttaccacaaataagaaaccttaaagcataaaacttggttcagtcttcacatttcttaaatggaaggagaaagggaataatagggagatatctttatctcaaagccaactgttgttgacttttccagtggcaggggtatgatgctaggacttcagatttcctgattccccatcctagtgccccttttgccaaactaggcaggctttcacagcttttggagcctaatttaagtttttcttgttaagaacagaaaactccattcatagattttaatttgtcattatttgcttatttactgaaaaaaaaaaaaaactattgaaaacaggtgtgggttaagtttcccaaaattaggtttatatttcaaaacaattctaagttcccaaggataacaccaaactaagaggataaatttttattttatttttttttattttatttttttgagatggagcctttccctgtcgcccaggctgaagtgcagtggcatgatctcggctcacttgcagcatccacctcccaggttgaagcaattcttctgcctcagcctcccaagtagagaaaatcttgataagatttcagaggcttataaggaacagcagtaaagatgggtgtttttaaagctagaatacagggatttttttaagacccttaagagaacaaacagggtttcaaaatagaaaggagtaattcttgtttggagaagtgaagacatttgggaaaagtttgacttgaggaaggccattatgataaggactgatgtggtagactctgaaccctgaagaatctggtaccttaagcctaaaggagggtagagtgaggacttgtgggaaaggtacagttatatgggaagacaactgagtgtgaaaatctattcatgcaaggctggctcttaggctctaatagaatcttgcaagctaactctagagcaagtcttttatctttgggatgaaagaaatttaaggctaaactttatacattataattataaaactataataaatattagataatgttctactgaagtataaactcaactatctggcatcaaacagtaactaagccatgatcacaccactgccactgtgttctggcctagtgtgacagagcaagaccctgtctcaaaacaaaatccagtaactaaagagaggaataaggggagcgcaaggtaaggcagtacatgtctgaaggggcagggaaagagttctttctctacttccaactgggcaaaataaatcacatttgccctttagattggaagagtgaaataagcttttcttgaacatcttttaagattggagtgtcaaatattaccaacttatttaccaagaatttggtttttcttaaagtctaaagtgtttactattagctttccacagggatataggagtttgcagaggttgtagttttttaagggaacatcaatgaattttcttgatgcatatgcctgtttctaccattttacattgttaatttgcctctaaaatgagtaactcttacaatggggtttaaaacctgaagactattgattgctaccttgatcaggtttggtttcaagtgtgcaccctgtaagagacaatgtgtggttttattgctattgtcacaccagttttttagatattgaaacctgtttcagatttgcttgaattgtgtcttgtaagaggaaaatgttaaacttacttcctctttgagaacagttatttatagaagacaggaaaatatgagaatttttaatagtatatgagagttctctgttaccaagaaaagagggtttttttcaggcatttttaaagaatcataaatcttaaattctttcactcagttgctttgagtctgtgacctgttttacaatggtgatagactgctttctgaaactatgaaattggtcttgttggcatgctcctacaaacataaaaagagcttcctgtgtgtccatgctccagtatactcgtctatggtagttatttcacaaagccaagcgagttacaaacgaaataaaatagtgcttaagtaaagaaactgaataggagaacatatactctctcttctcaattttatatttagaaaaatataccttcagaaattggggaaataggcatcagacactcagcttcatcattttttaaaagtttgctgtatgcgctttatatgtatgttttttgtgtatgaaccatttcaaagtaagttgcagacaagacagtttgctctaaataaactcaatgtctgggcacagtggttgacgcctgtaatcccaggactttgggaggccaaggcaggtggatcacttgagtccaggagttcaggaccagcctggacaacatggcaaaaccccatctctacaaaaaaagagaaaaatgtcagctaggcatggtgggcctgtagtcccagctactctagaggctgaggtgggaggatcacctgagccctgggaggttgaggctgcagtgagccatgattgcaccgctgcactccagcctgggtggcagagtgagaccctgtctgaaaataaataccctcaatattatcacaaacatacagactatatttaaatttccatagttgtcaggaatatgtcttttgtcgtctgtgtgttttgtttaattcagagtacattcaagattcatgcgttgcatttcattgctatatttctttaatctcttaattcagcaaagtcaccttatttggaaaaagacctgattgtgaaagctgagttttatgtgttttcattgatcttgttctttattccttgtcaggttacttttaataacattgtgttgtaattggaataaattattaatacttttaacatcttattatgtgtgtgtgtacatacactttataggttactaatcaggaaaaagtcttggctaggtcttaatacagtctttaaatcattgcctttaagtgggcttaaagtttttcaaaaatgttctttttgtaattctggaatcgaattaagattatgcctaaatctttaccttccttagctaaagcagtgtggatttggggttgattctgtttttttactaataatgacgctctagaactaaaagttaacgattaattataaggcaaaaagaaaagagcgttctttttttttttctaattgcagagtagtttcctgacactactaaatgaatattttaaataaaacaggagtaattctgaccctctgtgcttttgtcttataacctgtacttacagtggatgtaattttatattaaagtttaggggtttttttttttggtcaacaagggcaaacacaagattattcaaaggcttgggagaaatattacaagaagcaaggtattgtttttattagaaatgagatgttgggcttataattgtggttacagcaacaaagttcttttttttcaaaggtcaggcagttcctgctccgactggggctcctccaggtggtcagccagattatagtgcagcctgggctgagtattatagacaacaagcagcctattatgcccagacaagtccccagggaatgccacagcatcctccagcacctcaggtataatgtaattgctaatttgttgatttctactccagtctgttttctgcatgtttactgtttgtctgtttgggagtgtttgccttttaaatttttatctggcaaagtataataactatttaaatgaagtactacggtgtattgtttgggtttttttgttttttataatgctttccagcatctgagtggtgaatatttctgcaatgcctttgattttaaaaataaattttcttcccccagggatttgcaaatcatgcaagaagccaccaccatttatattaaccactttttctttcttaaaggattcactcctgaattagctccatttcaaggattttctttaactttttgtgtatttcttatgtatctcttctgcacagggccaataataagaagtggacaatacagtatttgcttcattgtgtgggggaaaaaaacctttgttaaatatatggatgcagacgacttgatgaagatcttaattttgtttttggtttaaaatagtgtttccttttttttttttttttttgaaaatgtacaaaatatctatcactactgataggaggttaatatttctgtgtagaaatgaaaattggtttgtttttagtatttagtgtagatgtacacattccagcaaatgtatttgcaattatgtggttgatgctttgtgatataaatgtactttttcaatgtatactttcacttttaaaatgcctgttttgtgctttacaataaatgatatgaaacctcctgtgtcggtaagttggatatgtgggtatttaaaggattcataatttcttagcaatgataaattaagatacatatacacaaatatataagctttccccatgaaatattgagtttttaaacactggcatgtttttccccccttgcagtatagtggtagattggaggatcttttccatttattgtattggctctttcagcacaagtaatcctgatatcttcattttttttccttctgtttgattaaaaactgcatgtgtgtacaatgatcttttggcatacttccattgcattaacagtgaaatttccttttatacatgaccactgtttcagacctgtactgctgctataacagttaacctttctgttcttaatttgataatacttgatttccaagactgtttcggcataactaattttaaacagttttcagatagtgaatatgagtagtctaataagaacagtttttttccatgtgaagcaactctttcaatgtatataatgttagtgtgtttctttctaaatttaggatagaaaagtgaatagtgtgcaaaaagtatagctacattgcatctgccattgaaacataaatggggtatggaaacgttcaagctttttttttttctttatgcagtatagataagctttgttttgtaaatgcacaagtccaatcattgaatcaacttaatttttttatgtacttgaagtcattttattactctttaacactcatgctgaagttctgatattttgttgaaatccattgttttactctttgcatatttgttggctctttgcatattaatatattagactacatgcaaatacagtctgtcttgccattgtctgttgaagtgcaggtttgatccagccagtatagaactagctctgtaggggtgaggaggactgtgctgtgtatcatccttgattgtgttccttcaaggagcattgcactgtaagtacatcagaatgacaaattgcatgaactgcaacagtatctttttgtcaatgttccacataatgcaaatgccatacgttgtgtgatattatgttggaatacagtgctgatatcttggaaaaccataactgcctcttaatttaacatagaataatacatagttctgtattttttttaaagtgagcttaatgggtaagtattttttatatgctttagctatagctaaagaaaactgatacttaacaaagttgaatagtattattcactggtgctcctaaaatattgtttttcagtgtaaaatatgcatatcttctatatttaatatgaaagtcttgaaatgtatcagacagaaggggatttcagtttgcaaataatgagcaatgtagcaattttaacacatttcataaatatatattttgtcattggtggagagcaccatttgttgttttgaatatactttaaaggaagaggtacaaggacataaatgttgagattacctacaggatggaaatagcagtacagttcattgtagatattttgaaatgtttttgattgttttatataacctagagtgacttcccttacccttatttagatctgcatatatagttctagtatgaagtttaatagttaaggagttagctatttgttatctttaagagtagggtattgacgtgaacaattgcagtattttgcatgatactgttttatagatgaccttttaggaaagtggtgcatttattaattgaactgaagaagtagttcagttgaattcagtatcataattcacaattggaggctgttgattttgattcatttaaggtttaaaatctttattaattgcaaacagtgcaattatttatacttcacagtgccttcccagaccttccaccttaggttctgctgcaaaaagcaccaggtaagcacaacctaaggacatatataaataaatatttcaatacattaatgttgtccctgtgaggtttttgtggttgtgtattcaaaggcaatctgctactgcttccccaaaatgtattttgttattttatgctaccatcttagtggaaagtctgtaagttgttaaagcaactgtttacatttctgggtaatgttttttattttacttttttttttttattaagacaagaaaatgatgagtagattgctgcagtaattgaactacatccaaatctttttgtattttttccccaaatatagaagtgttaatattaagaaaggacaattacacagttttcaagatttaggaaatcacttgtttagaaacttcaacagccttcacaatctgttttatatgatggacagaaaatttctttgccctccaaaattataatttctttatttttttcttattcttaaactataataattcagtaaggatattatgggttagaattttattatgatttttttcttagacaaaagttatatgctgaagaaggaaaaagttataaggcagtatgttttgataaaaggcatgtgcatcagtgaaatgttaactgtatagcaaataacctttcataatctgtagcatcagtatttttctgatttaataatatttaataactgacgctgcatttaatttttttgccagtttaaaatgtttgtgtgtttttatagatgattttaactggtacatattttgagttaagttgaatgtatgaaagcagcatcttatcagttttgtttattcgatttctaaaatgtgctgatccttttaaaactcctgcttatctctgcaacaaagaaaaatattcaaaaatactgccttcattttcacacacagtgctgaagatgctgcaagcaccaaatcatagctcataaaatcaggtcctgagatagttacccataaagaggaatcctttgagtgtatgccattggtgagccgatgagcatggaccatagaagggctcaatgtagaaggtaaaattggcaaatcataattgagaaatatgaaatgtattcccatacataatatggtatagggtgtaatgtacctgcttttgatcacttttcattttaaagtgctattcacttgatcttaaatgttccatgaactgttaaatttcttaagttacatagttactacaccacatttatgtgtatgttatgttttaatagtcaatgataggtatgtacaattgataatataaaggggctcattgaaacttgagagcctgttgagttttggttagttgtagattgcatttttataaaaaaaaatacagatagattgatgataatagatattggggcattgtttctgtctcatgagaattcttttattcattaccataagccttcactgatactataagcattattttaaatgacgctgatcttaagtctgaaataaatggaaagcagaaaaggtgagccagttgatttgaatgcattggatattagtgttagaaacaatgtatagtttagattgaaactgaactgacttatttagcacttaaacaaaaattgacaatgtttntagttttttttaagacagcttagtgtggtgatacttagaattctatggtttgatgtttcttttagaaatgagaagtatagttttattttttaatataaaaaatggttttaatactaaaactagtaatttgatactagttgtttataaacattgtaaaatatatcttttaaacaaattatcttggtagttaattcataagggtgggtttgggtaggaatagcagagtactttcagagggaaaggggagtcattcagaagtgatagcattttatttgtttgaatactctgccagtaaaatcagctgtacttagaaagttatctgttgtgtagaataatgatgtagagtttactaatcagtgaggatgtcttgtttttattttctgcaaactctgcctcactttaaaatgcattataacaatacctaattaaagataattttggctctgaaagttaccttattttttgttgagttagtgacttcatttttcttgccacaatataagcttttgagggatttttttaaattggtgcttttaataagcaaataaatcccagggttttattttcttcagtgatacccctatagaaactcttaaatgtattggcgcatatatatatatatattttcttatgcatgctcgatgcattttcgtcctgagaaaaatgttctctacagaaactacccgtgtgtaaaaagaagattggcttaaaatggctactgtgatgggaacagtgtcttagggagatgcagcttggacttgaggtaaattgaatactttacaactgtggtttagagtttgctttaatgacattgtatgtaaaaggtcacatgattgctgtaattttgtattcattatggtttcctcaataaatgtacattgatgactattataaaggagtgctttgtgttttttatacatatattacatggtaaaattttctacttgactgggtttttttttatgtttactgtgagaaaaaatgattttaaaaagttttaatgataaaagggtaacatctggttgcacaagtcttaaaatacagaaagacttttaaatacagaagttactttatttgggttcacgttgtaaaataaaattgtcttccagaaaattaaaatataaaacaacttaatagaacgtaatagctaattatttacaaactcattttaaagactagaattttaaatcgaaggttgtgccactttttccctaagtctgatacacttagatcttgaagccttcgactatgttgaaagtgttttctcttgcgtgaactattaatagaaagttttttcattaaaatataatttgttcaggcaagatcacaacataaatttgctttataaatttaatatatattacatacgtttgaaaaataacatgtttaatatcctcaacactcaacactgtatagccattctttaagtcctttaatttttgtttttctccatgctcctccccttttcctctgaaaggagtgacagttttccccaccccgctccaatcccaatatatctgcttcagaaagactttgaaactacaacaaccaaaatggtgtactactaaagaaaaagtccactcaaattgataggttccaaattaattatctcagctatttcagcctaattttaggtgtaaaaagctcagaaatgacattccttcatgcaaaataatgtattctacttaggtttgtgtgttttttttttgtttttgttttttaaacatagttgctgtaaacgtctatgggaaatacagtctttataataggttctgatagaataattgagtaattcccccccataagtacattttattgactgttactgcataataggcgataaatctgatgcttatttggaaaagaagtaggcattctttagatgagctgtgctttgaagactgttatgaaaaggaataagaagtcagcatagtggcactcctggtttccttttttggccccgccacagaaaagatggatgtagtaagaaagttggagtgaaagagaaagttccagggagaggggaggggagctagtagtcatcagctaaaaaagagaagaagaaaagtgattttaaggaaaaaaaaattaatagaataaaagataaaaagagtgattaattcttactttcaatggtaagaatacaggtactagctgcagatcctttattgttgactgctttacacatatactctcctccatcttctgggaaagtttctggtaagtaaaggcagtaagtttctcccctttcaatatattgatagtcttctccatcctgcagtatttctccttcaaaccaccatgtaatttctggttgggttctcctgttactttaaccgtaaatctgactggctcactgtctacaactgatgtgtttttaagaggcttcttgaaccatggagctcctgatctggtttgctcttcatcttcagcagtggagccattcatgatgctaccttcttcctcctcctcctcttctcttttctgtattaaaataaatgcattcaggttggcatttatagtattttcagggcagcgatttagtaacaattttgaaatgaaatttttttttttaagtaaagaacatacaagtgtgcctactacaaagtgtacttaacagtacattccagtgacttgaaagaaaaccattaaaacatttttttaacctacctaattataaaactatgggttttaagagggcatctttggaaaataaaggatacataagcctggtaccttttgtagtgctgcatcaatttccctttgttcaaactgcatgcgtagtaacttttgttcttcaattcttctttgttcttcttcttctcttgccttagccatttgttcaaatctagctttcatattcactttgtgagtaaatggagcctcgctttttcttgcaggcctaacatcaacatcatcttcctgcaagaaagtgggccaagattaacaattgcttgccttctaaaaacaaagaagcgttactagttctaaaggtgtttagaagcacaaaatgattaacatgtttataatgcatatttttgctacactgcagacactcagattttttctaactctccagttcaggaaaagtgatagatacatttatgaagcattctcttagttatagactttttctccaaatgtaaagatcacaatatcactgggatcctagcctgtttgtcctaccaactctgcttggttttgatagcacttaactgaaaaaggtcagaatgctatacattctaaataattgttaaaagtactcccttgattcctgtaagtcc

SEQ ID NO: 11420 - DNA, 286 bp, Homo sapiens
tagaagaacaggggtgaattagagtaactgttaagatgacattctctaaactccacttcaacttctttacagttaatgccttcagactgttccattcatcatcccttcttcacttgatgtgtcatcttaaatttcttaatttaactactcaagtaataagatcatattttttgacatgagtctgagcctagaaccttagtttaagccattgggagacattagacttccatttttattaatagattatcttttatttgtaaacaaagtatctttcattgaaggaaaa

SEQ ID NO: 11421 - DNA, 1800 bp, Homo sapiens
tctcaaacatgcacgtgtacctttaggatgaatttctgcaattggatgtgccaggccagagcgtgtgcatttgtggctttggttgacatcacctagtcgcccttcctggggcctgtgctggtgtactctgaggcgcgattgtgtgaaaggtgggcgaaggtgcctgttcgaccacatcctcactggtagactgggtcaccacagttttggaaaggtgagaaatggtatctaaacatagtttgaatttgcatttcttttactggaagggaggctgcgcgtgtttcacatcagagccatgtgtgtttgtggttgttgaactttctctcttggattgctaggagtgctttatgtattagggaagcagacttccctaatgcgtgataacgcatgcagatactgtttccaagtttttgttatttgtcttttaaatttgtttttgcatttgtcttttcactttgatttttgccaggctggagttttgatgtttatgtggtcataggtgtgaatattttcttttgtggcttctggattttgagacacagtggctatagaaccactgtagccaaaagttatgtttgcttttggtttcatatactttgctttggtcctgtcttcttgactttatttaaaatagtaagatattcttactacatttttccattgcccatagctggaaggagattgtaattatcaccaaagatgaaaaactaaggcatgttctcagcagaggcagattagactttaagttagaggcttgtccttggtgcagaggcctgtgagcgacccggccccacttgccctgcacaccatggcgtggattgtgggcagtcacagggaagacctctggctttgctgggagctggggtacggttcttagagtgccattctagagtggcttcgcgtactggtaatgaacgcccatcaagtggccttgggaattcatgagccggatgatgatgacttcgccggtgaaaagcaaatcccaaataggttgttttctgtgcattccagtcccaatttctcttccaagtaattattagatgtgccaagcctgttacgtttattacttacagaattgtttttgtctgtgtgagtttactgaggacttaggggttggtatgtgaggaggggagccccccttctcctgtgggcactctagcactcttaataatcagtattaaacatgttgaaggccataaaggaaataaccttctcttaaaaacaagttagagtcagtcataaaactgtttgcctagaccttgatcacttaaaataagatcttagatgtgatgtgtctttgtggagtatttcctgtggctcgggaggtgtgcatgagagtggggtctgagggacagtgaggggtgaaggaaaggtgggagagagggccttcagtgactgtaccaaagactcacagacactgggtgtcttggtgatgggtgcacatagcccttcttttgtgactgaagctgtgtggccttcatcccacagggtctgccctctccagataattctgtcactgaacttcaaactgtcaatggaacgatagcgcagtctcttaacaatgcttcaggacagataatagagctgtgcgggcagcctcggtgacagtgttgggaatctgcagaatggctttgtccacttctttcctttcagaggagacattgaacctcggcatggtgtctcacgccaggaatcccagcatgttgggaggctgaggttgggggatcggattgcttgaggctaggagcttgaggtcagcctgcgcaacatagtgagaccctgtctctaccaaaaaaaaaa

SEQ ID NO: 11422 - DNA, 1776 bp, Homo sapiens
tctcaaacatgcacgtgtacctttaggatgaatttctgcaattggatgtgccaaggccagagcgtgtgcatttgtggctttggttgacatcaccaagtcgcccttcctggggcctgtgctggtgtactctgaggcgcgattgtgtgaaaggtgggcgaaggtgcctgttcgaccacatcctcactggtagactgggtcaccacagttttggaaaggtgagaaatggtatctaaacatagtttgaatttgcatttcttttactggaagggaggctgcgcgtgtttcacatcagagccatgtgtgtttgtggttgttgaactttctctcttggattgctaggagtgctttatgtattagggaagcagacttccctaatgcgtgataacgcatgcagatactgtttccaagtttttgttatttgtcttttaaatttgtttttgcatttgtcttttcactttgatttttgccaggctggagttttgatgtttatgtggtcataggtgtgaatattttcttttgtggcttctggattttgagacacagtggctatagaaccactgtagccaaaagttatgtttgcttttggtttcatatactttgctttggtcctgtcttcttgactttatttaaaatagtaagatattcttactacatttttccattgcccatagctggaaggagattgtaattatcaccaaagatgaaaaactaaggcatgttctcagcagaggcagattagactttaagttagaggcttgtccttggtgcagaggcctgtgagcgacccggccccacttgccctgcacaccatggcgtggattgtgggcagtcacagggaagacctctggctttgctgggagctggggtacggttcttagagtgccattctagagtggcttcgcgtactggtaatgaacgcccatcaagtggccttgggaattcatgagccggatgatgatgacttcgccggtgaaaagcaaatcccaaataggttgttttctgtgcattccagtcccaatttctcttccaagtaattattagatgtgccaagcctgttacgtttattacttacagaattgtttttgtctgtgtgagtttactgaggacttaggggttggtatgtgaggaggggagccccccttctcctgtgggcactctagcactcttaataatcagtattaaacatgttgaaggccataaaggaaataaccttctcttaaaaacaagttagagtcagtcataaaactgtttgcctagaccttgatcacttaaaataagatcttagatgtgatgtgtctttgtggagtatttcctgtggctcgggaggtgtgcatgagagtggggtctgagggacagtgaggggtgaaggaaaggtgggagagagggccttcagtgactgtaccaaagactcacagacactgggtgtcttggtgatgggtgcacatagcccttcttttgtgactgaagctgtgtggccttcatcccacagggtctgccctctccagataattctgtcactgaacttcaaactgtcaatggaacgatagcgcagtctcttaacaatgcttcaggacagataatagagctgtgcgggcagcctcggtgacagtgttgggaatctgcagaatggctttgtccacttctttcctttcagaggagacattgaacctcggcatggtgtctcacgccaggaatcccagcatgttgggaggctgaggttgggggatcggattgcttgaggctaggagcttgaggtcagcctgcgcaacatagtga

SEQ ID NO: 11423 - DNA, 110 bp, Homo sapiens
cgtactcaatgtgaagataacgagaatgaagaactttatgatggttcacttccacttactgaatactaaatatattttctctttcttatgattttctttttttaattaaa

SEQ ID NO: 11424 - DNA, 110 bp, Homo sapiens; identical to SEQ ID NO: 11423

SEQ ID NO: 11425 - DNA, 148 bp, Homo sapiens
  misc_feature (136)..(136): n equals a,t,g, or c
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanaaaaaaaaaaaa

SEQ ID NO: 11426 - DNA, 152 bp, Homo sapiens
aaaaaaataaaaaaaaaaaaaaaaaaaaaaaaaataaaacaaaaaaaaaatataaaaaaaaaaaaaaaaaaaaaaaaaaaaaaaaaaaaaaaaaaaaaaacaaaaaaaaaaaaaaaaaatataaaaaaaaaaaaaaaaaaaaaattaaagag

SEQ ID NO: 11427 - DNA, 151 bp, Homo sapiens
aaaaaaaaaaaaaaaaaaaagaaaaaaaaaaaaaaaaaaaaaaaaaaaaaaaaaaaacaaaaaaaacaaaaaaaaaaaaaaaaaaaaaaataaataaaaaaaaaagagaaaaaaataaaaataaagaaataaataaaaaaaaaaaaaaaaa

SEQ ID NO: 11428 - DNA, 202 bp, Homo sapiens
aaaaaaaagaaaaaaaaaaaaaaaaataaaaaaaaaaaaaaaaaaaaaaaaaaaaaaaaaaaaaaaaaaaaaacaaaaaataaaaaaaaaaagaaaaaaaaaaaaataaaaaaaaaaataaaaaaaaacaaaaaaacaaaaaaaaaaaaaaaaaaaaaaaaaaaaaaaaaataaacaaaaaaaaaataaaacaaaaaaaaaa

SEQ ID NO: 11429 - DNA, 158 bp, Homo sapiens
taaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaataaaaaaaaaaaaaataaaaaaaaaaaaaaaaaataaactaaaaaaaaaaaataaaaaaa

SEQ ID NO: 11430 - DNA, 126 bp, Homo sapiens
  misc_feature (9)..(10): n equals a,t,g, or c
  misc_feature (14)..(14): n equals a,t,g, or c
  misc_feature (20)..(20): n equals a,t,g, or c
  misc_feature (95)..(95): n equals a,t,g, or c
  misc_feature (107)..(108): n equals a,t,g, or c
  misc_feature (110)..(110): n equals a,t,g, or c
  misc_feature (118)..(118): n equals a,t,g, or c
gccaaaaannaaanaaaaanaaaaaaaaaaaaaaaaaaaaaaaaaaaaaaaaaaaaaaaaaaaaaaaaaaaaaaaaaaaaaaaaaaaaaaaaaanaaaaaaaaaaannanaaaaaaanaaaaaaaa

SEQ ID NO: 11431 - DNA, 77 bp, Homo sapiens
aaataaaaaaaaaaaaaaaaaaaaaaaaaaaaaaaaaaaaaaaaaaaaaaaaaaaaaaaaataaaaaaaaaaaaaaa

SEQ ID NO: 11432 - DNA, 964 bp, Homo sapiens
ctcacaagataatatctcttgcctttttcctctcggagtgttcctgcggtttgtgatctctcttagctctggtagcctgttcaggccttaaggtatctgttcggtattatgtggtcaagtagctgggaccacaggatcacaacaccacgtctggctaatttttttttttttttttttttttttttgtagagatggggtttcgctatgttggccaggctggtctcaaactcctggcctcaagcaatcttccagccttggcctcccaaagtgctgggattacaggtgtgagccaccacgtctggcttggagggcttattaaaacaccgattcttagcctcacccccagagtttctggttagtaggtcttggcagggctggagaatttgtatttccacaccttccttggtgatgtgttgttggtagttcagggagtacatgtgagaggaaccgtttagatagtaaaaactgcaaacctgaagaagaatagaagaatccttattctgtgctctcttagatttagtttcctcatctatgatcaataactattcatttcttcctcatttccaataacgatttgctgcttttaagagcaagagatcacttttccttcatgttgttttgctagtggcaaatcagaaatggtttcgccagtattcactgatcttgtaatcactctcggaatccagctgcatctctagtgtagagttttgggtcaacaagaataatgctgagcttaaagaattggactcagtctcttgaagtcaggggttgatgagaaggtggctctaatctattcattcaacaacttcctattgagcacctgctatgtgccaggtgctgttctagccactaagatagagcaggtaataacatagggccattgtccttatggaatttgtattttagtggggtgaataaaaaagggcagtctaggtggggcccagaaatagaaaaatagaaaaaa

SEQ ID NO: 11433 - DNA, 964 bp, Homo sapiens; identical to SEQ ID NO: 11432

SEQ ID NO: 11434 - DNA, 236 bp, Homo sapiens
tgggtggatcacgaggtcaggagttcaagaccagcctggccaacgtggtgaaccctcatctctaataaaaatgcaaaaattagccaagcatgatgatgcgtttctggaatcccagctactcagtgaggctgaggcaggagaatcgcttgaacctgggaaacagaggttgcagtgcactcagattgtgtcattgcactccagcctgggccacatagtgtgactctttcccccatccc

SEQ ID NO: 11435 - DNA, 236 bp, Homo sapiens; identical to SEQ ID NO: 11434

SEQ ID NO: 11436 - DNA, 3722 bp, Homo sapiens
cagatgcttcccactagagaagctaagaagctgtggcagccacagccgggacagggcctggcctccagcccagggctttccctgatgtccagcctcagctgcctcttcctgcctcatcccacccgcaagaggagctggggaccagagacagagacacaaactccatttgaatgtgaaccttggcaccatggagatgctcagggtgagcccagtctgctctctcattagtatgaatttccttgtgtttctgtctctctcctcttccctggtatcagctgctggccccaggttcctccagagaggagcgggggtgggtggggtggtgctgattaaatctgaggacatgacattgagcgagagaagcaaggggagctgctgacctccctggatggataaccatcaggaggcggtagcagagtccacataccatcaccttctcctgcagatgttggttcagccacctttcctctaccacagatgggctatgtgttttcaaagcagaagagcagagacggcagagaaccccagctggttcccaggcaaggataatgaatacagtcccctggaatgtgggggcctgccgcctggccctccccaccaccaactgccccccttcagcagactcctctgcttccccaagcaggtgggccaggctgttgtctgggaatgccacctgccaccaggcacatgagcagccaggccaggatgaggtgggcagcagaggctgctgcagcctggggcaggggtcagcacagcatctctccatccctgcctttgggcagcccatccgcccacgcgtggatccgccaaagcaaagccctgccttctctctcgcggggcgctcagagttgcacactctgggttggtctttgatgacaccggccttgtggaaggagcaaaaaaacaaacctttaatgtggacctgcaacaccttccattccacttccattatgtaatcttgggagtcactcaactctccaagcctcagtgccctcctctgtaaagtgaggccgtgaatagttccgactccacagcattgctgtgtggtgcaaataagaaaatacacttgacgcaccagcacgaggcctggcacctgcctggttcctatgatctctgtgtgccaagccctcagccaggcaaagtgtccccgggtttttctccagttctatggcattgaatcctaacaaaacccagcaagggaggtgtcacaggacttcctggtacgcgccaggagactgtggctcagaaaacaggtgttgactctgtctcgagcagtctgtaaatgtggagttggggctcacccccgcccccaactcccatcctctagcaaaaccaaggccttctgtcattgcaaatggcctgcaaacttgagagtgattggaaatgcatccccaccctccagaacccataagagacccagcgcctgagcccacacatgggagtagctcctgagtacaggcagggcaagggcgggaggcaggaaggcaggagccagatgatggattagcacaggaaggagcacagcacctggagttgctttttagtcttcttcccaagaactgcatggggctggcagggagaggaggggaagtaggaggccacacgacacctggcacccattgtatgttttttatttttttttatttttttgatggggataagatttgcatgacataaaattagccattttaagactgactcatgccttaatcctagcactttgggaggccgaggtgggtacattgcttgagtccaagagttcgagatcagcctgggcaacgtgtcaaaacctcatctctactaaaaatacaaaatattagccaagcatggtggcacgcgcctgtggtcccaggtactcgagaggctaaagtggaggatcacttgagcctgggagttcaaggctgcagtgagctatgattgcaccaccacactcccgcctgggcagcagagcgagacccggtctcaaaaaaaaaaaaaaaaaaaaaatcattttcaagtgagcaattcagtggcacttagtacattcacaatgatgtacaaccaccactgagttccagaatactttcatcaccccagaaggaagcctgtacccactcacagtcactccccattcccctctctcccaaccacctgccagtcaccaatctgagccccatctctatggatctacctactctggatatctcatataaatggcatcatacaatagttgacctcttatttagtttgatggcaagagggggaaggagctgctgctggagcccctccaggccctgcctgaagcttctgcttgtggggaagtttctagatgctcagagggagcagcccagtctgccctagacctttgtttacctccttctttggggctccgctgtgtagtggactgggtgccggtggtcctgggctttggtctcagctcagcagctgatgcagagtcctcagggaagctgctgcacctctctgggccccaggggtctcgtatgtgaagcgagcggttgaacttgtgggtccctgttgctgcttttgcacccccccactactcccaataagttctgaggagagacgggactccctgtggtagagacaaagggccactgctgattggaggggaggaggtccagaagctccttctaaaacggaaagaaagagaggggaagtggccttgaccttggtccagcaaggggcagtgggccaccagacctcgtgggttctctgccaaccatgagagccagtaaaagggataaagaaggtgaccagggcaggagcagagcccagtgtccaggggtgcacaacggcctgcttccctccagattgggtgcagccccagatgggtgacaccaggatggccgtgggccctaggagtgactggggaggaggccgcgtgtgtgtggtgtgtgctggccggcaggcatgtgcaggcttctgtgtataatctggcttgtaaattgctcggggactgtaactgcggaaagggccatagagccgcgtggtgttattatttatgataaagcacagaggtgcctgccagggactagaatgggctgagcactgcgtgcaggatggacggcaaattgaactccaattttctgctcggcagtctttgttacacgccacaaagcgctggtacaccggggtcaccagcctgatgaatgtgtgttcttcctcagcggtggctccatctctcagcctccgtgcagagagcgactcgtgctttgttttttcctccctgcggggcccagccttggaatctgttcctgggctccaaacgcagcctggacagaggggaggtcagaggccttgcatggaggcaggcggctatgggttcaaaacccagctctgccactgacacacatgtgactgggtacctctctcatctgagcttcagatgagagaaataaaagagaagtcctcatagcactcccctaaggaggctgggaggattaaatgggtaaacatgcgctgctcagtgtggagtaggcctttaacaaatacccatctttccttcttgtccctgggctgagcagcctcgccctgaagccaggaaattgaggagaagcccctgaaattgggcagacaggccccgtctgggggtggtgaggtcaagcccctaaggacacctgctgtccagctcagccctctttattcaatattgggaaaccaatgctggtgttaagtcagagccactgcccctagctcccatcttcccccagcttccatctctc

SEQ ID NO: 11437 - DNA, 278 bp, Homo sapiens
ctcgatttccaaatcaggtcacattctgaggttttgggaaggacatgaatttgggggagacatattcaacccaatacaggcatcacctagtcttgtcccacagatgactttattaaacatcccttggcttccatgttgggccttactgtcattcatttgccacatatttcccaagcatcttctttgtctcaggctctgtgcccagtgccagggctatagaaaaacaggagtcttgggcccagctctcctggcatctgtgtgatgtgttctgcttttct

SEQ ID NO: 11438 - DNA, 14976 bp, Homo sapiens
gaggggccgcgcgcacgggaggacggagaggcggaaaggatggcgctgtgacagccgggccggagccctcgcgtccccaccccgcgccctggccgctgggcccggcggtgagtgcgcgcgggcgggggcggcggcggcgcggcccctcccccgggtcccgggcggctgggccgcggcagaggcgggggcgccgaggctgcgccgccgccgccgccgcctttgttgcgggcccgccggggaggcgggcggcgccggctctcgccgcccggcaggtgcgctggggccgggagggggccaggtggggaggcgggccgggcggagggggcagcggaagcgctcccggcgcggttccgcggagaaagggaaatggggcaagatggctggagaaatccgaacgcgcccgggggcgcggcggcggtggcgcaggcggggcagggcgggcggcggccctggttgcggcaccttagcgcggggaggcggcccctcccacctctgccccggagccggcagggagaccgccgccaagttcgggccccagctgcaggcatctgaagcctagacccatccatgccgcgttcgcctatcttttttggaaatatcgaaggaaccgactttgaactccagagggatcttttctttggaggttccccgatgcagccctcaagatgcatccgcactccacacctaggaattgcccgcgcccatagagggcaggagtgcggccctttgtactggccaagagtcagcgaatagagaatttgcagcccagaggcaatgggttatttccctgtcggggtgggccccagccgatttctgcacctttttgggtatccaggcataaccctcactatgtttcactgactcctgcgtttgcaaagtcccttaaggtagaatgaccctattttctgaaccagctcgtggacagaacctttgaatttggaaaatccaggcaatgggcctactgagccaaccgctccgcccatgcttaactggcttctagcacccattccagttgagtaagtgtccaatctgtgttcagacaccttcactgataggaaatcagcacctttcccctgcctctgattcctgtttgggtggcactggctgtgagaaagtactgcctttctcactgcttaaaaccttttccaggagtatttatccactggccggcctctgttctgccgtccagtctctacaaaccagtctgggttctcttccccagatagctttttaaatatttgaaggcagccagatacgttatctacccacagcctctcttatcataattaaacatgtcaccctgtagcttcctggccgactcttgtttccttacttccctccagcgggaacagtgcttggggctaaagaggtttgtatgtggctcagcctcccccatcataggctttggggaggtcacagtgacacctggtttttctgaacctgaatcttgcttgcagagatggagtccacagcctaccctctcaatttgagcctgaaagaagaggaagaggaagaagagattcagagccgggaactagaggacggcccggcagacatgcagaaagtacgaatctgctctgagggcggatgggtaagtaagaaggtgtggagtccacacagccagcagatgcaggcctgagagcccagcttgctttaagtctcctcctcagacagacgtgggaagtaaaaatagcccagcccggtgtgtttgcattcctgagaaaacagctctgtggctttaaaaggcagtgcaaagaatggaggaggtgttatggaaacagtccctcagccatgtagcttgtcatcgttcaattggaagtcctagaagccaggaccttgtctctctcgttcacccacttatcctgcactgcgtttgatgccaggcacattgtaggcaccaagtaaatgtttgttgacttactgctggttgaagggaaccattttaaataagactcgagtcattgggttgacatgagaggttaggctagttggttctgtgtgagcacctcttaccacagttgacacaggagagctgcctgtccagctgacctggatagaaatggtgggcagcagggaatacagagattcagggtatacacgcagaatagtatgatagaggtcggtttatacaaatgcaaatgcagtagatacttatagttacagatagttattcaccgtagttactggacttcgtggtaattaggcatgaatagtaaacattttaaataagcaacaaattgacattccttttctctgcttattttccgttgtgtataaacattgtcagtatacatagtatcctttgcttccatgaagagcccctatccatacaagcatggtacttctaaattgttccctaccagaggagagaactgggatgcagaaagattatctgccttgccctaaggttacacatgaacactgacatttgttcttcaaaacaggtctcctgagctgcacccttaaaagtaatgcattttaccatatgtatgctataccttaatttaaaaaaaaaaaaaacagtgcaaccacaggctctcagtttgccagtctagctgtggacaccgcgctgcctttgtctcatcagtgttctttgcccaccacatccttcttcccaattctgatccaagcaggcgtcaggtctatttagcctggaacaagaactcaaggcagtcaaaactcagggctttgaggctagattggtcaacccagaacatctaaatggagagccttggagaacaggtgcaatgaaagtgaatgttgggacagtgaggaaggagcaagatgaagaccaaccatgcttaggtgggaaaagaaggaagtaaccagaagggctggaggagggagtccagcagctggtggtgctggggattgggcatttgtggcctccaggcaatcagccatccatccacagttaccaagcacagtgctgggcgtaaagagagactcttttcctgatggaatttccagtcttgtgagcaaggcaggaaagtaaacataagtaatagtaagcacagtgtgcagagtgcagtggtggaagtctgcaaggatgcaccaggagccaagatgaggggatgcctcattcaggctgagaactccggggcttcctggacaaggcctaatcttgagcagtgagcaattttgcccccacccctggacatttggcaacatctagaaacactaccccctttccccacccctggatatttggcaatatctggaaacacttttgttggtctgacttggtgggggtgcgttggggactgggagatcctcctggcatctagtggatagaagccaggggagctgctagatatctacagtgcacaggatgcccccccaccaccacacacacacacacatacacacacaacaaagaggtaactggcccaaaatgtcagttgtgctgaggttgagaaaccctgctctagagcattagaagaaaagaatctgtttttaaaatatgtattttggttatagagaattatgttagggtgatcagtgaaagcttttcaagcataagaactatgataatatattaggataaaattccatagaattgaaatagaaatacaattttaagtagaaaaaataaaaaatgtgctttgaactgagtcttagtcattatggaatcagccaagggaagggaagggggttgcattccaggcaagaggacagcacaggcaaaagcactgaggagaggagcttgggtgcagagttaggagcagctcctgcagctggaacctgaaactcatggcagggagtggaaggggatcaggtataggaggccaggccaggggccagagccagccaggaggacatgcagtgctacgccagcgagtttgagctttctccttagctctgtggaatgaggccttagcccatctttctaagggaggcctcaggctctctacagccaccatgctaaggcctgagtggcctgctaagaaagcaaagctttggcatcagactttctagctctgtgaccttggacaagttacttaaccactctgtttccttacccataaaagtgaggtagtgatccccatgtccctagtttagcggattcagtgagagaatatatttatatgattgagtgtcctatacagtgcttggcccatagcaggcactccatcagtggatcagtacaaactaccccaaccccttcccccgagatccctgcgtctttgctgggtggctgcaaggctttagcgaggctgtgcaaggtgtaagcactttacaacatttaccctttgagatagcattggaatgccaacttcctgagcagagcaaggcagtgcacacaagctagaggaagaacacttatccagtgagcccttgatcttctgaggaaagggaggagggcagggactgaaggtccctacctgcaaggccaaggaggggtgtctggaggtggtacacagactgcctgacttctcagttttgcccggggccggccctgtttaccttctgctatgttgagccagataaaaggcctctgtggagcgaggggaggcctgcgcagcagggcctggctgaaggatcgctccattctcacagaggcttgctgtgaggagaatgtctaagccactacactgtgcctctggagcataatgtgggcttgtttgaagatcctccgtggctcagtcattaataggaagagatgaatcctgcaccagcccccagctttcttcctgcagcttcagggctcctggtacctgatgtttttaccaggcctagaatatgttaccccccctaagagtattgatggcccctctgaaatgacaggcatagacagtcctgttcccattttatcagcaaagggaaagggactataaataggtatgacctagatctggaacttcccagggagaaaaaaaggccaaagagacagttctttaaaagcctgggaattgggaaaggagtagggtggaaaattcctgggctgactggctttccagggtgaggaagtctgaggaaagcctgaagacgaatccattttacctcctcatatttcacacttagggatgtttgtccattcttactccaaagagtaggtttggttttatgacagataaaatttaatgattctttgaaacagttccaagtagaacaagagaagggaaatccagagatttgcctagatcgtatattcaaaagcacatttttcagtgactactagctacaggaagtgtcctcggcttagggaagcaaaaaggagtaagtacaggtcctgctttcaacaagctcagattctagtggagggagcagacaagtcaaccaaaagaattctgcagtgtgatgagtgccccgggagtgtggagcccaggacatttcagggacatgtgggtgtgctcacagcgtggcacagagtgggcttcctcgggagcagggattttgggctgagtcctggaagatgggtgggtgtcagccagaccaagaaaggggaggccctccaaggccaggggagaatatgggccaaggtgtgggggcgttggggaatggttgttcagggaactgcacacagctgagtacaagtggagcacagagctggggagagttgagggttagtcatcagggaggcagctgtgctcggtattgctggatccttggggtcaggcggtggtggccccaaaacgcaaccccaccatttattggctatgacattagcctggaaatgagacctctccaagcccatattctccttgattaagtaggggcatggtggcttgtgcctctaatcccagctactagggaggctgaggcaggagaatggcttgaactcaggaggcagaggttgcagtgagccaagatcgtgccactgcactccagcctgggcaacagagcaagactccatctcaaaaaaaaaaaaaaaaaataggcgtatctactcctccacaggcccattgcagggaataaatgaagcagttacaggccctttcctagtacgtgcttcctatgtatgaggtgctgtggaggtggggagagaacaagggggcttccttgggtcagggaggaaaggccaatgtatgtaagtgactgttggcctgacccctgaagtggctgcaggctatatagcatatggacactaattttctaagctaaggaaaaacagtatcataatcacccagacccaagatacagctttgggaaatagctttgaaggcaagaatacaaaataaccagcctgaaacaagccatccagtgccttcttatcactaaataggatgagctttggagtaggatttttaatgactgtaataagaaatacagttaaaaacaaaaagaggaggttggtttgggtggcttggctgccttgggctactgaggagccccctggtgctgggccaggaagcagaggaacaggggagggatgcagtcctttgggctttctgcctacctggtccaggatcaaagtgaatgagtttgctctggcatctcattacatatattaagctgtaattagcccttctttcttcctcttcatgctcttgtggattggaaaggccaaatagggccccttctctcagtggctcctccctgggcagctgtgggttccaagtctaacactttggttagtacccttggaaatgcagtgccctggaaacccacaaagatcccacggagggcagtgatcctattcagatttacaaacccaactcaccccgcccggggccgagggtctttttctggggtgggagggaattgggggtgcttgtgttggtgggacactttgtctgggtgtgggtggcttaagtcttgggtcagaggtgagccgtgagcagctctcaccacagtgcatgagggtgcgatgtcccatgtcctccaaccggtgatcatggtagggagttagttttcttctcaaagtgctgcttaccttatctgaactgagggtggcagctgctgtggtgggcacagaaggactgtgctcttgcccttgttggcttccagcagctgtatgaatgtggacagtccgttttcccctgggtcagggtccctcacctgacctgtgagaggacaggctgtgctgggctgtctgtaaggtcctgtccgctctgaaagtctgtctgcatatgcctgtttgtcattgtgaaagggctgttcactcttccaggtaccggccctatttgatgaggtggccatatatttttccgatgaggaatgggaagttttgacggagcaacaaaaggccctctaccgggaagtcatgaggatgaattatgaaactgtcctgtccctgggtaaagctgtgttttcctttgtctcctggaagctctgagcccagagaattgtttccatgcctctcttctctggtatatccaatgtccctctctcctgaacttagactctgcctcctcaatgtctgtgcccatttattccaatttttgatttgggcagtatatcaatattgtgtcaccctactcggcaatccgtgctgcctcagaactgcccccattcaacccaggcattcacatttaaggataaaaaccatgtaaccttagaaatgtcaccatggatctgggcctgtgcctcactgttccttacgagagaaggcaggcgttaatgttaccctgtcagcctcagaagtttggggacataccctcccaaagactgtttgctcctctccccaacttccaccccaaattgatatcacacatcttatcagcagaatgtaatcatttgaagagatttcccagtttgcttatacaggtaccaaaatgttaattggatcagcagctgcattcacccttctccctgctaaatgcagttcttttattgttggtgccaataccatccctcattaggagagatctacccattcctttagacagacctattttccattatcttttttctttaagtatccctgagcctttttccccttgtttttcacaaagaaggggagagtggctcttaagtattttgaagtacttattttggtagtgctccaggacagtaacacacagctgttacctattttatttcctataaacagaattcccattccctaagccagacatgatcacccgtttggaaggggaggaggagtctcagaattctgacgagtggcagctccaaggaggcacctctgcaggtactacaagtaaagcagttcagcgtccatccagctgggaacattgtggagtgggattttcagtgtacattccacggggtatttaagaggtagaaggattatgggttttggagttttgaaatctccctctttgcagtgctaaatgtgtgacagtgtgtgacaggcaactgcttttacctcagagcttccattcttcctctatcagctctgagtaacaagacttgatgtatgaccttgtttgtggatgaagcaaaatgaggcttgtgcagcatttggtctagtgcaccttctggctgaacagggctccctcagtggcgtaccatgtgcctctgcaaactaagaatagtgagaggaagcacacttcctgagttacctggctccctgtccatctcatactggatagaaaaagcaatagcaatcatagcatacatttgagcaaatgtatctaagaagtacctagtcctttgtcaagaaaaatggttattgaggccacagttgaataaatatagcattgcctccagacggccaaaatagttttatcttttctccggaagtaagagtttaaaatgccatatttcactgactctgagacatgtttttctcccattgctttactgtttctgaaattgagaatgcctcttaaaatcagtggcatgtcatagcttaattagtagtgttttctttcttaatggcacataatgatgcatcctacaactgatgacattttagtttgggtgagatagggtaatttccccaaatcatattcaacttctgtgaccaccttctaaatataaagtgaaacctggttgcaccattaatgtgcaagaactaattttctgccttataagcttaactttgctaagtgtggtttttgctgtaggttttcttggttctaaagggatatgattcaggccatgatgcatctctgtaatattatatggtagtatggttaacatttggcttctcattcacataaaaagtattttgatgcaaacatggcccccaaattatttggtccaagcttggttcctctgttgagttcccagctctgccactttctggcttggctaccttggtgcattatgtaacctctgtagcctccccttcttcatctgcaaagaaggaacagtgatacttagagttactctattaagagaactaggtgtgggtagtccacataaattggcatatggaaaaggacttaggcaatgttacctgttattaaagttactacttttggtgaacttcagattaaggtattcttagcatttcaacccccaaaaatcagggtataagccattttacttactggcattatttttgcccctcactatttgtctcccagaaaatgaagaatctgacgtaaagcctccagactggccaaacccaatgaatgctacctcccagtttcctcagcctcagcactttgacagctttggcctccgtctgcctcgggatatcacagagctgcccgagtggagtgaggggtaccccttctacatggccatgggcttcccagggtatgacctctcggctgatgacatagctgggaagtttcagttcagccggggcatgcgccgcagttacgacgcagggttcaagctgatggtagtggaatatgctgagagtaccaacaactgccaggctgccaagcagtttggagtattggaaaaaaacgttcgagactggcgcaaagtgaagccacagcttcaaaacgcccacgccatgcggcgggcattccgaggccccaagaatgggaggtttgctctggtggaccagcgtgtggccgaatatgtcagatacatgcaggccaaaggggaccccatcacccgggaggcgatgcagctgaaagctctcgaaatcgcccaggaaatgaacattccagagaaagggttcaaggcaagcttgggttggtgtcgaagaatgatgagaaggtatgacctgtctctgaggcataaagtgcccgtgccccagcacctgccggaagacctgactgagaaactcgtcacttaccagcgcagtgtcctggctctgcgcagggcgcatgactatgaggtagctcagatggggaatgcagatgagacgcccatttgtttagaggtgccatcacgggtaactgttgataaccagggcgaaaagcctgtcttggtcaagacaccaggcagggaaaaactgaaaatcacagcaatgcttggtgtcttggctgatgggaggaagttaccaccgtacatcattttgaggggaacatatatccccccggggaagtttcccagtgggatggaaattcgctgccaccggtatgggtggatgactgaagacttgatgcaggactggttggaagtggtgtggagacggaggacaggagcagtgcccaagcagcgagggatgctgatcttgaatggcttccggggccatgccacagattccgtgaagaactccatggaaagcatgaacactgacatggtgatcatcccagggggtctgacctcacagcttcaggtgctggatgtcgtggtctacaagccactgaatgacagtgtgcgggcccagtactccaactggcttctggctgggaacctggcgctgagcccaaccgggaatgctaagaagccacccctgggcctctttctggagtgggtcatggtcgcgtggaatagcatctcaagtgagtccatcgtccaagggttcaagaagtgccatatctccagcaacttggaggaggaagacgatgtcctgtgggaaatcgagagtgagttgccaggaggaggagaaccaccaaaagattgtgacaccgaaagcatggctgagagcaactgaagggaaagggaaaggtaaccactcaggagtagatactcagtgcctttgctgacatgtctgtgttctacaaacaccttctctccattatttttctgtttttaagttcccttagagcctacagtgcagtagtgtagatcaggggtccccaacccccaggtcacggaccatactggtccatggcctgtcaggaactgggctgcacagcaggaggtgagcggcaggtgagcaagcattaccacctgagctccgcccgctgtcacagcagcggcattagattctcataggagcacaaaccctgttgtgaactgcacatgtgagggatctaggttgcaggctcctcaatgcctgaggatctgaggcggaacagtttcatcccaaagccatcctaccacccactaccccgcacttcctgggtccctgcaaaaattgtcttccatgaaaccagtccctggtgccagaaaagttggggactgctggtatagataacagaccattagcattttctcctttatatgaaacatttattatttgatttatttgtgtctattttgctctgtggcttggacccagaaacacttgtataataggtgaaatgaacaaagaatgagctgccagaacatctgagagctgtaaagttaaaattatttggacccaaagaagcatagtctgacgttgttcagttcacacaaaattttgtctgaaaagccaacttttttctttcccttttaaattatgctgaacatttagggccagtatgtgtaactgacatgctgggacagttgtactcacttttgctggcctgtaggactgtgacatagggagaacactaagtgtgtcctccgggcctcgggtctcagtcctggagctatctacagtatgttaccagcgagtaagaataatagcttctacttgcttttccctacagagttcaggagttttaaaacgtcatcttagtctcattatgaccttcacatgggctatgacaataatttcctgtagtcagcagatgtctgaaggaagatattttttaactgaatctttacaccaaaaaaagaaaataaaacggtgcgtatctaggactctagtgagggctgaggacaataggcctggaattttctgggttgagtacacaagaagaacagctttcaaaggaaagtaggaatggaggcctaactgagacaacactagtgaaatgaccccacccacctacacctccagagaggaggaggatgagcatgtacagcaggggggacacccacaaagaacaaacaattcatttacctgttcgttctcatctccctaattataaattaaattgatcctccagacagtgttttatatgaaggaagaagccaccttttttacagaggacctgaaaccgtcaaccatcttcacacattctttttctttcttttaaagtataattaggtatttccatcttccttgcttttttctccaaatgaaatgctaatgggagccttattttacccacttcagctatataagtccatctgtgtttcaaagagtgacttatgtctcctgccttgcttccaaattaaattgtactcatattgctgaatcccattgtaattctgggatccctggaattacaatggagcaagaagttcttactattacattcaaaatcaccaaaattgcttttttttcccccttgggtcctccttgctttgagaaaccccatgaatccagcctcccttttctgctgacccttatattgcctgcattggatatcaaactgaattacattgagtttccatcttttcttcatttaccttttgcttttccctctccttgttagataacatttttgtgcacttttaatttcctaagctccttaccacctcagggacatgattaaaaacttccagaagaggaaaggagaaaaagctatgctaagttgcatttatgaatgttggcctgtaatattggtcatgagcttttgctcttctagtctgccacaattctctctgcagctcctgaggaagtgatgggagtagacagattcacagtgaacaagagatttgggagaccaagtgggcataaaactacgtcttggcctctatttggaaatctgaatgatggaattattatgtttgttaaaagttataccaaaaagccaagggttaattcatttaggttctctctgttttccagcaaatggaactctgatttaaacagctggggatgaaattcctcaagatgattattcctgaaagtgtggatgcgctggatgcgcagggaacatcaggaaaaggccacggggctctgaacagccccggtccagacagcagcctgtacatccatcccaggacacagcccagcccctccccacaccatacaaggtatcagaaaagtctaggacctatcatttcatcagagacatgatcagaaaagaaactgcttctgccccatttcttgttttggagattactccatctgtccatcaaaagaaacctgtaaatatgaaagaacaaaggttatttcctggagaaaagacaatttattcaacaccaacgagggactcatcatatgggcacaactctggtgtccttctatggagaaaacctcaagtaaagttttattctgcctttgaaaatgcttccaaaagtagaccctgtccccacacaggtcaagactacagagaaggctttgtagaaatgtgtcacctatgtacacctgctacttacacatttcctcttttggaaaaatgagatacttagaataacaagaaaattaagacatactggcctggtgccagcagatggcttttctatagacaaactaggttagtgtggaagatataggttaaaataaactatgctgttttatttatcttcccaacctgattggcagctagacttttttagggtctcatttaatggccctgtttttttcattattatatttaatgatagggcaggatttcgtatgcaagctcttgtttctcaggctgcctgcagaagaagtcgctataaattatctgttgtctacatggtacaaggcccattgactcatctgatgcttgttttgttaatttctttaatatttttatcacggggcagtgggagggcttgggcttttagccacagctgttttaagacttctgatctcctgccctgcaggaataggtgggaagtcattgaatttttacactatagtaatttgcattcccacataagtttgagtgttacgaaaacattcctttaaagggatctgtgctacacaaaatatgccaggacctcacagacaaagccattgctagaaatgtcattccaatgatcagatctggaaacaggctgccataaccacttttccttcttgtagactcagctcacctgtatatttaaactgttcttggcatcttgaaacacctatttctactcaggtactcattgtcctgttactgattcacctttctgatccttttcaaccagttttcccccaaggggggaaattttacttaacctctagtatttgaacaactcaatatttgaattgttgccccatttgcttttacctgtactgtattcttggtcatctcaaatggcgtctaaacccagctactttgcattccagaagtttccattccctccaattccacctaatttttcatctgtcctagttactggctctttcttcatgtcttatttctcttgctttgggagcttaaaagattttacaagacctaattttgggttccttccttggagccatagttaccctgccaagaagagtagaaaatgggttcaactcctgtttcgctccaccaacacctctgtgagtctcatcatcagctgagcgatgatgccttacaggttgcatagcactggaactttcctagagtaacggctctgctgccagggtttctctgggctcattcttccactgacttaattatgatctatgcctaacagagccccagtacaactattttgcagaatggctgttaccctagaattactatagcacatattgagatatagttgtactccctagtagataggaactgaccccaacaataaactttgataataaagacaata

SEQ ID NO: 11439 - DNA, 720 bp, Homo sapiens
gtcttccagcattctatggtcccaccaggtgggtaggtgactaggaattcaggccaggtcctagagagtagtgagaagttttccagtttgcagtttcctctgtgctgtatgtacagccatacagcctatggaacctgacattgcagtgggcagcaggacacggtcaaggctcctagctgcctctccatctatggaactatgaaatttcacacatattccctaggcagcattaaggcccaggtatattgagtagtccaaaccaaaaaactatattcgagtatcagtttaaattcttccaagccctaaaaattcttacgtagtttctcacctaaaactaatggcttgtgccaagaactgaaactaagctattgatttttttttaagaagtcttaatctatacataagaaattacatacctggccaggtgcagtagttcaggcctgtaatcctaacaaacactctgggaggccaaggtgggcagactgcttgagctcaggagttcattaccagtctgggcaacatgataaaaccgtgtctttacaaaaaaaaaaaattttaaattagccgggcatggtggtgtgaatctgtagtcccagctacttaggaggttgcgatgggagaatcacctgagcccagaggtccagtctgcagtgagccatgatcacaccacagcactccagctggggtgacagagtgagaccctatctcaaaaagaaaaga

SEQ ID NO: 11440 - DNA, 2407 bp, Homo sapiens
cctcactggactttcctgtctgctcggcatggacaggcagcccaggagaaggcagcacgtggccgggtgcagggacgtaccacccccacttccccaggggagctggggcagacgagtcccaggcactccatcctctgcagcaagtcaggttgtgatttactagggggtggtgaatataatggagagacttctggggaggaattcctgcgtcccgcgtggacttgcagagctcaacaggcagccacgtggctgagtgtccagcaaacatcacataaggctttgggtcctgcaggtgggctggccatgagcagcaagctcagtccagaagaacagttcctctccaggatccacttcctgcgcacttttatgtgcagtgtagctggagcagagctccccggaattccacaggcaactgagaacggagagggatgcaggccagccagggatccagcgtcttccccatcgtcactctccatggcctccgtctacacacagtgttcgtctgcacagcttgtcagcgcgttatcatgacttctatttggcaccggcccgtctgtccactgtcctggcttgttccaagcgctgccttctccaactggggtcctggctgcagagctgtctgctccccacgttgggcaactccagccaagattcctacacccaaatgtgaccgtgttgctcacgaagaaggctcagctttgcgtgtgcccagccgtgtgcacagctcgtcccaactcctgcgggtggcacctgcctctcccacctccagtctttcccctgtgatgagcagatgaccaccgccttccagggtcagcgtttggctgtttgtgtgcctgcccacccgcctccctgtgcctgggcctgccctgtgcctgcacacaggagtggctcatggcgtttgccctacacggatgggctgtcctgggagctactggacagtcaccttggtgggaactcagaggcatgggcattaggtcccgcgcggccagcctccgttccacatgggctatttttgtccatcgcgtgggacaacctagtattgggggaaaactcagtccactctaaagaagcatcggcgttttggatggacgaatgctgcttcatgcgtctccatgtcaatggactattttattcaactcgggtatttatgagtgtctcctctgtgccagccacgtgtgaaagaagaactccaagttactggacaccaggacaaaccaggtagatcactgcatccggttcctcctctttctgccgactctcccgggcaaccgttctgattcctggcatggagttggggcgagctcatcagtacccagagcgcctggtgtgcacgcaaaggcccccattttattagtcggtgtgttcagtatcacgctcaagacaagggccaacctattacttcacacacctcaaatacaaaaagtgcctgggaacgtcgatgaggtattaaaggaaaccactggtcttgtcagtcatgtacacacagaaaaaaaaaccagtcatttttatttttattttttgagacagagtttcgctcttgttgcccaggctggagtgcaatggtgcaatttcagctcactgcaatctctgccacccggattcaagcaattctcctgtctcagcctcccgagtagctggaattgcagacacccatcaccacgcccagctaattttatgtatttttagtagagatggggtttcaccatgttggtcaggctggtcttgaactcctgacctcaggtgatccacccacgtcaggctcccaaagtgctgagattacaggcatgaaccactgtgcccagccgaaaacaaccaagaattttttaacaataaaatgaccagcaagtaaacttgaaacaaaaatggacaaatatctaaaatatttttaaatgtatgtattttaattggcaaataatacttgtatatattgtttacaacttgttttaaagtatgaatacattgtggaatggctaaatcaagttaattaacatgcattaactcacatactttttgttttttggtgtggtgaggacacttaacatctactctcttagcaattttccagtcaccatgtcctactatagatccctagaacatattcctccaatgtaactgaaatgtatcccttgaccaacatcactgcccggccccagccccaggtaaacaccattctaccctctgcttctgtgagttcagcttttctagatttcacctgtgagtgagattgtgcagcatttgtctttctgtgcctgggttttttcacataatgcccttctggttcatctatattgtcatatatggtagcattgtcttcctttgtaaggctgactggtataccattgcgtatatacaccacattgtttacctaaaatattttttaatacaatcgctgaaaactgccacataa

SEQ ID NO: 11441 - DNA, 1783 bp, Homo sapiens
cctcactggactttcctgtctgctcagcatggacaggcagcccaggagaaggcagcacgtggccgggtgcagggacgtaccacccccacttccccaggggagctggggtcagacgagtcccaggcactccatcctctgcagcaagtcaggttgtgatttactagggggtggtgaatataatggagagacttctggggaggaattcctggctcccgcgtggacttgcagagctcaacaggcagccacgtggctgagtgtccagcaaacatcacataaggctttgggtcctgcaggtggggctgccatgagcagcaagctcagtccagaagaacagttcctctccaggatccacttcctgcgcacttttatgtgcagtgtagctggagcagagctccccggaattccacaggcaactgagaacggagagggatgcaggccagccagggatccagcgtcttccccatcgtcactctccatggcctccgtctacacacagtgttcgtctgcacagcttgtcagcgcgttatcatgacttctatttggcaccggcccgtctgtccactgtcctggcttgttccaagcgctgccttctccaactggggtcctggctgcagagctgtctgctccccacgttgggcaactccagccaagattcctacacccaaatgtgaccgtgttgctcacgaagaaggctcagctttgcgtgtgcccagccgtgtgcacagctcgtcccaactcctgcgggtggcacctgcctctcccacctccagtctttcccctgtgatgagcagatgaccaccgccctccagggtcagcgtttggctgtttgtgtgcctgcccacccgcctccctgtgcctgggcctgccctgtgcctgcacacaggagtggctcatggcgtttgccctacacggatgggctgtcctgggagctactggacagtcaccttggtgggaatgccagaggcatgggcattaggtccccccggccagcctccgttgccacatgggctatttttgtccatcgcgtgggacaacctagtattgggggaaaactcagtccactctaaagaagcatcggcgttttggatggacgaatgctgcttcatgcgactccatgtcaatggactattttattcaactcgggtatttatgagtgtctcctctgtgccagccacgtgtgaaagaagaactccaagttactggacaccaggacaaaccaggtagatcactgcatccggttcctcctctttctgccgactctcccgggcaaccgttctgattcctggcatggagttgggggcgagctcatcagtacccagagcgcctggtgtgcagccaaaggcccccattttattagtcggtgtgttcagtatcacgctcaagacaagggccaacctattacttcacacacctcaaatacaaaaagtgcctgggaacgtcgatgaggtattaaaggaaaccactggtcttgtcagtcatgtacacacagaaaaaaaaaccagtcatttttatttttattttttgagacagagtttcgctcttgttgcccaggctggagtgcaatggtgcaatttcagctcactgcaatctctgccacccggattcaagcaattctcctgtctcagcctcccgagtagctggaattgcagacacccatcaccacgcccagctaattttatgtatttttagtagagatggggtttcaccatgttggtcaggctggtcttgaactcctgacctcaggtgatccacccacgtcaggctcccaaagtgctgagattac

SEQ ID NO: 11442 - DNA, 271 bp, Homo sapiens
cctcgtggctgcatcgcctctcaaaggttccacctctcaagatcatcacaatgacaatcaaacttcatgaattttggaggggacaattattcaaaccagaacagagggggatggcaaatgttctgaaaacaagcctagaaattgatcttagaaatggtgcaaaagtagatttccccttctgtctttacctgtgatggtctaaccccaaaagcctcccagaacagaacttgtgagcacaagatagaaacaacaaacttgatgcagagctgag

SEQ ID NO: 11443 - DNA, 212 bp, Homo sapiens
ggaagctcgcggggctgcagcccggcggaggccccgggcctggtgttccgcacgttctaaaccgcctgtccccgaggaagtcgggcagggtcgggccggactcagcgccgctggcgggagcgccgtccgccccgaggaccctgcgggcccggaagccgagacagggccgcccacgtcagcgcctggcgcgggcccgaacgtaaatggcgctc

SEQ ID NO: 11444 - DNA, 2971 bp, Homo sapiens
gggaaagtgacggcccaaacgccagggaggagccaggacctcgccctgagctagcgggaggtaacggcggggagtcctggggcggagaccgagcgctgggggcgtggtctccagcgggactgggcctctagcgggagtgggggcgggggcgggggcggggccagcctgggggcccagacgtggcgcagcgactcggaggttcgcctccagcttgcgcatcatctgcggccgggtcccgatgagcctcctgttgcctccgctggcgctgctgctgcttctcgcggcgcttgtggccccagccacagccgccactgcctaccggccggactggaaccgtctgagcggcctaacccgcgcccgggtagaggtgagtacgccggcctccagccccggcactatcgttccccaaccctgcggccccatgggagcaccgtccgtcccggccccaagaccacctcgaaccgcgagtctccctgctttccccctggcgccgggaccatccctcctgttccctagccccagatggccccagcatccaccgtggaagcctgagacaccgactttggggcctggaactccgaacccttccccagctccccctacccggtccgacagcggacacccagacacactgacgcagtctcctaactcttctcgtggcctatgactcccaatcctgtcccaacttcccatcccccatcacttcatgttttcctggaattcccccccgacccggttccagggctggaggctccagaaagtctcttttccttctcctggggggaaagaagactttctgggtgcctcctcccatatgcaggatccggggaagggggccaactcggaggggcaaccgagttgggaacttggttgccaacatttactctgcagcagcctcccatcctcccccaaccaggaaattcccgttcggagtccctgtcttgctatgtgactttgaccatcacagcccgcctctgagctttttgtcagctctgtctgacaaaagggtgtagaatggttgggtgccggtggtgcacgcctgtaatcccagcactttgggaggccaaggcaggaggattgcttgagcccaggagttcaagaccagcttgggggacatagtgagaccctgtctctaagaaaagggctgagggtaggatggaggagggctggagtgggtggtcctggggtctagactcctgctggatggtggcatctcctcagggaaggcagggaggagccctcccatcctcccatgtcagggaagcaaccacatggtctgtggggctgggccgcaggtggcaggcagggtgaggtctgcctgtgtagagtagggaccagatggtaggtgtctccaatgggggcccccagggccattctgaggtgtttccttctgctctgcctccactgtgagatttcagggatcaaaggccaagcccaggtctctactgcttaagaggagcagggtgatcatttcccctgggcattgggagtcagtccacagccagtaggatgtacaggccccaaggctggcaggcacactgtgggtctctggccttgctcttttcccctggtgtctctaggcctgagtctccccacctgtatacacagttcccccttctgcccacaagggtccagcatttccttcagaccttgggaactgctgatccggggataactcacagcccgacccaactcagggataaggaagtatggctttggggatgtgactggaataaacgtgaaggactcctgacctatcccattttatccccctccagacctgcgggggatgacagctgaaccgcctaaaggaggtgagtttgaaggaagaggtccctagctctgttccccctgagcctcttggggagtgggcaacatggtcccaatgactggggcggggaggggggaaggatccctaggctgagagtctagcctaggctgagagtctagcctgcacctgacttgctttatgacctcactgggcttcagtgtctcgtctgtacctcgagtagactgaggtcatggtctctgatgctctggttcctccccaggtgaaggctttcgtcacgcaggacattccattctagtatccttctgttctgggggaggggaaatgggatgggcacctgggagaatctccacgtaacttcagaaaggggtggcagatggttttcaactgacaagttgaattgattggtagtggctcccagaggattctgaggtggtctccatgttgggtgggcaagagagattgactagtgatgactgccacagaatggagaggagggccctttacttctttgaaccctaattttctcacgtataagcggagaccctggcccctcccgggcacagagtaagctctgagcaaaggaggcaatgctgttcccatcagtaaggctgcggaaaccaccacctccctctgcccaccaccccgctccttaacaccacctccagtcacaacctggtgatgaaacacctccctggggccgaccctgagctcgtgctgctgggccgccgctacgaggaactagaggtgaggccgtgggaggtgggctgggggcgaggccagaggcgaggcccagcctgctgaccccgcccctcctccgcctcagcgcatcccactcagtgaaatgacccgcgaagagatcaatgcgctagtgcaggagctcggcttctaccgcaaggcggcgcccgacgcgcaggtgccccccgagtacgtgtgggcgcccgcgaagcccccagaggaaacttcggaccacgctgacctgtaggtccgggggcgcggcggagctgggacctacctgcctgagtcctggagacagaatgaagcgctcagcatcccgggaatacttctcttgctgagagccgatgcccgtccccgggccagcagggatggggttggggaggttctcccaaccccactttcttccttccccagctccactaaattccctcctgccttaactga

SEQ ID NO: 11445 - DNA, 23307 bp, Homo sapiens
tcgttgaaaaccaataatttatcaaaacgctgcgtgtgtatgtgggggggagggtgtcgcaacagacagggcagcggtgggcggacgcacaggcaggagacggtgcccggagagtgggggcggcagcttgccactggctggccatgcgggcgggcaggctagacattcttgccgcgcaggcgcagttcgtggcgtcgcaggtggttgtagagcgactgcacataggtgaagacacacttggggtcaggcttcttgcccatgatcatcatgtcgtccacctccaccaggggcacacagtccaccagcatcctgcagggagggggcacggggttggatgtcagcgccagacccgcctctcgtggcgcccctctaccccaaggtcttttttattgccgcattgcctgctggtctttcataaactccagacagggaaaagccttccaggaaggcaggaagcccctggcttcatctacccaagcctggaggcatctctcggggcgggggagcagagctaggcaggtggaggcggagatggcagaagagagccccatcccagtcaggcaggtcctgggtctgcttcctccaaccctggggaggtgctggctccaaaccctgcccatgttctccctggagaccaccttctgctcaccctcactggcacactccagttggtagaagcctctcagctcggcctttgcacccagatgggcttcatcactggccaatctttatctatggataggtctcactctagtggccctgtggtccaccgatgattgtctgctagctgcctgatctggtacttcctgttgagaggcccagggacccctattctttgacagggggtggggataaccctgctgctggagatggaggccagggaacgtgtgggcagcagaggggttctctaacccttatcacctgccttgggtagagcagaggaggcagatgaggatcccagccaataccaatggaccatctatgccatgctcggggggaccacccttctggccatccttcagaatgctagctgcccttcacagataaggaaactgagtcacagagcagaggagccatttgtttcaagccccatggcttagtaagtgcaggctaggccgcatgggacccaggcccccagttctgggtgttggcaaagccttttccccactctggagtgagtgggttgtgcctattaagcaactgacagctcccagagctctgaagctggagtctgctctctggctccttttcccctgtccctcaacccccagagcaagacctcttctgccttgatccctcctatctgccatacctgggacatagcaagcattcaatgttgctgaatgagtttcctatggcagggaaggcataatggcaacaattgctccttattctcaagacacctgagaacccaagaccacctcccatctcgtgcccttatggacaaactcagaactgtggtagggctgggcctacccccagctcacctggactccttcagagaagaaacctgggaggcagaacaccgaacacctctgttttagtccagactgtatccctaaccagttgtgggtgctagataaggcccttttctatgactgtttccccctctttagaacaggacagttattctctatctcatttgagaccttacaagaatttaggatgagtgagagggttctgggtctgctgctgatgtgccacgtgcccctagggtcatccctatcccagactgggcttgtttcccgagctgtaccatgatgcaaaggcagcctctctctgaagcttcttccagctgtggctatcgtcctggggatcccgaccgccctctccaacctggtgctccctcccgccccactcccttccctggagaccttataaagccattgtttacactggggctcagggctcagggctcaggctgccccagtgacaggccaaacaccaggcaacttgagcaacagcacggctgagtcacactttccaactggatcagggctgggctgggcccctctccctccaagctggcttgctgggcagcagctcctaagtccatatatgatctggagatagcaccaagcccatccgccactcatctgtgctccttctctgagtgtgtgtgtgcacatgtggactgccccccacaatggctccaggccctgaggggcatctgagtgtgcccctacctgtcactgactcacattccttcagccaatccccttgctccttctgggcctctattttcaatcctctctacaaaatgggcgggaacacagtgatggggcaaggaaaacagccactaagtggggagtttggagtctcagtttctggccccagctctgacctaaccatcttccctctccctcccacccccaggacagtcttagcccacgtctctctctgagctccttgtctgtaatggggtagttagtttaggatctgaattctttactttggtactgaggtgaggtgaccagagaggaaatgccacagctggcttaggatccagagtccccagccagaaacatcttcctgttgaactggtcctgctcctgagctccccactttggagtatggcaccaccaactccccagtgcccacacaggagcctggcagacttcttgaccttccctctccctctccaaaccagatctattgggaagcctgtctctctagctcttaagctattccagtcatctagtccatcccatctctcatccaagcctcatccgaggaaggtcctagaatgctatatccatcccttctctgtttggaaaccctttataactcctgttgtcctcaggaggaaggtcaaacttttttttttttttttttttttttgagatggagtctcgctctgtcacccaggctggagtgcagtggcatgatttcagctcattgcaaccttcgcctcctgggttcaagtgattctcctacctcagcctcctgagtcgctaggattacaggtgtgcgccacacgcctggctaatttttgtatttttagtagagatggggtttcaccatgttggtcaggctggtctcgaactcatgacctcgtgatctgcccaccttggcctcccaaagtgctgggattacaggcatgagccaccgtgctcggccagaaggtcaaacttctaactgtggccccctcctccctcatatccagactcaagtttcttcccttcctgatgtgctgtgctctccagctctcttgccctgctaagcctaggctgattcctctgcctggaactccctctccctcctttagcctgaacttgttcagatcccagcttagtttgcacttttttcagatggggggcccagacctgcagcctgggtcaggcatctcccctgggcttcccccatcacagtgctgcccacctgggtcatcactgcccatttagaatggtctcacctgctgggccctgaactgccagaagacagggctatgtctggctcctctggcttgactaaatgccccccttacttcccccacccgcctccctggaccctctctggccttgctgagcagattctggtgaaacggggcaggtggtagaggcggcgtttctcaccgtggggccccgagcaggggttaggactttttggtttttaccagccccttctggaccagacagcggtagaattcctggatgtacgtgtacacgcacttccagtcaggctctcgaagccgcaccatgtcctctgtatccaggagctgcgggcagtccgcatgggtcctggggagggtagggggccgggaaggggtgggggacgggggcaggaggccagggccccgggtggggaagagagggaagaggcagagaagagagaggggaggaaacagagacacacacacatacacacacacacacagagacatgagttcaattacgattccagtgctgcagtctgccagccccccgcatgcctcctccccactgtggacgtgccgctcactacccatcactaatggtgtgcaatgcagacaagggtgggggccaaaccagtcacaggtgcagagaactctaggggcaagcgggaacgcggggtgggggcgatggcgttggcaccaaggttggagaggagggctgtgccccggggagagggggtgagggaggcgtgagaggaggtggggggaggaggaagaggagaaggaggaggaggaagaaatttgagggaaaccagaaagagaaggggaaagaagggaagacagatggagaagggtgctgagggtgaggtgagcagacggggcaacgattccaaagtggagggcttgctgaggtcctatataagcctctggcagcactatataggctgggcgggcacggtgcccgggccaggagcctccttttggaatctccagccgggatcccgtgggagcaggaagctctggtgatagtgggaggagagcaggacagagaaagggagagagagggagaagggggcagagggaggatggaggggatatggacagggccacctggtgggctttggcccgggctggtaggccggcctgcggctccttcgttccggcgggcacctggcacgctcagcagcgggggggtggggatggagaaggacggggactctctggggaagggggtctcagccgctgactgacaatgtggctggcccgctccaggggttctcagggcaactgggcctggtcccgatgtccagccccagatgtgcagcaacattagcagggccagggcccacacttactccgcagatgagaaggccacctcgaagttctggcgtcggttctgagggctaagctgcccatagtcgaaggcctcagggaagaagttgtgcaccagggcacagaaggccatcccatcactccagctggaggagaagttctggatgtcgacgtgctataagccgtaggaggactggtcaggaacctgggggcaactcccccctgctgtctacccctcagcattctgttattccagacctagggcactgggcacaaagaggccccgtagcttgcacaatgagtgaatagttggaacatgagcctcctccaagtcagcctgtcaactcccatatttgcaatttcaagggacagagctactgagaggcccagcgccacccagctaaggctatggtcatgcctcatcactccttccctcatttagagaaattgactcagggcctcctacagagcaacaaggaggggactccaagagtgggatccggccttgaaccctgcccaccacccaagaggccctgttacttcatcactgattctggaatctagggcttgccttgtgtcctctttgagcctcagtttcctcaccccaagagcctttccatgttccctgtgaggccacacagtggcaggaagtgtactgggtaataggagctctgctaagaaggaggtgttgagctggggtctggggaggcctccaggccccctggcctcccggggctcacctcgtagccgcgagtcttggctcgacaccagtccagcagcatctgcttgatgctgttggcgttggggaccccgaagctggtggatcgctgcacggctgcgcggggtccgccagggctgctgtaggggcggtgtcaggaccaggtcacacgactataaggggcatgcctcggtgggcccacccagtggatcccaggccccgccttccatgaccttcgggcctttgcaccacagatctagccgcgcggtcttcccgcctctgccgggccaactatcaagccccgccccccactgcctatcacgccccgccccccactgcccagcccacttctgcagctcacccggccgcgccctccttctccagcttctcaatcatggccttgcgcgcctgggaggctgaggtcttgggcagactctgcgccttcatcagctctttcttcttctcggcctgccgtttctcgagcgccgccaggctgccggcccgtgggctggcctggtcctcgcggtcgaagatgctaggggttggggaggcgcatgttaggcagggagagcagggctgctccccagcctggaccaccactcgcgaggaggagggggggtcttgtagcacactagtatctccactgccacaaacgcctgccagggagggaggcgtcctcatcacacgcattttagaggagtacactgagtctcaaatgacagcaaggttttcaacaggtttccgcctccccctcccccacccacgagtagttctctgagaagcctcattgtaccctcaagttacaggggagttcagcttctgggcactatccgataataaaaatgatgactagcataataatagtaataataataattcatctctgttgatcctttcctgtgtgccattttaaacttcacaagagcagggaggggccttaccaattccactaaaggtgaggaaactgagacctctggcagtaacttgcctaagatttcagaggacgtgatgggcggaactagaacttgaacaaggtctctctgattcagagtctctggacccctttggttctcatcctggattctgatcctgttcctgctttctgccagccccaacagcctctgttacatgggggtaccctcctttctcatggggctaaggtataaaggtgctgtgtgacctgggacatggtttgcagatactgggaagtggcagtgccaccaggcagctcagtgtggtaggtaggcctctgtaagtgttcaatgctattgcagccactcagagatgtgagcccctaagcaactcactggcctccctgagcatccacctctcctgtggtgtggttgagaataaaatgagatcccaaggagagcaggatccttaactctcactttgcccctccctggctatagacctattacctcccagcatcccagtctacccctctgttttatttatttatttatttatttatttatttatttatctatttatttttgagactgagtctcgctctgttgcccagactggagtgcagtggagtgatctcagctcactgcaacctccgcctcccaggttcaagtgattcttgtgcctcggcctccccagtagttgggattacaggtgcctgccaccacgcccggctaatttttgtatttttagtagagatgaggttttaccatgttggccaggctggtcttgaactcctgacctcaagtgatccgcccacctcggcctcccaaagtgctgggattacaggcaagagccactgtgcccagcccacccctctgtaaaacgggtttgcagttaggtcccctgtggcactgactcctctatggtcagggattgggtgctggtgctcacctgcccatcttcttggatgaggaggaagaggagaaggtcttggtttgcatcatggtgctgccactgccatctgcaaaaaaggggaaggggcaccaggtgagggcctgggctggacatcaggagatgggatgggaggctgtatggaggggtggtgatagccgcaggcagagaagagaaagtgacggcacagttgaagacacggagagagagctcaaggaagagccggaggaggtgggcggacaggcaggcaggcacagggcgacaccaggtggccttactctccgagcgcctcacgaaactcgactccactgtggtggtgcgggccgtccgtgtgccatcatctgcaggggcaggggatgagaaggatgtgaaaggcacagggggctgggggaggatgtgttcccaccctgagccctgggccggccccatttggccccttactggagtggacgagccgctcagtcttggtaacagtgctgacagcagagccatcagctgcccgctggctgtgcctcgtggtggtctcagtggctgtgttgccgcgcccctcccctggccggccccgtgcctcctgcagccgccgttcccgctccttgtcccgctggtctgggcaggggatgccccatgcatgcgcaaaagggccaccaacacccacacagcacagatgcacaggtgcatggggcacacaagacggggtggagggtggcttgttagaaacatgaatgacacaggtaacaagggcctctctaggagcagctggggtgaggggacagccataacttgacagggaatggagtgtgggaagggtttgatggactcaggcagaaactagagaatacggagtagctaaactcaaaggggtatggatccaaaaagggtttctataggcatgagtagctaagtcaggaggggtatctagatctagtgagggggtagctgagtccaaggaaggagaagctgagtgaggaagtagctgggtgggccatcagcaggtctttggttggaggagaagagcagctggaggcaggaatatttagatccaggaagggagcaattgatgggatctgagaagcaatctgatccaggggaagagtagctgggagagaagctagtgaagggggttaactgggcttaaaatagaagtaggtgggtagagatagagactggggtggccatcagtgggccctggcagaagcagctagattcagaggagtaattgagagtgtttgagaggagaagcaattgaacccagaatctaagggaatgaatagatgtgtccagggaagaactatctgggggaggaagtagttgtgtccaggaaaagggaagctggatggggcagaggctaagatggccatcaatggacttcagggagagaggagcagcagggagaaggagtatctggattcagggaaggagtcgttgacagtactttgagaggcaactggatccaaggagagagtagctgcgggagggagtatctgggtctaggaaggagaagagaagctggttggggagaataactggggtcaccagcgggagagaaggagctagggaaggagcagctggatccagcagggaatagccaagggaactgctgggtctagagaaggagaagctgggtagggcagttattaagctggggtgtccacaaatggaccccagagtatgaggggagcagctggggaatggggcagctggatctagggtagggcaactggctctctacctctcttcctttgtcggagctcacgaagtgcagcccggatgagcttccgctcttcaaagtccgtgctctgatccagctgcatatagagcccatcattgcctacctggtgcctgctggcctctgccaacccccagcccaccggatctggctataccatcttgtccaagactccttcatcctcaatagtcatcagctcctcagcgctcagagggctccgcccttctggtgctttgttcactcgggtctgctcagccccattggccgcttccactgctgcagcgagaggctctgctggctctgcttccatctgcagggtggggagagggcatggactttaagcaggggtatgggtgaaactcatcatgtctccaatggatagggaagcagatcctagggttgctggcacgccttggaaataaccactagcctgccagcctgcctgcccaaagatggccatgtcagcgtcagtcagggaagaggcactgacagttttgttgtagggcttcccacgtaccccgaattgtattaatacaatggatagtgataataatgatgatttccagtccatagtaagtgttgtataaacactagggactttactgtccctatttaacagaagggaaggccgggcgcagtggctcatgcctgtaatgtcaacagtttgggaggccgaggtgggagggatcacttgttgccagcagtttgagaccaacctgggtaacatagcgagaccgcatctctacaaaaacaaaaataaaaaattagctaggcatggtggtgtgcacctgtagtcccacctactcagaaagctgaggtaggaggattacttgagcccaggagttagaggctgcagagagctatgatcatgcagctgcactccagtctgggcaagagagtaagaccctgttgcaaagaaaacaagaccggaaaaaaaaaaaaaaaaaacagaaggggaaactgaggctcagggcagctaactgacttgcccacagtctctctctaagtgtgatgcagcctgggatctgagctgaaggcagcctaactcctgaaccttagttcattttgctgctttgttcccagccccctcccaggcaggctctgctctgtgctgccagttcccgaggcctaggtcctcctgggccagtgcccaggcagcacatgttgccccccatctgcctgctaccttgccaagagggctggcccggggcctgtaggctcctgaccaggtgtctgactggggctgccctgagccaagacctctatgaagctctcctctgtaccacctccccctgcctcgcccctgctggaaaccatcctctaaggagtctctagccctgcagccctcccagggcatctccctagccccttgaagacaaggccccaagccaactattatggcccttcctctcctggcagggcctctccgtctgctataagggtaaggagagctgaggtggcagctgtttcagggaggcttggtctggccagggtgcagggcggcagggagctgggggctggggcctgggtcatgccaggggctgccaaggcagctgccacacatgcctcagggctggagcctggcaccctcttgccctagtcttagagcactagtgccccagtcccctgtcaagatagataaactgaggctcagagaaggtggtgacatacctaaagtcaagaggaggcagagcctggctcaaaactacccctcccaccaacccagaagcacttacgagactagtgctgcgggtggtgccggtggaggagcggcggcgggtgctgaaggcaggtgggtgggccacgggggtcccggcatcctcggcagcctgaaagagggcctcggggtcggcggcagccaggagcagctcgctgggctccagctcaggctcaaggccggacacaagtgggacccccagccgtaggctcagcacctccacctgcctgctcagtgcatccagccgccggctcagtgctgctctctctgcccgcagctcttcagctgcccgggccaccggctccacggtggctacagctacctcggctgcctgggtcactgccacccggcctgcttcagccaccgcccgcagctcctccagtgcccggcccaactgctcctcaagggctgcggccagctcaggcccaggccctggtacccccggcatggtgctggtggggactctatggggggtaatggtggggcagtggcaggggctgctgtctctggctgagtgtctgagtctttgcagctggtccgagggcaaaggcaagggcagcgggcctgccccgcccctgcctcccagcccgccaccagccagctggagctgcagcccaaatagaaacctattctgggctcctccgtggaaggggcagtgggggagggggggcctgcccaagcaggcggatcgccaggcctggctatagccctacagaaatcataggcctgcagcacagtaagactgcatgggttctgaagatcactgagatcggggccccatgcctcacaggtggggaaactgaggcagggaacagggaatggacctggcctagccaccatgtacattagctgtgagaatcagtctgctggactccacagcctgtactcctttaccctttaccctaactccagctgttttagacagctggaacagatgggggaaatggaggcacagggaggcaggactttgagtgatctgctataaaaagtgtcttggtcttacataaatgccctctggcctgcccatggtgctcacgtccaaccacagactttgagcaagcacattatgggtacatcacctgtcccctttggttccagatgggtaaactgaggcaagttggtggtgtcagacccaggtctcactgtggcacctcccatccacctcaagggcctcagcgggtccccccaccccaccccacacaatcccttgtcagagggcagctggatcctgcttttttggaaaggaagggtgctttatttccctcactctctccctgtctcccctgagaaggcccaaagctggtctagccatctcacctcagccaaagtcccattcagtccctggtttagcacagagggcattacctgggcagccgggtggcccgcttggggatccctttcccggctgagctcccggctagtggatcctgggcttgggaatgaataatggaagggtgctgcgtattcagttcccaaggcacctgctaggctgctgcctcacctgattggcgcccctctgcctgtctgtcccccctcagagcttctgcccaacccccacagggaggttgacgcagatgctaatcactaatctccaatctcctaatgggccaggctgatcttggatgagcagatgagctgctctatacctcggggctgatgtccagtgtgggtgggcgcaggggcactggggctgccacaggaagaggggagcaagcccttaccaccctctctgagcctcagtttccccatctgttcaccaggaatgaaccaaccaatttcgaactaaggatcagagatcagcatccaggaagcttaacgccagtacagagtaagcttccgacacacttagggactgatatgctagggtctggccttagctctgccaccgactggctgtggtctgtgagcagccaccttccctctctgggcctcggtttctctgtgtgtgcagtaggggaggagcagaggaaccctgctagccctacaccctgaagcagtgtatgtgaggctgacggatggtgaggctggtggggtgaggaggggctcaccttgatgctgcagcctcctcggctactggggggggcatggctgaagctggtgacatgagtgacactgcccagccgagccagggtcccagggctgttgacacgggtgatggtgctcttgcccccactactggtgctgagtagggtcgggggcgcccgcagccccagtgtcagttctgagtggggagaaaggtggctgtcaggaggatcaggtggagtgagggcagtgccagacaaggttgataatgccctcgctcccagcacaccctttggagacaccctgagtcctggccgcagcacctgtcctgcatgcagaagtgcggttgcaggcactcatccccattggggaggcagtggggggcgcctacctgccctctggttgcctgtgggcagcagcacccggcctgtggaggcctggccacggccgtccttgatctcgatggtgaatgtggtcttcatactgccccctggctcggcagtgccgacggccacgggcagcggggcaccaggctcctctgaacgtgccacaggcccccctgctctgttttcaaggggcctagcagccaagccccgccccctggggccctcctcctgggggcagcttcgaagctgggccaggggctgggctactcctcgttgctccttgctgaaccgggaggaggtatcactggggccccgagaggaggagccgctggaggaggaggcaggggtggtgctggtgagggaggggcccaggagccttgcgggggtcaggggacttagggcagcctggggtgtgccatcctggagcctagcagccataggagaatcagatgtgaacttgtggacacgatcccgcacagagccagcccgctggaatgaggaaggtccgctggcaaggggggtggactctagaaggaacaggagggctgtcagcaactgggtgggacagggtctgcacagatcctaggcagggtgagaataggtagtacctcggttctgggctggttggcgggggctgagcaccgacagggagcgttggcagggtcggggtccagccacgtctggcaggttggggagggggtgatggccatgtggggaaagagaaaagacaggggatagtgggtgtccacctttcataatcctctcctctacacctccctagcttcccaccctttcctgtactcaacccccaccccacctctccatcccctcctggatctcccacactccggcatccccactcggctgcatctctcctacaggcacctccttctcctgccacactgaccctaggatgacttggacactcctgggggccaggcgaggcttaggctggaggaagggtgcccagatcctttctgcagatggggaggggggacagccctcctggccagtgctgcccacagctccagctgggagatgggtggactcccttattggggagaagaatgtgcctgaggcccgttgcctttcaaggctgcaggggaggcctctagccatgggggtggagggggaggctggcctagctgggggcggggacacttcaggggtggggtgcagtatcagggactgcatggacctgaggaagctagagctgccaggcacaagagcccattttctaggcagggaaagggaggcagggggaggggaagaaagatgcctgtgactacccctgctgggaccctcacctgctctcttggtgtcagaggggcctctggtggggctctgggcagcaggggtctctttggggccagacagaagctgcaagggagaagaacagggcctgagcaaggcctgactcccagacctgctcacttgcctggcatccctgcccctcatccagactcaccttgttgaccacctggccctcagtgctggggagcgttggagactcctgaggctcagggctggtggtcttgggtgggctggggggtggctctgggctgcctggaacctcagctgtaaggcactgggcctcggcaggctccaatggaggctcaggagaggcaggggtgggtgaactgctgggtgaggcaggtgagctggatgtgctcccaggtggggctcgcagcaggagtgtcactgtggtcacatcctggctggtgccttcaggggtgggggttggctttgaaacctctgcctgctgttcctgttcctctcgctctggcacctgtaagggacccacaggatgcaaccaaggctccctaggctttgaacgccacccccaccactgagggccaggctggcaagtgcccagggcagggcatgcaaagcagagtggtggggcatggcttcctgtaggcacacctgcgcaagcactggcactggcatgctaagggcagtctctgatccccacttcccaatctcttggcactacctagccaaaggggttcagagaggaccaggtcctgatgtcagtgggtgggtatggcaggagacctattggggacgggagccttaatagatccctggagtggaggttcctgactcctggcctcagcctggttcatctggagtgggagtggggtcctgccaggaccgtggacccagcggcctctgctggccacttggggaacctgcatggcctgacctctcacccacactctggaaaatagagtgaactgtgagccagctggggtctgacatgcaggccccataagccaaggtaaagatgtgggctgtgtggagggtgaggggcagccctgggacgggttgaagcaggggaggtgccagggccggatttgcatttctgggagatccctctgactgctaaatagaggctggatggcaggggtgggccccttacagtgaaataccagcctagcaaagacactcaggcactctgtgctaccggtatccatgggcacaggacactgggccactctcccaccctccttacctcacactgttccagcctgtgtgccgctagccccttgctgtcctctcttgagccactgttgggacgcccgctgtacaacctcccagccaaggtggcagctggaagggaaggagcaagtggcaggtgagtgacagggaggtgctgtggacagcagacagcagggcaggggtggggccgggacaggccacataccctcaatctcctgagcccgtacacggcggatggcagctcggatcagcttgcgctcctcatactcaccagcgcttcgcaactgtgggtaagagacaggtcgcgggtgttgggctgtggagtccaggtcttcacctgccctgcccccatcccctgccccagcctgggcctcaccagtgcagtcaattcctccacatcgttcatggactccagctgccctgccagccgtgccagggcagcccgctgctcagcttcccgctgctgagagctgcagagacatcatgactgtaaccaccactgccatggccaggtcgtggaggatgtgggctaagggtaggagccagaacagagtacccagaaccttggcagaagggcatgtggctgtgcacaccctctaactgcacactgatacacatatgcccatggacgtgggcactaataccacacactcagacgtgctggctacatcagcacggccgcgacgccacaatcagtacatgctccatgcccacaaacatctctgtttttccagaagcgtgtgtggacgtactgccattagcacatgcaatccacagatacacttgtgctcacgcctgcctgcacacatgagctgagccagggctcacactcaccttctcacccgcatgttccaccccccgctactcactgcagccagttctccttgttgtcctgccgctcggcacggaaacgcttggatgccagggcctcctcctcgcgctccagctcctgccgctgcagttcccggatggctgagcggatgcgccgccgctctgccagatctgctgtgacctccagctgcagtgggtgcgagaggcaggtcattttggctgccaggggcggagggctggcaccagctgcccacggctctgcctagggcacaatgtgtggcctgtgtccactccctgtgtcccaagctcttcacgtgcctgcctgcccacgcagggtcccgggggtagacccagcccactgtttcagggatcttgggtagtccactttgcattgtggttcacagagcacacaactgtgagtggacagccagaaactgcccacttgtgccaggtgccaagccaggcactcctttctacaactcgattcctgcctctcagagcccagatccccaaaagtcagggagctattgtaggaggaggagggaggccaccctgtgggtcactaacagggtccctagagggaaaggtgacagatgaagtccaccctctgagcaagggaggctccctggtctagtcaccaaacaccacagcccagctgggggttgactgcttcatccacagatggggaaactgaggacaggtgctcaggagtcctgcctggctgagggctattgtccccactgcactggcctggacctagccaccatggaagaagccagggtgcagagtgggaggaccaatcccccagacatataaggtggctggcactaggggccaccccagggccttatagagggcatccctgggtgacagctgcttctaccggttctcaacccctcagttcccgggaaattgggggtgactggtctaaccaggttcaggaaagaacaccttctctggagtgagtcagccaatcctgttgcctcccccacacctccaccatgtagagccacctgctacatacagatcctccgtggctcaagggagagaggactggcccagggttcccctggaagatagtggcagagataagcctccagtgtgggtctgataaccagacgggagccagtaaaggcggggtgatttcctctgtccccaccccccaaatcattcaggggtagggccaaagaaccctctatcatctccctttttagcgcccccccgtcattcctttctgcttagcgggaaggccaggtggcaagggtggggatgggatggagatagttttcagcagggagtgtgggctggcccaactcagccatgagccagcttgtcctagtctgaagagagcagggagagtcttgggggaagagccctccaggctccacattcctgaggaattatgagaagaccccctgaaactcaggccagagcccttagttggttccagccctagtccaatcctggctgggtgatcaagagcatatcccttaaactctctgtgtcttggttttttcatttgccagtgggtggggttgggaacagtgacttggcctctcctgtacatagctgcagttgcaataagcatcacccccatacttggttctagccagtcaggaggagggagagagacaagggggcaaatgggaagggcaggataccccgaggcatcagtaacatttatggagagcctgtgagtcaaaccctgtgctgagccccctacttgtcctaagcccacaaaaaccctagatactactgttattcccatttgacagatgaggagattgaagtccagggaggacatgtgatttgctcatggtcaaatgacctgagccaggatttgaacccaggtctctctgactccagggcctgccctaggctgaagatagctctgctactggggtctgtgtgtcatggtggggacctcagggatcctggcactgtgttggagacccctctagcctggactagagatgctctgaggcctaaggaggccttatagcagaggcggggggaatgaggctcactccccagcccccggtgctggctgtgtctcaggcctagagccttctgtggtacatttggaggctgggggctggaggggacagagggtccagccccttctgtacagagggtaaagaggcccagaggggcaagggctagccttttgtctcctaggtccccattctcagtgctctgggctcggagatggggtccttgtctctgacaaaagcctgatgtaggaacttggccacctctacagcacaacccccggagcttcagtgtccccatctggaaaatgggagcctccctctgatcccccaaagtgggtgggcaaggctggagactgacaacctcattccactggtcaccctctggcacgacccttccctttgggcctggaggcaaaggttggaccacagtgtctcctctgtgtgtcccgagttccacccgcccaggccccaccgctgtgtaaggagggagctgtgggagggagggaaggaagtacaaagcgccattgtctaccgagggggaaggggaaggggatggggcggtttccgaaactgcccagtgaaattctcccgggaggaaagagggtgcttcctccccctggggagccggctctccgtgtactctctgccctcgctgttgggaacgcctggcaggccctgaggtctcactgggcctcagtctccccaacagcacaacggagggggctctccaggctttcagtcccagctcccccggttgcccatgggggtcccgccggcggtggagggaagcctcgccagggggcgctgaaggcccgcaggttctgcgaccgccctccctcgcagggcgccgccctcgcctcgcccaccctgcctcgcgctaggcgccgaaggggtagccaggtaggaagacacccgctaccgcctgcttcagtgtccggatctaaagggaagaaaccaaggtccccaggacacccagctgagtggcggaggtcgaactcgaactcgggaccgaggcagagggcgtcccggcgggtggtggaggggcacgcggcgtgcaagtccccaggcgtccccattcctcccatccccggcccaatcctcaagaatgtgcgggagccggggccggaagcgactgcccgcgtccccaaatcggccagacgctggggcgcagggcgggcggagcgggcctagcttttccttatatggcccggccccgcggggaggagcccggctcgggacgcccccgttcttgccacgaggccagcgggggccgggccggcgcgcggggcgcagtaatggcgggcgccgggtgctggaggagccgctcccggggtcggaaagacttcgagaggcaccgatcccgagaccggggcaggttctcatctgtcctttcccagagattcaaccactgctccagcttctctccaaaactcttttccagcgccgcccgagcctcgcttaagagagggaggtggcggctgaagaaccctgagcctgcctgtggataccttgagatgaggatgtgcgggaaccaggcctggcattccctctttttggactgtgctgcctctacgacccccactgggacttggacttcctgagggaaggtcgaactgactggcgggcacctttggaaacctaacctcatcccctccaggctgcacacatcctgcggtgatagtggagaggcagacacccagagagtctaatgcgctggtccgagaacatacaggcagagtgccttggggaggtcatggcagcagctgggcactgcccagtggctgggctacgctggttggttccagcctctgcctgcgggggaaggtatgagagtggggtgggtcacttgtcttctaggtaaagtaaatctttaatttacccccatggacaagggtcagggactgaggagatggagctcctctggcccctcctccaggtcaggctgcctggcctttggggttggggaaggagccctgccccactgggttgccctacggcctctgtgcatggaggtagacagggctctcaggaagaggaacaagaaaggggatggagtgggctcatctttcctccacctgagatctgggtccatgcctcattctgtccccatgccaactctaggacctagagcttgtgtgcaaacacatctccctccctcccttcattttacaggtagaggaactgagactcaagagtagaaaaatgagatgagaagccacagaatccataagggcccacaaaacctgtctctctcttatggcctcgtccagccttgactttcccaggactctggtcccccgtggcccactatggggttgggattttggcacagctccttcttagatgggtgtccttgagcaggtgattttaactctcttgagtcgcagtgcccaggctttcagagctgctgtgattattctgtgacatggtatacccagtacccagcctgccccctgccaggccttggcattattaatcattgctgctaccattatcactgggccagcttccaggggtgggcattgcccgagctattgctctggagaggcatatccagcctccccacacctgtggctgcatacgggcgagtctacagcagttactgtttaaacaggtggtggctgtggagggttgggagggactaggcttcagtaccaggcatggacaggcacatgccacaagggcctctgcatcagccacatggaactggcctacccctgttcccatgtccccctcctcctgacctttcccccatcacttcttcctgtcagctgagaggtaccctggattgaccctgcctctctggcttggctttcctgtccccacagtgggtgatggggccacttaccagcttccgaagggctccctcatccagcccagctaaggcctcgtccgccatctcgctggcccctagctccgtcggttcctttctggtgagatccccagtgcctgtggcacctgtcaccagctcagagaattctgcaggggacagacatgaatcaggcatgctggggcttccagaaaccacaggcacttaggctctgtgccttactttccctctctaacctaggagcgtccattactgtcccatcctataatgtggctcctggctggaagctgccctctgccctagggtggtttgctggaaaactcaccaaacccagggtagggggtctctggttccagccctgccagcttggccgccagtctgctgtgtggcctgggatggactctcatcctgtctaaacctcaaaacagggagggcagggacctggattgagaagccagggcctggcaagacccacccaagctgtgcttaccaccagggggtgcactccagtctccagtttcctgccccacccacccatccacagggcctacccagcccccacccactccgcaggctcagcttctggctgtgggctgaacccgtagttcttgctgccaccaccactgtcattcccccaggtataggaaggtacactgtgtcttccgattcttggagccagctctgctgtccagacctcctgaagccaggtgtccaggcacccagcacctcctgccaattcatacagaattcaattccccacctggaagggctttcagaagctgacctgcccaacccctggatttcaggcaaactgagaagattggagagggccaaggatttgtcactgagcaaggaggaagccaaagacttagagggcagagaaggatgtaatcaaaatcttcgtcatctccggcttccgaagctcccttccaaagtgccctcaagggcctggaacactctcagtgacagaggcaagagccccatcttgccccagtgctgcccatcaaaatggacccctaaatcctggcccagcctcccagcgcagatctctccttcctcctgtagccccaactaatgtctgtctggaatttgaggggccctggtctggcacactgtggatgcttagttaatgtatggtgactgactaatgtgtggccccaggcctgccccccacctcctgttgattcatctttcaatcatcccttccctctcttcagaacagtcacttgggaagtcaccccatacggtgcatgggtggggggtgagggttaccgctccacacagttggggtgtgtgggtcccagcctgttcaagtcactgcttgttccccctcccatcctggtaggctcagaggtgtcaacctcccaatctctgcctgttaggatccttgcctcttacctagttactctgtctgggttaaacctcttcaagactgtccagtggtcaccagccttaggttctgcggacattctgattccccccatgtctgttcttctatggggcagctgaccctaatgcctaatctaggacacccatgggattataagaagatccctgccgctgctcttctccaatctccctgtcacacagtctggggtcgccggacattgtgaggggcctcaggattctgtggcagcttccccagggtttctgccgccacagactagcgcccctgtggggcgtggagtctcttaggaatccgggggcgtcttcccccaacagtctcataactttatcccatggcttagacctctcgtatgggtgggggctcccaggtctggacgttccagaactcctgtctagacatccgggttccacccccggacacgttggggcagcaccaggatcccccccgaggtccgcacacccacctctcagtccagcccacccgtccggcgcaggctcggcttagctctttcgggacccgacagacggattagacacgcgcaggccggaggtgccgcgacccgctgtcccaggcccgctcagcaaccgtcccctggattctgc

SEQ ID NO: 11446 - DNA, 523 bp, Homo sapiens
acctcctacatttatgagcaaagctcggtttccctttttgctttccctccgctggttctctgcttagaacactcacaggcatccttgggaaccagactccctgtggtcacaccatcctcactcccctcctcctgcaagggaataggatgtggtttcctggagcttggatagaaagaacaggaagggcgttttcatatgcccggcattaaggctttgaagttcttaaaaccccttctagggtgaaaccgttagggaatttcaacgacgtactagaattattgaacaaatgcaatgggaggatcttgccttgatcctgaagcaacaaatacactttaaaatgacgttttagagggaaatgggggaaattgaatatggactgggaactaaatgattgaaagtagttttgttaatcttgttggtataatattttgtagttctgtttttaaactgctgcagtgtttatggccagagtctaaatgtttacgagttgctttgcttttaaaatattccaacaaaaaaaaaa

SEQ ID NO: 11447 - DNA, 522 bp, Homo sapiens
acctcctacatttatgagcaaagctcggtttccctttttgctttccctccgctggttctctgcttagaacactcacaggcatccttgggaaccagactccctgtggtcacaccatcctcactcccctcctcctgcaagggaataggatgtggtttcctggagcttggatagaaagaacaggaagggcgttttcatatgcccggcattaaggctttgaagttcttaaaaccccttctagggtgaaaccgttagggaatttcaacgacgtactagaattattgaacaaatgcaatgggaggatcttgccttgatcctgaagcaacaaatacactttaaaatgacgttttagagggaattgggggaaattgaatatggactgggaactaaatgattgaaagtagttttgttaatcttgttggtataatattttgtagttctgtttttaaactgctgcagtgtttatggccagagtctaaatgtttacgagttgctttcttttaaaatattccaacaaaaaaaaaa

SEQ ID NO: 11448 - DNA, 11071 bp, Homo sapiens
aggcaaatccagatcccaacacttgccttggagtgtttggcctcagtttgtacacaacagagagggatcttcgtgaagtattttctcgatatggaccattgagtggtgtcaatgtggtttatgatcagcgaactgggcgatctcgaggatttgcttttgtgtattttgagagaatagatgactcaaaggaggtaaatttgtcttttatatgcctgattatagtactgaattagtgtgaaaagttgattaatagacttatttctgtaaacattgcatccttttttcttcctttttttcttttttttttttttaaagataggatcttgcgtccaggcgcggtggctcatgtctgtaatcccagcactttgggaggccgaggcaggtggatcacgaggtcaggagatcgagactatcctggctaacacggtgaaaccccgtctctactaaaaatacaaacaattagccaggcgtggtggccggcgcttgtagtcccagctactcgggagtctgaggcaggagaatggcgcgaacccgggaggcagagcttacagtgagccgagattgcgccactgtactccagcctgggcgacacagtgagactccgtctcaaaaaaaaaagataggatcttgctgattttgctctgttgcccaggctggagtgcagcctcgacctcctgggctcaagcagtcctcctacctcagcctcctgagtagcagacactacaagtgtgggccaccatgcccagataattttttgttgtagagatgaggtctcactatgttgcccaggctgatctcgaactcctggcctcaagtgatcctcccagaatgctgggtttacaggcatgagccatcatacatggcctgttgtgtcctttctaattttgacctgattcaaactctgcctctcagtgttaacaattggagtgactacagtttcactttttttggttatgctctctgctataggcatatcctaattgaaatctggctgtgtaaagtgagctatatgtgtttaaattaatggaaaaagtatatgtgtaagtgttctcttttgaataagccataatgatgctccaaacagatgattacattaacttttaaaaaataattctgatgtgtgggtttgatatgtttaattttgtgtctataatgaggaaggaacttgtttttctattctctaaatgttcatttatcagtgtgttcaataattgaaaaatagtacatggaaagaattgataattttttagtgctattcttaacttgcctaacacaatgaactaatcaatgtcaatgacttgaaatagtgctattctaacatgttcggtattataaaggaagtggtaggcttgctttaagtttttgcagggagtcttgctgtgttgcttaggctggtctcggaacaactcctggcctcaactgttcctcctgccttggcttcccaaggtgctagaattactgatgtgaaccaccatacctggcctaggctcgcttactctttactaaaagttgatagtaattgatttagaaaattgcattttaaagaatttgaagctcaatacttttagttttgttagaccttctgtcttttaaattaatatatatatatttgtatatatctggaagttttattagaccttaataatcagggtgtttttcttttcttttcttttcctttttttttttttttttttttttttttttttttttttttgagatggagtctcgctctgtcgcccaggctggagtgcagtggcgcgatctcagctcactgcaagctctacctcccgggttcatgccattctcctgcctcagcctcccgagtagctgggactacagacgcccgccaccatgtccagctaattttttgtatttttagtagaggcagggtttcactgtgttagccaggatgatctcaatctcctgacctcgtgatccacccgcctcagcctcccaaggtgttggaattacaggtgtgagccaccgcgcctggccaaataaggctatcttttaaaaacagtaagttcttggcatctggtgggtagaagccaggaacactgctaaataaccatacagtacacaagctggcaccccataacatagaatcagtctcaaaatgtcaatagtgctaaggttgagaaaccccggataactctaacaaactagtactttagtttttaagtcatttatgtcacaggcagtttaatgccttaatttgtcagtcttatgatttttttttttactgttacgtatttgtgatttatatattccttttctcaattaagagatacatgttatcaatttagaaatactaggatatctgagctgaagtaaaagttgcaaaatgcaagccagaacagtgtaatttttttattattaatattttttaatgtgaaacgtgtttatctcttgattccacctgtccccttccacttctggataaaactaaaatggcaggccgggcacagtggctcgcaccttgtaatcccagcacttcgggaggctgaggcgggcagatcacctgaggtcaggagttcaagaccagcctggccaacagggtgaaaccccatctgctaaaatacaaaaattagccgggcattgtggcaagcgcctgtaaccccaagctactcgggaggctgaggcaggagaattgcttgaacctaggaggcggaggttgcagtgagctaagtttgtgccacttcactccagcctgggcaacagagtgagactccacttcatctcaaaaagaaaagaaaaaaaagcttaactggcaactttaaagacaggagcagttacttagtggcaggattagaagttccttttagttcactaggtgacaatatgttacttaaggagcggggtgacgaggcttgtcagctaaatcacagtttctcttttcagttgcccaggctgaattctcagctaacacaggcatgttgtatggtttcttctgtatggctgagactgtctccagtctttagggacaggcaatctgaagtgatttgatttttttctttttttgttgtttgtttgttgtttctttgtttgtttggagatgaggtcttgctctttgccctgtcgcctaggctggagtgtggtggcacgatctcagctcactgcaacttccgcctcccaggctcaagtgatcttcccaccttagcctcccgagtagctgggacaacaggtgcgcaccaccatgcccggctaatttttgtattttttggtagagacggggttttgccccattgcccaggctagcctcaaactctggacctcaagtgatttggcctccccaaagtgccaggattacaggcatgagccacttcacttggctaaagtgattttttttttttgagacggagtcttgctctgttgccaggctggagggcagtggcacaatctcggctcactgcaacctctgcctcccgggttcaagcaattctgcctctgcctcccgagtagctaggactataggtgcatgccaccacacccagctaatttttgtatttttagtagagatggggtttcaccatgttggccaggatggtcttgatctcttgatacctcatgatccccccatcttggcctcccaaagtgctgggagtacaggtgtgagccatcgcgcccagcctaaagtgatttttaaaatctttttaaaatttgtattcctttttgactaacttctccctgattctgaaaatttcactgaagtttcaaagttattagtgtgcatatggtgaagataataatataagctcctcaccctgttttagtaagaagtacttagagattttgtgtgtgtttttttggggggtgcttaggatggggtgcagggagatcaacttagagaattttgatttttggaacttcaaatggaagatgtgttaaatttgttgcagctttgcttttgcagacatttatgtgatgtaaagttctttttaaaaattggaccgggtgtggtggctcatgcctctaatcccagcactttggcaagaggatttacttgagcccaggagtttgagaccagcctggggaaacatagggagacttggtctctacaaatatatatatgtgtgtgagagaataggaaaaaaaaattgtcccagaaacaaataatactctcagagttcttttcaaagagaccaaagagacaactcttatcttcaagaattaggctgtgcaaggcggctcatgctatttgggaggctgaggtgggaaggccacttgaggccacgagttaagagaccagcctgggcaacagatcttgtctctacaaaaataaatgcatgcaggccaggcgtggtggcttacgcctgtaatcccagcactttgggaggccaaggcaggaggatcacaaggtcaagagatcgagaccatcctggccaacatggtgaaaccccatctctactaaaaatacaaaaaattagctgggcatggtggcgcatgcctgtagtcccagctacttgggaggctgaggcaggagaatcacttgaacctgggaggcagaggctgcagtgaaccgaggtcacgccattgcactccagcctgtgcaacaagagcgaaacttggtctcataaataaataataaaatgcattccattgaatggaatactgtttagaccccttctctaccaagaatttttgttttaattagccgagcatggtggcacaaacctgtggtcctagctacttaggagactaaggctggaggattgcataagccaagaagtttgaggccacagtgaactatgatccactgccagcctgggcaatggagtgagacctccttttttttttttttttttttttaatgacctttagtttatgggacactcttacggagaaatatttgtggatacataaaaattgtgtagtttttattagtttattatacttttattagttcagtctcaataaaaggttgaaaggcattacgataaatttgttcttgtctgtttatatcatttcttcttggctgctcactgagtcttaatcagtgtactagactgcaaactaaagaataagattgggggcaggttataaaaagaacatgtataaagcttagcaaaccctttttaatgttctgaagtcagtctttgtaagtgaaatcgctggagactagaaagtatgaaatggcagtctacctgggcaacctacaaaaaatttagcttgaaaagacttcagtctccgctcccctgttgatctcatggagtggggaatgggaattgaaccagaactggaaaattatttaggaaagtttgttaactactctttgttgatctcatggagtggggaatgggaattgaaccagaactggaaaattatttgggaaagtttattaactactctttctgctgagtaaatttaaatgtgttctggacattgttgaggtctagaattgtctatacaatgccctgtacaagctacattgctgtcattttcaaaatcaggagtttatttggattacatatactttgtgcttaattttaagtaatgattacttcaagactggtgaattatacgtgactttttgtgcctgttctttataggctatggaaagggcaaatggaatggagctggatggtagaagaattcgggtggattattctataaccaagagagcgcacacaccaacaccaggcatctacatgggcagaccaactcagtaagagttcaagtttcctaagctaaactatgaaatccaccagaaatatgtgcaaaattttgattactcagaaacttttttcctataattagaattgattctggcaaggggcaacatggcaaaaccctgcttctactaaaaaaaaataaaaaatcagccaggtgtggtggcacatgcctgtaatcccagctgctcgggagctgaggcacaggaatcacttgaacttgggaggcagaggttgcagtgagcctgggcaacagagtgagactctttctcaaaaaagaaaaaaaacataagtaggggttttgataatgtttttaaatatacaaccctcctggctggctcacgatgttcatttgccgggcgcagtggcttacacctgtaatcccagcactttgggaggccgaggcgggtggatcacgagatcacgagatcgggaccacggtgaaaccccgtctctactaaaaatacaaaaaattggctgggcatggtggcaggcacctgtagtcccagctactcaggaggctgaggcaggagaatggcatgaaccccggaggcagggcttgcagtgagccgagatcgcaccactgcactccagcctgggcgacagagcaagactccgtctcaaaaaataaaaataaaatatacaaccaaaggcagtattcacagaggtatttcttgggaataaaagaaggaatatagtcattccttggtattctctttggtgtccagagttacttaaaaattcttggtgtttattgccttttagtcacagggatacaccttttattcatttatttatttatttaccagtctcatttagcagtaggaatgcatcttagcatttttatactgctgctcaacacagtgcttcatcgtttcaatttgttgaaaagattttaatttgggcagtgcattagtagaaaagcagttaatagttttgagagttttgtgaagcccttcttgattatgtatgtagggaataaggcaaaccagaataccatgggagtcagtaaaatgagatacggaggcaatttctcatgaaagggatgttcttcctcacttttctcttttttaagccattcaatttgtattaaagtgtcctggaaaatagtcattcacactaatggagaatttttacatttttctgcagtagtggtgggggtggtggaggaggcggcggcggtggaggtggaggtggtggcagacgtcgagattcttactatgatagaggatatgatcgtgggtatgacagatatgaagactatgattaccgatacaggtaatgttttaacttgagctttctgttctaaattagatgatagtagtgttacttggcacttttatgttggatacatatgaataaaaacttgatttttaaaatagatcatatatgacgcctttgggagcagaagttagcagtctgtatatgtcagtattttgttgtgctatatacttttctggtctcattggcagaaagagaacttaatattaagtagttatcaccttaggtacattattattttgaatgatgaggaatttttattttcatctgcctcagtggagtgattatatagtatgctaagtaatctttcatttcttacagaagacgatcaccttctccttattatagtcgatatagatcacgatcaagatctcgttcctacagcccaagtatgtgaactttacttttgtagcataaaaaacctcatttctaattaatggcttactttagaatattagagtataaggtggaaggtggcagttaatagttggaaaaatatgaggcaaattaaactataattgttaactttttttttttttttttttttttgctttttctcttttaggacgctattgataacggaatggttgcaattaaggacattttttttcctcttttttttttttttttttttaattctgagatttccccaagctgtggattcttcctactccttaagaaaaaaactttggtttatttagcatctacacttttgtcagttgtgttgctgttttccacccattttattatactcttaaaagatgtaattgttgtcattttgaacagttaaacatcttgagtataaaaagaaccccaatgttatgttatgctttgtaaatttttttttttgcttttacctagataaacttctagctaatcaaataaggaaagaaactgtctttttaaagcttcttttgtgttagatactgtattagagatctgcatttatcatgagttcctttttttttttaactttatttttgggaaagtaacacatgaagtagttcagtcatgtcaggtttgtctggggtggaatggaacagtcaggtagttgaaagtttttttttagagatgaaaagcttgtgaactcctgtaaaacatgctgtatttgaaatacatctgttaaaacttaaaaactaaagtgtgattttttttgttgttgttaagtttattgaagtttattcccttaatcagtgaaggacaacccttatttattacctagagcagttgtataattcgctgttagaaattttggtattgggacagtggataagcaggttatcacatagcatagaattcttaaaagatacatgtggggaaaagtagtctcaaataaaagctaatttctttgaaaatgggattgtctctttattgtggtaccatggagaaatatgattgaggaactggtccttccttttccctcacatccccccagtgtgtatttatatgaaagtttacccatcctgagttttaacttcccaatatttctcatttttaaaaatattttttcttacactagaatgttattccttgtcttttctttggttcttttaaaacccttgtttttcttctcttttgggggagaccgaattgtaaatattgagaatattcagtaccagcaccatgctgaaggaaagataggtagctaatacctttttttttttgagacggagtcttgctctgtcacccaggctggagtgcagtggcgcgatctcggctcactgcaagctccgcctcccgggttcacgccattctcctgcctcagcttcccgagtagctgggactacaggcgcccaccaccacgcccggctaattttttgtgtatttagtagagacggggtttcacggtgttagccaggatggtctcgatctcctgaccttgtgatccacatgccttggcctcccagagtgctgggattacagacgtgagccactgcacccggcctactttttttttttttttttttttttggagacagagtctcgctctgttgcccaggctggagtgcagtggcgtgatctcagttcactgcaagctccacctctctggttgacgccattctcctgcctcagcctcccaagtagctgggactacaggcacccaccaccacgcccgggtaattttttgtatttttagtagagggttttcaccatgttagccaggatggtctcgatctcctgacctcgtgatatgcccgcctcagcctcccaaattgctgggattacaggcgtgagccactgcgaccggcctataggtagataatatcttaagaagtctaaatatattccagtaggaaacacacttaaataactgtaatgtaaaagaagaagagggtgtttcaagtgacctttaaaaaaaggtgttgggcagctgggcgtagtggctctcacacctgtaatcccagcactttgggaggctgaggcgggcggatcacgaggtcaggagattgagaccatcctggctaacacggtgaaaccccgtctctactaaaaatacaaaataattagccaggcatggtggtgggttccagtagtcccacctactcaggaggctgaggcaggagaatcacttgaacctgggaggcagaggttgcagagagcaccactgtactccagcctgggcaacaaagcaagactccatctcaaaaaaaaaaaaaaaatttactgtttgaaagtcctgtcctttttaagtatattttgtgactagggagctgagctcagtagtgtgcacctgtagtcacaactagggatgctgagacagaaagttattttgagcataactactcaaaatagaaataaaagcttagatatttctggacctccactttttctgtttactattaagatctaaatgtggccgggcactgtggctcacacctgtaatcccagcactctgggaggctgaggtgagtggatcacctgaggtcaggagttcaagaccagccttgccaacatggtgaaaccccatctctaataaaaatacaaaaaaaattagctgggcatggtggtggacacctttaattccagctacttgggaggctgaggcaggagaatctcttaagcctgggaagcataggttgcaatgagctgagatgatgccattgcactccagcctgggcaacaagagcaaaactccatctcaaagatataagtgttttcaactggcgggtaagaaaaactgctgctgttggttctctaacttcttacaacggtggttcccacttaatcttatttaggtcctggagccctaaaaaaaaaatctgaaaaacctgcagtctgtcttcccagaaacacttgtgtgaaacgttctggtgtttttgtgttgagacagggtctcactctgtcacccaggctggagtgcagtggtgggatcacagctcactgcagcctcgactgccagactcaagcaattctcccacttcagcctctcaagtagctgggactacaggcgcacgccttcatgcctggctaatttttgtacttttttgtagagaagaggctttgccatgttgccctggctggtctcaaactcctgggctcaaacaaattgacctccctcagcctcgaaaagtgttgggattacaggtgtgagccaccacgtccagcagagtatttggcttttaaattataatcttgtgcatagaataagatctataagaatatacaccaggggccgggctcacgcctataatcccagcactttgggaggctgaggcaggtggatcacgaggtcagaagatcgagaccatcctggctaacatggtgaaaccccgtctctactaaaaaatacaaaaaattagctgggcgtggtggcgggtgcctgtagtcccagctactcgggaggctgaggcaggagaatggcatgaacccgggaggcggagcttgcagtgagccgagatcacgccactgcactccagcctgggtgacagagcaagactcagtctcaagaaaaaaaaaaaaaagaatatacaccagcctgggcgtggtggctcacgcctgtaatctcagcacttttgggaggccgaaggcaggtggatccacctgaggtcaggattttgagaccagcctgaccaacatggtgaaaccccatccctactaaaaaaaaaaaaaaaaaaaaaaaa

SEQ ID NO: 11449 - DNA, 286 bp, Homo sapiens
gaattgcacagcaacttgaactattacacacaaatacatattgctttgctgtggcaattaaaagcccagcattttaatgtattcctatccctgatgtcacacttaatgctttgggtttttagtatgaattttctttttccctcccaattaagttaaaattaaatgaatcaaatggtcaaaactagtgcatatttttattctatgaaacaattcagatacttattgacattaaaagatcaggggaggagtctttgagcatactctggctagggaagctgctcaataa

SEQ ID NO: 11450 - DNA, 754 bp, Homo sapiens
gtaatcatagctaacacttttattcagtacacttaaagcttttaacatttctgtgaggcaagttatgttatatataaaaaaaattgagtcttggatgtatgacattgaaggagttttagttttggttttggtttagtttttgctaactagcagtctaggtttcaaccaggcagccgggctctaaagttcttagaacatgtttgcatgctgtactatgcttctcccacaggatactaacttaaactgtggtggagcatgtcattatttaatgttttgaaatctgtaaatttatttctaaaatctggattgtgggaacactgaaagaatatcctcgctaaagaatgaaaatgggccaggcatattggctcacgcttgtaatcccgactacttgggaggctgagatgggaggattccctgagcccaaggaggccaaggctgcagtgagccatgatcaggccagtaaactccagcttgggcaagagagtgaggccctgtctcagaaaaaaaaaagaaagaaaatggaggagaggaggtctaaatcaacaattacagatgaagtcagattaagtacaaatctgtaagggatgtaaagcatttgaattaactagaaagatggtattaaactgaggatactttttttttataagtgagacggagtttcactcttataaaaagtaaaggttgttcaaagagattttcctccccatctaattagaaatagataataatttctcttagaagcaaaatttattca

SEQ ID NO: 11451 - DNA, 1006 bp, Homo sapiens
caaaaggggcttctattgtattggtcatattttattttggtttaaaaaattttagagtaaatgtggcaaaatgttaatgcttgttaaatctgagtggagagtacattggtgttaagtgtgctgctatgcagggtgagtgaattactcaataactaaataattgtgacataatatatttatttatgcttccctgttatgatctacacataaaattactggagcattattgcttaacttcttgtaaaaaagttctgcaattgtagtgttattaagaaagtaatattgatttgtatagtgacagaggattttttcagtgtcactttgccagcagagatcttcatggtgggcattgcccctgcccatgtctcacttggccctgggcttgccccactaggtaccctgcccacctggccaggcaggctgtgcttggcttgagctctggcccagatcctgcacttgctctgcggctgagccaggcatgccatgacctacttccaccttgggagccggcgtctggatgaggggaatgctgtgacacttgaacagaggtgggcatgtgaccccaaagccccaaagggggtgttacagcatgctaacagttctttcagtctcacatccacagcccaacaaatggaggtgtgtggtgcccagaggtcccttctcccattgtttggcaagcaggaggggtgtgctacagggttacagctttgtttgcacttgccgtttggtgggtcctgagttcttttcccatgtccaagaataaggttgtgctgacagctagcggttgagtgaggcaaagagttttactcagtaacaaaacagctctcagcagagaaggaagcctgagttggacagcacccttacctgaagttgggtagtcttcccaccacctaaaagtgggtagcccaaagtgtggctgagcctggggcttttatatgctcagaatgggagtgtatgtgctaattggtttgtgagtatgcaaaaaaagctaaaaaaaaaaaaaaaa

SEQ ID NO: 11452 - DNA, 336 bp, Homo sapiens
gaatgtaagctaattaaatggcttattaaaggagattttcagatatttttgaaaatctatcttgatagtacttataagagataaatataaaaacttaaagatattggccaaaggagattaaaaaaaagtcaggcaattaaccagaacaacattagtgatattaatagaagctagtaaaatacaagagagaacacaaaacagacccatccctgtatagaatttggtgatatatgacagagatgaccatacaatcaattagaaaagaaagcattgttgatggtcctgattgagtaactatgtggatgtggagggcagtgtaaatgaaagcctaacttc

SEQ ID NO: 11453 - DNA, 739 bp, Homo sapiens
gcagacagagcccttggccagctctgagacgctttgtgagaccccaaggtgggtgttctagaaggaagaagctttggcttgcttactggaaccaagacaaaaattccaaataaaattccaaataaaaatgtaaatcgagttttttcctcgattgtcacagagactctggtgaatatgttaagttttcagaaagcgattcttttcctagcaatgggctgcttgccttgcattcctcaaggcctgtcctgtgccttccatcctgcatccttccacaaggctctgagtggctgtaggaccctcatatgacaggaggaggaggctgaccttggccaaggtcacatatcccttcttttatccattcgaaaggctcttgctgttgactgactatgcagcagacatagctgggccctggggagatgtgcaaggcaaacacacccaagagattcctgccttcactgagcatgcaccgcagagacacgctcagtcacttctccctgagctctcgcagcacctcagacatgcctctagtttaagcctctacttttaaatgtaatccctgtgcatggcacaccataggtactcaaacaggggctggtggaactcttgagggagagggagtgccactgattcctcttcctgagatggaagtgtgcgtgcatccgtaccaatgtgcatgcatgtgtgtgtttgggggaagacatagtaaataagctgagtgtttcttgttctccatggtctc

SEQ ID NO: 11454 - DNA, 739 bp, Homo sapiens; identical to SEQ ID NO: 11453

SEQ ID NO: 11455 - DNA, 3126 bp, Homo sapiens
cttggcaatgtattaaacagcaggccttggagactagcacttgagttaacacagccaccacaaccaccactgccatcatcaccttcccggaaagcagccacctgtctggctcctggctttgtccagctgccaacctaaggcatgtgcctacgcaggaggcgatgacattttggctccacgttcaaagttgttttttttttcctttctcatgtgttatttctaaagataacaaaggtcaaaaggcatccagcgttttctggtttctcataagcttctggtcaatatttaatctggtttatggattttttttaggtcttctagatgccttcttgaggctgcttgtggccacccacagacacttgtaaggaggagagaagtcagcctggcagagagactctgaaatgagggattagaggtgttcaaggagcaagagcttcagcctgaagacaagggagcagtccctgaagacgcttctactgagaggtctgccatggcctctcttggcctccaacttgtgggctacatcctaggccttctggggcttttgggcacactggttgccatgctgctccccagctggaaaacaagttcttatgtcggtgccagcattgtgacagcagttggcttctccaagggcctctggatggaatgtgccacacacagcacaggcatcacccagtgtgacatctatagcacccttctgggcctgcccgctgacatccaggctgcccaggccatgatggtgacatccagtgcaatctcctccctggcctgcattatctctgtggtgggcatgagatgcacagtcttctgccaggaatcccgagccaaagacagagtggcggtagcaggtggagtctttttcatccttggaggcctcctgggattcattcctgttgcctggaatcttcatgggatcctacgggacttctactcaccactggtgcctgacagcatgaaatttgagattggagaggctctttacttgggcattatttcttccctgttctccctgatagctggaatcatcctctgcttttcctgctcatcccagagaaatcgctccaactactacgatgcctaccaagcccaacctcttgccacaaggagctctccaaggcctggtcaacctcccaaagtcaagagtgagttcaattcctacagcctgacagggtatgtgtgaagaaccaggggccagagctggggggtggctgggtctgtgaaaaacagtggacagcaccccgagggccacaggtgagggacactaccactggatcgtgtcagaaggtgctgctgaggatagactgactttggccattggattgagcaaaggcagaaatgggggctagtgtaacagcatgcaggttgaattgccaaggatgctcgccatgccagcctttctgttttcctcaccttgctgctcccctgccctaagtccccaaccctcaacttgaaaccccattcccttaagccaggactcagaggatccctttgccctctggtttacctgggactccatccccaaacccactaatcacatcccactgactgaccctctgtgatcaaagaccctctctctggctgaggttggctcttagctcattgctggggatgggaaggagaagcagtggcttttgtgggcattgctctaacctacttctcaagcttccctccaaagaaactgattggccctggaacctccatcccactcttgttatgactccacagtgtccagactaatttgtgcatgaactgaaataaaaccatcctacggtatccagggaacagaaagcaggatgcaggatgggaggacaggaaggcagcctgggacatttaaaaaaataaaaatgaaaaaaaaacccagaacccatttctcagggcactttccagaattctctcatatttgtgggctgggatcaagcctgcagcttgaggaaagcacaaggaaaggaaagaagatctggtggaaagctcaggtggcagcggactctgactccactgaggaactgcctcagaagctgcgatcacaactttggctgaagcccctgcctcactctagggcacctgacctggcctcttgcctaaaccacaaggctaagggctatagacaatggtttccttaggaacagtaaaccagtttttctagggatggcccttggctgggggatgacagtgtgggagctgtggggtactgaggaagacaccattccttgacggtgtctaagaagccaggtggatgtgtgtggtggctccagtgggtgtttctactctgccagtgagaggcagccccctagaaactcttcaggcgtaatggaaaatcagctcaaatgagatcaggcccccccagggtccacccacagagcactacagagcctctgaaagaccatagcaccaagcgagccccttcagattcccccactgtccatcggaagatgctccagagtggctagagggcatctaagggctccagcatggcatatccatgcccacggtgctgtgtccatgatctgagtgatagctgcactgctgcctgggattgcagctgaggtgggagtggagaatggttcccaggaagacagttccacctctaaggtccgaaaatgttccctttaccctggagtgggagtgaggggtcatacaccaaaggtattttccctcaccagtctaggcatgactggcttctgaaaaattccagcacacctcctcgaacctcattgtcagcagagagggcccatctgttgtctgtaacatgcctttcacatgtccaccttcttgccatgttccagctgctctcccaacctggaaggccgtctccccttagccaagtcctcctcaggcttggagaacttcctcagcgtcacctccttcattgagccttctttccccactccatccctctcctacccctccctcccccaaccctcaatgtataaattgcttcttgatgcttagcattcacaatttttgattgatcgttatttgtgtgtgtgtgtccgatctcacaagtatattgtaaacccttcggtgggtgggggccatatcctagacctctctgtatcccccagactatctgtaacagtgccaggcacacagtaggtgatcaataaacacttgttgattgagtaa

SEQ ID NO: 11456 - DNA, 6888 bp, Homo sapiens
gatccccgcccgcgcgccgcgtcccacgtaccccgccgcgccgggcaagaagatggcgggatcagtggccgacagcgatgccgtggtggtgagtgtggcagggcgcgcgcgaggcgcccctccccgccgtcccgcactccgccgccgcctgctccagcagtgctggggtgctgagcagccgcaggcccggccggcgcccggcgtgggaaggcgcccggtacctgttagcagccgctggctgcgcgcggccggtgttaggggctggagaggctcccgggctgcggggctctgggctggggagggagtttggggaggatggcgggtagggacgcccgacagccccctctgtgccgtgcaaccgccagccaggtgtgcgcgtgggtgagtgtgtccggggcgcgcgccccgccaccgcccccgacgtaccggggattcccccttggaaatgggtcggcgcccggggctcccgagagaagttgagcacggccgctgcacttcagtcacgtcccgaaggacaggcctggcccaccgcgcttccagaagcgtttacggttggagaggggcctgccctcctccggcgtggggctctggctcttcggtggacctcgaccttgattttgatctggatctgaagggtctgcggatcttcagaggcttaactaccgggtggaaaggatgggttttgttcgggggtgatgagattatctaagagacggtgaagaggcatcatctgcagacactgtgtgcatgtggaaggctgctggattccaccacatctgtgtgggttcttcctccagccccccaaaaaagagcccatggaaagccaatctgtgtacttctatttttagaaactagatgatggccatttaaacaactctttgagctctccagttcaagcggacgtgtacttcccacgactggtaaatgattttgctctgtgtctctgcctgtaccttcctcctttctcattgctttttaaaattttattcatttgtttattgcattttccagtgggtcaggccttcagggtctgaggtcttggcttttccctaacaggctgtaaaattcatttttcttctcccacccttttcagatagttccattttgtgggcacattaaaggtggcatgagaccaggcaagaaggtgttagtgatgggcatcgtagacctcaacccagagaggtaaggcagagtctttgtcaggacagaactatcaggctgtggctgagccctgcccacttctgttgtggtttagcactcctcttcctctccttgtggacagtgttgctagttgccagtgccaagaaagtaccatgttcccatgaaacgaatatgtatgaatcccagccatcatttctccagacagctatttatatcagagattataaatataggcccacattttctctttgacccttagggaggccagaggatttttttttttttttttaatggttttgaaacatggtgccaggagcaagaactatcaagatgaataagaacccaacttaacattatttcccctggtcaatttctgtggctgtttttgagaattccgaagtggaattctctaattttagtcattttcaacaccaaagttttcaccagagcttgctttaggtaacaaaataagctggtttgacttacttctccataatctaacctctcttgaagagtagtggcctcttaaaaatggacaaacccagaggaggaagaagaaatataagcacttgggtcattttgaaatgtttttatatccaacccttaatcagtgggatgattttcttttcagctttgcaatcagcttgacctgtggggactcagaagaccctcctgccgatgtggcaatcgaactcaaagctgtgttcacagatcggcagctactcagaaattcttgtatatctggggagaggggtgaagaacagtcagcaatcccttactttccattcattccagaccagccattcagggtgagtacctcgagtgcctcggctccagccactggcaggctgataatgttcgacttacctagtgtgtgccaagaacacttgaagcagccagaatttctgcatgtccaggaaatttgtcacccaatggtgaaaaaaaaagatcaaaagagctctgtttgctgatataaattaacacttgccatagtatcttcttagttctattcaggtcatacatttaaatagacccatatttacatgtccaaattgttaagaataagtaacttttctatgtagtacccaacatatagtagatacctacccccaaatatctgattgattaatcaatactaagtacccacttattaaatattaatattaataaggttgagagctaataagtagctcttttatttgtatgacattttaaagaatatgatgatgatcatttcattttctcttgttccctttgctaatgaggccatgttcgtgtccttgtttccccctctggattaattagcctcagtctatttcatggttacaggctgtgtggctgacaaattccttcccttggggctggatgaataaagatttgctccccactatcttctgggcaggaagcacaatccaaacttttcatccaatcaagcagcattagcagccccttcctctatgaaaggcaatgccaaataagagatgcaggtagtggcacagtggcttgtgcctataatcccaccactttgggaggctgaggcaagaggattgcttgagcaaaggagttcaagaccagcctaggaaacacagcaaaaaccctgcctttaaaaaaaaaaaaattagcctgccatggtgtcacacacctgtagtcctagctacttgggaggctgagacgggaggattgcttgagcccaggaattcaaggctgcagtgagctatgtgtgcatcactgcactccagcctgggtgacagagcaaggctctgtcaaaaaaaaaaaaaataaagggaaatgcaagtagtaatggtgttaaaaaggggtcagacctagtgatgaattgtcattacaccttaacattacatcacaataatgacaactcagttaaaagctccatgttacatgtgagcccaataaaacacaactacacttaactggttacccttcatctagaaattttcaagtgcctcatgaagaagtaattctttcacttctcttcttacattctggggaaaataagaatccatgatttttgcattggtggtagaattgagatagttgcacttctagttatagtctctggaaggcacccttgacccattatctctcctcatccccttctctagaatggtgatgtccccttgggctcctcttggctaggatagtttcttagtgatgaaccttaatgcatagctcatgaatgtgagtaaccacagcttctgactgccaggaggaatataatgctcccaacagcaaaactgaagtgaaataggcccttcttggtgataaaatttagtaatataaaataaatgtgactagtatcacatatggagcctccttacatggtgaatgccaatgcttttaataaacccatcatagcacactaccagtaattgaactttatggtaaattacttgaggaaaaagcttttacacttacattctacacaggaatcagaaattttggaggtagagcccaacaatctgtgttctaacaagccctctgcaggtctcaatgcattctgatgtttgtgaaccactgaagatactgcctttctttctctaaaatgaagtattgtttgttttccccagtagcgttcattgaaattgtggattattattttgtttcttccaggtggaaattctttgtgagcacccacgtttccgagtgtttgtggatggacaccaactttttgatttttaccatcgcattcaaacgttatctgcaattgacaccataaagataaatggagacctccagatcaccaagcttggctgatttaaaccacctctatttcaaataggatcacgtgccacaactatctgactgttggtctggaagaagtgtcctagcaagatctggagacttaaaaagaaaacaaaaacaaatggcaagtttcacttaagggtggtttgcccttaagaagaaagctgttgggacaaagacaccgagccattatacccagaataaaataatacatttatgctggattttattcagaccaaactaaaatggatttgtgatgatttgtgatttggtagcaaattattcatcttttcaaagcaaggcaatgcttagaaacagaagtgctaaagacacttaaaaagccaacaacaacggtacagtgaaatcaatgcatttctgcactaaagtggaattgtgtagcacaaccaatattttagtcagggtatttacatagaatgtaggttgttcaaggtttgactttttttttgttttttgtttttgtttttgtttttgttttgcacagcataatgttaattcagattgttgaagctttcttgtagttatttatttatactcaatgtatgtattaaagaatgaacaatgtctcaagaacagcaagttgtaaacttttgaatgtataaatatcttaggtccaaggggagaaaattacatattacaattatgaaacaggtgaatttctgctttaaagaattgagattctccatacccctaaacttaggatctcttgatataaactgctgtaagtgcttttgggaaacctttgcaaaaccattttgataaaactgctttccaagttattgttggttatgtaaaattctatttacattgctttttctccttactgggaattagcacattattggcttccttaagactaattatttctctcttgatttatataatagctcattaagttgttattaatcaaaaacacaaagaggtgattgcttagacaatttttaaagtgactatagtataaacttttaaaagaataatatgaaaatgactgtggaatgcagtgtaaagcagaagcaaacggccctgaataacttacttggaagtaatttatatcaacttaagctgttagctcattgtataacttttcttatgtgaccctcaccaatatccctaagtaatgcctttggaagcttcagagtagaagatgcttcctactgtgttggctctgaggagatagtaggattagataggatccagattaggaaatgatccagttagtttatctgaaaggttaactcccaggactccaggtctttgaatccagccagtagagtgaatgcttccaattaagctgtaggtgttaccctgcacttacggaactgatcaaacaggtgactccaacaggaggttgcagtactgtaaacgtcaccgcaaggcaagggatgcttaaagtcctgggttctggactttaaaagctacattggccctggagggagggacccttggcattgctttgatcaggtagtgagggaagacagggttctggggtgggggtgtatttatatataatttaggttttgtttgtacagcatactgtgtcttgtaatgacacatccttgtcctgctttccttttttgagttttttttttttttttacacaacatgcagaggcactgaagtgaccatgtcattttcaagtgtcaagaatgtagacagtgtttcagtaccaaagtctaaaataaactaaaattatgaattttttataggtgatacatttggattcttctcaactttgaaactgtttagcacagttccattgtattatataagaagacactgtatccaacaagactggctgtacattgaaaagctttatgtaccagccaacttatttaaccatattcagcctgttccgtgggggctgttctgtggttccaggtattttcaagcctgtgattaacttctcatggcttgtcacttaaaagtccctaaatttgagagacttaaagggcaccttgaaatacatttgtggagttttgatccaacttatggtggaagagccccataggaagactgttttgagtggccaaccattcccacccactgcataattcagcagaaactagaggagcagggcgtgtactgattggaattgacacgcttattctgtctacctatcagctaactcattagcagccaagcccttaggcagcttagtgtgaaaatacaatgttaactgtttgtttctctgtgaggttagtgggaaccgcttggataagcctattgggattaatctaaatgatgtgatgatttgattcaggtatagcccaaattagtaaggggctttagctgtaaactgaaaacaatattcacaccctctcctgggcctgtaaggtctaaggtgagaatttcaggatggaaaatgcaatgtaaagcttccacaggaaagtattcgggtatgtaaggtgttatttctgaccagagccctagttctgcaataaccaaaaccaaggagtataaataacaatcaggctctgggggaatagaaagcaggctttagacaatctgtccatttctacagtaaaattggagtgagtgtgtatatctacttaaaacttaatagaagtgacttctactttttgggctattccagaagtattttaaaattattatttaaaattttgaagccccatttcaaatcttgccgaccttagttcaaagccccctgagagatcacttttagaattgaggatttgttaaaatggcaagtcatttcatttgtgttaaaaagaaaatacccaaaaggaaggagggagccctgtttgccttgagataaacggccttggcattttctggcattaatgtagaaataatgttcctatgatgacatattttcaaagaaacactttcttatttactgtgtggtgtaaaatgttgctaaatgtgttgttacattatgtcactgctgaaagtaatttgcactataataaaggaattttctacaaaaca

SEQ ID NO: 11457 - DNA, 186 bp, Homo sapiens
gggcagcggcagcggcagcggcagcaagcagccccgtcggcccgggtccggggccgttctgggccgcggcaagcaccttcgccctcccagctcgcgctgcctccctcccctcccctcctcccaggctctgcctgccaggtcggcgccgggccccgggcgcgcgcgcgcgcgccccctcgtgtgtgc

SEQ ID NO: 11458 - DNA, 8056 bp, Homo sapiens
agcggcctgcagtgggaagctggagcagcacacggagcggcgtggggtcatctacagcccggcctggcccctcaactacccgccaggcaccaactgcagctggtacatccagggcgaccgtggtgacatgattaccatcaggtaggggcacccgggggtgtcggaaggaatcaatgtgggcccacgtgcatggggtgggtgagaatgtgtgtgtgtgagcaggtgtggagggcacacgcctgagggtgtacatgtgtgtgagcaggtgtgggatcatgtgcatgtgtgtgagcatatgagtgaggcgtgtgtgagcactcgtgtgaacaggtgtatgggtgtgtgcatgtgtgtgagcatttgtgagtaggtgtgtgtgcatgcagatgtgtgtgtgtgaggtaggcgtgtgtaggtatttgagcaggtatgtggtgtgtgcatgcatgtgaacacatgtaagtaggtgtgtgtgcatatgtgtgtgtgtgcatgtatgtgaacacatgtgtgcttgtgtacatggaaaagcccatgtcggagaagacataaaggacacatgtgagagactgcatgtgtgagcacatgtatgtgcacgagccatgcctgcaaaggtgcagagagcgtgtatgtgcgcatgcatgtaagataacaggtgtaaccatgtgtgaaccgtaagcatgtatgtgcacatgtgaatgcatgcacgcaagtgtgtccagtgctctgggtctccacgggcctctgtggcgaggtgcccaagctggacctcttcctggtttgagcctcgttcatggggtgtggggggtctcagtcactcagctctgccaggaaggcagggccagcacacaggccactgggaacacagcctgggactggtgggcatggtctgatgtctctgaggtggcagaggtgtcctctctgtcctgcaggggtggctgggggccaggctggcactgagcccagagcatggtttctggagggggccttggggaggggagtgaatcaggcaaagcccgggtgcttgagctgcagggacatgcagagggaaagggggccaggcagtgagcggtggtcctggccaggggtggtcacagggacatttggctggggagtcactataggttccatctgccatagttttcctaaatgccagagcccaaaaagcgcaacccctgacttactccatagctgcaatgcgtgaggatgtgatgggcatgggcagggtctatcctagtctctgtgcctcagtttccccaagggccaggtggttcagggccagtgtatctccggagatgacaagctgtcaacctgctgcagccttagccagccccgtgggcagtctcaccctcacttcccatgcctgggactttgtgctgggcccatcccagtggtcccgaggtggagggttctgggcccttgggccactgcccttttggggagggtgtcggggcagggggctcttgacttcctgctccacttcggcttcgggctgggggtactgtgtgcactgatggagggaaggggagccgcagcagagctggaaatgacctgcgtggatgtcgcaattcttcatggagcctcccgtgcacacctggatggggacagtgtggggacagagtggctgggagtggaggaaccaggcagtctggaacatgaggagtgggggcagccggccgggacagggctggctgtcctggccgtggctccagcctgaccactccctgctggtcctcggccatggagatcccacctactgcctcatgtctgggtcctctccgcccccccgcagcttccgcaactttgacgtggaggagtcccaccagtgctccctggactggctcctgctgggcccagcagccccaccccgccaggaggccttccgcctctgtggctccgccatcccacctgccttcatctctgcccgcgaccatgtctggattttcttccactcagacgcctccagctccggccaggcccagggcttccgtctgtcttacatccgaggtgatggaggctgcagggcaggcaggacaccacggagcacaccgtgcatgcccacaggctcccggcccacaggggcggcaccctccacagggccccggctccctgtgggatgtcccctgaccgccctgtcaatctcaggacagtggcaggactgggcatgcggatgccttggacctctcaaggtcactggccccacttcccagtcttggctagtcctgggaactcacccctaaccccaggctcaggtcagggacagagcccaccctggtgttggaggggtctctgctgccacagtgatggggaaccacctgcccgcttttggccccaggccccctggccgaagggaggctcttctgtctcctgactgtcccctgctacgtctccaccccacagggaagctgggccaggcatcctgccaggcagatgagttccgctgtgacaacggcaagtgcctgcccggcccgtggcagtgcaacacggtggacgagtgtggagacggctctgatgagggcaactgctcggcgcccgcctccgagcctccaggcagcctgtgccccggggggaccttcccatgcagcggggcgcgctccacgcgctgcctgcctgtggagcggcgctgtgacggcttgcaggactgcggcgacggctcggatgaggcgggctgccccgacctggcgtgcggccggcggctgggcagcttctacggctcctttgcctccccagacctgttcggcgccgctcgcgggccctcagaccttcactgcacgtggctggtggacacacaggactcccggcgggtgctgctgcagctggaactgcggctgggctatgacgactacgtgcaggtatacgagggcctgggcgagcgcggggaccgcctgctgcagacgctgtcctaccgcagcaaccaccggcccgtgagcctggaggccgcccagggccgcctcactgtggcctaccacgcgcgcgcccgcagcgccggccacggcttcaatgccacctaccaggtgaagggctattgcctcccctgggagcagccgtgcgggagcagtagtgacagtgacgggggcagcctgggcgaccagggctgcttctcagagccacagcgctgtgatggctggtggcattgtgccagcggccgagacgagcagggctgccctgcctgcccgcccgaccagtacccctgcgagggtggcagtggtctgtgctacacgcctgccgaccgctgcaacaaccagaaaagctgtcccgacggcgccgacgagaagaactgcttctcctgccagcccggcaccttccactgcggtaccaacctgtgcatcttcgagacgtggcgctgtgacggccaggaagactgccaggacggcagcgatgagcatgggtgcctggccgccgtgccccgcaaggtcatcacggcggcgctcattggcagcctggtgtgtggcctgctgctggtcatcgcgctgggctgcgccttcaagctctactcactgcgcacgcaggaatacaggtgggcgctgtgcccgcagccaggggaccgggcttcttcatcacccaggcttgctgtccccgtagctgtgggtttgcaaacgggggcctggactagctacatggaggctgccctggtgcacactggggtccctatatcttggggtgtctgggtggagggtcgtcctggaatcctgttgttgttcctgctgcaggtcccgggcagcccagtcatgtcgccctccgcccactgcttctagggccttcgagacccagatgacgcgcctggaggctgagttcgtgcggcgggaggcacccccatcctatggtcagctcatcgcccagggcctcattccacccgtggaggactttcctgtctacagtgcgtcccaggtgagcccccggagggcgtgaggcccctccggggccacttgggacagtgtgcggaggaggctggtccaggggtcacaggagcaggaggcaaggcctgcgcagggtgacctgagggcccatggccaggtggggggggtggacaaggtggtctctcgggtctcaggtcccttgggggtgtgctgtctcctgcccctgagcagcctgtctgccccctcagccgcatccccccgcccctaccctgctccaccccacaggcctctgtgctgcagaatcttcgcacagccatgcggagacagatgcgtcggcacgcctcccgccgggggccctcccgccgccgcctcggccgcctctggaaccggctctttcaccggccgcgggcgccccgaggccagatcccactgctgaccgcagcacgcccctcacagaccgtgctgggcgatggcttcctccagcctgctccaggggctgcccccgaccccccagcaccgctcatggacacaggcagcaccagggcggccggagacaggccccccagtgcccccggccgtgcaccggaggtgggaccttcagggccacccttgccctcgggcctgcgagacccagagtgcaggcccgtggacaaggacagaaaggtctgcagggagccactggtagacggcccagctcctgcagatgcacctcgggagccctgctcagcccaggacccgcacccccaggtctccactgccagcagcaccctgggcccccactcgccagagccactgggggtctgcaggaaccccccgcccccctgctccccaatgctggaggccagcgatgatgaggccctgttggtctgttgaccgctgggctcgctggtgaccgccacagccccgctttgtaaccagggaatacacagtcatttctaccctgcctctgcgtcctttcttatggagaggccctccggggaccccagcggaggggctggcccctaagccagctggctgcactggtgggcgggagctgtgggactgaacggcgggggggagaagagtggagtggtgagcccgtctgcagggtcccattgtacacaagcaccctggggtctcacttctctccccccactccattctgggaacccatttccagagaagcaggggaccagagcctttttgcttcatctgccctgcagtggcaacagctgcccctagagctgggagttgtcatgaggatggggccgggccatggggacgctgggtctcatccgtggtgactattttgctcacgcctcaccctcttcctgtccagcaaggcctctggaggacctgggttgggtggctcctgccaaaccctcatgcccctggccaggcaggcgccctttgccctccctgaaggtccaatctcctgggcaccgtggaagggctggggtgtgtgcctgctgtacatgaagcccctggagttccctgcaggcctcaaagcccccaggacatgctgctctgtgctttctggggacagagaggccgaggcaccaacagcagtggccacgtctgttccatcctatctcagggcctcggtttccccacctgtaagccagggtgagactgtgggctctgaagtcctgaccttcactctgtggtgatttacgggaagaaagacaatcccagcctggagcccctgagctctcctgggtggccgagctcagactggcatcgaggggcctggggtaggggcggactgagctgctaccccatcctcgacatccctttagggcagggggactctgggtgccatggtagggagcgcctgtgtcaagcagcaaagccccctaatgtcaagagcctcctccagggcctgccacggcatcttcctggccagcaacatgtgtgcacccaccgaggtacgccccagccactcccatctgtgcccatcagggactccccatagcacgagcgaacagccagccctgtttatttataggccttttcaggaagagctagcagggcagtgctaagacaggaaacccagtccacattttagggcttccttaaacaggcttctgagagtcgtatcttttttcttttttttccagaaaaaaacaaaacaaaacttttttgccaaaacacctcctcaataaacaacatgtaaacagaaacaactgcttcagtctctacaaaaatctcattgtggcttcgagggcttgtctgtggcaggcagcagggagggtgggcaggggccattctcctcctcttcgggggcgtcctgggggtagaccacgaaacacagctcctggccccagtgtgtcatggactctgaggacagacagatggaccttggggcctgacctctcgggataggggtgacccccagctccggacacctccccttgggcaggggtcttcagggagttgctccgtcggtacccgtggttctggaaactttgggtacatcttgggaagagacatttggtggcggctgggccctgtgttcccacctcagctgctaggacaccctgctctggggtgagcctctaagagggaggtctggtctccaggccccggccccctgtgctgggtgacctgcagctgcccggctcacctgtgagtctgtgcacacactttggtttgcttctccagaacactcccagaaagaaaatgggcacccccgtaaggatgatgatgacgccgaccccacagaccataggctctgagatgaagctgaagaccagcaggaaggcccagaagaccaagtacgccacggggatgagaaggttcacctggggaagggggagcagaaacaccgatggtgcagggcctccagctgtctgtacccccgacccctgggggtctggggaattttcctcccttccctgggagctgaggcctgaagggcaattgcacccactacaccccctcttggcgacagcccagtgtgttggaggccaattcatgggtcaggccgttggccagttttgctgaggatttttcaaagtctcagcggcaccgagctccacacagcggttgcgtgtggacttgaggcttgcacttggctggaggtcagtgattttttggtgtttcacatttcaggcactgagcacttctccacttaaggatttatacacacatggggggctttgcttttagctcaggctatggtcttctgtttttgtgtgggctcatgaaatcctggcagcctttgtgaccttgaacagttcctgagtctcattttctttaatttttttttttttttgagacagggtctccctctgtcacccaggttggagtacggtggccctagcaccgctcactgcagcctcaacctcccgggctcaagcgatcctcccatttcagcctctcaagtagctgggaccacaggtgcgcaccaccacaccaggctaacccttttatttttaactttttgcagagaggaagtctcgttatgttgcccaggctggtctcaaactcctgggctccagcaatcctcccacctcggcctcccaaagtgctggaataggcatgagcccctgtgcccagtcctgagcctcattttcgccatctgtacactgggagcattcaaagctctgtcctcatggggctgctatgaggaatggctgcctcagtgcacagagagccctgagcagggcccaacactccacaaaagctggcacctcccatcccacctgcccctggtgcccactgtggatgcaggggtggctctggcagcacccggcacagggccagctgtcccagggcctcaccttgatgggcctgtggagtgcaggccgcctccagcgcagcagcagcaggcccaggatggtgacgccgtagcagaggtagttgatgaaggacacatagttgatgagcgtgtacgtgtcgcccacgagcatgatgacggctgtggccccgcactgggagaggacctggggctgacggctggcccctagcctgcctcctgacgcccctgcaggatgagccctggccccaccccccaacccccaccctggaatggctcacccctgccattacccggaaggtcctgcattgccgggtagccctgcctccacgccctgcctggcccaggtcccccaacttacacagacgaggagggcggggatgggggtgcagtgtctgacgtggatcatggccagcaggctgggcaggtgcccctcgcgggctccagagaagcacagcct

SEQ ID NO: 11459 - DNA, 1679 bp, Homo sapiens
tcctgaaactttgctggatttatttatcaggtctaggagctttttggatggtctttaagtttttctagatatataatcctatcatcaacaaacagcgacagtttgacttcctctttttaaatttggatgcactttatttctttcctttatccaattgctctggctacgacttccagtactgtgttgaatagaagtggtgaatgtgggcatccttgtctcgttccagttctcagggagaatgctttcagcctttccccattcggtatgatgtttgctgtgggtttgtcatatatggctttttttactttgaggtatgttccttctgtgccaattttgttgagggtttttatcatacaggaatgttggattttatcgaatgctttttctgcatctggtgagatgatcatatgatttttatttttaattctatttatgtgatatatcacattgacttgggtatgttaaaccatccctgcatccctagtattcaacccacttgatcatgatatattattatctttttgatatgctgttggatttggttagctaatattttgttgaggatttttgcatctgtgttcatcagggatattggtttgtagttttctttttttgagacagctaattctttgttgtgaggggctgtcctgtgcatcatagaatgaccagcagcagcagcactgactgacaaaccaaaaatgtctccagacattgccaaatgtccccttgggggcaaaatttccatctgttaagaaccattggcctaatgcttggcacataataagtgctcaataaatattagcactgtgactgctgttattatttttacagtttgagtatcccttacccaaaatgcttgggaccacaagtatttcagattttaggtttttttggattttggaatatttgcattatacgtcccagtttagcatctctaatctgaaatctgaaatgctctaatgagcatttcttttgagtgtcataacagcacacaaaaaaagtttccaattttggagcttttggaattggagatacccaacctgtaccttcttgaattgttgaattttctcccatgtgcatttgttacttttataataataaaaaaatactctcttgattgagatgaaaagtatcaaagaggaaaaagcaattagtcttcatccaggggaacaatgtataacgtgaaaaaataattgcctggcatttattgagtgattaccatgtgctaggtgctgtgctaaacaaaaacatacgttatctaccttaatcttcaacatctccttgagataagcacttctgtgctcctccgcccccatttcacagatgaagaaggtaagtcattgaatagttaggaatatttctcaggaatgtggttgctttggatgcatgttggtctataagaagtaaacatcttatgtactctatgtgtgtgcgtgtgtgtgcgtgtgtgtgtgtatgtgtgagtgtgatgaggtctcactattttacctgggctggtcttgaactcctgagctcaagcaatcctcccgccttagcctcctgaggagctggaattacaggcacatactgtcacacctagttatgatatttttaatacataaatcacagaattttagacctagaatagattttaagagattgtctaaaaactattgttttatagatgaagaaactgaggc

SEQ ID NO: 11460 - DNA, 648 bp, Homo sapiens
cttgcctacaaaggagaccactaatcactagcatgctgaataaacatgaagttgacttaaacattaatttacttattatcaaaagcttatctgcttctgctggtgcaatgactctgatgggaattgccagtggtgatggtagataggtgatggcttcagagaagtgtgctctgtgctttggcaggagcagggctaagctgagacagtggtcctagtggcccagtccatgggctaagcaggaatgggtgggaagagggcaggggaggcttccccggggcctgcagattgtgttcttaagagttttttccttcagtccttagaagctcagctgaaaggaatgactgcggccggatgtggtggttcatgcctgtaatcccagcacttagggaggccgaggtgggcagatcacctgaggtcaggagtttgagaccagcctggccaaactggtaaaaccccaactctactaaaaatacaaaaattagctgagcatggtggctggtgcctgtaatcccagctacttgggaggctgagccagaggaattgcttgaacccaggaggtggaggttgcagtaagcccagatcaagatcacaccactgcattccagcctgggcaacagagcaagcaagattctatctcaaaaaaaaaaa

SEQ ID NO: 11461 - DNA, 648 bp, Homo sapiens; identical to SEQ ID NO: 11460

SEQ ID NO: 11462 - DNA, 101 bp, Homo sapiens
aatattagctgggcgtggtggcgggcgcctgtagtcccagctactcaggaggctgaggcaggagaattccttgaacccaggaggcggaggttgcagtgagc

SEQ ID NO: 11463 - DNA, 155 bp, Homo sapiens
tgagacagagtctcgctctgtcgcccaggctggagtgcagtggtgcgatctctgctcactacaacctctgcctcctaggttcaagcgattctcctgcctcagcttccgagtagctgggattacaggcatgcgccaccatgcccagctaatttttg

SEQ ID NO: 11464 - DNA, 155 bp, Homo sapiens; identical to SEQ ID NO: 11463

SEQ ID NO: 11465 - DNA, 120 bp, Homo sapiens
gcgcctgtagtcccagctactcaggaggctgaggcaggagaattccttgaacccaggaggcggaggttgcagtgagctgagatcacgccactgcactccatcctggcgacagagtgagac

SEQ ID NO: 11466 - DNA, 3096 bp, Homo sapiens
actgaggcgccttctctttttattcttgagccaatgagatatcagtgtgtttattaataaggattgcaatagtatagtgcttaatatgtgccaggcatagtgctaagggtttacatacgttatcccttttaatccagaaaacagcctttgattaggtattgttgtctccattttatagatgaggaaactgaggcagtatgactgaggccgagagcagtggttaagacagactttgggatcaaatcaccctaggtgcgggcaggtttctaggctgctctaagcttctaccttgaaggcagttgggtctgataatagtaccttcttcctggggtggttgtgaggatataacgaggtaatgcatgtaagcatttagtaccatgcctggcacatagtaagcactcaataaatggtagttacttttgttgagctcagctggtagtttgacctccgttggtgcaatgccagagatgggattgtcagccaccacactgccaccaccctgcacacagtctgggtccctccgagagaagcacgccaaccttaacatcccctacagcatcttggtgcttcacacaccatttaggaggccaccctaacgaggcaagaggacatgggggtgtgcagaagttctgttcttagtgagaatggctggcctgagaatccagctcacctcctctgcccacagtctggactgcttgtgggaaggccatctcctcctgtctggtggtacctccactctgggcagggagggcctgtctgtgactcgctctggaccccacttcccgctctggccaagggctgtcttctgtgcacatagctcaggagcctgcagcagttccctgtatgggtggatgtcctcaggggccaagaagagaagaatggggacaacagaaacctgctttgtaggggattatgtagactaaaagcctagaagttctgcccacatccttatgacgcagccaatctggagcttcatgtttccttctaaaagtagtaaccgggtagaagtgggtgacccattgaggacacatgatgtgaggtatttctgccggattctaggttagcaaagactcaaatgggtgactcatgaatgaagggagaacaggcacaggacttaatgaaaagagtttcttgaacttagttttctgaatgggggtggggagttggggcacgtgtgtgtaaggggaggctgcctcactttgaaggaatggtgttggctaacaggatccatgaaattcctaggtcagttgaataataactgaactactggtttgactgtggattatttcctgggtattagtgggacccaacagcacattgctattaatagtatggaaataatggtccctctgtttcattgaattgctgaagtaatgataatgccatgaaccaggagaagatggttgtgggggtttctaggaagcagctgctgtgacaggccaatcccaggcttgcccccgagccctcctgtccttctgggtttgtgtttgccttgcctggtgcttcctccctcattgtgttgttgaatagacctaggcagccttgtatccatagaaagcctccactgctgggccggggagggggttgtggtaagggccctctggaaatcaagcagagaatgcctttgcagtggtctcccgggcattgggcagggcctagccttttgcagcccccagaggaccttgcctgcataaagcactcagaagggttagccacctggtgattttgtctctagtgaaactgtgtttgccgataatcatccacatagccacctctgtcctcgcagtttggatgcctttttttgacacctgcgctaggttcttgtatgctggcttttcttaaaggaacagcagagtagaaaagaggttgagaatgttttctagcaggcagaatgtgcatacatgttttcatgagtgtcctttgggtgctgtttcttttaaatcctctgtgcacagggctctggcctttagtaaactgtttttctgtcttacgtcatgctgactgggtgctaggggctgattacaaaggggaagagttgaacagacatcaggggccgatgaaaccaaaggactaggagtcaggagaacaagtcagggattaggagacagcggtttggtttattgttatccagctggaggactcctaggggcagcagcaggaggaataccagggccacggaggggccaggagtctcacagtggagggcagactctaacagatgccagctgaacgctcgctggccctggatgtcatacgagttggggaccagaaatctgggctcagagaacccgtccagggagatttgaagccatgggttatcttctagagttgatactgataatatattttaatttttattgatgtttaataccttctgaaacaggagggtaagatcagatgggaagcccctctgttgaaggatcttgggaaccttggtggttttttttttttttttggttttttttttttgatcgagctgtggacatccttcttaattcgattctgaggatttgtttaactaaaaagttcccaaacacagaaagggcctccccacctgctttggggagctgtctgtgctgggagtgccaggcatcccatgggacccatcactgccagtgtctgtgcctcccagaggtcagccgtgtctgccctggctctgtctcctctgtgacagggcagagcatttctggtcagtttctccatggtgcctcccacccctttgtaaagtggatggacatgatggaattcagttgtctcaccctgatagcctgggtgttgatattcactttacccgcactcagacacaggcgaccttgaagcagttctcggtgtgtagagtccacgtgacagtccccacagcctccccagatagctgtgtgcctgtgcgctactgctgtgccattttcccaacttggcgtttcactaaatgcagctgatctctctctctgtgcactcgtgatccatgttgaacaatacatgtaggttctttttccacgcaatgtaagaacatgatatactgtacgttggaaagcatttaccttatttatatacctgaatgttcctactacacaaataaacatatattaaattctagat

SEQ ID NO: 11467 - DNA, 1289 bp, Homo sapiens
acctgcgctaggttcttgtatgctggcttttcttaaaggaacagcagagtagaaaagaggttgagaatgttttctagcaggcagaatgtgcatacatgttttcatgagtgtcctttgggtgctgtttcttttaaatcctctgtgcacagggctctggcctttagtaaactgtttttctgtcttacgtcatgctgactgggtgctaggggctgattacaaaggggaagagttgaacagacatcaggggccgatgaaaccaaaggactaggagtcaggagaacaagtcagggattaggagacagcggtttggtttattgttatccagctggaggactcctaggggcagcagcaggaggaataccagggccacggaggggccaggagtctcacagtggagggcagactctaacagatgccagctgaacgctcgctggccctggatgtcatacgagttggggaccagaaatctgggctcagagaacccgtccagggagatttgaagccatgggttatcttctagagttgatactgataatatattttaatttttattgatgtttaataccttctgaaacaggagggtaagatcagatgggaagcccctctgttgaaggatcttgggaaccttggtggtttttttttttttttggttttttttttttgatcgagctgtggacatccttcttaattcgattctgaggatttgtttaactaaaaagttcccaaacacagaaagggcctccccacctgctttggggagctgtctgtgctgggagtgccaggcatcccatgggacccatcactgccagtgtctgtgcctcccagaggtcagccgtgtctgccctggctctgtctcctctgtgacagggcagagcatttctggtcagtttctccatggtgcctcccacccctttgtaaagtggatggacatgatggaattcagttgtctcaccctgatagcctgggtgttgatattcactttacccgcactcagacacaggcgaccttgaagcagttctcggtgtgtagagtccacgtgacagtccccacagcctccccagatagctgtgtgcctgtgcgctactgctgtgccattttcccaacttggcgtttcactaaatgcagctgatctctctctctgtgcactcgtgatccatgttgaacaatacatgtaggttctttttccacgcaatgtaagaacatgatatactgtacgttggaaagcatttaccttatttatatacctgaatgttcctactacacaaataaacatatattaaattctagat

SEQ ID NO: 11468 - DNA, 508 bp, Homo sapiens
agtgaaaccctcttaggcaacttgtttcatattctgggcattttagtagctacagtattttgcatttaaaatgtaattactcttagtattgtacagccctataatgtatgagaactagtttcacatcctttgaaactaatctctttcattggggaggatacaacttttgactttacacaggtggactttgaatccatttttatagaatttttttccactgtaacttgacctatattatgcaagaaaatcccaaaaatatgttttaagggagactacacagaccttgtgatttggtctgagctagttgctgagttgactggagccttatttgaatggatctttgagttgagatcttcacactgtcagtgagcccttggctcagcccttgtcacctgtttgtatggggaccatgtttcccaaagctcaggttcatctccactattgacagagtcgggtagtgggagagtataagtgacttgagacagagtgtccttgctcagaaaactgt

SEQ ID NO: 11469 - DNA, 708 bp, Homo sapiens
cttgaggttaaagttcagacttggtaacgaggcttctggggccatctgtgagctggccagtgcctgacccacgcattcgggccctgccttcacagccacagctgccgcttgtccttccttgttccaggtgtgcgcctgtcccgggccctggcgtgggccctctgcccagtttttttcctttcccagctcttcgtcagcctgcctaactcctcttttcctagcagttctcaccgtcaacagcacttccttggggaggccttatgttgtctcctcactgtgtgtctcctgccccaggacagaagggtctgaactcctgggagccagcaggccagccttaccagggcaaatgtctgaggccagtgggacctctagattgattaccttttggacaggggcctctgccattttcacccataggaaagctactaccattggaatttcctcagtgaattgctcgccaacattcaagatgcagaaaaacccactgcattcacttactttcctaaaccccacaaaatctgactgcaagccaccagtttccaagactgatgggaaaaccaacatgagtcgttttccctggctgctttgctcccttttgttgcaccaggagccgagggctcacatgttgctgaagtggtgagggtccctgggctcaactccatctgctgaaggctctgttgtccagccctgtgaagtccataggaggcc

SEQ ID NO: 11470 - DNA, 708 bp, Homo sapiens
cttgaggttaaagttcagacttggtaacgaggcttctggggccatctgtgagctggccagtgcctgacccacgcattcgggccctgccttcacagccacagctgccgcttgtccttccttgttccaggtgtgcgcctgtcccgggccctggcgtgggccctctgcccagtttttttcctttcccagctcttcgtcagcctgcctaactcctcttttcctagcagttctcaccgtcaacagcacttccttggggaggccttatgttgtctcctcactgtgtgtctcctgccccaggacagaagggtctgaactcctgggagccagcaggccagccttaccagggcaaatgtctgaggccagtgggacctctagattgattaccttttggacaggggcctctgccattttcacccataggaaagctactaccattggaatttcctcagtgaattgctcgccaccattcaagatgcagaaaaacccactgcattcacttactttcctaaaccccacaaaatctgactgcaagccaccagtttccaagactgatgggaaaaccaacatgagtcgttttccctggctgctttgctcccttttgttgcaccaggagccgagggctcacatgttgctgaagtggtgagggtccctgggctcaactccatctgctgaaggctctgttgtccagccctgtgaagtccataggaggcc

SEQ ID NO: 11471 - DNA, 3616 bp, Homo sapiens
ttttttttcctggagaaatgtttgaatcagctgaaaacaggtaggcattgctgtttttccccaacaaagaagggcaaaggtttcagctgtatgttatgaagaaagtggtatatttaagaatgagttaaaagggaacaaaactttatttaaaattcctccaatttcttgtagaaaggcagggccgtggatatgtctggaaatgtagaaacctgtagctgcttctgggatcacccacctgatggtggtgacttgtctgctgaggccggctggaggggacgcttagagatggggcgagggggaggccagtgtctgttgtctgcgagcctctcctgccatctcttttgcagctgagggcacttggcacaaagcaagcacagacagcagagagggccaggcagtgctggagtgcgtttgctggcagggtttattgtgggagaggaatttgagtttaggatctgaatcttgtacataagaaatgaaaaggcttccctccaccccgcccccaaaatatgcccgtcctgtatccatgagagtgcatgtcggttctcagtgagggtcagagtgggggtgggggatgtaaggcctgggtccctttcagcggcctctagggcaggagcgtgcgtcttcttcccagtgcagtggtggtttgagtgctgtgggctctggtggggagggggctctgctcctcttcatttgctggtagctgggtcagggcactggcgcccagtgaggatgcccactagcattctgccccagttggttggtggggggacacctgaccactgagcctttggtaaccttattttttatagtaagtacttcttataattttctttttcacatcttattttataagaagtttaggaatatttttgcatggatcattgtaaacagcagattctttattcctgatgtctattaacatagaatgtttactgataagtactttaaattgcttcatgagcacttaatccatcttagtgtctatgtgtgggggcagacatttaccgcaggcacacagtttgtgcccctttcttcaagtctctgttggtaattccatctgtttagtggatggttggcaggattagtaggttctaacggttccaggggttcagctgaccaagtagcagagaagtcttttttcccaattgagtgctaatagattaggataaaatactcacaatgttagtgtatgcttttaaaaagccccacacaacaaaatggaaacatacatgtacaactcctgtgagggctggagtcttggggttcaggaggaggttagaagttacaggcatctcttcaggcttgcttggtacttggcacacacaggatggtgttttaaagagtgggctgcaccccccacacgccatttacatcagcttcataaacacttttcttcctccctgtaacttaaccttttttcccttttatgaagttgagaggctttatgaaataagtttgcattgcacatccgtgcagaaatctttctgactttgaaatttttaggacgtcagctgtcagatacgaaaggtagatatcaggtaagaatctggacttaggaaatagtcacaaaactgtcataggttgtaattttatcaacattcgcttctagtaaaattaaagtcaattaagaaatagaacttgggtcaaaattctgttacaaagcttcataatttgtcccgaagcatatggtggagcattctgagaaatttgctttttgtgtgtttgacattcctaatttgggagtccttcagctgaattactattcttttagaagttgagacagcaggtaagcaaaggacctagttcatgtaaacatggacatcatgatggctatttaaaaaatatttgttctacaccttctcccctgaggcttggggagtgtgttcagccgctgcagtttctctgctcatggaggtcttgtttggatctgtgctggcggctgagcatttagtgtgagccagtgacccatgaacttgccgctctgtgagggccagagtcagggccagtcatggtaatgggcctgaaggcacttccagaaccttttatgtctctcgtgagccatctgttaagaacgttcttcttggtgtggtttgtaggcctacctgtcgctattctgggaaaccttcttgagtgctatgcaaatgtgttcacaggcaatgggggtggtcctgagccttggggtgggcacctggtcagtgagtgtcttgcccttccccagctgggcatacagtaccttgctctttctggtggcatcatctggctgtgatgaatgaggtctaggaaataatttgcatgtgtcttgggggacacaacagtaacgagaggaaatacattattacagcaacttgcgacgtactaatacctgtcagtgttggcccccgtaaggtatgtaaggcacctgtgagtgccagtgagtgctggtgaaaggccaacatgtactagttatgtaagtattggtgtctgctttaaaaaaggagacccagacttcacctgtcctttttaaacatttgagaacagtgttactctgagcagttgggccaccttcaccttatccgacagctgactgttggatgtgtccattgtcgccagtttggctgttgcccggacaggacaggacctccattgggcgcagcagcaggtggcaggggtgtggcttgaggtgggtggcagcgtctggtcctcctctctggtgctttctgagagggtctctaaagcagagtgtggttggcctgggggaaggcagagcacgtatttctcccctctagtacctctgcatttgtgagtgttccctctggctttctgaagggcagcagactcttgagtatactgcagaggacatgctttatcagtaggtcctgagggctccaggggctcaactgaccaagtaacacagaagttggggtatgtggcctatttgggtcggaaactgcatgtttcagaaagtttgtctctttttcctactcattatttgaagaagagagagcctgtggggatagccttatcttggtccacaggactgaagtgaagtcacttgggaaggggagacagaggatgagcggcgtctgtgtagggacccccccccgggcctgcagaagggtggtgtgctcccaggactggcatgacaggtgtctcctcctcaccacaggctgtgcccatgagtccctgtgcagaccagtgggcaaggcagctgggccagatctcaggccagccgtttgtgctcctagcagggttgctgtgctggccacacggagaggccctagagagcctcatggattgtaactaaagaagaaacggttcctttttgtttttttaaaaatgatttttaaataccgttttttacaccgttctctcggtactttttttaagctaagtcagcattgtcttccagtgttaaaggcatccctcacctctgcattgaacttacgtatccatgccaaggaatggaatttccatcctgagccagttcagttaggtgtcaattgatactattttaattttttatgcaatctgatgagatgagctcagatttaaaaatctcaaaagcacgtttattgtaacaagaattgttatgtattaatactgcagttttcaataaagattgacttgtgttgca

SEQ ID NO: 11472 - DNA, 7096 bp, Homo sapiens
ttacttttcataaatttatttatgaaattaaatgtggtttctggcttggagaaggaatagtgcaagagtgactgtccatgctgctgaatcctgtgggctccacgccagctcgccaggccctggctctgctcctggcgccccttggcaggacagggcgccatctccacacacccgctgcctgggctgtgggtcagtcctgtgtgctgagccacagaattcggtctctctcttatggcttctcacgctcacgagcgtaaggcaatcttctgtgtcactaagaatcaattctttttctccattgtttgttgttagaaaaacaagatgccaaaatccaaacaaaaccaggaacgaggtggttctggagctaccgcacagcagcaggcagactgaccacactcccgactgggagtatgcagccgactgcaccgtcttgtccttttccgctacacacacacacacaagtgaagagggtgtccagcagccagcggtgtcttgaggggctgggaggcgaagggcgggctccgggcgcaacacaagggtgtggaattcctggcttctgccctcccaagtggcaagctgcctggcaccactggccgggctggggacttggagaactagagggcagaggggcacatggcctggcattgcaggccacagaaggccagagagtcctgcccagaggaaatgaaaggaggattaggtttccagagaagagggtcccacgcaggtagcgccttctccccagctgggcctgggctgagctgcggtttccccgctccagcagtgaggccctacacaggtccagagggcggatggggcccaagctgcagcggcggtgtggcgagtgcggggtctgcccccttgctggtctcttcagggcaccaggagcagggaaaaagacaacaggagtacagacctggcacgtcttggtggcacaagcaactccccagcccatccctgctcacttgcaggcagaggaaggccaggccgagtgggcctcggggaagaaaaactgggggccactggcaggaaggcccagcaggtgctgtcaggcagggaccagttcacttgcggaagggtgccagccggctgatgctgtgccagaaggtagatggcttgcgcctgggctccgccagcaccaggacctgctgctggggccggttgctgggcagggctgggtgcttctggcgcgtcaggtagcagggccggccaacagctgaacagggagagacagcagagggtcatgggtgcccagggcagagtgccaccccagctgttggggacagcatggggtccgtcccagggctctgcttcagagccgccgtaggaggcagttttgccacacaggacttgctcctggagagctgaccacatccaagagctcaggctgcctggggtctctggcctgggcctggcctcctgcagcagcctgaagaggggggtggcctgtgcaaaggcatgtgatgtttcaggggcatggctctctgtagaaatggggaaagcagctccatccctacaccaaccccagatgcctgtcaggaaggaaccctggggaaacaagcattgtcaccaatggccctgatctgggggagccaaggtgttgagagtaagaatgtcaaccatatactgacccaggcttccccagtggccccttattaccaacctttgggaacaaacagctgcaaagggcagtgggcccccctcaggcctggtggctagctggcttggctttgtggttcagagaagggaatgatgtcagcagggtaaggaccgggcagccgaggaggtggggctgctgtccgcctacctttgggcttccctgtgacctgctgcttgctggcattcagcatggcctgcttcctctgcagttcagtgatggagaagcctgaggaaggggcacaggtgagggcgctgccccacttcgtggccccaggtgcagttccctgcacacctgcaccttcctggtgcccagggtctcatcatgtactggggactcagtactggccacagcggggactgttgcccattctgcacagtcagcctgccttggccaaccagggcagagggcatgctctggtgtcctgtcctggggctcctggcagaaaatgaagatccccgagtccttcctctgcccacccatctctcaccttcactccatgtctagtgtcttttccactgcagtggaggctccttcccagaccaagagccgacctggtcactgtggcgggtaatgtgggggcccgtggacaggagggaaggtgtagtggggagatgtctgcgtgcatggggcaggggaggcttctgaggccagtacccacagcccactccaaggctctcccagggcttttgctggctggaaaggggtcccgcaggtcccagcaacccagggcactgcgcagaggaccccgtcctatggagtgtgtgcacatgtgagcgcgtgtagtgaaacaactccccaaaagccagcagacccatgccttggggctgaactctgcgaaactgtatcatgggatgcggtcaggtaaccctgccattgaggtgatgaaggcaaagccttatgctcatgactgggacctagaggtgcctggagccttgctacaccctgcaacctgagagggctgagcggcgctctcctgaccggcaggcggccaggcaggcgggagcgccgggtgggccctgggggcggggcaaggcccagcagggtctcgaacctgtctcctggtccagctgcacctgctccctctccctggcaaaggccttgagccagcgctgcttctgctcgggcttcctggtgcacagcaggtggctgtcccctgtggcgccacggtgcagccggaaggcgttcttgatgctcacatggaggtctctgtccttcccgtcctccaggtccaccacctccaggccgtccatgtccagccggcccttgtagtacaacacgtcgcggcggagcaggtcctgccagatgctggcctcagccctggctgctgaaccgctcccctgaccatttcctggctgctcccacctcctctccccagccataggaggggctgctggtgatgcctccacctccccagcagacagtgagatcctgagggcagagcatgccttctgcagcccacagacatgctgagccatgagtggagaggccttgctcctttattttgcaggtactgactagcccggggttggccctgtctttgaggtggggagactaagacagtggctcacaccacacgtaggaaagatcacccgtggacaaggagggcttcatggacatgaggccactgggccatgttttgaaagaggagcagaagccggcagcgtagaggaagctgggaggtggctagagcaggggactccggggttggagagaggggatgtggaggtttgcagggagagaagaggtagcttgaggagcaagcagcggccaggtcaggaaagatcatgctctcaacagcacccggcctggtcagactgtgaaagccgcctgctgctcctgggccaccaggctcacctgcagagagccaccccatcccagccccaagggtctggccaggctccccgggtatggtctggctggcacctgtcttctgggcagctgctcccagccctcagctcccctccctccacttgctcaacttggggcagcagggcagagcagctctggtaccttcttacagtagatgagctggtggtcaaagagaaagaacattcgctgctggcttttggcttgaggctgtgtaactcgagtcagctcccccgagtagatgagttctgagctcctgaccaagagatcttctccctgggaagatcccaaggagaaccatgagcctcgcatacccaaccgtgggctccacttcctgcccccatcatgggtgggtggcgcacctccccctggccttgcctgcagcgcccacctggccaggccatggtgggagggggaggaagaggtggcacgtctggcctgtgagttggctgtccttgcaaaataggagccccctgtcaccagtggcctctggtggctgttgggcactggaagtgtggctaatccatattaattagatgtgatgtcagtgtaagatacatattgattttgaagacttcatatgaaataatgtaaaatatttcattaatgatagttgatcacaagttgaaatgctattttggagttaaatgaaacattattaaaattaaattcacttgtttttttccctttttaaagatggctactgcatagcatacgattccatatgtggctcacatactagtttgattggacagtgctgccctagagaagaattaggcctgtctgggattcacctctgaggccaacctttgagatctctaaggaggccctcttcccagctaagtgcactgagtacctgaaggtccatcatccacccttgggcttcatacttttagactaagccctgccctggtctcattctaccttgaaaatgcaaaccccagctgggagtggttggcggtggcctgtttgggatgagtgactctggagggccctgagccagggctgggcctcacaactgcccctattgctcagccccgcctcacagctgactgcccctattcctcagccccgccccagggcttctgattcactgtgtctagggtggggccctggaatctgtattttcataatgttctgtggctgatactgattgatttccaggccatttctctcgctgacagctggtgcatggtggtggcagcacccatgtgggtagggagccttcgggaacagatcaggaggtggcagattggcagatgcaagtgggggtgggtggagggggacaggaacatcgtcattagttctaaggcaagattggcagatgcaaagggaaatgtgcaagtcagacaaacagaaccaggaggctctgatgggtggcgatgcatttttggtcatgctgtgttgggcctgcagccttctgttaggagtcccagaagtgaactaaaacagggatctggcctgtcccctgaaggcagaggaacagaacacagctgaggaacacacttcctctgttgagggcttctcctgggctggctggctgctcatgggaggagtttcacatagaaaagaggccaccaggtgccaaagcctgctacggtaggcagcagcaaaggtccagagcccacgctggggacaggctttcacaccatgagcatctgttgctagctcccaggagcgcagctccctgcttcagctcccttctagatttttcaggggcaagcatgattttaaagcgaggggccaagacctcctggaattttctgtgcccccaggccctcacctcccagtcctctatggagctctgccactgagcaatcttgtcgatgttctcaagtctccgcttccgctcgttgatgagctgggccacgttcttcatggcatgcaaggcggcttcaacatccttgaagtccctggggcagaacagagatggaaggctgctgcaggctggagacagagaaagggtgaggatcccctgcagcccccacgtgtggagctgctttcctctggggctgtgccctttgaccacatcctcactatcagatgcacagcccctctcttctccataaatggcaagcacagagcagagcttaatatcctgttggcatcctcttcccccattgcaaggagctcatcaggacagggctagttttctgtgtgttgccccagggctgcagcagtgcccagcacactgctaatgctcaaactggctgactggaggcatgcagaggcgtgggctgcctccctgcctcagtgccctcctacctgtgctgggggtgcgtgtatttgagcagctcggccagctgcagagggtacttgcagatcttctgcaccggagtcagcaggaagccatccagggagatgtcaatcatcttctgcagcagccggcaggcctcgaagaagtacacgtacttgctgagcttggtgagccgggagagctccacgcaggcgttggggtggttattgcagtactccgagtagatctggaagtcggcttgctaaggggcacagctggaggttagcagagctctctgctgctcccacaggcaatccagctgcatgtgtgggaagggcaagagcctctacatttccttcaggagctgggctgggggctaggggagacccaggctgtgtgtacctatttccctggggcataagctacatggagtcacacacaggggtgggaatggtgagaatatgagcaggtgtcccggctgcacgctagccttctgggtgaaatccatgataacaaggacgggataacaatgccaaaagcggcggtggtagggggttgggtgggacaggcatcctctgctcaccctcgctcgactgcccaagagggccaaaacaaggcccttctctaccaggtgaggctaggaggtgtccacttagagcggcccagtgaaccttggtaaatgccagccggcatctgccgcctaagcaggctgtaaattctccctgtgtgagaaaccccagagctcactctgaacagcccctgcggcgctcggcaggcctctgccctcctatctgtcaaagcaagtccttcctgggggacgccccagccctctgctcccaggagcgttccctgacttggtttcgccacacagaagcagagaccatcctaaaactgtcctgaagggtgcgggcagcggggcagatagagggctggagctggggcccaggcgttgtggaaggttttgggaccagccacccgctgtccgcgctggcgcccgcggcagcctctgtgaacgcagcgcccaggtaggggccgggggccgcgcgctcacatgctccaggaagcaggcacccagctcgctcaggtgtgggcgctcgcggttgaacctctgctccagggccttcacgaaggccttctggcagcggtagatgtcctcgatgttcccgaagatggtacgcagctgctcctcgctgaacatgtctgcgcgcttgcggcactgccggacgtagccctgcgggcggacgtggttaggcctcccccgaccgggtccccagtcaccgcccgccggccgggcctcacctcgcagatgtcgcgcaggtgcttgatgtagtccc

SEQ ID NO: 11473 - DNA, 224 bp, Homo sapiens
gggaagccacagctgcttgggtgcagctggttcatggacatccctttgagtttaggcttggtggagtcagtggaacagggacatgcttaaagctcatcatgaaagattatggtagtgtggccagtgaaatttggggcgaggggggtggtttatgtgtcagcaaagcagtttctctgctatctaaattttcattacagttctcttagagagatgatgtttttata

SEQ ID NO: 11474 - DNA, 913 bp, Homo sapiens
ttttttttttttttttttttttttgcagaaattgacaaactagtcctaaaatttatagggaaatgtaagggactagaatagccaaaaaggttttgagaaagaacacagttggaggagtcaaacttccttatttcaaagcttactacaaagctacacttatcaacactgtggtactgacacatagatgtacatatagatcaatgggattgaactgagagttcagaaagaagtgcatatatttatgtttaaccgattcttgatgagggtgccaaaacaattcaatgggggaaagaatagtctttaaaacaaatggtaccacacaaatggatatccacaatgcaatataatgaagctagatttctacttcacaccgtatacaaaaatttactcaaaatagattaaagactagatgtaaaaagtaaaactattaaactcttagaataaacctaggtgtaaatcttcatgaccttgtatgagacaataatagttttttaaatatgacacaaaagcataagtaaacaaagaaaaaatagatctattaaactgtatcaaaatttaaaatgtttgtgcttcaaaaaatactatcaagaaagtaaaactataacatacagcatgggaaaaaaagcatttgcaaatcacgtatttgttaaaggtctggtatttagaatatgcaaagaattcttgcaactcaagatctaaaaggcaagaattaaaatttaaaatgggcaaaagatttggatagacatttctccaaagaagatatccaaacaacaaacacatgaaaaggtggccattgacattactctctagagagatgcaaatcaagaacataatgagataccacttcacatgcattaggatggtaataataataatcaatcacaagtgtgaatgagggggcggagggtgagaa

SEQ ID NO: 11475 - DNA, 912 bp, Homo sapiens
tttttttttttttttttttttttgcagaaattgacaaactagtcctaaaatttatagggaaatgtaagggactagaatagccaaaaaggttttgagaaagaacacagttggaggagtcaaacttccttatttcaaagcttactacaaagctacacttatcaacactgtggtactgacacatagatgtacatatagatcaatgggattgaactgagagttcagaaagaagtgcatatatttatgtttaaccgattcttgatgagggtgccaaaacaattcaatgggggaaagaatagtctttaaaacaaatggtaccacacaaatggatatccacaatgcaatataatgaagctagatttctacttcacaccgtatacaaaaatttactcaaaatagattaaagactagatgtaaaaagtaaaactattaaactcttagaataaacctaggtgtaaatcttcatgaccttgtatgagacaataatagttttttaaatatgacacaaaagcataagtaaacaaagaaaaaatagatctattaaactgtatcaaaatttaaaatgtttgtgcttcaaaaaatactatcaagaaagtaaaactataacatacagcatgggaaaaaaagcatttgcaaatcacgtatttgttaaaggtctggtatttagaatatgcaaagaattcttgcaactcaagatctaaaaggcaagaattaaaatttaaaatgggcaaaagatttggatagacatttctccaaagaagatatccaaacaacaaacacatgaaaaggtggccattgacattactctctagagagatgcaaatcaagaacataatgagataccacttcacatgcattaggatggtaataataataatcaatcacaagtgtgaatgagggggcggagggtgagaa

SEQ ID NO: 11476 - DNA, 179 bp, Homo sapiens
tttactatactatatcttaaatcactattttagggtgtgctccttgtacttacttaaaaaaaaatgttggaggggcacagtggcttacgcctgtaatcccagcactttgggaggctgaggcaggcagatcacttgaggtcaggagttggaaaccagcctggccaacatggtgaaacccc

SEQ ID NO: 11477 - DNA, 179 bp, Homo sapiens; identical to SEQ ID NO: 11476

SEQ ID NO: 11478 - DNA, 962 bp, Homo sapiens
aaataatttcaatgctctcaggtactttgctttcttttcctattgtggcctgtgcatctatcctttacctggcccagacctggtgccaagagtggaatcatttagactttagtgcatcagcaaatatcccttcactcatataccatcctatgatgaaaaaaataattgcttttattttaaagttaaaaacttcagttcttccacaaattccagaaacataagaaatatgtggttcactgtttaacaaagccatttctcatgagtactgatgttcctttgattagttagagggaccttctctcagaagaagctctcaagtctagaagctcaataagtgggatgtgagaagttttaatctttgaaggaagccactgttacgttggaactggtgtaatggctcctgagagctaaatgtatatgtgttttcccaactcagtgtccagaaatgtcagactgatagcttgaaattttccttggtgggagtattttcacctagaaaattgaaaacccctgaaaatccgaacttttttcctcctggagagccaattgttaaatatttaccagcataccactgacggtagcttgccttccttcacctgggacttgatgaagttgatggatttactaaactattctgcatatgatatgcataacaatctcttaatttgggtttgaatataattatacactctgtattaatttcttttcccctcccccacatatatgggttaaaaattcacttaatttgacatgtaaatgtatgcaaagtagcaaacaattcatgtttttcgctgagaagcctggaacattaataacactgcaatcttaattacgcagctaccaaaccaatgctcattcgaaaccaccctcctatattgccacctatggaaaataccctgctgaaatgaacttttcttctatgattgacaaagacatagctttcatcttgctgaaaaaaaaaa

SEQ ID NO: 11479 - DNA, 612 bp, Homo sapiens
gatttgccactctctgagtgaccttaggcaaattacctaaaactcattttatagatgagccacagttgccttgtctatagaagggggtcttgtagcttataagattgtaaagaagattaatcgggctaatgaatggagatttcttaagatggagcctaccacacgttaaatgctccataaatgctagaatttttttctactagtccagataaagggaacggcatttgaaaaattatggaggtgagaaaaaagcagtctgtttcaggaagggcaagcttaccttatagcagaaatactgagtgttggttggagagtggagaaagacgaagctggagtggcagatgacaaccagaacctggaggaccttgtgtgacatgctcaattctttggactttaagctggatgtgataaggatctattaaaggattttaaggggacagagacccattttgcttcctgctactaagctgaacattatttttattatcactctgcttccccaaaccatcaaataaaaacagagacaatgtttattcaagatagaaaaacattttatttaggatactgcagtgggggaaagagactccagttgaactcaactccactaaaaaa

SEQ ID NO: 11480 - DNA, 2105 bp, Homo sapiens
gacgctgctcccgggggcagcccccggccagggccaggcacacccgattcctggagcgtctaggttcctctaaacccgcggccagcgcagtctcgggtttccatgacgacgacgcggatggggaacccgggcggggtcgggtcggagcgcatgcgcgttgcgcgccggacgcggaacgtctgccggtgtccccgcgctgctggtcccggggtccctgaaccgcggtaagggcggtggtgcgggcgtccgaatgggcgtttctagatacggggcgcggactagaggctcgctgggcccggagaccggcggactgggagcggggaaccggaggtggggagggggctcccgggcccggggtgggtgggtccagggctcccaggcctggggcttggacaagggtcgtggggcccgcgggaggggacgggggctcaccggcccggggcgggcggggcgggcgccgctgacccctcgctggcttcagggcggccccgctccctctgctggccatggcccccccgcccgcgtgccggtccccgagtcaccgccgccgccgccgctgctgctgctgctgctgagtctggcgctgctgggcgcccgggcccgcgccgagcccgccgggagtgccgtccccgcgcagagtaggtgccgggggccgggttccggggagcggggcggggctggcgacaggggcgtgcggggccggggctctgcggggaggaccgcgcctcgcctttgttaccgggagcgggtcctccccttcgcgggagatggtggcttggggagtggggacgtgcgctctttggcactgggtggacgggcccagagtgcgtgggggccttgcgggtgaccccccctgcgccccctccaccctgacccgcgccccccgcaggccgcccatgcgtggactgccacgccttcgattcatgcagcgcgccctgcaggactgcggaagacagcctgcagcctggacgcgcgggtgagcgcccgcggcgcgacggtcctcccgggcttcccaggggtggggagggcagggaggatgaggaagaggcccctgcgggagtggagtgtccctcatccttcaccccgatttaagatgccgcaccttgcccccttcctctggctccagtcatccaaggggcattctgggcacctgtctcacctatgagacgcccctctctccagcatactctatttctagcccctcccccagaagctctcactgggcactttgtcctatgaccgccactcctgaggctgtgacagatctggaccctggggaaggactgtcagcccaatccaggatcccctaggtgggcggcaaggccccagggcagaggagaaactgaggccggaggatgtggcgaaagtgcaggaatggggggtcaggctgggcagggggtctggtctgggtgatgcacagttggtaaggcccctccaagcctggatgaacagggagcccccacgccatggggtgcagccaaggagttttgtttgtgccggggctcaagcttcttcctggaaagggagaattctaggaaggagaaagcaggaagaccctgcctggtcccaccccccaccagccctagtgtcctcttgggaacactccagaggctccgactaagacctggagccctctccccactcacagagcctggaactgagctcttgggaggagcacccccacctatccttagcatgagggtggcagggagtgggggacagtggacccctgcgggtggtgtgggagctggaagaaggcaggtgggcacgctggcatggcgtgggcaccagcagaccccaggcaggccccaccagtgggagccactgcagaggaaagagatgagtgggaggctctgggtgtgggggttagagccagggcctgaccttgtctgtctcaggagccggtggagatagggctgccttgggtgggtggaggcccaggggaatgccagtgggcagctgggctgcaccctcacccctcttgttgctttgcagacggagaccctactgctgcaggcagagcgccgtgccctgtgtgcctgctggccagcggggcactgaggaccacgctgctccgtgtgaataaatgcccagtggcacgcctg

SEQ ID NO: 11481 - DNA, 544 bp, Homo sapiens
gcaggtcgcgagcgggcgcagcgtgggaccgaagggagaaggacgcctgcggcccggcgcgtccccggaggcacgtcccccccagggctccgcggccccggcaacagcgcggggctacccctctacggctcccgccccactgggggaccgcgacggcctgctcccgggctcttggctccgagtggagaagagcgcggaagtgcgcactagcccgacactcgggagggccgctgcctccccaggcgcctgggacagcggcccgcagcccccacccggcccctcgggccccgcgtgcgtttcagcgcgctgaggatgcagcacacccccgaggtgcgaccgggtccccgaagcccggcgtcggcccaacccggaggaggcagcggcagtcacgggcacgcttccccaacccaccctcccacccatcttaggtcaggacacccgcgtccggccggggcaggggcggctctgaccacgcgagagcaggtgcgtccgcagtcccagcttgtgccgggaagaccaccggccagaaccccgggggttgggg

SEQ ID NO: 11482 - DNA, 774 bp, Homo sapiens
aaagaactgttggggcagatctgtttgttcatgtatttgaaagcatataaatgtgggcagcaagaaggtgtgagttgcaatagacagtaattgaaatatctattattggcacctgctatttgccaatggtacactattcatggtgtgcattattttgtcactttgctcagggaacttgtctacaaaattcattccaaagtgggctggttaaaggttgccaagggtcaacaggagggaaccagggttctttccaggcagctaaaatgagcccagtctgctactctggccacaccggctggctgtcacggccctgggcaaaaagcatctctcaaagtgcagatgacagaagtcctcctagcaggaggacttagccaaggtcaccaagtatttaggatggaatgaggattaaatccaagttggctgactcttccttcaatgctttctgctgtgccatgactccctcctgctttacaaaatgaataaggaggccaggcaccgtggctcacggctgtaatctgcatacactgggaggctgagatgagcagatctcatctcaaacttgaggtcaggagtttgagaccagcctgggcaacatggagcaaccccatctctacaaaacatgtaaaaattagccggtcatggtggtgtgtgcctacagtcccaactactcgggaggctgcggtggcaggatggcttgagcccgggagactgcgctactgcactccagcctgggtgacagagtgagaccctgtctgaaaaaaaaaggaaagaaaa

SEQ ID NO: 11483 - DNA, 198 bp, Homo sapiens
gtaatcctagcactttaggaggccgaggtgggcggattacctgaggtcaggagttcgagaccagcctggccaacatggtgaaaccccgtctcaactaaaaatacaaaaattagctgggtgtggtggcgggcacctgtaatcccatctactcgggaggctgaggcaggagaatcgcttgaacccaggtggtggaggttg

SEQ ID NO: 11484 - DNA, 289 bp, Homo sapiens
ttttttttttgagacgaagtcttgctctgtctcccaggctggagtgcagtggtgcgatcttggctcactgcaacctccgcctcctgggttcatgccattctcctgcctcagcctccgaagtagctgggactacaggcgcccgcaccacgcctggctaatttttgtatttttagtagagacatggtttcaccagcttggccaggctggtctcgaactctgacctcaggtgatccacccgcctcggcctcccaaagtgctgggattacaggcgtgagccactgcgcccggc

SEQ ID NO: 11485 - DNA, 9443 bp, Homo sapiens
cttctgacgctgggccattggacgctgcggaaccaggcttcttcactttgagtttccgccgcgaagcgccagtccgggccgaggagggaggtgggtagataactctgccttttctgaagtcagatcccgcacgctcactttacccccacccgcccgctgtcctggggacctgcccaacgccctgtggccaggccaggagctgctccctgactccggaggttaccgcccgcccctcgactcccttcccgctggggtcctaactggaagtcttccaggccccgcccccttctcaaatgcccttctcagactctcgctgtaccctacggaaggcacagtcaaagcaaccgaacgtttaattatttgaattttctcaaagtaattcatgtataataaaaagtcaaacattaaagcaggtcttattttgaagagcagtaactacccatccccagatctttgcagaggctgccacttttagtttgtccccatttagatgtttttagcaccctaaatcaaaataatatgcgttccactgtatttctggatttatcattttgatatttctttgccttactttcttactgccacaatcttgtcaattttccatcgctattttaggtcttccatttgtagctttaaataatgggtatcaacttccatttattgttttattgactttagatggtgtctcttaatgtctctactgacttagctaaggatattaacacatcctccactttcaatctactatcggttggaactcaacatttacatttagttttcacgtattcaacaagtatttgaggcactgttcttggcactggggaaatagaaatggacaaaacagacaatgaccctatccacatgaaaaagttctagtatgggaagtaagacaatagacgaatacatggcaaatgacgtcaaaggcaggatcatgtagaagtcattttcagctgggagaatagcaggcacccaagtcaggtagattgaatggacgaggggtttgcgggagtgtgtggaagtttattcctttgcctagctgggcacaggtgctgtttcaaggagagatcttgttaaccgggagccaggatagattatttagtaagttagtgatttaccaaaatgaggttttaggatactggatcccacagtttggtagtgatagtgggaggaagaaaagcaggaggcagggagtctagtgagaaggcatgccctgccaatggcatatcagagtcctgcaagatttactgctctgcttcctgcttcctgctactggactgcgctaaaccacagtgatttttctctcctcttgaatttgtattataccttaaagctaaagaggttaagaaatttgcccaagatagatggcagagccccaagccaaacatctgtaaaatgagaacaataatggcctctgcctagggttgtgaaataaaccaacttaattcatgtaaagtgctcagaacagtgcctggcacatcatagaactgctcaaagagtgcttgcttttattattaatgtatgctctcaatttacctcacaaatgctaaaaggattttgggtttaggaactatttcctatgtctagctggttaattcattcaacaaatatttactcagcaatatctgcattgcaggtgctgtttaggtgctgaggatacaacaggaactaggatcaacatgtcccttccttgtatagattctagctggtaacacaaactagcaaagtgaatgaataaatattgccaactgagccaagagcctgccattgaccaagttccatgcccatatgtggccctggcaaaaatctcagatttcttgctggtgtagtgatttcatcaatatgggtgtgatgatcatcaaatgatctttgttttaatctccaagggatgttatttcatctctgcttctagcatatcactaaaagctcagaagactaccttgacatcttggtgaataataagtacattagtgctggagcagtgggcaggggtttaaaaggcacaggaaaagaactgctgtttcctttacagtttttgcattttagtgtgcaacacaagaaaacaaattgagcttgtaggcaatgggcttctggcatactaccttttgacactttgaattatattaatgtaaatataaacataccagagagtgaggctggaggtatttatggccttacttcagatactgaaataccacattttatgtgaacttacccaagtttaagagaaataatgctgatttgtagagcatgattggagtggtaatggtcaagtagagcaaacccagaggaaaatcagagttgaccaagtgaatgaaaaccgaggactcccaatattcactcacttaggcatccccattatccccttcatggtatgagtaatgtggcccgttcagaccatgcacccttcagttggaaaggccaatgcttattaaagaaggtcagtaaagggtcaaaaggaaggtggttttcccccagaaattaattattcctgttactgatctctctgttcctctgttacctttttctcttatttgtctttcttttcttcttctcagcctttactacttctccctggtttcattcatgttctgaggagggtgtgagaaggaaccatggatcccacagccttggtggaagccattgtggaagaagtggcctgtcccatctgtatgaccttcctgagggagcccatgagcattgactgtggccacagcttctgccacagctgtctctctggactctgggagatcccaggagaatcccagaactggggttacacctgtcccctctgtcgagctcctgtccagccaaggaacctgcggcctaattggcagctggccaatgttgtagaaaaagtccgtctgctaaggctacatccaggaatggggctgaagggtgacctgtgtgagcgccatggggaaaagctgaagatgttctgcaaagaggatgtcttgataatgtgtgaggcctgcagccagtccccagagcatgaggcccacagtgttgtgccaatggaggatgttgcctgggagtacaaggtgagagatggaagctggccactccagtctaaccccggccccaagttggctgtttctagatcaagggcttgaccaccagcaccacagactgagagctaactcctttggttcctgacacccagagatccctggaatctgatacagagagctatacctttccttgtattcatgaccttccttgatttcctgctctcccacttcctctacacctacatcctaacagggctcaattcctaacccaaggctgatttcagtaatgagaatgtgaaggaaaacagtttgggttttaactgagattctggatgccttggatgagtttaggcatgaggctcttatatagatggtcaaggctacacctgacctgcaaactcctcctagcagtgctgcaagtagtcatttggcattgaatggatcacttccctccttcattttatagacaaaagtgaggcttagaaagttgaaaacatggcaatttattttagaggtggaaagaactatgggtgagtcacaagattgagagaggtcatctgatatagtcttctcaggtcctttctgacttcaggtccagttagtgaaaggaagatcagaggctgtgactcaagtcttcttgcactttctcctctcccaagtttgtttgtttgacaagtcatctctgacaaacctgggactccttttttgtagctaacctcatcaacttccagcttctgggcttctctttactctttcatcagatgcccataatgacatctttatcggaaccattatctcagtgattctgtgatccagtgatccagcattggtctcaactctcttttttggagttgaaataggaaggtgagagtgtaagacaaatcccctgaattagcttttttcctatatgggagggatttctaaaatatgaaaagtatttactaactcattctgtttttgagactattagaaaagggagctagtataacataggggtaaagggctggatgaaatcccagcccaaccatttattacctgaatgactttgggtaggtcaccctctaagcctcagttttcttgtctataaaataaggttaataccagcctcagaggattgtaagtatcacatgcatatttagagctgaaaatatacctgacacttgatatattttaacaaaatagttgctattttgttaaaatagcagaattaaatggtgtttctgcacagtttatgcttttcagtagaaatcccttgcattactattctaggaaagtgcttcttacccttaataagcatatgaaccacctgggagatccatctaaaattgagattctcatttggtaggtctaaagtaaggccaagattctgcatttctaacaagctcctaggtgatgtggatgctgctgatccacttgaaccacatttggagtaacaaggttctggcagacagtaagataaaaataaataagataaggataaaaattggcatggaaaggaaagtccaaggtacttttgtggagaggttgtaaatggaccttttcttccagtttacagacatttagagactgtgggagttgaaatgattctcagcccagagagctacctcggatgtcatctgggcagagtctgcttcctctgtggcattccctttccccacagccttcactgtggccggttgcctgaaggactctggttctcccatagcctcccagtgctaggaagcctaggctgccggaggtggcctcatgagggttttgtctcttgcagtgggaacttcatgaggccctcgaacatctgaagaaagagcaagaagaggcctggaagcttgaagttggtgaaaggaaacgaactgccacctggaaggcaggttgcctcgtggggaaaggagtttgtgtcagtcgtcctgtgtggtcctggagctggcctagggtagcattctcatcactgtgaggcagaatgtgaggcttgaaatcacagagcctagggttctaatccctgctttctctgtcccaggccttaggtaggccacgtcacctcttaattccagtttctccatggggatgtagggataacctctggtcttgtatcctcctatatgagaaaggaaaagcacatgctcacgtgtgtcagctcacagtggcatggcttatatcatgcttgtaaagcagagtttctctttcattttcccaagttagagaatatttgctaagagtctggttattaaaatattgtaaaatcacctctgaaataaatttgaggccagtaagtatcaaactactagaacttttgatcaacagaaagtaacactgaaccaatctaaaacagcatgttgaacagatataatatcaacatgaaaatgaaccacctaacagtgtagttaagttacactgccttagagacttaaatgtaacacatcttgtcattattctgaaaatggaaaatagtctagagcatgtagtattaagataatatcctggaccctactggagtcaataagagtgacaatagagacctagaagcatgtggtggagctgggagaacaggaagctaggaaaaatagtatcctttatctttgcccctgcatagcctgtcacgtggttggtaccattgcagagtatgtgtgtatgcatatgtcagtatgctcgatactgggtgactgaaagtatcagtgctgatttccatcttggctccacagatacaggtggaaacccgaaaacagagtattgtatgggagtttgaaaaataccagcgattactagagaaaaagcagccaccacatcggcagctgggggcagaggtagcagcagctctggccagcctacagcgggaggcagcggagaccatgcagaaactggagttgaaccatagcgagctcatccagcagagccaggtcctgtggaggatgattgcagagttgaaagagaggtcgcagaggcctgtccgctggatgttgcaggtgagtagtaggttttcctggtaaccctgagtgacagctgaagatagactgagactccaggagagagcatcagttacccttcagtagggactgccagccctctgccagctggtcatggatcctgtgtttccccagctaatacctgctgtttccctatccctggctggtggatgacctggtctgttgtagcatcataggtggggcagtgctcaggcagctctggcgtcattccaggccctctcctctagcccgagagtcttgagatggagcctgaaattggccagttcagccaaagctcagcctgctcttccatccttccataggcttctccttacctctgcatggcatctctccattcttggtatctgtctcccttcccctagagaaactccctgccagttcgatgtctgttccctctgaggaatagcacttactcagatgctgcatttttttttctccttccaggatattcaggaagtgttaaacaggtatgttctcacccttggagcctctaagcagccctgtaggggatagtgaggcctaactagagccagaagtagggacggagcacagactcggtgcacacagaaaagcaggtgctggtccacagtctcgtcccacttacatggtaatggctaaggaatctttgttgatctttcctttttcttctttgtacttgatcaaatgtatatcaagtgaagctgtaaaatatgtggtttcaagtagattgctcaaagaggataaaagactgcccatgactccttcatgtccgacagaaaatgtgtgcacttcttcctctcccagaatcaaatatacatccaacccttcccatagcatgggcatgcaggtgttctcacctctgcacacaaacagcttgaggctcagccaaataaccgtaaccatcatgtctctgctttgctggggttcactatgtccctggccaagcccctcttccctgtactaagataaggcccatgtgacaaagccgggactcctggccctgaggttcaccctcctctaccaggagcaaatcttggagcttgcagcagccagaaccaatctccctggagttgaagacagattgccgtgtgctggggctaagagagatcctgaagacttatgcaggtaatggatcctgggggagactgtagtggacagtgggagggacccctcccagagatagaaaatggttcagtgcctctgggtgctccatccagcctcaccccttcatcattgagaaatctgtggctgaatttatcagagggctctcacccatgtcccctggccctatatcactgttaccaaccaggaccttttcttctagctgatgtgcgcttggatccagatactgcttactcccgtctcatcgtgtctgaggacagaaaacgtgtgcactatggagacaccaaccagaaactgccagacaatcctgagagattttaccgctataatatcgtcctgggaagccagtgcatctcctcaggccggcactactgggaggtggaggtgggagacaggtctgagtggggcctgggagtatgtaagcaaaatgtagaccggaaggaggtggtctacttatccccccactatggattctgggtgataaggctgaggaagggaaatgagtaccgagcaggcaccgatgagtacccaatcctgtccttgccggtccctcctcgccgggtgggaatcttcgtggattatgaggcccatgacatttctttctacaatgtgactgactgtggctcccacatcttcactttcccccgctatcccttccctgggcgcctcctgccctattttagtccttgctacagcattggaaccaacaacactgctcctctggccatctgctccctggatggggaggactaagaaagctaccaccctaaccagagaggcttggaattgggcctggccccatggggcttggaggaccgagccactgacaggtatcccctgaaactgagctgagcccagtatccaaggattcctctgtctgatcctttggtctttgctaccaggctgaagtctgtcatgaaaccacttattttaaaaagcagaggcccagtcaaatgagcattgcatcccatgagggaagcacgacagggctgatggtgaggatcagagcagttctaaggtgactcgttggggtaaggatcaggactttgtccatgtagtagccaaccaccctcttccctgattcccgtccggtgtcacagttcagtcagtgaggatgatgaagtagatacagtcttcaggacaccattagatgggctttcccaataggccaaaaaaatgctgcgcatacccagagctggttgttgtgctgaggccagtcagaggatgcttcccctgaggtttgctataactaagcaacctttatgtgactctcaccttctgacctcctggcaagagaaattcagtgcagcagggggacacagacctgcccaagccaccccactgccgttccctctctgagcacaagctgggcaaatcactgtcccttggactccaggagaccagtgtcctagtcttgccttttttctctaagtggcaggatcagaaaacctgcgagctttagtttgtattttcactttatgaatgaggaaactgaaatggccttaagggagcaagttatttctttttttttgacacggagtctcactctgttgcccaggctggagtgcagtggcacgatctcggctcactgcaggctctgcctcctgggttcacgccattctcctgcctcagcttcccgagtagctgggactacaggcgcccaccacgacgcctggctcatttttttgtatttttagtagagacggagtttcaccatgttagctaggatggtctcgatctcctgacctcatgatccgccctcctcagcctcccacagtgctgggattagaggcatgagccactgcgcccggcccctggagcaagttatttcttacaaagctgctgaaggtaagattatcaaaattataaagcatttttcacactcaagtgaaacaaggttgacaaactcacttcgcaggtcacatgcctatacatcacttattatatttgggtctgaaacttctcacatgtttgggaggttttatgtgtcctcattgggaaaatgggtgtaattcagcataaaacctcatatgattgtcctgcctcatggagctgttgtatagatcccagatccatcccatgatttgttcctgtctgaggcatagaggcaggcaagccgtggattttgcacatggtgactttcccactgtgccatgatacagtctgcatcttatagcagtgcctttgtctcagggcctctgctggcagtctagaccttttgggcagaaaggagcttcaaatggctgtgataaggaatattaaaaattgtgtttctactttaattgtattggctgttcatgtatgtaggagttaaaataggccaaactggagaaataaacgcattctgtccaccatg

SEQ ID NO: 11486 - DNA, 9445 bp, Homo sapiens
cttctgacgctgggccattggacgctgcggaaccaggcttcttcactttgagtttccgccgcgaagcgccagtccgggccgaggagggaggtgggtagataactctgccttttctgaagtcagatcccgcacgctcactttacccccacccgcccgctgtcctggggacctgcccaacgccctgtggccaggccaggagctgctccctgactccggaggttaccgcccgcccctcgactcccttcccgctggggtcctaactggaagtcttccaggccccgcccccttctcaaatgcccttctcagactctcgctgtaccctacggaaggcacagtcaaagcaaccgaacgtttaattatttgaattttctcaaagtaattcatgtataataaaaagtcaaacattaaagcaggtcttattttgaagagcagtaactacccatccccagatctttgcagaggctgccacttttagtttgtccccatttagatgtttttagcaccctaaatcaaaataatatgcgttccactgtatttctggatttatcattttgatatttctttgccttactttcttactgccacaatcttgtcaattttccatcgctattttaggtcttccatttgtagctttaaataatgggtatcaacttccatttattgttttattgactttagatggtgtctcttaatgtctctactgacttagctaaggatattaacacatcctccactttcaatctactatcggttggaactcaacatttacatttagttttcacgtattcaacaagtatttgaggcactgttcttggcactggggaaatagaaatggacaaaacagacaatgaccctatccacatgaaaaagttctagtatgggaagtaagacaatagacgaatacatggcaaatgacgtcaaaggcaggatcatgtagaagtcattttcagctgggagaatagcaggcacccaagtcaggtagattgaatggacgaggggtttgcgggagtgtgtggaagtttattcctttgcctagctgggcacaggtgctgtttcaaggagagatcttgttaaccgggagccaggatagattatttagtaagttagtgatttaccaaaatgaggttttaggatactggatcccacagtttggtagtgatagtgggaggaagaaaagcaggaggcagggagtctagtgagaaggcatgccctgccaatggcatatcagagtcctgcaagatttactgctctgcttcctgcttcctgctactggactgcgctaaaccacagtgatttttctctcctcttgaatttgtattataccttaaagctaaagaggttaagaaatttgcccaagatagatggcagagccccaagccaaacatctgtaaaatgagaacaataatggcctctgcctagggttgtgaaataaaccaacttaattcatgtaaagtgctcagaacagtgcctggcacatcatagaactgctcaaagagtgcttgcttttattattaatgtatgctctcaatttacctcacaaatgctaaaaggattttgggtttaggaactatttcctatgtctagctggttaattcattcaacaaatatttactcagcaatatctgcattgcaggtgctgtttaggtgctgaggatacaacaggaactaggatcaacatgtcccttccttgtatagattctagctggtaacacaaactagcaaagtgaatgaataaatattgccaactgagccaagagcctgccattgaccaagttccatgcccatatgtggccctggcaaaaatctcagatttcttgctggtgtagtgatttcatcaatatgggtgtgatgatcatcaaatgatctttgttttaatctccaagggatgttatttcatctctgcttctagcatatcactaaaagctcagaagactaccttgacatcttggtgaataataagtacattagtgctggagcagtgggcaggggtttaaaaggcacaggaaaagaactgctgtttcctttacagtttttgcattttagtgtgcaacacaagaaaacaaattgagcttgtaggcaatgggcttctggcatactaccttttgacactttgaattatattaatgtaaatataaacataccagagagtgaggctggaggtatttatggccttacttcagatactgaaataccacattttatgtgaacttacccaagtttaagagaaataatgctgatttgtagagcatgattggagtggtaatggtcaagtagagcaaacccagaggaaaatcagagttgaccaagtgaatgaaaaccgaggactcccaatattcactcacttaggcatccccattatccccttcatggtatgagtaatgtggcccgttcagaccatgcacccttcagttggaaaggccaatgcttattaaagaaggtcagtaaagggtcaaaaggaaggtggttttcccccagaaattaattattcctgttactgatctctctgttcctctgttacctttttctcttatttgtctttcttttcttcttctcagcctttactacttctccctggtttcattcatgttctgaggagggtgtgagaaggaaccatggatcccacagccttggtggaagccattgtggaagaagtggcctgtcccatctgtatgaccttcctgagggagcccatgagcattgactgtggccacagcttctgccacagctgtctctctggactctgggagatcccaggagaatcccagaactggggttacacctgtcccctctgtcgagctcctgtccagccaaggaacctgcggcctaattggcagctggccaatgttgtagaaaaagtccgtctgctaaggctacatccaggaatggggctgaagggtgacctgtgtgagcgccatggggaaaagctgaagatgttctgcaaagaggatgtcttgataatgtgtgaggcctgcagccagtccccagagcatgaggcccacagtgttgtgccaatggaggatgttgcctgggagtacaaggtgagagatggaagctggccactccagtctaaccccggccccaagttggctgtttctagatcaagggcttgaccaccagcaccacagactgagagctaactcctttggttcctgacacccagagatccctggaatctgatacagagagctatacctttccttgtattcatgaccttccttgatttcctgctctcccacttcctctacacctacatcctaacagggctcaattcctaacccaaggctgatttcagtaatgagaatgtgaaggaaaacagtttgggttttaactgagattctggatgccttggatgagtttaggcatgaggctcttatatagatggtcaaggctacacctgacctgcaaactcctcctagcagtgctgcaagtagtcatttggcattgaatggatcacttccctccttcattttatagacaaaagtgaggcttagaaagttgaaaacatggcaatttattttagaggtggaaagaactatgggtgagtcacaagattgagagaggtcatctgatatagtcttctcaggtcctttctgacttcaggtccagttagtgaaaggaagatcagaggctgtgactcaagtcttcttgcactttctcctctcccaagtttgtttgtttgacaagtcatctctgacaaacctgggactccttttttgtagctaacctcatcaacttccagcttctgggcttctctttactctttcatcagatgcccataatgacatctttatcggaaccattatctcagtgattctgtgatccagtgatccagcattggtctcaactctcttttttggagttgaaataggaaggtgagagtgtaagacaaatcccctgaattagcttttttcctatatgggagggatttctaaaatatgaaaagtatttactaactcattctgtttttgagactattagaaaagggagctagtataacataggggtaaagggctggatgaaatcccagcccaaccatttattacctgaatgactttgggtaggtcaccctctaagcctcagttttcttgtctataaaataaggttaataccagcctcagaggattgtaagtatcacatgcatatttagagctgaaaatatacctgacacttgatatattttaacaaaatagttgctattttgttaaaatagcagaattaaatggtgtttctgcacagtttatgcttttcagtagaaatcccttgcattactattctaggaaagtgcttcttacccttaataagcatatgaaccacctgggagatccatctaaaattgagattctcatttggtaggtctaaagtaaggccaagattctgcatttctaacaagctcctaggtgatgtggatgctgctgatccacttgaaccacatttggagtaacaaggttctggcagacagtaagataaaaataaataagataaggataaaaattggcatggaaaggaaagtccaaggtacttttgtggagaggttgtaaatggaccttttcttccagtttacagacatttagagactgtgggagttgaaatgattctcagcccagagagctacctcggatgtcatctgggcagagtctgcttcctctgtggcattccctttccccacagccttcactgtggccggttgcctgaaggactctggttctcccatagcctcccagtgctaggaagcctaggctgccggaggtggcctcatgagggttttgtctcttgcagtgggaacttcatgaggccctcgaacatctgaagaaagagcaagaagaggcctggaagcttgaagttggtgaaaggaaacgaactgccacctggaaggcaggttgcctcgtggggaaaggagtttgtgtcagtcgtcctgtgtggtcctggagctggcctagggtagcattctcatcactgtgaggcagaatgtgaggcttgaaatcacagagcctagggttctaatccctgctttctctgtcccaggccttaggtaggccacgtcacctcttaattccagtttctccatggggatgtagggataacctctggtcttgtatcctcctatatgagaaaggaaaagcacatgctcacgtgtgtcagctcacagtggcatggcttatatcatgcttgtaaagcagagtttctctttcattttcccaagttagagaatatttgctaagagtctggttattaaaatattgtaaaatcacctctgaaataaatttgaggccagtaagtatcaaactactagaacttttgatcaacagaaagtaacactgaaccaatctaaaacagcatgttgaacagatataatatcaacatgaaaatgaaccacctaacagtgtagttaagttacactgccttagagacttaaatgtaacacatcttgtcattattctgaaaatggaaaatagtctagagcatgtagtattaagataatatcctggaccctactggagtcaataagagtgacaatagagacctagaagcatgtggtggagctgggagaacaggaagctaggaaaaatagtatcctttatctttgcccctgcatagcctgtcacgtggttggtaccattgcagagtatgtgtgtatgcatatgtcagtatgctcgatactgggtgactgaaagtatcagtgctgatttccatcttggctccacagatacaggtggaaacccgaaaacagagtattgtatgggagtttgaaaaataccagcgattactagagaaaaagcagccaccacatcggcagctgggggcagaggtagcagcagctctggccagcctacagcgggaggcagcggagaccatgcagaaactggagttgaaccatagcgagctcatccagcagagccaggtcctgtggaggatgattgcagagttgaaagagaggtcgcagaggcctgtccgctggatgttgcaggtgagtagtaggttttcctggtaaccctgagtgacagctgaagatagactgagactccaggagagagcatcagttacccttcagtagggactgccagccctctgccagctggtcatggatcctgtgtttccccagctaatacctgctgtttccctatccctggctggtggatgacctggtctgttgtagcatcataggtggggcagtgctcaggcagctctggcgtcattccaggccctctcctctagcccgagagtcttgagatggagcctgaaattggccagttcagccaaagctcagcctgctcttccatccttccataggcttctccttacctctgcatggcatctctccattcttggtatctgtctcccttcccctagagaaactccctgccagttcgatgtctgttccctctgaggaatagcacttactcagatgctgcatttttttttctccttccaggatattcaggaagtgttaaacaggtatgttctcacccttggagcctctaagcagccctgtaggggatagtgaggcctaactagagccagaagtagggacggagcacagactcggtgcacacagaaaagcaggtgctggtccacagtctcgtcccacttacatggtaatggctaaggaatctttgttgatctttcctttttcttctttgtacttgatcaaatgtatatcaagtgaagctgtaaaatatgtggtttcaagtagattgctcaaagaggataaaagactgcccatgactccttcatgtccgacagaaaatgtgtgcacttcttcctctcccagaatcaaatatacatccaacccttcccatagcatgggcatgcaggtgttctcacctctgcacacaaacagcttgaggctcagccaaataaccgtaaccatcatgtctctgctttgctggggttcactatgtccctggccaagcccctcttccctgtactaagataaggcccatgtgacaaagccgggactcctggccctgaggttcaccctcctctaccaggagcaaatcttggagcttgcagcagccagaaccaatctccctggagttgaagacagattgccgtgtgctggggctaagagagatcctgaagacttatgcaggtaatggatcctgggggagactgtagtggacagtgggagggacccctcccagagatagaaaatggttcagtgccctctgggtgctccatccagcctcaccccttcatcattgagaaatctgtggctgaatttatcagagggctctcacccatgtcccctggccctatatcactgttaccaaccaggaccttttcttctagctgatgtgcgcttggatccagatactgcttactcccgtctcatcgtgtctgaggacagaaaacgtgtgcactatggagacaccaaccagaaactgccagacaatcctgagagattttaccgctataatatcgtcctgggaagccagtgcatctcctcaggccggcactactgggaggtggaggtgggagacaggtctgagtggggcctgggagtatgtaagcaaaatgtagaccggaaggaggtggtctacttatccccccactatggattctgggtgataaggctgaggaagggaaatgagtaccgagcaggcaccgatgagtacccaatcctgtccttgccggtccctcctcgccgggtgggaatcttcgtggattatgaggcccatgacatttctttctacaatgtgactgactgtggctcccacatcttcactttcccccgctatcccttccctgggcgcctcctgccctattttagtccttgctacagcattggaaccaacaacactgctcctctggccatctgctccctggatggggaggactaagaaagctaccaccctaaccagagaggcttggaattgggcctggcccccatggggcttggaggaccgagccactgacaggtatcccctgaaactgagctgagcccagtatccaaggattcctctgtctgatcctttggtctttgctaccaggctgaagtctgtcatgaaaccacttattttaaaaagcagaggcccagtcaaatgagcattgcatcccatgagggaagcacgacagggctgatggtgaggatcagagcagttctaaggtgactcgttggggtaaggatcaggactttgtccatgtagtagccaaccaccctcttccctgattcccgtccggtgtcacagttcagtcagtgaggatgatgaagtagatacagtcttcaggacaccattagatgggctttcccaataggccaaaaaaatgctgcgcatacccagagctggttgttgtgctgaggccagtcagaggatgcttcccctgaggtttgctataactaagcaacctttatgtgactctcaccttctgacctcctggcaagagaaattcagtgcagcagggggacacagacctgcccaagccaccccactgccgttccctctctgagcacaagctgggcaaatcactgtcccttggactccaggagaccagtgtcctagtcttgccttttttctctaagtggcaggatcagaaaacctgcgagctttagtttgtattttcactttatgaatgaggaaactgaaatggccttaagggagcaagttatttctttttttttgacacggagtctcactctgttgcccaggctggagtgcagtggcacgatctcggctcactgcaggctctgcctcctgggttcacgccattctcctgcctcagcttcccgagtagctgggactacaggcgcccaccacgacgcctggctcatttttttgtatttttagtagagacggagtttcaccatgttagctaggatggtctcgatctcctgacctcatgatccgccctcctcagcctcccacagtgctgggattagaggcatgagccactgcgcccggcccctggagcaagttatttcttacaaagctgctgaaggtaagattatcaaaattataaagcatttttcacactcaagtgaaacaaggttgacaaactcacttcgcaggtcacatgcctatacatcacttattatatttgggtctgaaacttctcacatgtttgggaggttttatgtgtcctcattgggaaaatgggtgtaattcagcataaaacctcatatgattgtcctgcctcatggagctgttgtatagatcccagatccatcccatgatttgttcctgtctgaggcatagaggcaggcaagccgtggattttgcacatggtgactttcccactgtgccatgatacagtctgcatcttatagcagtgcctttgtctcagggcctctgctggcagtctagaccttttgggcagaaaggagcttcaaatggctgtgataaggaatattaaaaattgtgtttctactttaattgtattggctgttcatgtatgtaggagttaaaataggccaaactggagaaataaacgcattctgtccaccatg

SEQ ID NO: 11487 - DNA, 26730 bp, Homo sapiens
agtgggtgcctgatagacatcctaggactatacagaaggaaaaggcccactttgggggataatgctgagggacactatgaaatcttggaatgatagccagtcagatctgtgtagcactgaccaagaagaggaagaagagatgatttttggtgaaaatgaagatgatttggatgagatgatggatttaagtgatctgcctacctcactttttgcttgcagcgtccatgaagcagtgtttgaggcacgagagcagaaggtaggcatctatcctccctttccctacatttgtagcatgttaaatgtgtatggatttggggaaacagagcttgactggtccctgacaaattaagtatagaaagtgtatgtccacttttaggccgggcgcattggctcacacctgtaatcccagcactttgggaggctgaggtgggcagatcacctgaggtcaggagttcaagacgagcttgggcaacatatagaaaccctgtctctactaaaaatgcaaaaactagccgggtgtggtggtgcgcgcctgtaatcccagctactcgcagggctgaggcaggagaatcacttgaacttgggaggcagaggttgcaaagagctgagaacatgccactgcacttaagcctgggggacagagtgagactctgtctcaaaaaaaaaaaaaagaaagtgtatgtccacttttagatgttgccgcagaatttttattgtatttttagaagagtttcagtctgcagcagttaggaaatgtttcaaaaccagttcttctccatagacactttaagaagcactggcatttagtgaactctgagtcaagtcttattcaatccattcacttatttattcacttattcattttcggagactacaattaaagaaaacctggggatctttagccgggcttcctattacttgggagtgcattcacaaaagaaggaattcagctttttcctggggctgatttacataaaacctattaggactatttatgattttgtcgtaacaaaattgttcacgtttcttgtattagtttctataactggggaaaatgattgagcttattattttaaagattcctttagttcatttattatttacctagaaagagaggtgtgtgtgtgtgtgtgtgtgtgtgtgtgtgtgtgtgctttgttttgtttttccccgtcatgacctcacaaaaggctataggtcttagtcccacaaaagtaaaatagctctgccactgggatgtgtcttccttgttctgagctttttctcaaaaccctatcactggccctttagttttcagccgatgtacccaaaatatttcccttccgatgactttcttggagcagaacttcaataccgtttaactcaggacatacttgagtgcctacggtgtgccaggcgctggtgccagttgcttcaggggatagagtgtgagtcatgcagcttctgcctcatggtgtccagccctgcagcagaatcaaggccaggcagcagggatgacaagcaattatgttatcaaatggaatcttagtgcctttagaaacacttgaaagtggccgggcgtggtggctcatgcttgtagtcccagtactttgggaggccaaggcaggcagatcacgaggtcaggagttccagaccagcctgaccaacatggtgaaaccccgtttctactaaaaatacaaaaattagctgggcgtggtggcaggtgcctgtaatcccagctactcaggaggctgagacaggagaatcgcttgaacctgggaggcagaggttgcagtgagcggagattgcgccagcgtactccagcctgggcaacagagcgagactcagtctcaagaaaaaaaaaagaaagaaagaaacacttgaaagaacagggccaggcgcagtggctctcgcctgtaatcccagcattttgggaggctgtggcgggcagatcacttgagcccagggtttcatgaccagcctgggcaatatagcgagaccccatctccataaaataaaataataataataatttaaatagtgcgttgaggtaagaaaggaggaaggatcacagccagttggaataaaagatctcacagggaggtggcattggagaagggctgtgagagctgggtaggattttagcagggaagggaaagggaattttggccacggggaacagaatgagaaaagagctgaatcgggagagtgtgggccatttcgggagtagcaagccattctgtgtgcttagcacatagctgatatttggccagagtcaggagaaatcggactagaagagtgagtatgcggccacccagcaaaatctcatgaacatctagctcaggagcttgtccttttgtgggaaacggtcggagggtttctgagcacagagcggccatcagagctccacgtcaggaagctcagcccacagcacgtggatggcagagtgatgggagaagagggcagagcagggagccagggagctctcggattgcacccgcctggagatgacccaccccaagcggagcagggaagggggctgcactcgccaactttgtgtctttcagggttgtttcatttacaaatgctatttgctttcccaagttcagtcataatttagacattttgaaatcatccttttgagtttcatgctaagagctctaagtttttatgttataaataagttaaccttgttgtttattgttgtaaaaaaccagatgaattgccaatttatgttaaaattatatatgtaggaattctctcaagaaacgtcacaatcttttctatttttttgtttttttttgttttttttttgtttgtttgtttgttttggtgagatggagtccttctctgcctcccaggctggaaggctggagtgcaatggcgcagtctcggctcactgcaacctccgcctcccaggttcaagcaattctcctgcctcagcttcctgagtagctgggattacaggcacatgccacaatgcccggctaatttttttgtatttttagtagagatggggtttcaccacattggccaggctggtcttgatctcctgacctcaagtgatctgcccaccttggcctcccaaagtgctggtattacaggcgtgagccaccgtatccggccaatcttttctatttcaaccttttctttttaactgtagcctgggaaatttttaacctgcaaaaagggtgggtccttgttgggtttcattttttaaaccatttggggattatatctaacgtaaatttatactggaaatcatcccagcagaaattctaataacagcagttcagcggacttcctagtaaattgtatttaatacccttaacagtaatatctgaaatgacaaaatataaaatgtttatattatggttatctatagatcatcagttggatataaaatatggacagaatcaaggccagatatgatggctcatgcttgtaatcccagcactttgggaggccaaggcaagaggatcgcttgagaccaggagtttgagaccagcctgggcaacagagtgagacctcgtttctattaaagaaacattttttaagatatgggcagaatcaaatgtttcctttacatttttcttctatcagtgtcttattttgttgtagtttctcctgaaatcagctgtttattcaggttatctatgaatgtgcaaaaaataaaacagttgcttttgttggattacaggcagaataatcccgattgcaattaaacactttaatttcaaaaaataatttctggctgggcacattggctcacacccatagtcccagcactttgggaggccgaggcaggtggattgcttgaacccaggagttcgagaccagcctggccaacatagcaagaccccatctctataaaaaaatttttttttcccagcttgaaaaagtttttgtctttataagcttctaactattggagtaagcttttacattcttccgaatagtagaataaataacacaggtgccattatcatgtaaatgtaatctttgctctagatcattagattttggctctatgtttttatcaatatttcttaaaaatagtgttggagggataataaatcatagaaaaataaactgtaagaaaaataggtggagaaaaggacttatctttcaatgtatatttctcagctatagggttgttaattttatgcatgtactctgctaatcaatagctccatcaggagtgcgacaggcttagtgcttcatttttctttgacagatttggatttgtcccaatgtgattgtatttgcttgtttgctgtctttaaccccagtttttttttttctctgtcttttaaaaaagcaacagggtcttgctctgtcacccaggctggaatgtggtggcatgatcataggtcactgcagccttgacctcctgggctcaagcaatcctcctacctcagcctctcgagtagctgggactataggcatgcaccagcacatccagctaatttattatttatttatttatttatttattttggagatggagtctcactctgtcacccaggctggagtgcagtggtgcagtctcagctcagtgcaacctctgcctcccgggttcaagcaatcctcccacctcagcctcccaagtagctaggattacaggcatccaccaccatgctcggctaatttttttgtatttttagtaaagacagggtttcaccctgttggccaggctggtatcaaactcctgacctcagatgatctgcctgccttgacctcccaaaatgctgggactacaggtgcatgccactacaaccagctaatttttgtatttttagtagagatagagtttcgccatgttggccaagctggtctcaaactctcgacttcaagtgatctgcccatctcagcctcccaaagtgctgttattacaggcgtgagccactgtgcctggcctgatgttttttttttttttttttaagagacaaggtcttgctatgttgcccagactggtctcaaactcctgggctcaagcgatcctcctacctctgcctctcaaagtgctgggattataggtgtgatccaccatgcctgacccctccagaagcaaattaatcttgcttctggtttgaacatgaggagttttcaaaatataatttaggtttttataacatgagaaatgggactgtttttttctgccttaggtcttggtgtttgaggggactcagtaaatgttagtgttagcagtcttctcagcaggacatcctgtacaaagaaatgcagtagaatctagtccccttgcaaagtactgccctttgtatataaaactgtttatctgacctcctcaccataggacatttgatttgtgtttctgattatggtggttgagggatattaagacatcactacttgttctgctgtcctgctctgtgatgggtgacactgagcatctcattgagttcccagtgcaaagcaacacctgttaaatgtttgttgaatgaatggattctgtaagatggttgttgaggcttagtgatgcaatgctatgatcgagaaacagaattgtgagctgagtgaggcaaaatagtacgtaggagatttaatctgaaattatgctcccagatacactggcctaaattcttttgtggcttgtataatcatatgcacaatttaaatcttcctttcaagctttgattctgtaccttccatttaaagaagtatcaaaaatattatttaagaaaagtaaatgatatttggaagctgagtgaagtgatcttatgatttttagactaaatcaattgtttgtacattctagcatagccttcagcccagaaaaagtagaatcctttaaggaaagtgatgttttaaatttgggaattaaaaaagaggattcaaaggaagaatatctctgttatagttaactgtgtttttaacagagcatgaaacatcctaaggtttcactaagtgtttgtttaattggttttatagtgctgttctggccaagaattagtaatttagttagctttgaggctcaattaaatactagagaatcatagtttagaattaagaaatcctagtcaagtctgtattttatacagtgggtttagagttatagacattgctacaaaacgttgttgaaagaaatttaaagaaggcacaaataaaggggaagacatccgtatctatggactggaaaacttaataacattaagatgtcagtacatacaccgtggaatactatgcagccataaaaaatgatgagttcatgtcctttgtagggacatagatgaaactggaaaccatcattctcagcaaactatcgcaaggacaaaaaaccaaacactgcatgttctcactcataggtgggaattgaacaatgagaacacaatgacacaggaaggggaacatcacactccggggactgttgtggggtggggggagggggaagagatagcattaggagatatacctaatgctaaatgacgagttaatgggtgcagcacaccaacatggcacatgtatacatatgtaacaaacctgcacgttgtacacatgtaccctaaaacttaaagtataataataataaaataaaaataaaataaaataaaattaaaagatgtcagtactacctaaagtgctctacagattcaactcaatccctatcaaaatcccaatgattttttttgcagaaatagaaaacctaccctgaaattcatatagaacctcaaggaatcccaaattgccaaaacagtcttgaaaacaaagaacaaagttggatgcacacttcctgatttcaaaactttagtataaagccatggtaatcaaaacagtgtggtactggcataaagacaaacatagagatggatggaattgaatagaaagcccagagacgaacctttgtatatatggtcaaatgattttcaacaaaggttccaagactattctgtgggtgaaaggacagtctcttttcaacaaaaggtgctgggaaaactgaaatccacatgcagaagaatgaagttgcatccttattttatatcaaataaaaaattagaatggatcaagctactcaggaggctgaggtgggaaaattgcttgagcgcaggagtttgaggccagcctggaaacgtagtgagaccccatctcctaaaacaaaacaaaacaaaaaaccaaagacttaaacgttagaattaaaactataaaactcttagaagatgcagtagcatcttcagagagaaggctcctctatgtgctggaactgtgctaccctctatggcacagctcataatagcatgcttttaaaagtatcatttaggctgggcaaagtggctcacgcctgtaatcccagcactttgggaatacaaggcaggtagatcacctgaggtcaggagttcgagaccagcctggcaaacatgatgaaaccccacctctactaaaaatacaaaaattagctgggcatggtggtatacgcctgtagtcccagctactcgggaggctgaggcaggagaatcgcttgaacctgggaggtggaggttgcagtgagctgagatcgtgccattgtactccagcctgggtgacaaagtgagattctgtctcaaaaacaaacaaacaaaaaaaatttttttaaaaaagaaaatagaatattggttgctggggggggtggggaaaatatttacagtttaatgtattgagagcttgtatgggatgatggaaaagttcaggagacagatagtggtgatggtcacacagtaagactgtacttaataccactgacttgtacatttaaaaatggttaaatgataaattttgtgttttgtatatttgaccacaataaaaataatgcaaaaagagcctatttttcttgagtttagtgttcttggtaatatgtatataccaagaatatatttttaaatatacacatacatatatttatacacacacatgtgtgtgcggtatgtatgtattggacacctgtttggctccactttaaccctcttttcacctagtcattgctggagcagccagctgtgtgcaggtgtgacctcacacctggcctgagctgccgtgtctttccatcccagcatttctgtgctgcctgaacaaggatgctcagccttattgatgcatgcacagacttggaagcatgagggagttaaagtcccatagggtagccctcaaccagtggaaaactaaacccggtgaataagctcctctgtgttctgacactgaagccaacagttctcaggcaggttcttactggctccccagcagatcaagccccagttgcccacagaggtgaccagcttgaaaacgcgacctggagggacagagaatgggcttgccctccttcccggtgccactgttcccaggcctccacgcttgtctcatggggtcacttcccaaaacaaacactcagcgtgtgtgcctttgccttgcctctgcttctccaaggagcccaggtaaggcacaggtaacgcttccaagtttggttatggttattcctcttatgtaaggcgctgttccagactctcaaaataaaaaaggcaatttttaggttatgcaaaaaggatagactaatataaaaaacacccacgtgcccacccaatttagcaaataaaattttactaatacagttgaatcccatgtctcctcccagagataaccatcatcctgaactcaggtttctcattttccacgaaatctgtaaactttaataggttgaaccatatgaaattgctatatttgttggtcaaaagtggtcaaatatcagcatttcttctgattgagcctgatattctgtgtgtatgtacacacacttttttttttttttgagacagagtctcactctgttgcccaggctggagtgtaatggcgcaatctcagctcactgcaaccttcacctcccgggttcaaagagttctcctacctcagcctcccgagtagctgggattacaggcacctgccactgcgcccggctaattttttgtatttttagtggagacggggcttcaccatgttggccaggctggtctcgaactcctgacctcaggtgatccgcccgccttggcctcccaaagtgctgggattttaaattatctgtatttggagtcgacatgattgtctctttagaacggaatctacataaaagctgttagaacgaataagtgagtttaggaagattgcaggatgtggggtcaatgtccaaaatcaactgtctctgtaacagtaaacatttggaaattgaaatatctatggatatttcaaaatccctaaatatatatacacatatatttacacaaatatgtatacacacacatatataaaggtatatcaaatctatattatttctaatacacacacacacacacacacacacacacacacacacacatatatattttttttcttcagatggagtctcattctgtttcccaggctggagtgcagtggtacaatctcggcccactgcaacctccccttcctgggttcaagcaagccaccatgcctggccatgaaataatgtaatatattttgagataagcatcttcaattaccttcaacgatatttgtagcttaagtatacattaacaaaatatgtgtatgatctgtatgctgaaaattatatgctaaactgtatgctaaaacactaatgaaataaatagtattttacatcatttaaaattttatatattggccaggcgtggtggcacaggcctgtaatcccagcactttgggaggccgaggtgggtggatcaccctgaggtcaggagttcgagaccagcctggccaacatagcaaaaccccatctgtactaaaaatacaaaagtgagttgggcatagtggtggtgcacgcctgtaatcccagctacttgggaggctgaggcaggagaatcgcttgaacctgggaggcagaggttgcagagagccaagatcgcgccacttcactccagcctgagagactgagaaaaaaagataaaaaataaggagttccaataagtcagagtttgtgtttataaatacagtagccattaaaacataaaaatccatcttgaatagctagcattccatattttcttgaattttaattcagttacaggtttctttctgatctggaaaaatgatgatggcaacataaataataaaggttatcaaaggtttttgcatttttcatatattctgctcccctctagcacttttgactgtaggtcccagaattttacaagtactcagattatcaaagtaaagtttttaaattcaccatgtctagctgtatgtgcacttttttctgtttagtaaagtccatctctctggctgttttagtcagtggtgattgatgagaaccaaaagcactttgcctacccccaggcagaaatggaggccttgcctttgatattagtggacctgcaggctctggacactggagaaatggaattttctagatcagatttacagaaagacgtagaatataaatctcttgccttaggatgctaaagataatttcactgctgaatggatcaagccattccttctcaagagtaaaatcgttcctcctactctgtttattttgttttcttttgtttttttttttttttttttgagacagggtctcgctctgttccccaggctggagtgcagtggcacaatcacagctctctgcaacctccgcctcccaggttcaagcaattctcgtgcatcagtctcccgtcctcccactctttaatgtttaatagaagtggtgggctcctcatttttttttcagtccaaagcaaaggtgtgtggcaaaatcatgttcccagtttgttcttcagtgaaacagctaaaccttgccttctccgaattgggatggggcaacagagtggagccatggtggatccagaaaggtcaggaaatacacacttggctgccatcctcatctgttgctccttgaaactgaccttcccatatggccttttccacttttctcctttactgatgcctattatccagctgtcaagcactctttcttaagttcccaagaaggttgatggttatgtgttgttcttagctattttaggtacaaggtatgtactgtcattttgatgactgactaactgcacaggtgatcttagcatatgaaggcagcttctggtctgtattttgtggaaaacctacttacatcataggaaaaagcctcaggcattggtttttaggctgcattgtttgtgttatgcctgtagacgttgtgctgccagagggggatactaagtgactacagaaaaagttaagtggttaatgatgatttttattttaatggaatccccattatcttttctcaaataaatatgcggccatcacccaacaggatgatgttaattttatatcattagagaattcagaaatttctaaaagtgagctatttctgaaataattctaaggagaaaaatagtcatttggtttttgaatgaacagctgcagatccttcctgtttatcgcaagtcattttcagtccattttcatagattatgtccttcccctgccgtctgcaatcttctaaatccctttcgtgctaatgccgggttatcaggggcagcctcaggaatctacatggggatgtctgtggactcacagaagggcaaagctaccagctgagggctcgtaaccatttttcacaaataggaaactgatggttttgcctccaagttaattcttcatgcttccaaagcacctcacagctagaattcacgtatttcataaccatatttatgctacttcaaggggaaaatgggtgtggaggagagagaaagaacacaaaactcagtaaaagcttgctaatcggttcttgcatggcttcatttttgtataattctttttaagagagagagacagggtctcactctgttgcccaggctggagtacagtggtgagattgtggctcactgcggcctcgaactcctgggttcaagcaatcttcccaccttagccaaccgagtagataagactacaagcgtatgccaccatgcctggctaattatttaattgtttgtagagatggggtcttgcagtgttgtccaggctggtctcaagttcctggcatcccacagtgctaggatgaatgggccactgtgcctggccattttgttataattcttaatcctatcacaggtattggattttggaagagagagagagagagcgccgtataacccattgctgtcatctgcatgttacattcagttacagtgtatttctggaatttgaaaaaaaaattatcttgaagggaaatgggaagaaggatatgattatcaagtaactgtttgcaagatagcttctgtcatacgatgcgttggtactaggaagaattcgttgtggggggctagggataatacatgagccttttcccttgggcaaggaaaatgtttaatgtacagaattacaaagtactaatattttataagctattctttcttaattagttcttccttaatttccattgtgttcaatgttaatatttcttaactatctcacataggaattttagtattttcttaatgtttaaaatacatttaaaataagctaataccaagaaccaaatgggatgtgattttgcaaaatctcaattctaattctctttaaaagcgacaaagctagccacctttgaaatggatgctaaagaaactttgaaatgtatccagaagcaataataattatcagcatttaatatacttacatattcaccttcccttttaagaactgatatgctactttaaaatccttactatatctatataatattttgttatttatgtatattacttttttttgagacagtcttgctctgttactcaggttggagtgcagtggcgtcattttggctcactgcaacctctgcctcccaggctcaagcaattctcatgtctcagcctccagagtaactaggactacaggtgtgtaattttgcatttttagtagagatggggtttcaccgcattggccaggctggtctcgaagttgatccgcctgcctctgcctcccaaagtgttgggaatacaggcgtgagctaccgcgcatggctttctgtattactttaatatatggaaacacgatagtaaataagagtaggattaatcttaaaactgccccctgctggaagcagcttgcagtccactgaaaagccagactgagtagaaggtctgacataatatatttttttaaatgaattgacaaaaaatacatagtttttaggataaatgatgtttcctcaataatgaaggatatttgaacactggaagaataaatattggtgcacaaattattttatattttatctagttggagaaatgttgcaaagtggcaggtaaatgttcaaattgagagaagttaataaatgagggagtgtataatttgcacttcaggatcaacagatcattgaaagatctttacataggcgaagcaagaacaaagctaatttataggttccttttattgtgttaccattgccaagcctaaggaatatttctaaaggtattgagaagtttcttggatccattttattgcatttcatttattaaactattgcctaaatatgttttctgtaaagaaaatttaatgttgcttttcttctagtgattgaaattaggcttttcattatcccaattcattaataaatgggaaaataatttttttctcagcctcatgaacgactcaaatattgctctctttctttttctctagtccatctcaaaatactcaggagatatacacgtactgcaaattatataaaataatttgtgctcagatattcttccaatgcttttcaccccaaaatgcattttttgtggaattacatagtcccagtatgaattttgagaaaaaggtttgattgttttgcctttgtgaaagagaaactgtggctatagggagttaggcatctttaaagaagttgccaaacgtacattagcatctttcatgggaatttcattcaggggaggaaaatagagaaagagaaaaaatagttggaaaaaaagaaaaaaaaaaaaagaaaaaaagaaaaaggaaatgaacacagaaaatctgagacaaacagataaaataagatggtagacatcccaaaatatcagtaatcaacaatggactagttcctctagtgaaaagacagtgagtgtcaaactgtgtttatttacatacaggcacacacatgcattatacacacatgtattctttttatgaggcatatctaaaacataaggatacagaaaggttagaagtaaaggctgaaaattgatctccatgcaatacataatcaaaagaaagctacaccagctatattaatgccagacaaaatagactttaagacaaagggcattcctttatctggaagacgaagagggtcactacctaatgattaaaagttccattcaccaggaagagaaaaaaatcataagcttgtatgcacatgataacttagccttaaaaggtaggaagcgaaagtgaccaaatgtacgaaaaaataacacatccacctaatagtgggagaatctaatagatctttcctgataatagttgaaacagacccccaaaaaatcaggatatagaacttgtaaagcacaggagctggatatactgaacatgtttataatactgtaccaaacagctgcgcaaacacactctttgtaagcacatgtagatttatgaaatttgatgacactgaaccaaaagcaagcctcaaactgtcaaaggattactatcactgtggatagcctactccaatcagagggaaaatgagttagacattaaaaagataaaaaactcccatctatttgcaatttgagaaacatacatctaaataattcatgagacagggagagatcataagggaaattagagagtatttagaatcaactggcgcagttgctcacgtctttaatcccagcactttgggaggctcaggcagaaggatgcttgagcccaggagttccagaccagcctgggcaagacattgagactgtgtctgtacaaaaataaaataaaattagccaggtgtggccaggcatggtggctcatgcctgtaatcccagcattttgggagggcaaggtaggaagattgcctgagctcaggagtttgagaccagcctgcgcaacatagcgagacttcatctcatttaaaaaaagaaaaaaaaagaaaaaaagccagttgtggtggtgcctgctactcaggaggctgaagtaggggcgggtggcttgagcccaggagtttgaggctgcagtgaactctgatcacaccactgcactccagcctgggtgacagagagactctgtctctcttttttttttttttttttaggacagagtctcgttctgtcacccaggctggagtgcagtggcaggatcttggctcactgcaacctccgcttcccaggttcgagcaattctcccatctcagcctcccgagtagctgggattacaggcgcccaccaccatgcccggctaatttttatatttttagtagagacagggtttcaccatgttggccatgctggtcttgaactcctgacctcaagtgatccgcctacctcagcctcccaaagtgctgggattacaggcttgagccactgtgccctgccttctattttaaaaaataaataataaaacatatcaaaactgttcaggtgctgggtgtggtagcacgtgcctctactcccagctatttgggaggctgaggcaggaggatcacttgagcccaacttaggcaatatagcaagaccccatctcaaaaaaaaaaacaaaacaaaattaaacgaactggtggagaacagctgaaacagtacttagaaatggatgtcttgctgggtgtagtggctcatacctataatcccagcactttgggaggtcaaggaggatagatcacttgagcccaaggagtttgagaccagcttgggcaatgtggcaaaaccccatctctactaaaaatacaaaaaattagctggatgtggtggcaggtgcctatagtcccagctacccaagaagccgaggcaggaggattgcctgaaccctagaggttgaggctgcagtgagccaagattgtaccactgcacctcattctgggcaacagagtgagactcttatctccaaaaaaaaaaaaaaaaaaaaaaagacagtcacacacaacagcaagggagaacctcaggagcaagatctaagcaaaaaaagcaagttgtggaagaatacctataacatgataacatttttagagatacaaatagatgttgtaaactctaaagaaaagcaagggaatgataaaattccagaaatgacaactttgaaggaggaaaggaatgtgacagagggaaaaaccaaccttgtcccaccggggacatcagaacaatagcagtgttctagaattgggcatgtttgtatcattctcttatatcttgcattcattttataacctttgaatatggacaatatttaataaagttaattacatttaaaataagtgcacgacccagcttggtggctcacgcctgtaatcccagcactttgggaggcccaggtggacagatcacttgaggtcaggagttcaagaccagcctagccaacatggtgaaacccatctctactaaaaatgtaaaaattagccgggcatggtggccggcccctataatcccagctactttggaggctgaggcaggaaaatcacttgaatccaagaggtggaggttgcagtgagctgagatcacaccactgcactctagcctggataacagaatgagactccgtctcaaacaaatacataaagtaagtgtaattgctaaattacaggatacctgttcttgtatatgtgcaagaaaagtatactttttttggagaaaaggttaacttataatgagttcttaattaggtttcatgatttaaatttccccttctgttaaaggtttttcttttttttttttcctccccttccctttgccttgctgctccttaattgtaggaaagatttgaagcactcttcaccatctatgatgaccaggttacttttcagctgtttaaaagctttagaagagtcagaataaatttcagcaaacctgaagcggcagcaagagcgcgaatagaactccacgaaacagacttcaatgggcagaagctaaagctatattttgcacaggtacttcaccgtgcagagaacactgttctctaaacttgtttttctccatccaaaaatatttttatttcaccgttttctatattattatagcagaggtgtgtagagtgaaccatctcaatcagcaaataatacaaaaatattttccctttattttatagatacataatttcgtgtatttattaagcacatttacctcctaagttgttttgctgagactagtagttgaaggagttgatttttctggcagctttgctcaactgggactctgcgtgggttacgccctgacaccctagtgttcggaaactaacttctctcctgtgcatctagaatggtatacatgaaataagacatgaaatccttgggaaaactgagaaaatggtctcttaaatcatttccataattcatatgaggaaccagggaggtcacggaactgtacaaaagggctgtcttcgactttgaaattgcagaggaccctgtagggtaccaaaaattggctacgcttagtatattctaatcctgcattggtgtgactctctgagaaaccaatttcttctgagaagagtgggcaaaatcaggagattactcgtgtattaaatgcactgttttattttcaaaacatttttttcagtctcccttacaaattaaaaaaaaaaggtttgttttcttgccttccacgtaaaaacctaaatgaaagagatgtcttgacgtttcttggtagagtctcttgagatggagtacaaataagtccatataacctaatgtcttctaagattggaatttagtagttgctgtcgttcatttctctcttcatccatttatttatttatttattatttttatttttttattttttgagatggagtctcactctgtcacccaggctggagtgcagtgatgcaatctcagctcaccacaacctccgcctcccaggttcaagtgattctcccgcctccgcctcccaagtagctgggactacaggcatatgccaccacacctagctaatttttgtatttttagtagagatagagtttcaccatgttggccaggctgatctcaaactcctgacctcaggtgacccacccgcctcggcctcccaaagtgctgggattacaggtgtgagccaccacacctggcccatccatttattttttatgcagttaatattcatgaagcacctactgtgtgtggccatgtgctgtacactgagtggccagtggtgagccaaacagacccagtcccacccttttggagattatagactgtttacaagaaataggccaggcacggtggctcacacctgtaatcccagcactttgggaggccaaggtgggcggatgatgaagtcaggagatcgagaccatcctggctaacacagtgcaaccccgtctctactaaaaatatgaaaacaaaattagccgggcgtggtgacatgcacctgtagtcccagctactcgggaggctgaggcaggagaatgtgaacccgggaggtggagtttgcagtgagctgagattggaccactgcactccagcctgggcgacaaagtgagactccgtctcaaaaaaaaaaaaaaaaaaaaaaaaaaagaaatgtttaattttctacaaaaagatggaacagtcaacataaaggtgaaaatgaagaaaacatagcccggtttgcaaactggctttgagcgtctcgctccctgcaggtgcagatgtccggcgaagtgcgggacaagtcctatctcctgccgccccagcctgtcaagcagttcctcatctcccctccagcctctcccccggtggggtggaagcagagcgaagatgcgatgcctgttataaattatgatttactctgtgctgtttccaaattgggaccaggtaataaacttctatttttcctattttcttccccaagaaacttttgtattgaagatcgtattcagcagtgtgcattgtggcagtatgattagagcagaggataaagtcaaacacacctgggttcagattccagctgtggcatctgcttgctctgtgatcttgaacaagttacttagcctccattttctgagcttctgcttttccatctataaagcagggagaatcatatgcaccattcagtgtggttataagtactaaatgagggccaggtgtggtggcccacgcctgtaatcctagcactttgggaggctagggtgggcggattgcttgaggtcaggagttcgagaccaacctggccaacatggggaaaccccgtctctactaaaatataaaaaattagctaggcatggtggcgtacgcctatagtcccagctacttgggaggctgaggcaggagaattgcttgaacccaagaggcagaggatgcagtgagccgagatcgtaccactgtactccagcctaggcaatgaagcaagactctgtctccaaaaaagtaaaaataaaaaattaagtattaaatgatgtatagataatactcagtaaatgtaactaatttttactactacagattttgctagtacttgataggcagttagtgaatatgaggtgccttctctccccagccccaccaagtatcagacaaacaacaactactttgaatatattacaaggaattggtggtgatatcatctcactccttcaatatttttgtcatttctttttcatttcctttttccttctctttactttctctacctctcttccttttaaaatcatataagaaaccgatgtgatgctggttcagacagttgtccacccaagacagagttatgtctcttgtaggggaataaaagaggcattttgaggaagaagtgattcagtgctgtttttagacgttagagctgtgtcttagatatccaagttcctataatcaagggagtgcctatgctgcctggatccttacaagtatctcccaaactgaaaccattatgatgtcagagtcacttggctgggtgcggtggctcacacctgtaatcccagcactttgggaggccaaaacaggcagatcacctggggtcaggagatcgagaccagcctggccaacatgataaaaccccgtctctactaaaaatacaaaaacaaattagccgggcgtgatagcgggcgcctgtagtcccagctactcgggaggctgaggcaggagaatggcgtgaacccgggaggcggagcttgcagtgagccgaggtcgcaccactgcactccagcctgggcgacagagcaagactccatctcaaaaaaaagaaaaaaaaaaaccatctcgactgaaaatacaaaaattagctgggcgtggtggcacacacctgtagtcccaactactcgggaggctaaggcaggagaatcgcttgaacctgggaggcagaagttggagtgagccgagatcgtgccactgcactccagcctgccgacagagcgagactccatctcaaataaataaattaattaattaaacagattaactcatattattcataaaacaataattagcatttgcattttaactcccaagacttcagtactgaaacaacattttatacaagccttaaagtatcaaatctttaacaccaaaacaagataaaatactctaacatagtatttaaagatttaaagaacaagaatcacccattaaaataggagtagaacaaaaagttgcaagggacaaaagagttctttttgctggaagtgatgcttttgtcatggttattttgtttgcctctgcaggagagaaatatgaacttcacgcgggaacagagtcgacacccagcgtggtggttcatgtctgtgaaagtgaaactgaagaggaagaagagacaaaaaaccccaaacagaaaattgcccagacgaggcgccccgaccctccgaccgcagcgttgaatgagccccagacctttgattgcgcgctgtgaggcccttggttgtggtgcgaggcggctgccctggtgggctctggccatggcgctctgtgcctgcggccgatgcgttgctgcgaacagcataggtgagactctgccgagtgaggtataggtcttctcaccacgcctgtactgcagacacggtcgtgtagagtagcagctgatttgacctgtcccagattttaagtgatattccaaaagggactttacattaaaggagaagcccccaagatgtggccacccttaaccatttttaaatagtaacaaattaggaaaacagctcccctcccctccagccatgtaagtcctcctgattctgtatcacatgagacaccaaaaactggaaatgtagtcacacccagtacagtaccatttttatgaatttaaaaatagtcttataattttaattgtttgtgggtatttttctactggtataaatagcttctaattaataaatcgatcaaaggttgttactcagtatacatgaaattttttgcaggaaaagaaaccagaaatacagaataattcatagaaatcatggttctcaagtatttgttcaattagctttggggaagaaatgccaaatccactttgaggatgagtcttacgacacagatccacccacatgttgctcttatctggaatttgggacaaagcaatgcacaggccctcattcctgatgtggcgccctccagacatggctgcccaggaaggacggccactttagaagtgggacgtatcaccagtaagcttgaatgattaggatcgcaggtggctactgcattctgccgttcgtgaccgtgttctagcctgtagaccacccagctaccttcattcaccagtttttatccttcaccttttccagtatcttgttaaccactagttcttgagttttttggctatgatgtgtacgtttatgtatgtcattcatggactttcaactagaaaaggtaatgataaggttttctgaagaccatttgtaaattgtccatttaaccatttttcagcttgctttgaaacaaaagtcacacctactatttttctatgaattagggaatgagggggagatcattcagttttacttttctttttgttgaaattttgtacccggattgcagttggcacttttcctaaaacagaattgtttcccacttaggtgtcagaatgtacctttgaacttccctaagaagcagcaggatctttttaactctctctggtctgtttagactttgaagtcccttctgtagaaaagtctcataactgagaaggctctgttttgggccgggtgggtctgctggcctccactcactgtgctgtttcctttgagtggcacacttgggaagctccggggcatgtgaaggagctgcaaacatgagaactaatgaaccaaggcggctgccaccaggaaggaacagaacgcaggcattcaaccatgacgtctgcacagtgttagtaacatgtcattgtggtttcgttctcactgtggtaaaatttatttctgagcacttaaactgtgttgcatacccctaattttttttttttctgtatcttccttgccctcaaataccctgaggtgataaactgttccagttgtagccaactaccactgctaggcctcaatgtaaattcagttgaaatttgcaattctatcagcaatttaatgtattgaattcagatcatcatttgtcattttaaccgacaaccacccaataaatttactctgcagttctgaactcagcattgtgcccattttttactgcaagatggaccctgtatgccaggagacatgtattatcaacaattgggaattttttgaatttccttttaggtaatattgattcactgtaattttctaagtgatcaaaacccatgagattttgttatttggcttggctttcattctctgcctgcccattaaagaatattctattcctaacacataaaacattttacagtcaagcagtgcaaattacagtgcttttctattttttttttgagagccttgaataaattgaagaaaactttaaaccaaaattagagacgagtcatttaagcttttctgaatggaaagtattaatattttcatttttctagtataatataataaaatgaatttttttaaaaaagctactaagtacccatcaactttttcatattgtgaaatgaaccaggatcttaacagatactatcatcgctgtccttttttggctgtttaatatctagttcatgtaacaaatttacaagagataagtctcatggttttttttttcttttaataggcttttctgcaatttttttgaaattgagttattacttggatttaaccctgataggaccaggtgtggtggctcacaccataatcccagcactttgggaggccaaggtgggtggatccacctgaggtcaggagttcaagaccagcctgaccaacatggtgaaatcctgtctctacttaaaaaatacaaaattagcctggcatggtggcacatgcctgtaatcccagctacttgggaggctgaggcaggagaatttcctgaaccgggagacggaggttgcggtgagccgagatcacgccatcgcactccagcctcggcaacaagagcgaaactccgtctcaaaaaaaaaagatttaaccctgattgatagtatagtagccatgttttctttagaaatcataacctcttcatgggaatcaaactatgttgaaaattgtgaggaaagataatggtgctttgtgttgggaaaaaaacatttgtgaaggattagaaaaccgtaacacttaacaaggatagtcacagaaccgacgctgcattggctcttaggttctagatttttgtagcacactcacctgatgaaaccaaagacaaatccatgtaaaaagtgttccagtgagcatctctgaggtttaaggtactaagaggcagaagtggatagcaacagttccattgccttcgagaactaaaactcagctggaaagcaaattagtcttttcacattctgcttcttcaaaatgttgtactcaaaaacataccagtaattaagagccaaagcaaagcttcaaggaacttttaagttcaacataaaggtttaaataaaatattttttattttttatttttatttatttatttatttattttgagacagagtctcactctgtcgcccaggctggagcgcagccgcgtgatctcggctcactgcaagctccgcctcccgggttcacgccattctcctgcctcagcctcccaagtagctgggactacaggcgcccgctcccacgcccggctaattttttttttttttttttttataagtagagacggggtttcaccacgttagccaggatggtctcgatctcctgacctagtgatccgcctgccttggcctcccaaagtgctgggattaaccaggcgtgagccactgcgcccggccttaaataaaatattgtagtcattaatggtgtgtttgaattgaagagataccaggagatagaggtgaagtgcagtacttttattctttaagaatatagtctttagccaggtgcagtggtgtgtgcctgtagtctcagctatttgagaggctgaggtgagaggatcacttgagttcaggagttcaagaccagcctgggcaacatagcaagtccctggctcaaaaaaaaaaaagtttcccattcatattaactccatcttttaaaaatgtcatgattacaaagtgaaaagatttggctttcttagaggctcaatcacagaggtgaaagtgaccttggaaatcatatactctatccccatgttacacagattagaaaaactgaggttatggcactgacttaggcacccccagcaaggcaacccagggactacaactggcaatcccaactcctgggctagggctttttctacctttttttgcattggcctcttaaagaggcaatgaatactaattcctggcatcagaaaaaaaaaaaggcatgaggtgggaggattcttttttccctgatgggaaacagtgaataagaaaaatctcatcattcgatggaagaggtgacttaataattttattaatgaatttgatgtcccatgttttgtagttttgttatcattgaaccattggggctggaatctgcctaaataattttatcttggtagccagcaattatgttggtattttatgtgggccttcccagattttcatattaatgaaatgactaatagtcgtacttaagaggtaactctactaaagcagaatgagatctaatatgttgtggaaataaaagagtttgcagtggaatgatactctcactccgtgcttgtaaaattgagttctattcaagacggaactgctatgactggcctattcaaggcttcatatttttatacagactatttcacagaccatagatttattttaaaagggaaaatctcacacataattaagcagtggaaaatgtgctcaatgctatggtgcgtcaggccctctgtctaccaggtttctcccctttctgcagagctgtggaccctgtacgtaccaaacaggtgaacttggtccatctttccttcttcctttttttgcacatttgcatttatatcttcctgtactaaaagaaacaaattatttataattggggtgacaatataaaggaacaaaagatggggcaatagttgcttcctagctggagctgtaagtccatgttacagaaactcactatttaaaaagttttaaaagatttatgaaccttgtcctacaattcgctgaatacttatttgtcttttaaactcccctcggtgtatggatcatcttcgtcagaatgccgttgtttcattgtgaatcaggggaaaatgttaatcatttggagactgttttcttattaccaaatgtacaatccataagacaactgaaagcaacaactgctgggttcactgacaaagattataaaaatcatcacgttcaaagtagagtttttagccaaggtcaagaactaacctggggctgagtcagcgtctctacccacttaaataacagcgtaaagatctttcactaaattcgttatgtggtctgtctggatgtaaacctatatatttccttttgaaacagaatcatatcctgcagactcttggcactcctgcatagctttgaccgaatgttcactctcatcgtaatggaagatttctatctatgcagataatacatgtttttaaatactgttttctgtttagtcctcaatcttcctaactcaaattggggactgaggagagagaaaggtggttacccctgttaccgtgccatattcttcttgctgcttttcaaccccacgtgattgttgattgacggttctgctataatgtgcgtgcccttcaagtttcagaaaactttcccaatcatttcacttcaatcttaattgaacccaagagtcaaagttattattttctccgaacgtgtttgtgatcttctgttatattttggggcatgttacctttatggtatataagctgtagtgcatactctttgtattgcaaaaaactggtcagtaatttatgtacatgtattccacattttagtgtgcttgaagtgacaatccatagtttgtagtagtttgttatttgtcaactttaccctgtgttttaaggacatctaaacattccttgtcctatcaagatgacaaaagcagaatgtaatttttttttggaagcttcgtgattacctgtaacaagttctgtttttaaaacgaatacaaataaagttagtaactatttttaaatcag

SEQ ID NO: 11488 - DNA, 3866 bp, Homo sapiens
cctccagcctctcccccagtggggtggaagcagagcgaagatgcgatgcctgttataaattatgatttactctgtgctgtttccaaattgggaccaggtaataaacttctatttttcctattttcttccccaagaaacttttgtattgaagatcgtattcagcagtgtgcattgtggcagtatgattagagcagaggataaagtcaaacacacctgggttcagattccagctgtggcatctgcttgctctgtgatcttgaacaagttacttagcctccattttctgagcttctgcttttccatctataaagcagggagaatcatatgcaccattcagtgtggttataagtactaaatgagggccaggtgtggtggcccacgcctgtaatcctagcactttgggaggctagggtgggcggattgcttgaggtcaggagttcgagaccaacctggccaacatggggaaaccccgtctctactaaaatataaaaaattagctaggcatggtggcgtacgcctatagtcccagctacttgggaggctgaggcaggagaattgcttgaacccaagaggcagaggatgcagtgagccgagatcgtaccactgtactccagcctaggcaatgaagcaagactctgtctccaaaaaagtaaaaataaaaaattaagtattaaatgatgtatagataatactcagtaaatgtaactaatttttactactacagattttgctagtacttgataggcagttagtgaatatgaggtgccttctctccccagccccaccaagtatcagacaaacaacaactactttgaatatattacaaggaattggtggtgatatcatctcactccttcaatatttttgtcatttctttttcatttcctttttccttctctttactttctctacctctcttccttttaaaatcatataagaaaccgatgtgatgctggttcagacagttgtccacccaagacagagttatgtctcttgtaggggaataaaagaggcattttgaggaagaagtgattcagtgctgtttttagacgttagagctgtgtcttagatatccaagttcctataatcaagggagtgcctatgctgcctggatccttacaagtatctcccaaactgaaaccattatgatgtcagagtcacttggctggatgcggtggctcacacctgtaatcccagcactttgggaggccaaaacaggcagatcacctggggtcaggagatcgagaccagcctggccaacatgataaaaccccgtctctactaaaaatacaaaaacaaattagccgggcgtgatagcgggcgcctgtagtcccagctactcgggaggctgaggcaggagaatggcgtgaacccgggaggcggagcttgcagtgagccgaggtcgcaccactgcactccagcctgggcgacagagcaagactccatctcaaaaaaaagaaaaaaaaaaaccatctcgactgaaaatacaaaaattagctgggcgtggtggcacacacctgtagtcccaactactcgggaggctaaggcaggagaatcgcttgaacctgggaggcagaagttggagtgagccgagatcgtgccactgcactccagcctgccgacagagcgagactccatctcaaataaataaattaattaattaaacagattaactcatattattcataaaacaataattagcatttgcattttaactcccaagacttcagtactgaaacaacattttatacaagccttaaagtatcaaatctttaacaccaaaacaagataaaatactctaacatagtatttaaagatttaaagaacaagaatcacccattaaaataggagtagaacaaaaagttgcaagggacaaaagagttctttttgctggaagtgatgcttttgtcatggttattttgtttgcctctgcaggagagaaatatgaacttcacgcgggaacagagtcgacacccagcgtggtggttcatgtctgtgaaagtgaaactgaagaggaagaagagacaaaaaaccccaaacagaaaattgcccagacaaggcgccccgaccctccgaccgcagcgttgaatgagccccagacctttgattgcgcgctgtgaggcccttggttgtggtgcgaggcggctgccctggtgggctctggccatggcgctctgtgcctgcggccgatgcgttgctgcgaacagcataggtgagactctgccgagtgaggtataggtcttctcaccacgcctgtactgcagacacggtcgtgtagagtagcagctgatttgacctgtcccagattttaagtgatattccaaaagggactttacattaaaggagaagcccccaagatgtggccacccttaaccatttttaaatagtaacaaattaggaaaacagctcccctcccctccagccatgtaagtcctcctgattctgtatcacatgagacaccaaaaactggaaatgtagtcacacccagtacagtaccatttttatgaatttaaaaatagtcttataattttaattgtttgtgggtatttttctactggtataaatagcttctaattaataaatcgatcaaaggttgttactcagtatacatgaaattttttgcaggaaaagaaaccagaaatacagaataattcatagaaatcatggttctcaagtatttgttcaattagctttggggaagaaatgccaaatccactttgaggatgagtcttacgacacagatccacccacatgttgctcttatctggaatttgggacaaagcaatgcacaggccctcattcctgatgtggcgccctccagacatggctgcccaggaaggacggccactttagaagtgggacgtatcaccagtaagcttgaatgattaggatcgcaggtggctactgcattctgccgttcgtgaccgtgttctagcctgtagaccacccagctaccttcattcaccagtttttatccttcaccttttccagtatcgtgttagccactagttcttgagttttttggctatgatgtgtacgtttatgtatgtcattcatggactttcaactagaaaaggtaatgataaggttttctgaagaccatttgtaaattgtccatttaaccatttttcagcttgctttgaaacaaaagtcacacctactatttttctatgaaattagggaatgagggggagatcattcagttttactttttctttttgttgaaattttgtacccggattgcagttggcacttttcctaaaacagaattgtttcccacttaggtgtcagaatgtacctttgaacttccctaagaagcagcaggatctttttaactctctctggtctgtttagactttgaagtcccttctgtagaaaagtctcataactgagaaggctctgttttgggccgggtgggtctgctggcctccactcactgtgctgtttcctttgagtggcacacttgggaagctccggggcatgtgaaggagctgcaaacatgagaactaatgaaccaaggcggctgccaccaggaaggaacagaacgcaggcattcaaccatgacggtctgcacagtgttagtaacatgtcattggggtttcgttctcactgtggtaaaatttatttctgagcacttaaactgtgttgcatacccctaattttttttttttcggtatcttccttgccctcaaataccctgaggtgataaactgttccagttgtagccaactaccactgctaggcctcaatgtaaattcagttgaaatttgcaattctatcagcaatttaatgtattgaattcagatcatcatttgtcattttaaccgacaaccacccaataaatttactctgcagttctgaactca

SEQ ID NO: 11489 - DNA, 241 bp, Homo sapiens
gagttgggcggatcaccaggtcaggagatcgagaccatcctggctaacacagtgaaaccccatctctactaaaaatacaaaaaattagctgagcgtggtgtcgggcgcctgtagtcccagctacctgggaggctgaggcaggagaatggtgtgaacccgggaggcggagcttgcagtgagccgagattgtgccactgcactccagcctgggtgacagagcgagactctgtctcaaaaaaaa

SEQ ID NO: 11490 - DNA, 102 bp, Homo sapiens
gggaggtggagtttgcagtgagctgagattggaccactgcactccagcctgggcgacaaagtgagactccgtctcaaaaaaaaaaaaaaaaaaaaaaaaaaa

SEQ ID NO: 11491 - DNA, 2935 bp, Homo sapiens
tcctcacctgtggctctctttctagcccccaccatgccgtggcccctgctgctgctgctggccgtgagtggggcccagacaacccggccatgcttccccgggtgccaatgcgaggtggagaccttcggccttttcgacagcttcagcctgactcgggtggattgtagcggcctgggcccccacatcatgccggtgcccatccctctggacacagcccacttggacctgtcctccaaccggctggagatggtgaatgagtcggtgttggcggggccgggctacacgacgttggctggcctggatctcagccacaacctgctcaccagcatctcacccactgccttctcccgccttcgctacctggagtcgcttgacctcagccacaatggcctgacagccctgccagccgagagcttcaccagctcacccctgagcgacgtgaaccttagccacaaccagctccgggaggtctcagtgtctgccttcacgacgcacagtcagggccgggcactacacgtggacctctcccacaacctcattcaccgcctcgtgccccaccccacgagggccggcctgcctgcgcccaccattcagagcctgaacctggcctggaaccggctccatgccgtgcccaacctccgagacttgcccctgcgctacctgagcctggatgggaaccctctagctgtcattggtccgggtgccttcgcggggctgggaggccttacacacctgtctctggccagcctgcagaggctccctgagctggcgcccagtggcttccgtgagctaccgggcctgcaggtcctggacctgtcgggcaaccccaagcttaactgggcaggagctgaggtgttttcaggcctgagctccctgcaggagctggacctttcgggcaccaacctggtgcccctgcctgaggcgctgctcctccacctcccggcactgcagagcgtcagcgtgggccaggatgtgcggtgccggcgcctggtgcgggagggcacctacccccggaggcctggctccagccccaaggtggccctgcactgcgtagacacccgggattctgctgccaggggccccaccatcttgtgacaaatggtgtggcccagggccacataacagactgctgtcctgggctgcctcaggtcccgagtaacttatgttcaatgtgccaacaccagtggggagcccgcaggcctatgtggcagcgtcaccacaggagttgtgggcctaggagaggctttggacctgggagccacacctaggagcaaagtctcacccctttgtctacgttgcttccccaaaccatgagcagagggacttcgatgccaaaccagactcgggtcccctcctgcttcccttccccacttatcccccaagtgccttccctcatgcctgggccggcctgacccgcaatgggcagagggtgggtgggaccccctgctgcagggcagagttcaggtccactgggctgagtgtccccttgggcccatggcccagtcactcaggggcgagtttcttttctaacatagccctttctttgccatgaggccatgaggcccgcttcatccttttctatttccctagaaccttaatggtagaaggaattgcaaagaatcaagtccacccttctcatgtgacagatggggaaactgaggccttgagaaggaaaaaggctaatctaagttcctgcgggcagtggcatgactggagcacagcctcctgcctcccagcccggacccaatgcactttcttgtctcctctaataagccccaccctccccgcctgggctccccttgctgcccttgcctgttccccattagcacaggagtagcagcagcaggacaggcaagagcctcacaagtgggactctgggcctctgaccagctgtgcggcatgggctaagtcactctgcccttcggagcctctggaagcttagggcacattggttccagcctagccagtttctcaccctgggttggggtcccccagcatccagactggaaacctacccattttcccctgagcatcctctagatgctgccccaaggagttgctgcagttctggagcctcatctggctgggatctccaaggggcctcctggattcagtccccactggccctgagcacgacagcccttcttaccctcccaggaatgccgtgaaaggagacaaggtctgcccgacccatgtctatgctctacccccagggtagcatctcagcttccgaaccctgggctgtttccttagtcttcattttataaaagttgttgcctttttaacggagtgtcactttcaaccggcctcccctacccctgctggccggggatggagacatgtcatttgtaaaagcagaaaaaggttgcatttgttcacttttgtaatattgtcctgggcctgtgttggggtgttgggggaagctgggcatcagtggccacatgggcatcaggggctggccccacagagaccccacagggcagtgagctctgtcttcccccacctgcctagcccatcatctatctaaccggtccttgatttaataaacactataaaaagttctttgctttactcagccagtgtccactggcaatccctgggctgggctctggggccacaaagatgaatcaggttaggccctgccctgggcagcttgttctccctgaaaagcctgataatctcaggatttggggagtaaggtgacgtgaaggagggagttcctgcaccctgttcacctctcatctcccgtggccctaccccactgttcctgccaccccagctccagccatagccatgagcatgcaggcccttgcacacctgttctcttgctcaggcgttactgtgggaccttgcccttgccctcacccctgtctctcaacctccttcctatccagtagacctagttcttgcccgcccgcagaagcttccttggccc

SEQ ID NO: 11492 - DNA, 2935 bp, Homo sapiens
tcctcacctgtggctctctttctagcccccaccatgccgtggcccctgctgctgctgctggccgtgagtggggcccagacaacccggccatgcttccccgggtgccaatgcgaggtggagaccttcggccttttcgacagcttcagcctgactcgggtggattgtagcggcctgggcccccacatcatgccggtgcccatccctctggacacagcccacttggacctgtcctccaaccggctggagatggtgaatgagtcggtgttggcggggccgggctacacgacgttggctggcctggatctcagccacaacctgctcaccagcatctcacccactgccttctcccgccttcgctacctggagtcgcttgacctcagccacaatggcctgacagccctgccagccgagagcttcaccagctcacccctgagcgacgtgaaccttagccacaaccagctccgggaggtctcagtgtctgccttcacgacgcacagtcagggccgggcactacacgtggacctctcccacaacctcattcaccgcctcgtgccccaccccacgagggccggcctgcctgcgcccaccattcagagcctgaacctggcctggaaccggctccatgccgtgcccaacctccgagacttgcccctgcgctacctgagcctggatgggaaccctctagctgtcattggtccgggtgccttcgcggggctgggaggccttacacacctgtctctggccagcctgcagaggctccctgagctggcgcccagtggcttccgtgagctaccgggcctgcaggtcctggacctgtcgggcaaccccaagcttaactgggcaggagctgaggtgttttcaggcctgagctccctgcaggagctggacctttcgggcaccaacctggtgcccctgcctgaggcgctgctcctccacctcccggcactgcagagcgtcagcgtgggccaggatgtgcggtgccggcgcctggtgcgggagggcacctacccccggaggcctggctccagccccaaggtggccctgcactgcgtagacacccgggaatctgctgccaggggccccaccatcttgtgacaaatggtgtggcccagggccacataacagactgctgtcctgggctgcctcaggtcccgagtaacttatgttcaatgtgccaacaccagtggggagcccgcaggcctatgtggcagcgtcaccacaggagttgtgggcctaggagaggctttggacctgggagccacacctaggagcaaagtctcacccctttgtctacgttgcttccccaaaccatgagcagagggacttcgatgccaaaccagactcgggtcccctcctgcttcccttccccacttatcccccaagtgccttccctcatgcctgggccggcctgacccgcaatgggcagagggtgggtgggaccccctgctgcagggcagagttcaggtccactgggctgagtgtccccttgggcccatggcccagtcactcaggggcgagtttcttttctaacatagccctttctttgccatgaggccatgaggcccgcttcatccttttctatttccctagaaccttaatggtagaaggaattgcaaagaatcaagtccacccttctcatgtgacagatggggaaactgaggccttgagaaggaaaaaggctaatctaagttcctgcgggcagtggcatgactggagcacagcctcctgcctcccagcccggacccaatgcactttcttgtctcctctaataagccccaccctccccgcctgggctccccttgctgcccttgcctgttccccattagcacaggagtagcagcagcaggacaggcaagagcctcacaagtgggactctgggcctctgaccagctgtgcggcatgggctaagtcactctgcccttcggagcctctggaagcttagggcacattggttccagcctagccagtttctcaccctgggttggggtcccccagcatccagactggaaacctacccattttcccctgagcatcctctagatgctgccccaaggagttgctgcagttctggagcctcatctggctgggatctccaaggggcctcctggattcagtccccactggccctgagcacgacagcccttcttaccctcccaggaatgccgtgaaaggagacaaggtctgcccgacccatgtctatgctctacccccagggtagcatctcagcttccgaaccctgggctgtttccttagtcttcattttataaaagttgttgcctttttaacggagtgtcactttcaaccggcctcccctacccctgctggccggggatggagacatgtcatttgtaaaagcagaaaaaggttgcatttgttcacttttgtaatattgtcctgggcctgtgttggggtgttgggggaagctgggcatcagtggccacatgggcatcaggggctggccccacagagaccccacagggcagtgagctctgtcttcccccacctgcctagcccatcatctatctaaccggtccttgatttaataaacactataaaaagttctttgctttactcagccagtgtccactggcaatccctgggctgggctctggggccacaaagatgaatcaggttaggccctgccctgggcagcttgttctccctgaaaagcctgataatctcaggatttggggagtaaggtgacgtgaaggagggagttcctgcaccctgttcacctctcatctcccgtggccctaccccactgttcctgccaccccagctccagccatagccatgagcatgcaggcccttgcacacctgttctcttgctcaggcgttactgtgggaccttgcccttgccctcacccctgtctctcaacctccttcctatccagtagacctagttcttgcccgcccgcagaagcttccttggccc

SEQ ID NO: 11493 - DNA, 2935 bp, Homo sapiens; identical to SEQ ID NO: 11491

SEQ ID NO: 11494 - DNA, 420 bp, Homo sapiens
ttgtaaagttctgggactgtagaatcacagaacgacacccggtaatccacagggtcatggagtaggtactcaccgtcagctgtggcccagctcaccaccatgggtcagcagggtcaccagcctctttatgcctttcacagtaatgcagcggccagctatggctatgtgttcctcatgctttgtgtacatgccatcatctcctcacaactgcaccaggtgtttttgtcaccatacagatgaggaaaccagcataggccaggctttatctgtcaggtggcaattctcacattcttccttgtcctaccccaggggccgggccagctgtgtaaatcccatgaatcagagagggtagaggtgcactgataaaccaaaaagcactgggattccatttattttttattttcaaataagttgcagaag

SEQ ID NO: 11495 - DNA, 420 bp, Homo sapiens; identical to SEQ ID NO: 11494

SEQ ID NO: 11496 - DNA, 1053 bp, Homo sapiens
ggcaagtgcaccaccatgactggctagtttgttttttggttttggtttttggtttttggttttttttttttggttggttggttgttttttacaggcggggtctcactatattgtccaggctagaagaattttctaatggtctattacacctcccgttttggcaagtaaattcagaataattttaggttcttttgttattcagtagttttgcagacttaaaagtgtaaatttagaattagaagatgaagctatagtagtaagaatctcaagttgaagggctttggggagccaaagcagcatattagagcataggcttgaacttaaatctcagctcagtcacctgcaggactttaggcaccagtgatttcacccttctgagcctgtttctttattcgtaaaatgattataataattctttcacagcgttgtgaggattaagtgaaatgtgttaaatgcctactacagtaggtgctcagatatttatttttatttttttattatgcacattgtttttcctgcctttttatggctgtctaaagtctagggaaaagggaagactggttaatgatgagtagaaaaaacttgtaagctaatcattcactgacttattttccttccattttctggtttttaaaattagccacaccacaggaaacccacatttttagatggaaagagcaagaaaattgtgtcagtgctcttagttattttcatcttaatggtatagtgaaaagacattgacttgagatgatactaaggaagctttggctcactctcacttgaagaggggatcttggtgttgtagtacttggactgtacaaatgttttactgacttttcttactgctgtaaaggaatcaggcagttgggtattgatatgttatttggtgctctcattcatggcaaaggatttgataaataaaagttctttaaacactaaagcaaaatcaaatgagcaaaactaaggatgaaatgtaatattcatcagaacaaggatcactgagaaaaaatattcagaaacaactttaataaaacctgaattgaaataactgca

SEQ ID NO: 11497 - DNA, 4892 bp, Homo sapiens
aaggaggcgaacccagagatgtgtggaagacgccaagatatttggtgagagatttatttacaataaaaatgtctttggttgggcacagtggcttatgcctgtaatcccagcactttgagagtctaaggctgtcagatcacatgagatcaggattcaagaccagtctggccaacatgacacctcgtctctactgaaaatacaaactagctaggcatggtggcaggcgcctgtaatcccagctactctggaggctgaggcacgagaatcacttgaacccaggaggcagaggttgcagtaagccaggatcatgcccctacactccagcctggtcaacagaatgagactcagtctcaaaaaaaaaaatgaaaaatgtctttgacttcaaagtcaaagacctagcctgttttgacacaaggccttaagcctgtccctggattaaagtcagattaacaaagtccttgactctcaccagcccccactggagctttggtatcgtgtcatagacctctctaatgatgactttcttgccctcatttctgtaagaaaaatcaagttttagaattgagcgtaatgggatttctcaacaactgaatttacttttgtcttgtaacagttcgtatgactcttttaaaaaatcagacaagttttgtggtccatctctagcaacttcatagccaacttacctcatctatggctgtgtcttactttcgtgttcctatttagccagtcctcaagaataaaccattcatgacaccccttagcatagtgttgttgactttctttttttattgttagtgcccttctcgtgaaatattaatgtcttgtccctgttgagaatgtatgccatagcacaactgggacaggcaggaattttcaaaatgtacataatactacaagcaaatagcaacaaaaattcatgtacataaaaatagttgtttttaaagaacaggtttaagcctgttgtgtatagtcttacctagttcttgggttctgtcttttccatttcctagtcaagttcctagtcatatatgccttctgagagagacactgacttgtcagttgggttggggtggtaatcagtgatgatctctgagtcctgtgtggcaacctttccacttgctggactactcagcatactagccgtctatctaggccttacccaaactctatgcccacgggcagagtgatttcctcacaaacaataaaaataactggcttctctgcaggaatccagagtttctgtaaggacttggtggaggtggctgacattttggagaagactacagagtgcatttctgaagaatcggagcctgaggaccaaaagctcactctggagaaggtcttccgagggttgttgcttttagaagcaaagctgaaaagtgtgtttgccaagcatggcctggagaaactgacacccattggtgacaaatatgacccccatgagcatgaactcatctgtcatgtgccagctggtgttggggtgcagcctggcaccgtggcattagtaagacaagatggctacaaacttcatggccgcaccattaggcttgcccgagtggaagtggcagtggagtctcagagaagactgtgaagaggccatcaggaactggatgttctcccagagcgcagtcacctatgtttcttttatttattaaactaggtttgtattgtacatgaggtacttcatgtgatatgttttggatttagtcatattggctttatttctaagatattctattgatttaatgtgacctgtttggtctcatcagaagtcttaccattgggcatttgaacagtgtgacaggtgttccaatggcctttatcaaaacatgtttaggaaaattggtactgtgataaatttgaatccaaaatccttttaactatgggttttcaactacatgtttcttcctagcggtctctataacaggaattgtgtagtatcttgtattttgtggaaaaaggagatggtagggattggttcaacatttgggtacttagaggataaagcttcgtggtcgtataaatttagatcatttggattgatttttatacacatagattttcaggactttaccttttgttttgtttttttccttttagccatcttttgttcttgtaatcccaactagataggctttatgctcacatcattgtcccatacccacccctttctcatccccatttgcaggggctaaaggtctagatgagacttggaaggcaaggagcatcgaaatttgagatacccaggaccctttcaagcaagaatggccaaaaagccttgtgctgtctttgctcttcaaattattttcagcctccttgtcatataatcatttcaggcaaactgaggcaacactaacagctaatgacccagatggctctatttgggtaatttacctacaacttattccaccagcctttactcctctgcccttttgtcaattttaccttataatcctttattaaatgatgggaggtggtgatcaggacaaaagtgttaggttcccatgatttctcatttcatttattaatagttaatgctgaatttttttttaagtttcctctggctctatttatgttactttttgcgataagaacacttaacataagtattctctcctcttggcaattttttttttttttcctgtgttgcccaggctgacctccaactcctgggcccaagcaatcctgcctcagcctgccaagtagctaggactacaggcgttcaccactgcgcccgcaaagtttttttgttgtttttttttttaagttggtactcacaaatcactacctctgttatattgacaagctctatttcctattctttgtatctgttaagtcacatctgtgtaaacattgagctcaccttttatatattaacctctagaattaatgggcctatgtggttttttttcagtcttatagctggtgttctgtaaaagatttgtccaataaacgacttaatgaatgatacatcagtcagattttaggaaggcagtcaattatggatattttaatgttggaagaggccttaatgatcaaatctcaccctttctgcttctgaagtatgaaaatctagtctttttaggactggacacaaggaaaataatctctaaactattgactaaattccagtgagagtatgaatgaagaacaactagatattaatgtcaatcatttaagattaatgggcatgcaattaagtctccatttaagattaatgggcatgcaatgaagtctccagcagacaatcagatgttgttggatgtctagattatataggtttaggttgaagttataaaataaaataaaattcattttccactggaactctatgacattcagtggagtggtggaaagttaacctcttatacattatagataattctaagacagcacacaaacttatcaataaagccatctccttgtgggccttaccatcttcatcagatttagacccttaaaaaacaagtaaatatgcacttttaaaatgcaatcaaaagactggtggttaagcttgtaaaaccagaacatcttttggcattccactaagtatatattgtaaatttaatgaacaatcaaggttcacaataggaagttgtctttttttgccttccattctgtgagatttgacagatggtgacaataagaaaatgagctgattgtaattactctctgtgtgtttttttattgctagctatcattaccagttagaattaacattaattacaattaacaataattttaggtatggaatgttatgattacctaaagagatgtctctacctaatgagctcaagtgatcctcccacctcagcctaccaagtagccaggaccacaggcaagtgcaccaccatgactggctagttttgttttttggtttttggtttttggtttttggttttttttttttggttggttggttgttttttacaggcggggtctcactatattgtccaggctagaagaattttctaatggtctattacacctcccgttttggcaagtaaattcagaataattttaggttcttttgttattcagtagttttgcagacttaaaagtgtaaatttagaattagaagatgaagctatagtagtaagaatctcaagctgaagggctttggggagccaaagcagcatattagagcataggcttgaacttaaatctcagctcagtcacctgcaggactttaggcaccagtgatttcacccttctgagcctgtttctttattcgtaaaatgattataataattctttcacagcgttgtgaggattaagtgaaatgtgttaaatgcctactacagtaggtgctcagatatttatttttatttttttattatgcacattgtttttcctgcctttttatggctgtctaaagtctagggaaaagggaagactggttaatgatgagtagaaaaaacttgtaagctaatcattcactgacttattttccttccattttctggtttttaaaattagccacaccacaggaaacccacatttttagatggaaagagcaagaaaattgtgtcagtgctcttagttattttcatcttaatggtatagtgaaaagacattgacttgagatgatactaaggaagctttggctcactctcacttgaagaggggatcttggtgttgtagtacttggactgtacaaatgttttactgacttttcttactgctgtaaaggaatcaggcagttgggtattgatatgttatttggtgctctcattcatggcaaaggatttgataaataaaagttctttaaacactaaagcaaaatcaaatgagcaaaactaaggatgaaatgtaatattcatcagaacaaggatcactgagaaaaaatattcagaaacaactttaataaaacctgaattgaaataactgca

SEQ ID NO: 11498 - DNA, 166 bp, Homo sapiens
tttttttttttttttttttttgagatggagttttgctcttgttgcccaggctagagtgcaatggcgcgatctcagctcagcgcaacctccgcctcccaggttcaagcaattctcctgcctcagcctcccgagtagctgggattacaggcacctgccaccacgccta

SEQ ID NO: 11499 - DNA, 166 bp, Homo sapiens; identical to SEQ ID NO: 11498

SEQ ID NO: 11500 - DNA, 3236 bp, Homo sapiens
atcgcagtggctgcgcccgggatagctggctgcgccgccgcgcacatgcctaggttcgacgccctcctccctttgcccaggagttccttctgtcccggctctgttccgtctcgccccgaggttcacgccatcctcggagccccagcctttcacccagcgcctccaagctttggaccttgacttctgcaaaactagatggtcacagccatgaatgtctcacatgaagtaaatcagctgttccagccctataacttcgagctgtccaaggacatgaggccctttttcgaggagtattggtgagactttgggagagggaaaggccatgccagggccccggggccggggcgcgagggggtggcattgaatgcccacaatgattttcttacagagcagagttatgggactcccttgtactggcttcacactacctttgtccgaggtgcaggtagtatgtggcacctcaaagagattagagctgaaagcaagcaagcagaaataagaggatgagggagaacgtggaaatatacagaagtcaaagagagcgtgtagtgagaagggtcttggaggcgtgaggttgatctgaagccttactagatgacttccccgtcctttgtggctgtgtgtgcgcgcgtgtgtgcacagtgcagggcccgggggacagcctgccctttacaattatcccatcgttccccaggtgctccaccgttcctgctgtggagaaggaggcgaagtcagagagctcttccaagctttccccaggaagagctctctggctttgccttaaagctccccagaggttttggaggctgactttatgctccaaccaatttgccataccccagccagggagaagctattgccacattcttcttacgccacagccctggtatgcttctaggagccccaaccagggagaagctattgccacacttcttacaccacagccctgggctgcttctaggcgcgggccagacagccgtcacccacctctaaccccactgagagagcaataatcacagaaaccttggacatagctcctgccctgtgctagatactttgtatacgttaatacccccaggagagatgtagtattcgcgctctacaaatgaggaagccaaggctcagagaattaagttggtttttccaatgtcacatagctagtaagtggcagaactgggactccaacccagagcactcacctggagagatgagtgggcatttctctaatcagcacccacccatgagcccatccctctgccttctgcttgccagggcaacctcattccccatagccctgatctacctggttctcatcgctgtggggcagaactacatgaaggaacgcaagggcttcaacctgcaagggcctctcatcctctggtccttctgccttgcaatcttcaggtaagaccccatcccactccctgcctcttctctagatcttagaccaccattctatcccttgaagctttcccgattgcatcaacctccatcctgtccccaagttgccttgtaacactctccccatctcattctcggctttagttcccctcccagccttcaccctcttctgttatattatcctgttttccttctcttttagacccctacctggtggtctctgctttgtccctcttgccttcgtagagtctgtactcgcaactaatttctccagcctctaatagtgtcacctcctaacaccctctctcaagaccctccaataacttccccatattttctcccccaaactccttcagtcttcccctatccctctacacatctcctcccaggctcctaacccctcccaagaaccccattccttaactcaactttcagtcccatccccctgcattccctgatctttctccagccctcgtctcctctagactactgattggatctaccagattggcttcaggatctcaggagctttgacccaccccctgtggacaggtggggaggtggtagagcttggaacacagtaacctggccaagccgggggaagggtggattattggtgcctggggatgacacttacaccatcttcctttgtcccatttcagtatcctgggggcagtgaggatgtggggcattatggggactgtgctacttaccgggggcctaaagcaaaccgtgtgcttcatcaacttcatcgataattccacagtcaaattctggtcctgggtctttcttctcagcaaggtcatagaactcggtgagtggcaaagctttgtctttctggtgccttgtgaactgcatccttcctcagggccctcccttcacccatcccatggagggtctctttcctacccttgggtcccaataatacctctcacccaagcccctctacagattctctgccacaaagacccccttccctcccctgagaatttctcccgtgtccctacatccagtgcagagggtggtcccagcactgggtggtatgccaactatgactctccatctcccaggagacacagccttcatcatcctgcgtaagcggccactcatctttattcactggtaccaccacagcacagtgctcgtgtacacaagctttggatacaagaacaaagtgcctgcaggaggctggttcgtcaccatgaactttggtgttcatgccatcatgtacacctactacactctgaaggctgccaacgtgaagccccccaagatgctgcccatgctcatcaccagcctgcagatcttgcagatgtttgtaggagccatcgtcagcatcctcacgtacatctggaggcaggatcagggatgccacaccacgatggaacacttattctggtccttcatcttgtatatgacctatttcatcctctttgcccacttcttctgccagacctacatcaggcccaaggtcaaagccaagaccaagagccagtgaaggtttggagagaacaatgaagctccaggctctctcttctccagggcaccaagaggctgggcttagttttgggagaatgattaggttgccttacctgcatggtttccccagaggatgtgtgccccaaggtggctggaatttttgacagacaagaagggtgaccttgggatgggggtgtggtctgttactttaatgtttctgtttttaatgtgaaggccaagcaggccctgggatgggagtggggcggaggagggtcctaagagctgattatttaatttctatccagaaatctttcttcttcttgctctgtttttttaaattaaagatttcaacaaaa

SEQ ID NO: 11501 - DNA, 318 bp, Homo sapiens
ccactgaaggtttttttttttttttttttttttgagacggagtctcactctgtcacccaggctggagtgcagtggcacgatctctgctcactgcaagctctgcctcccaggttcacgccattctcctgcctcagcctcccgagtagctgggactacaggcgcctgccaccacgcccggctaattttttgtattttttagtagagacggggtttgacggtgttagccaggatggtctcgatctcctgacctcatgatctgcccgcctcggcctcccaaggtgctgggattacaggcgtgaaccaccgtgcccggccgaa

SEQ ID NO: 11502 - DNA, 7135 bp, Homo sapiens
tttcttgcactgtgcgtgtctcttgtatgtgtaaaagtgtgtatgcatgtcgactgcatgtcgagtgtgcagtgcagagataagagaggaaatgggataaagttcagtctatagcatactatgctattagactgcattaaactgctacaaagtttctttactccaaaaagtagacaggttaactgttggaaactctgtaattattagataaaattaacagtactttacaattatatgtatgtcactttacagtttacaaagttattaagtagatattcaatttgatgccctgaaataaatttaacttctttgccctcccttctcccctccatcaaggacagagtaaggaacacttaatcaggaaaggcaatataattgcatcaatctgtacagaaccacaaagaataaagggtaggaaggtaggaccttgaagagggccacagggacttcaaggaaggaggaaaccagaatgttaaacatgagggaagcccagggttcacaggagagttaggcaccatacggggcaggttgtgttcgccacataaaaggaggggcacacagcataagtttcacattctaaaataatatgaaaagaccataactgaagagctgaatttggaatttctggtttttcacaatacaagtagatgatgaccaccaaccatggtttctgaatgaactgggttcaaaacatatctggttgcaacagagggcttccttggaccctaacatttgaaattaaacagaggtaatttgaggagctgcgattttacacagtggtggcatcctggggagcttctattccatcagtcaattttaatatctcacaatcgtggaaaaggagtttccgagcagggacgagcaatatcgatgggaagccgatacttgggccatctcttggagattcctgctgtaaggacggcaagtgtttctccagagaaagcacttgcctgggtatgactcagggccgggcaggaattcacactatgaatccgggtggtgggaaggcggagaagtatgcctacaaagattaaagagccaggaatggaaaacacactaaaaaccgtcccagtgggcagcctgcctccccacaaataagaagaccttgaatcctgagcataatcagggagacaaagcaatgccctggatgccaccagcatagacaaagccaacggaaaaaaaaaaaagaaaagaaaatgcatgattcagtatttacacacacaaaaagaagagtgcagaagcaagcaagaaactaaagaaaaaggaggctgggtgcggtggctcatgcctgtaattccagcactttgggaggccaaggaaggtggatcacttgaggtcaagagttcgagatcagcctgaccagcatggtgaaaccccgtctctactaaaaatacaaaattaggcgggcgtggtggcccatgcctgtaatcccagctacttgggaggctgaggcaggagaatcgcttgaacctggaaggcagaggttgtagtgagttgagattgcaccactgcactccagcctgggcaacaagagtgaaactccatctaaaaataaaataaaataaaaaatataatataatataaaaaataaactaaagaaaaaggaacaatgctcacaccaagggagctgccgacaaaccccactgatgcttcccagcagcactacagcttggctaatcccagcttcccactgtacctttcaaaatgacaagggagagacatgagttaagcattgaccccacctcagcatggggtaaacatctgagatttctgctgccctgggtgtggttacgtgggattaccattctgggtgactcactgaaatgtactcacagtgagtcatgccttcaaatgacatctcaagttctgcctgcttggagatacatctggggatcttaaggggtgagggactactcaacaagaaggaatttagcctgtctttttaaataaacggcatttctttttcctagaaaaatgggaaattcttcaattctctaatacagggacactgagataacaaagaggaaagtgtctggttggaggttgggaggccaccctggggtctctcctacaaaaatggaaaagaaaagaacggtgagaaatcaagcaaagcacaagaaagtttccctttgctaaaagggaaaagatgccccacaatggccataaacatgaactggggataaggaggagaatgtctcttcttggcacccccaaacaaacgttaattacccctcccggagaagacgatgtgaaagataaggattcagaggttctaagtcctggaatctaagccacactctacagaccttctcagagaccttatacttaggaagaaacaagaaagtaaagaaattcaaatagataaaccgaataataaggaagtccttacccagtgagaccacgttcccataattctctaacatcacttctctgtagaggtccctctgaacagggtccaggtatccccattcctctcgagtaaggtgcacagccacatcctcgaatgtcacaaactcctgaaataacacatcctggctgctctgaggaatgagaacactgtagcaccatggccagagaatgaagatcatagagagggtatccactgtgtacttacgttgaggaggagggagaacagattagaacctacggaataaagcccataacccttaaacatctaataagcacccatcacacaaccatggacaaagagaaaacagagtttgctcatggcactggggagatgggaagttggtttatgtgaagtccaggtctccgaagaggatcaattcccaaactggagtctgctattgaaaaaaattccaggcaaggtctacagatgggatgagagagaggccacactccatcagtagcaatagtccctgaggaaaagcagagggttcctcagctcacctggtacctggctgtcaagagcgcagctgcctggtctcctgggcttccctcacggggaagagcaggcacctgaggaacaggtggagctgagggaggagaaaggagtgaagagtgagagcagccctttcccagggctccctttcagaggaggcctctccagcccaaggggtgtcagcaggaccctcctcaatactctagtaaaaccaatgaacatttttcaggtattgggtgtgtctactctgcttcgtctcagtacttgcatgccttatgcgtgttttgacctgtgatacaggattttcttaggaaagcttgtatttcactttatcttcatcacatgacagtcctcttacagaagagtaagactatacctgttttgcagatgggcaaagcaaagcataaagacttgtggggacttgtcctgggctagggttatttagcagacttctgaccctttccaggcactgttctagacacttgatcagcgtttctcttgtgaatgggtgctgtctcaaccagtgtgtaaggcccccaagaacaagaaagggtcatctgtttcctcgaaatcttttccacagtcccacaatcccccacagcactctacacattgtggcacttgatctgtgtgggtgacacacaagttatttcaggcactagagttaaccacaggcaatctaagacacagctcttataaaacaaaggaagaaaaagaccaacctacctatacgatacagcaaagtgtgactgcgtagtcaaaatacagtatatatacattcatacaggcattgtgttcaaccaaggaattaaatggttgcttccttgaccaaatttagtctagtcacaaaacactgcagttacaacagaatggatggcaggtgacaaagcaaagaaaaactaagtgaagggaacaggggaaagaaaggtcctgaacctaagaggaagtgagagccaggaaaggactgtgagatgtggcaaaagcagcatatcttagaaattattctggatgtgagaactgggatgaagtgaaggttgcctgaaggaaaaaccaccacagcgagtaagcagccatcactctgcttatttgagaaagatgagctatccttaataaaggggctcagactaggactgaactgagtcacatctgccccctctttcattcctccctctagggaccatgttcttattccagttcttggcctctctcaaaccaggcccaggagccccctcgggagcccctccgcactcccactctcccagacggaagtgctttctctgccttacccccagtgagtccctgttccatgtcggtgtcctgcacaaactgaggctctggggacagacactcagactgggtctccaaagactgaaactggacccttggtgaccctgctgcttcctgggctggtatttcctccatcactgctctggaggacaatgaccatcactgcaaggtaagattaagagaaattactgtaataagttaaagcatttcatcattttatatcgtcaggactttgcaaaggatcttacacactatggatattcaataaaaattagttgataatgattaaccaccctaaataagtaacagaaaaatggggccaggcgcagtggcctgtaatcccagcactttgggaggctgaggcgggaagatcacttgaggtcaggagttcaagaccagcctgatcaacatggtgcaacttcttctctactaaaaatacaaaaattagccagcgtggtggtgcgggtctgtaatcccagctattcgggaggctgaggcaggagaattgcttgaatacagaaggcatacgtggcagtgagccaagattgcaccactgcactccaacctgggcaacacagtgagactccgtcccaaaaaaaaaaaaaagaaaaaaaagaaaaagaaatatggatatgcttcagctttaaatacttaagaaccaaatcatagaagagtctctaatttggaatttgtggcattaaaaaaattaacacggtacaatttaatagtgtaaagctttctgtggaaactttaaaatatttaaaattggccacgtgcggtggctcaagcctgtaatcccaacagtttgggaggcacagacgggtggatcccttaagctcaggagttccagaccgtcctggacaacatggtgaaaccccgtccctacaaaaaaaaaaaaaaaaaaaaaaattaggtggcccaggcctgtagttccagctactccaaaggccaaggcaggagaatcgcttgagcttgggaggtagaggctgcagtgagctatgactgcgccactgcattccagcctgtatgacagcgtgacagcccacctcaaataaacaaaacaaaatatttaaaatttacaatcgtctttggaggctcaagttggtgcccagagaaaaatgctagttatgattgctcattttattttaattttgttttagcagagatgggagtctcgctatgttgcccaggctggactcgaacgcctggcctcaagcgatcctcccacttcggcctcccaaagtgcggggattacggcgtgaaccaccgtgacaggcccgcgtttacgtaaataaactcatttaaataaataaaacagcaggccccctaggaaatgtcttggtaacaccgtcagcccactccgatttactacacgggcttggcgaataaaactccacttttggggtcaggcccttcgctaactcagaccagctagaccggccttttcccggaatcctgagagcaacgcaggtaagagctgcggttcgaacaggtttgagcggcgtccttcaggcccaaggacgcatgagggtgccgtccccctcccaccaccctcgccctgggcccctgcccggctcccagctcggtcctcagaaggccttgcccggcgctgccctcctcccacttcccttttaggccaaggcaaagtcccaaaaggaccagtgaggacatacagaccagctcgcaccagggcacggtcgccggctcctgacggcggggccctcggtccgcgaggtgaatgaaccagggctgaagagaaacaggccctcctcgcacccgggcctccgcgcactctcggggaagcgaactaccgtcggccgcggccggacgccgcctccttctactcccgtgaaggcaaaacaagctgccaccccgctgcgaccccaaaacggcttccgggtactcaccgaggggaggggcgggcctggccgctgtcctgtcacctacacactcgcgctcggggccaccacagcctctcccgggccgctgtagacagccccgaggccggcgcttctcggtggcacttccggcgacggagtgcagggtcccgaatgagggccccccctcctccgcccaggcatgagggtcccggatgtgggtgagagccccggatgagggtcccggatgtgagtgagggccccggatgtgagtgacggccccggatgaggaactcggaggaggagctgggcccgcgcgtccatgattcgaaggctcgttttcgcagcttttccacgtctttttccggtcccactgccctccatgctaactcactgggcgtctctagccgttataccaacaatgactgcgaccagtgttgggaaagcgccccctgggcccctccctgacgccagcccatccttgagactccctgcaaggaggcggcccgacccagtgggtgcgtgtcgtggggtgaggaggaatggccgacctaatggtcccgcttccgtgagtagcacaggggtgcctgctcagagtgtagtacaacgctgacaagtagaaggcgaggattgcggggcctgggtgagatgggacccactaagttgtgggatcgaaatctcagtaggtccttggggaaagcggggacgggaggggagatgagcagattggaatagaaccgagagagacggaggaaactgacagttgcgtccctggtgggaagactaaaatctatgcagaaacagggataggcaaaagcattgtgcacaagcgggacaggcagagcgccgggacagaaacccttaggacattctgacaccttgctgaacctggatccttacagaatatgtcttgtaggtgaagctagatctgcaaggcataggcaagcctcttagagaatcagaaaagtgatttggaaggaacttcagctgttactactttgtttaagcaaatcaaatgctgttctttaatgttactggacgtttcaaattaaacacaagaaaacctgaa

SEQ ID NO: 11503 - DNA, 4955 bp, Homo sapiens
taaggaggagaatgtctcttcttggcacccccaaacaaacgttaattacccctcccggagaagacgatgtgaaagataaggattcagaggttctaagtcctggaatctaagccacactctacagaccttctcagagaccttatacttaggaagaaacaagaaagtaaagaaattcaaatagataaaccgaataataaggaagtccttacccagtgagaccacgttcccataattctctaacatcacttctctgtagaggtccctctgaacagggtccaggtatccccattcctctcgagtaaggtgcacagccacatcctcgaatgtcacaaactcctgaaataacacatcctggctgctctgaggaatgagaacactgtagcaccatggccagagaatgaagatcatagagagggtatccactgtgtacttacgttgaggaggagggagaacagattagaacctacggaataaagcccataacccttaaacatctaataagcacccatcacacaaccatggacaaagagaaaacagagtttgctcatggcactggggagatgggaagttggtttatgtgaagtccaggtctccgaagaggatcaattcccaaactggagtctgctattgaaaaaaattccaggcaaggtctacagatgggatgagagagaggccacactccatcagtagcaatagtccctgaggaaaagcagagggttcctcagctcacctggtacctggctgtcaagagcgcagctgcctggtctcctgggcttccctcacggggaagagcaggcacctgaggaacaggtggagctgagggaggagaaaggagtgaagagtgagagcagccctttcccagggctccctttcagaggaggcctctccagcccaaggggtgtcagcaggaccctcctcaatactctagtaaaaccaatgaacatttttcaggtattgggtgtgtctactctgcttcgtctcagtacttgcatgccttatgcgtgttttgacctgtgatacaggattttcttaggaaagcttgtatttcactttatcttcatcacatgacagtcctcttacagaagagtaagactatacctgttttgcagatgggcaaagcaaagcataaagacttgtggggacttgtcctgggctagggttatttagcagacttctgaccctttccaggcactgttctagacacttgatcagcgtttctcttgtgaatgggtgctgtctcaaccagtgtgtaaggcccccaagaacaagaaagggtcatctgtttcctcgaaatcttttccacagtcccacaatcccccacagcactctacacattgtggcacttgatctgtgtgggtgacacacaagttatttcaggcactagagttaaccacaggcaatctaagacacagctcttataaaacaaaggaagaaaaagaccaacctacctatacgatacagcaaagtgtgactgcgtagtcaaaatacagtatatatacattcatacaggcattgtgttcaaccaaggaattaaatggttgcttccttgaccaaatttagtctagtcacaaaacactgcagttacaacagaatggatggcaggtgacaaagcaaagaaaaactaagtgaagggaacaggggaaagaaaggtcctgaacctaagaggaagtgagagccaggaaaggactgtgagatgtggcaaaagcagcatatcttagaaattattctggatgtgagaactgggatgaagtgaaggttgcctgaaggaaaaaccaccacagcgagtaagcagccatcactctgcttatttgagaaagatgagctatccttaataaaggggctcagactaggactgaactgagtcacatctgccccctctttcattcctccctctagggaccatgttcttattccagttcttggcctctctcaaaccaggcccaggagccccctcgggagcccctccgcactcccactctcccagacggaagtgctttctctgccttacccccagtgagtccctgttccatgtcggtgtcctgcacaaactgaggctctggggacagacactcagactgggtctccaaagactgaaactggacccttggtgaccctgctgcttcctgggctggtatttcctccatcactgctctggaggacaatgaccatcactgcaaggtaagattaagagaaattactgtaataagttaaagcatttcatcattttatatcgtcaggactttgcaaaggatcttacacactatggatattcaataaaaattagttgataatgattaaccaccctaaataagtaacagaaaaatggggccaggcgcagtggcctgtaatcccagcactttgggaggctgaggcgggaagatcacttgaggtcaggagttcaagaccagcctgatcaacatggtgcaacttcttctctactaaaaatacaaaaattagccagcgtggtggtgcgggtctgtaatcccagctattcgggaggctgaggcaggagaattgcttgaatacagaaggcatacgtggcagtgagccaagattgcaccactgcactccaacctgggcaacacagtgagactccgtcccaaaaaaaaaaaaaagaaaaaaaagaaaaagaaatatggatatgcttcagctttaaatacttaagaaccaaatcatagaagagtctctaatttggaatttgtggcattaaaaaaattaacacggtacaatttaatagtgtaaagctttctgtggaaactttaaaatatttaaaattggccacgtgcggtggctcaagcctgtaatcccaacagtttgggaggcacagacgggtggatcccttaagctcaggagttccagaccgtcctggacaacatggtgaaaccccgtccctacaaaaaaaaaaaaaaaaaaaaaaattaggtggcccaggcctgtagttccagctactccaaaggccaaggcaggagaatcgcttgagcttgggaggtagaggctgcagtgagctatgactgcgccactgcattccagcctgtatgacagcgtgacagcccacctcaaataaacaaaacaaaatatttaaaatttacaatcgtctttggaggctcaagttggtgcccagagaaaaatgctagttatgattgctcattttattttaattttgttttagcagagatgggagtctcgctatgttgcccaggctggactcgaacgcctggcctcaagcgatcctcccacttcggcctcccaaagtgcggggattacggcgtgaaccaccgtgacaggcccgcgtttacgtaaataaactcatttaaataaataaaacagcaggccccctaggaaatgtcttggtaacaccgtcagcccactccgatttactacacgggcttggcgaataaaactccacttttggggtcaggcccttcgctaactcagaccagctagaccggccttttcccggaatcctgagagcaacgcaggtaagagctgcggttcgaacaggtttgagcggcgtccttcaggcccaaggacgcatgagggtgccgtccccctcccaccaccctcgccctgggcccctgcccggctcccagctcggtcctcagaaggccttgcccggcgctgccctcctcccacttcccttttaggccaaggcaaagtcccaaaaggaccagtgaggacatacagaccagctcgcaccagggcacggtcgccggctcctgacggcggggccctcggtccgcgaggtgaatgaaccagggctgaagagaaacaggccctcctcgcacccgggcctccgcgcactctcggggaagcgaactaccgtcggccgcggccggacgccgcctccttctactcccgtgaaggcaaaacaagctgccaccccgctgcgaccccaaaacggcttccgggtactcaccgaggggaggggcgggcctggccgctgtcctgtcacctacacactcgcgctcggggccaccacagcctctcccgggccgctgtagacagccccgaggccggcgcttctcggtggcacttccggcgacggagtgcagggtcccgaatgagggccccccctcctccgcccaggcatgagggtcccggatgtgggtgagagccccggatgagggtcccggatgtgagtgagggccccggatgtgagtgacggccccggatgaggaactcggaggaggagctgggcccgcgcgtccatgattcgaaggctcgttttcgcagcttttccacgtctttttccggtcccactgccctccatgctaactcactgggcgtctctagccgttataccaacaatgactgcgaccagtgttgggaaagcgccccctgggcccctccctgacgccagcccatccttgagactccctgcaaggaggcggcccgacccagtgggtgcgtgtcgtggggtgaggaggaatggccgacctaatggtcccgcttccgtgagtagcacaggggtgcctgctcagagtgtagtacaacgctgacaagtagaaggcgaggattgcggggcctgggtgagatgggacccactaagttgtgggatcgaaatctcagtaggtccttggggaaagcggggacgggaggggagatgagcagattggaatagaaccgagagagacggaggaaactgacagttgcgtccctggtgggaagactaaaatctatgcagaaacagggataggcaaaagcattgtgcacaagcgggacaggcagagcgccgggacagaaacccttaggacattctgacaccttgctgaacctggatccttacagaatatgtcttgtaggtgaagctagatctgcaaggcataggcaagcctcttagagaatcagaaaagtgatttggaaggaacttcagctgttactactttgtttaagcaaatcaaatgctgttctttaatgttactggacgtttcaaattaaacacaagaaaacctgaa

SEQ ID NO: 11504 - DNA, 409 bp, Homo sapiens
tcagatataaaataggagcagtgtcatctgctcacagggttatggtaaggattaaatgagatatatacacatatcctttatatatatatatacacacacacacacacacacatataaatgtcctatgtctgtgtgtgtgtatatacatatgtgtgtgtgtgtgtatacatacatatatatagtacccaataacatattggctgctcaataaatactaaatagctgtgacaatggaaaacattctgtgcaaaataactgtagtccttcatgacatcaagttaaaaaagcagagagtatgtgccaaacattcccaatctactgacccagttaatatcaattagaattttaacaagcatgcttctgaggccatcatctaatagggcacctgccacacttacccatgtgaaaa

SEQ ID NO: 11505 - DNA, 1179 bp, Homo sapiens
tcaagtctttatataatgaaagagaagaaagtcacacttccgtcgagcagccaatatatgcctcattctgcagcaggtaatctaagatagatgtaacagaagcaatattaagaattagcagatatgctacgtgtagtggaaggcatcttcatttttgttgtagttagtgagtcagtgtttggggttttggggaatggatttattggacttgtaaactgcattgactgtgccaagaataagttatctacgattggctttattctcaccggcttagctatttcaagaatttttctgatatggataataattacagatggatttatacagatattctctccaaatatatatgcctccggtaacctaattgaatatattagttacttttgggtaattggtaatcaatcaagtatgtggtttgccaccagcctcagcatcttctatttcctgaagatagcaaatttttccaactacatatttctctggttgaagagcagaacaaatatggttcttcccttcatgatagtattcttacttatttcatcgttacttaattttgcatacattgcgaagattcttaatgattataaaacgaagaatgacacagtctgggatctcaacatgtataaaagtgaatactttattaaacagattttgctaaatctgggagtcattttcttctttacactatccctaattacatgtatttttttaatcatttccctttggagacacaacaggcagatgcaatcgaatgtgacaggattgagagactccaacacagaagctcatgtgaaggcaatgaaagttttgatatctttcatcatcctctttatcttgtattttataggcatggccatagaaatatcatgttttactgtgcgagaaaacaaactgctgcttatgtttggaatgacaaccacagccatctatccctggggtcactcatttatcttaattctaggaaacagcaagctaaagcaagcctctttgagggtactgcagcaattgaagtgctgtgagaaaaggaaaaatctcagagtcacatagacaccttgggaagagatggatgttccacgaaaggaatccagtgaataaatccttgaagatctgtttcattgcactgcattcttgcattgtctttttaactgtgtcattaaagatcactgaaatcttccataa

SEQ ID NO: 11506 - DNA, 1179 bp, Homo sapiens
tcaagtctttatataatgaaagagaagaaagtcacacttccgtcgagcagccaatatatgcctcattctgcagcaggtaatctaagatagatgtaacagaagcaatattaagaattagcagatatgctacgtgtagtggaaggcatcttcatttttgttgtagttagtgagtcagtgtttggggttttggggaatggatttattggacttgtaaactgcattgactgtgccaagaataagttatctacgattggctttattctcaccggcttagctatttcaagaatttttctgatatggataataattacagatggatttatacagatattctctccaaatatatatgcctccggtaacctaattgaatatattagttacttttgggtaattggtaatcaatcaagtatgtggtttgccaccagcctcagcatcttctatttcctgaagatagcaaatttttccaactacatatttctctggttgaagagcagaacaaatatggttcttcccttcatgatagtattcttacttatttcatcgttacttaattttgcatacattgcgaagattcttaatgattataaaatgaagaatgacacagtctgggatctcaacatgtataaaagtgaatactttattaaacagattttgctaaatctgggagtcattttcttctttacactatccctaattacatgtatttttttaatcatttccctttggagacacaacaggcagatgcaatcgaatgtgacaggattgagagactccaacacagaagctcatgtgaaggcaatgaaagttttgatatctttcatcatcctctttatcttgtattttataggcatggccatagaaatatcatgttttactgtgcgagaaaacaaactgctgcttatgtttggaatgacaaccacagccatctatccctggggtcactcatttatcttaattctaggaaacagcaagctaaagcaagcctctttgagggtactgcagcaattgaagtgctgtgagaaaaggaaaaatctcagagtcacatagacaccttgggaagagatggatgttccacgaaaggaatccagtgaataaatccttgaagatctgtttcattgcactgcattcttgcattgtctttttaactgtgtcattaaagatcactgaaatcttccataa

SEQ ID NO: 11507 - DNA, 6717 bp, Homo sapiens
cctcccagtctgaggctgcatcctccattaccatcgcccttcctgtgggctgggaggccaggtcctttcctgcccagcgatgtcagcgtttcctcaggggccaggcactcatcaggagaaaggaactaattacttgagtaatttgccttgccttgctgagaggagtgtgccctgagggactccatgtgagtgtggtgacgggtgtgggggtgtccctgtgttattttaaaatgggtgccttcaggacgatgagcatgtgaccatttcctctctatttccatcacaagagtattatggtatgagggtctcaggttagattatcctcccaagactcttctctcttccttctctactggaagcccacatagcatttccttatggcttgagggagaggttcggagccacttacaaattagataaagtacatttacaatcttgtacaaagccacacaatgaagtcatttttctcagctttttttttttttttttttttttttttgagcctgagtctcgctctatcgtccagactggagtgcagtggcgcgatcttgcttcactgaaacctctgcctcccaggttcaagagattctcatacctcagcctcctgagtagctgggattacagacatgcaccactatgcctggctaatttttggatttttagtagagaccgggtttcaccctgttggccaggctggtctcgaacccctgacctcaagtgatcttcccgcctgggcctcccaaagtgctgggattataggtgtgagccacagtgcccagccttgtttttgtttttgttttgttttgacagtctgtcactctgtcacccaggctggagtgcagtggtgcgatctcacctcacttcagcctctgcctcccaggttcaagtgattctcctgtctcagcctcctgagtagctgggattacaggcgtgccaccacgcccagctatttttgtaatttcattaaagacagggtttccccatgttggtgaggctggtcttgaactcctggcctcaagtgatccacctgcttcagcctcccaaagtgcagggattacaggcatgagccactgtgcctggcctcagctatcttgaatgctggagaattaaatccttttctgtctagggtgtcagctccctaagggctgggccaaaacagttggatttataagacactagagtcttgcctcagtagctcctttgaattctgcactgaattgatcagtttcttggcccaaagtaaactcagatggcagcccaagagccactctgcagtgccttctttcacatggtcatcatgctctctgatccctcaggttctgtctaagcctcatgttttatgaccgtgctgttctcagcccacctcaccctgccccatgccttctcaatggtttgttcacctgaattccccagatttcatgccagtatccccaaggttccttgacctcttggtgtaagcattcagcatctaaaattcattttattcccgtcaacgcatttctaactgtagaacaagaattataaatgacaaagctcatagaaaattggcaccttgtcttccccctccctcttattttatacataaaagagaatatgggctgggcattgtggccaaggctgggcatgatagctcatacttgtaatccagcactttgggagggtgaggcagatggatcacctgaggtcaggagttcaagaccagcctggccaacatggtgaaacctcatctctactaaaattacaaaaaaaaaattagctaggcatggtggcagatgcctgtaatccagctactcaggaggctgatgaaggagaatcacttgaaccctggaggcagaggttgtagagagccaagatggcgctactgcactccaacctgggcgaaagagagcaagactccgtctcaaaaaaaaaaaagacaaaaattagccaggcatggtggtgccacctgtagtcccagctgcttgggagcctaaggcaggagaatcgttttgacctgggagtaggaggttgcggtaaccgagattgtgccactgcacttgagcctgggcaacagagtgagactctgtctcaaaacaataagaacaacagcaacaaaagagagagaccatgccttgctccaggtctcttagctattgaagatgtacctggacccaggtctccggtcttctagttgaagcaattgtactgccttacaaagtcacattctctttggtgctttttgattgacgtatttatccaactagaaagttactcatgccctcatccaaaaatgtggtagaggccagattagtgctggtaggaataagagatataacctttggctttggaaccacaagcattagcagtctccatgttctttaaagacttggtgatattggtatttaggctggacaccatgcaaagactacacaggctcggttcctgcatgcagagaagttatctaagagatatgaccaggccggaatagaatgctcagaccacgtggaggctgttaaacttttacataatctagggaaagaagggacacaaggtggcattagtctagggtcaggtgggaaaaggttatgctgaaaagtctctgcagctcaggacagctttgtgcaaagaactgaagttcacagctgctagtgcctgggagatcaaatagtataaatgagggcagacaaccctgaggggcagatggagctttccagacaatcttggcatgaggatgagtgagtttcaaatcagtcctgccgaggcagatggcttcctccagctctgcttactgaatgcgaagtcacagtcagtaagaaaactggttttcttcttcccaggcgctgccccatacctgaagaccaagtttatctgtgtgacaccgtaagtggcttcctttccccgttttgccttcatttctaatatcctcagttatccctgggaatgggacactgggtgagagttaatctgccaaaggttggaagcccctgggctatgtttagtactcaaagtgaccttgtgtgtttaaaaagcttgagcttttatttttctgttggagaccagagtttgatggcttgtgtgtgtgtgttttgttcttttttttttttccattgtgtcttgtcaaccccccgtttcccctcctgctgccccccatttcctacagaacgacctgcagcaataccattgacctgccgatgtccccccgcactttagattcattgatgcagtttggaaataatggtgaaggtgctgaaccctcagcaggagggcagtttggtgagtatttggttgacagactttgtccctataagggaagttggtcccctttgtgtgatgctctcacatgtacacaccgagagctggtcactcggaatggtaggagattctagagctttgctttccaaaagagatggtatgaatgccacatgtgtgagtataaatcttctagcagccacactggaaatagacgaacttaatttttacaatatattttatttaacccactaaatccaacatactctcaatttaacatttcagaaaaagttgaggctgggtgagtggctcatgcctgtaatcccagcactttgggaggccgaggtgggtggatcacttgaggtcaggagttcgagaccagtctgaccaaaatctctaaaatataaaaattagctgggcatggtggcgcatacctgtaatcccagctactcaagaagctgaggtgggaggatcgcttgagcctgggaggtggaggttgcagtgagcagagatcgtgccactgcactccagcctgggcgacagagtgagactccatctcaaataaacaaaactaaactaaaaagaaaaagttgagacctttttttattcttttttttcatactaagcctttaaaatccagtgggcttttgacagccacagcacagctcagtttggacaaaccaaatctcaaatgcttggtggccacgtgtgtctcggggctcctgaattaaacagtagatcaagggcagaagatctcaggacagccttagagcttctgtaaacatggagctctgggaatcagttaaggtgggaatgagaaaggacccttcccgaggcagggtcctccagggaggagggtaaatctggcttttctgaccatccctgggccttaaggggcaggagattggatagcagtggtagcctgggccctgtcctctgaagggctgggggcgtggcctgccagttgcagagggtggacaactgaactagttttccctgtctgtccctccagagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttcagaggctaggttgtttctgtgggtgccttatcagggctgggatacttctgattctggcttccttcctgccccaccctcccgaccccagtccccctgatcctgctagaggcatgtctccttgcgtgtctaaaggtccctcatcctgtttgttttaggaatcctggtctcaggacctcatggaagaagagggggagagagttacaggttggacatgatgcacactatggggccccagcgacgtgtctggttgagctcagggaatatggttcttagccagtttcttggtgatatccagtggcacttgtaatggcgtcttcattcagttcatgcagggcaaaggcttactgataaacttgagtctgccctcgtatgagggtgtatacctggcctccctctgaggctggtgactcctccctgctggggccccacaggtgaggcagaacagctagagggcctccccgcctgcccgccttggctggctagctcgcctctcctgtgcgtatgggaacacctagcacgtgctggatgggctgcctctgactcagaggcatggccggatttggcaactcaaaaccaccttgcctcagctgatcagagtttctgtggaattctgtttgttaaatcaaattagctggtctctgaattaagggggagacgaccttctctaagatgaacagggttcgccccagtcctcctgcctggagacagttgatgtgtcatgcagagctcttacttctccagcaacactcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtcttttttttttttttttttttttggtatattgctgtatctactttaacttccagaaataaacgttatataggaaccgtc

SEQ ID NO: 11508 - DNA, 418 bp, Homo sapiens
aaaggtgtcagagtggaggcctccctccccggccccctcctaccccccagagcggcctcgtcctgtctggggtcagataagccacctaagcggggtggggggtagatactcccaccgcaccaaggcctccccttccacagttggctcctttatcactttcccttcagttcacccagcggggacaacacgcagacacccggtggtggctgcagggcccccggcagccagcggtgataatgcagggaaaggcgccccaacctcagctacgcgggcgcccacagggcttctccccacccctacacgtgccccagcgccctggagaccgcgcctgggagctacgagcgagcaccttccctcgcagagatggatcagattagccccctggggcggtggcacctgcccgtcccctcccctcctc

SEQ ID NO: 11509 - DNA, 10048 bp, Homo sapiens
  misc_feature (3322)..(3322): n equals a,t,g, or c
  misc_feature (3343)..(3346): n equals a,t,g, or c
  misc_feature (3350)..(3352): n equals a,t,g, or c
  misc_feature (3359)..(3364): n equals a,t,g, or c
  misc_feature (3367)..(3368): n equals a,t,g, or c
  misc_feature (3387)..(3387): n equals a,t,g, or c
  misc_feature (3542)..(3542): n equals a,t,g, or c
tgatccctggctcagacagttcagtgggagaatcccaaaggccttttccctccttcctgagcctccgggcaaggagggagggatcttggttccagggtctcagtaccccctgtgccatttgagctgcttgcgctcatcatctctattaataaccaacttccctcccccactgccagtgctgcccccacgcctgcccagctcgtgttctccggtcacagcagctcagtcctccaaagctgctggaccccagggagagctgaccactgcccgagcagccggtaagtctccagctctatcgttagaaaggctggagcccactgtgttgacttctgtgtctgtgtctacaattgtgattcttgatcctgggggagtctcccctctcctcatctatgctcagctcccagctgtccagttggcaaggagaggggaaggagagttggaaggagaggggcccaggaggttggggggaatggagatgtcgggggaggcactggaagaatgggaagggagaccccactaagtcagtagagttgcagatgtattttttgagacaggacttagaagaggacagcatttcactgagtgccaacttctcttaagaagggattggagtccatcttatcccagtttgtccctttccattgccagatcctattactatgtttctgccccacctcaattccccactgctatgatattgctgaattgacgtgtcgggatttgaatgctccctacccttcccagttccacacctgcctccactctggggtctgtggcgggagtgattgcaggagcagggccatgacttcccaggccatgttccagctggcctgatgaaggagcaacaacctctccttcctatggagagtgtttttggctgaatctcctcaaccctggcagaatatttctctgtcctcctggggactgggggaagactgaggagagaccagagcctggaatcacagccccagtctgatatcccagtgcaaataaaaacttcaaatcatgccaagccaatgaaacctgggtgcattgccctgcttgtgttattgttttttaaacactccccacacctagctatgttcctaattcctgcactgactctatgaaaaacagctcacaacaggttggtagacaacaggggctggtgtgcatctatacttcctgtcctgtatcccaagaaaagagaagccctaaagcgcaagttttcaccttttggggaaatacatgcttctttgaaaatctgggtcaggtgaagtggctcacccctgtaatctcagcactttgggaggcaggaggactgcttgagcccaggagtttgagaccagcctgggcaacatggcaaaaccacatttctacaaaaaatacaaaaattagccaggcacggtggtgcgcacctatagtcccagctacttgggaggctgaagttggaggatcacctgagcccagggaggttgaggctgcagtgaggcatgattgtgccattgcactccagcctgggcgacagagtgagatcctgtctctaaaaaagaaaaaaaaatttttttgtcccctcaagcccttaaacccaggttaagaagtgctgctctcctacagacactcactcttcccagtccctgtccatccaccaactcctccttcccaccctgtccaggctgaatccacctccacaatgccgctctcaggaaccccggcccctaataagaagaggaaatccagcaagctgatcatggaactcactggaggtaggacatgtttgcatctccctagtgtgggacttcttaagagcatccctaaaccaagagtcccagaaatatatatcttagggtgaacaaacaagagaaattaagtggtgggaaggcgggtgatggggagtgggagagggaagattaagaagggtaaggagaaagagagaaaagattcaacaccttctacccttttcacttcataatctgagacaataccctgccatgttacctgcacaggtccaggaccacaggacccatgagtcagtgaggtatatttgaggaagaaaatataatggagactggcacagactcaggtctcaataagtggttaatttcccttacttctttccccagagctagggagcttgtgtaagtacttaaaatggaaaactgcacaggcatgtttcctgggggtgggcaggggtgcatgcatgtgaagagctcttcaatacctagagactctttggagccagagctcactgagggaaagaaaagggaaagtagttaagacagaagtctgggccaggtgcagtggctcacgcctgtaatcccagaactttgggaggccaaggctggtggatcgcttgaactcaggggtttgagactggcctaggcacatggtaaaacctcgtctctacaaaaagtacaaaaattagccaggtgtagtggcatgtgcctagagtcccagctactccagaggctgaggtgggacgatcgcttgaacccgggaggtggaggctgccgtgagccatgattgcgacgctaccctccagcctgggtgacagagttcatcctaagatatatttattttgtctcaaaataaataatacaaatagggctggggctgtgtctcatacctgtaatcgcagcactttgggaggctgaggtgagaggaccacttgagcccaggagttcaagaccagcctggacaacataatgagacctcatttccattaaaaaaaaaaaaaaaaaaaaagtccaggcgtggtggctcatgcctgtaatcccagcactttgggaggctgaggtgggccaatcatctgaggtcagaagttcaagaccagcccggccaacatggtgaaaccctgtctctacaaaaatagaaaaattaactgggcatggtgccgggtgcctgtaatcccggctacttgggagactgagggaggagaatcacttgaacccaggagatggaggttgcagtgagctgcaatcgcgccattgcacttcagcctgggagacagagcaagtctctgactcaataaataaataaataaataaataaataaataaataaataaataaaatgtaggctgggcgccacggctcacgcctgtcatcccagcattttgggaggccgtggctggtaggtcagttgagctcaggagtttgcgaccagcctggccaacatggtgaaaccccatccctaccaaaaaatataaaaatcagccagggatggtggtgcaggcctgcaatcccagcgacctgggaggctgaggcaggagaattgcttgaacctgggaggcggaggctgcagtgagctgagatcgcgccattccactccagcctggatgatngagcaggactctgtctcaaannnntggnnnaagactnnnnnntcnncccaatctctatttctttntatttatggcgtctgtattggactccacacaagatgggccttgggtttttccgaatccaaggtttctccaatggcctccatctatgatgtccctttactccttttgctctgtaccccatgcccgtacctcttttacccctttggcctctccactntagtattcccattatctccacagtgcaccccagttcccatgcattctctccaagtcccaggaaatcaaaatccctcacaaactagacagcatttgttcccctaaatgacctctgccaggacacacatacacacttagttgtggatgaggtctgcattctgagcccagaaaaccctactttcctctttcccttgattcttcttctttgcctccctgaaaggtggacaggagagctcaggcttgaacctgggcaaaaagatcagtgtcccaagggatgtgatgttggaggaactgtcgctgcttaccaaccggggctccaagatgttcaaactgcggcagatgagggtggagaagtttatttatgagaaccaccctgatgttttctctgacagctcaatggtgagtctggaactttatcactatctcaaagcctggtgcctgttctgacagcttgttagtaggccctgaacctccaaaatgcagtcaacatcccctccctgaaaatttataaatttgttaaacccccagatatattgagcccgcaacagctccagggtgagttacagcccacctctgaaacccagttttcatcatagagccactgaagggttggagaataccacacccttagggagaaaattccttcccagtaaaggtaagtgttaaagatagattgccagataaaacacaggatgcccagtggggcagtccagtcttgtattttgaagttgagatacacaatgaataattttttagtgaagtatgctccatgcaatatttgggacataaagataaaaatttaaaaaaattttagaaagaagataaggcagccaggcatggtggctcacacctgtaatcccagcactttgggaggccgaggcaggtgggtcacctgaggtcaggagtttgagaccagcctggccaacatggtgaaacccccatctctactaaaaatacaaaaaattagctgggcgtggtcgtgggttcctgtgatcccaggtactcaggaggctgaggcaggagaatcacttgaacccaggaggtggagttgcagtgagcccagattgtgccactgcactccagcctgggcaacaagagtgaaactctgtctcaaaaaaaaaaaaaaaagaaagaaaaaagaaaaaaggaagaagataaggcaaagaataaaattgaaattttaaaatacagaatatacaattaaatttgagtttcagatgcacaatgaattcttttttaaatatgtcccatgcaatatttgggacattaaaataaaaatacaggatgtccacttaaatttgaatttcagatgcaaatgaataatttttttagtataagtaagtcccaagcaatatttggaggcatatctatactaaaaaagtatttgggtcaagtgtggtagctcacacctgtaatcccagcactttgggatgccaaggcaagaggactgcttgagtccaggagttggagaccagcctgggcaacatggcaagactctgtttctacaaaaaattaaaaagttagctgggtctggtggcgcacacctgtaatcccagctactctggagggtgaggtgggaggatggcttgagcctggaaggtagaggatgcatgaacatgagccatgttcacaccactgcactccagcctgggtgacagagaacccatctaaaaaaaaaaaataaaaatttgttgtgcatctgaaattcaaatttaagtggtatcctatatttgatttgctaaatctggcaaccctagaaagagttaattgagtttttacagccacctcccatttgagccattcttccatttaaagggtcagtctattccctaagaagccccaggtgtggagactgaaacggtccttcaagatatattctagtcaggctccttctccaaagaaagaggagactggagaggggccaggcacaggatggtatagctgaggaagaagggccttctccatttcctttcttcctcctccaccctctctgagtggctgggggagagtggaaatagatgcctgcatggggccgggggcagaagtgtctgtcattggtcctcatataggagcagagtaaaagtgctgagctgctcatatctaactttaggaggccaaaagcactcttctctgcctgggtctggttacactgggtggagcattggggtgtacatggtgggatggccaggagagcctcctgaagaagttggtggggttatttttaggctttgggtttgcatctaatgttgcccttttggccacacttccccccacctgctacagtgtcactgtcaccagatgaggtgccaacaggcaccaagcaggagacgaggaagagaaagaaggagagagaagagagttctgactggcggacaagctgaggaagggagggggcagagatttctctagcaccttgtaattaagactgggtgctccatggcaaccccatcctcccaaattttagttggggctggacacagctcatgcctgttatctcagcactttggggaggctgaggcagatggatcacttgagcccaggagtttgagaccagcctgggcacatggcaaaccctgtctctaggaaaaaaaaaaatacaaaatttagctgggtgtggtagcatgccagtagtcccagctacttgagaggctgaggtgggaggattgcctgagccagggaggtggaggttgcagtgagccgagattgtgtcactgcactccaacctgggtgacagagccagattctgtctcaaaaagcaaaagaattttttttcattttttttttttaaagctgggcaggcgtgttggtcttttttgacttgttaaggatgagaaaggggagtgtggagaacacgctgcccttaccctaggtataactggaggaaacgagccaagggagtcctacctcttaagaagagtttaattcgggctgggtgcggtggctaacgcctgtaatcccggcactttgggaggccgaggtgggtggatcatctgaggtcggagtttgagaccagccggaccaacgtgcagaaaccccacctctactaaaaatatatcaaattagccgggtgtgatggtgcatgcctgtaatcccagctactcgggaggctgaggctgggaattgcttgaacctggaaggctgaggttgcggtgagccgagatcgtgccatcacactccagcctgggcaacaagggcgaaactctgtctaaaaaaaaccacaaaaaatcaaacaaacaaaaagaagagtttaattctcttagtcagcccatgtactacccatcaactggagggggaaatatcagaaaattcagggtcttctggttagccactatttctgcctttgctaaacatacctctgtttttgtatattttccatacccattgctaaccttcccctcactttgtcttcttttcaggatcacttccagaagttccttccaacagtggggggacagctgggcacagctggtcagggattctcatacagcaagagcaacggcagaggcggcagccaggcagggggcagtggctctgccggacagtatggctctgatcagcagcaccatctgggctctgggtctggagctgggggtacaggtggtcccgcgggccaggctggcagaggaggagctgctggcacagcaggggttggtgagacaggatcaggcaagtacactcacccaagagtaatgtgtttggtccctagagcagagttgtacccaggaatgatgtctacgctgagtgtggggagcagaggaggtcagtttaaatatcttaatattaaatataataatatcagtttaaatatcataaatatcttggtgaattacctgggtccaggagtatatagagatgtgtctattctacccagaagccttgtttttcagttactttcctggcttttcggattcagtcacagatctgcccacagactatcattatgccacaaaccttatacaattaccaggatattatatctttagtccctggctcttgcaatttccctagtgtaggggcgtgggattacctttcattggctactaaatgctattatttgactgaattttctctcccatggctaccaggagaccaggcaggcggagaaggaaaacatatcactgtgttcaagacctatatttccccatgggagcgagccatgggggttgacccccagcaaaaaatggaacttggcattgacctgctggcctatggggccaaagctgaacttcccaaatataagtccttcaacaggtaggggtggtgaggaaggaaccagatgcattctagtgtgaggcactgtgtctttagttaggatggagactaattcaaatgtttcagaaggaggctaaggagagatggcagggatatgggggtcctaatcaaaggccctgctcttttcactctatctcagcttcatcatagcagtgtgatgaaggaaaaaatttgctgggaggcaggatttgaattctagctcaatggtcatttattagctgtgtaggcatgggaaaatcactctacctctgagcctgggttgctttgaacgttacacttatttattttttgtcttttttttgcttcctttttgtggagaatggggtctcgctatatcgcccaggcaggtctcgaactcctgggctcaagctatcctcccgcctctgcctacctgagacctgggattacaggggtgagccaccgtgcccggcctgctttgaatgttaaatgcgaataacattttacatgtctgaaggcctcttgaggctctcttccattcaaggttaggatgccattattctccctgtaatatgattctatttccttatacttttttcttttctttctttccttctttttctttgactcagttttgctcttgttgcccaggctggagtgcagtggcatgatctcagctcactgcaacctccgcctcctgggttcaagtgattttcctgcctcagcctccctagtagctggcattataggcacccgccaccacgcccagctaatttttgtatttttagtagagatggggtttcaccatgttgaccaggctggtctcaaactcctgacctcaggtgatctgcccgcctcgggctcccaaagtgctgggattacaggcgtgagccaccatgcctggccaccctgctttagatggctctaagtctctgttcttttggaattaggcttctctagcccatggagaggaggtctgtgtgaaaggatagggaagagctagaaaggtactcttgtatttggtcctaaggagcctggattttccaggcaacaataattactcttagccaggctatccactgtccactagggttggagagagggggtctctatattgcaatttttttttttttttttgagacagagtcttgctctgttgcccaggctgaagtgcagtggtgcagtctcggctcactgcaacctccacctcctgggttcaagcaattcctatacctcagccacctgagtagctgggatgacaggggtgcgccaccatgcccagctaatttttttttggggggggggtgtctcgtattatttagtagagatggcgtttccaccacgtctgaccaggctagtctcaaactcctggtctcaagtgatccacccaccttggcctcccaaaatgctggtgattacaggcgtgagccaccgcaccgcacctggcctttctacattgtcatgtaaggtgacctcaggcccttgggtctatagtatttggggtcactttctctgaaatgctggtgctgggtcacagctatccaagagtctctagtacacactagactccttttctcattattagctttggggaaacaagctaaccaggaaggcaaaatgggatgctaaggaagaagaaggagtacagatgcaatcccaaactagaattcacagacttccctattctcaaagagggtagcatctcatgataaggctctgtttcttttattctgattcttaattaaataatgtgtccccttctcaggacggcaatgccctatggtggatatgagaaggcctccaaacgcatgaccttccagatgcccaagtttgacctggggcccttgctgagtgaacccctggtcctctacaaccaaaacctctccaacaggccttctttcaatcgaacccctattccctggctgagctctggggagcctgtagactacaacgtggatattggcatccccttggatggagaaacagaggagctgtgaggtgtttcctcctctgatttgcatcatttcccctctctggctccaatttggagagggaatgctgagcagatagcccccattgttaatccagtatccttatgggaatggagggaaaaaggagagatctacctttccatcctttactccaagtccccactccacgcatccttcctcaccaactcagagctccccttctacttgctccatatggaacctgctcgtttatggaatttgctctgccaccagtaacagtcaataaacttcaaggaaaatgaactca

SEQ ID NO: 11510 - DNA, 145 bp, Homo sapiens
tgtaatacccagctactcagtaggctgaggcaggagaattgcttgaacccaggaggtggaggttgcagtgagccgagatcgcaccactgcactccagcctgggcaaaaagagcgaaactccatctcaaaaaaaaaaaaaaaaaaa

SEQ ID NO: 11511 - DNA, 7071 bp, Homo sapiens
tgtaaaaactcgtttagtttgaaaaatcaatgtagaatattaaattcaccaaacacagatagatcagatctacataaaaatatgtcttaatatcttagaattttcctttactccaaaaaaccccatatatatatgtttctcctttataagcttagagattgctttggtggtcaagtgcagggcggctgggggaggtaagaccttcaggaaggccatatcccggacaagacccagaagggaagcccccagagccaagggtaggagggccccacccgggtctcagccactcacttctccagggcggatccgagacactcacaggcctcagggaggggccaggtgctgctcctggtcattgcttcccccacaaggtttgcatgaggagcagagacagtccagtctcctgaacacccacagggcacagagcccagtgcagggggcagacaccaccgcagctcctgggaccaagaggaagctcccagaggggggcccaggaacgctggggtgggtggacagggctgggtaggggttccttctgggccaaacccccagagcagcagagcaccccagtccaaggaagctcttctcagggacccaaggctccagagccaggaaaaagggaggggcggggcgggagcctgcatccccagtgcccatcagctctgggggaaacctccgtctcccgtccctatggtgaccacagcagcagagggggatcctccatgccccaggcaggctggcatcagggccacacaggggccaggagcaggggtctcggagtccacagctcccggccccagtggtgggctcagggctcctgggcgccatgggtctcaccacagcctcgccagggaacaggaccatagggagtccttctccccatctctagccacccacaggccagcagagcacacagccccaccctcgcacaggcacctgtggtctccaagtaaccaagcccaggccccaggggccactgcagacagcagctgggatctgcagagggatctcagcagcgagcaggcagctggcgaggagaggtgcgtgtgagggaggggtggccctctcctcagtaggaggaagtaagagggtatctaggccaatttattcagctggaaatcaatctgtccagggctggaccaggcgcctccccctcgatacagctcctggctgaagaggtcatcagagcagcagctgtccccaggccagtgtcacgtcactgcgtacagttcctcccgatcgttcttgcagatctgatagtggcaggggaatttctgcgagcaggcccagggctcggcgggctggtcaggtggcggcagcagcaaggctgcgctcccggccagcaggatgtgccagatgctgtgggtgtagtagtagttgtcgctagtcatcatggaggtgtagatggcgatgcccacagaggccatagagacgccgggcaggaggtagaaggcccagcgctgccacgaggtggggtagcactggcgccggtgcccgcagcggtaagcctggagaaaacagccacgcaggtatcagtgcaggtggggccgcggctgcagctcccagggcccagatacggtggttactgggggcctgcccaggtctgggcagcagaacgacaagggtgggctgcttcgagggggctcaaggccactggtcctcaggcccaggcctcagggacacagccatgctgggcctctgtgggtgccatggcaacccccagcagatatgggcattcactggttggagcaggaccaggaacgtggctagagcaaggggccaggctctcttctccgagcacctgggcagcagtgccagccagcccggctccttacccacatggaggccatgatcacgaaggcaaagaggcagggccccagcatgttccacatgcccctgcggtccagctgcaaggacatggcgatgaccagtgtacccagaagaaacagcacctgcgcaagacacagggatgactgcagggacgtctctgagggctcaaggcccagcaggagcacgcgtaccccacggccccacagcacctctgcctgccccctcggagctgctgccaccctcagaccagctctgccagcctctgactagctctgccagccggcagggacatgcccctccttcagcttctgtattgcatccacaggtgaatgtggccaggcaggcatctctgggggattagacgatgctcacacaaactggacagacgcatatggccgctctgcacccacacactcactagccccctgtaccactgggtttctagaagtcccccatcagggtggcttcagtctcccacccactgttccatggggaggggctcccaccccccagtctccatcagacacctctgcccacagcctacagttctctgcctatctgcaggttcaggccccgcactcagccctgcaggaccctggtgcttcccagcctcccctctgccctggctgtggggctcccatgggcacccccttggggcagtacccagcctgcagttcccagagcagatgggagggcagagcatgcagctcacaagcccagggcatgagtctccccttgccagggccagctgccacagagagtccccaaagcatcattggccccaaggacccagggagcatgggtgggggcttctcgaaggcagggggcctggcctcccctgcctaccaccttccttcctggcatcctccaaacagctggcactgccccctcacaactgcctgcggggtctcagacccgcatctccgtgtggcatcacagaagacatgaggtttcttttcttttcttttgtcacccaggctggagtgcagtgctgtgacctcggctcactccaacgcctccaatgcctgggatcaagcgatcctcccaccttagtctcccgagtggctgggaccacaggcatgtaccactacgctcggctaacttttcgattttttgtacagcccaggctgctcttgaacccctggcctcatgggatcctcctgcaagtgttgggattacaggtgtgagccaccatgctcggccaaggcattacaggtgtgagccaccatgctcggcctagggattacaggtgtgagccaccatgctcggccgagatgtgaggtttccaggggccgtgcccaacgccaggtccggcctctcccacggtactgcctttcgcaggctgcacttgggggccctgctcccccggagcccacaccccacgtcgagggccactcacgtatttcaggactgtcttgagccgtgccatgcacaggatggtgacccagatggccgccccggagcccaagaagtcgcagtactgcagcgtgtcgtagctgaggatgcacagcaccgcctccccgggctggtcgcaggcgtggtagaactgtggggaggctccatgagcgcggtcctgccctcccaccccacatccctgcaggaggggccagcctaccgtggagaagaacatggtgtaggcgtagacggaggcctccaccaggaagaatcgccgcactgagacggcgatgggggccaggaacatgaggttgctgagcgtgagcagcagtgtggccgccctctgctgggccaccgtctgggctgtgctgttgtccgtgcagctccacccacgccagcctgcggtcacaaaaccccgacgcggaggctgggggcactgctgaacctcagggcccacccctcacccaggaccctgcagagaagccccttcctcacccaggagcaagcagggtaggcacggcgggcggggtccaaggtcaggaggcagtaccaccccccggggatacctggtgcctgtgccaggcagacggattgttggtggggaatgggggagtggggaggaggctttgcccctgcattgctctgcaagggtctctctccagccccttgcggcgctcccccaggggaaaggcacagcacagcactggaagccaacagcagcagcgtctcggggcgggcggggccctggcactcacctgccttgcagctgcagctggcatacaggtagctgtgtctgcggagcaggaggcactggccatagggtccacaatcgttcaaacagggcaccaggtacaaggtggtctccacgtggaccacagcctgctcacagtccctttgaggaaggggccacaggaaagctggtgcagtgatctgacagcccagctgccaccagcgctcccaacaggctgacagacatgagaacgcagcattagggcccccagctttcagcagccctggaggaagcacccctctagctgggtcactccgaacgccaacctcaggcagcccggcctgtggtcctgagtgaaatgacagggtgcctggcccccgtctctgccctaggtttacttactcagcattctcagggcacatgagctgcagggagaggtaccagttgtctgtctctgggtaggggatgatgaggttggccctgcgagaccaggcgctcagagacaaagggtagccctggaagaaggctgcaggggagccagagggccccatcagaggaggccggggcggggggctggccggggccacgctgacggtgacgcctgcccatcatacctgtggtgcagttgagcgaagtattgaagccaaggaagggcgaggcagcattcacgcaggccactacgacggtctcgttccgcatctctgtctggaaagggaggcggtgccggctcagctccagcagcccctggccgcagtggggtcatctgccccacgtgccagctcagcctggtgctggtgcctttctttttttttttttttctgagatggagtcttgctctgtcgcccaggctggagggcagtgccgcgatctcggctcactgcaacctccgcccctgggttcatgccattctcccgcctcagcctcccgagtagctgggactacaggcgcccgccaccacgcccggctaatttttgtattttcagtagagacggggtttcaccgtgttagccaggatggtcccaatctcctgacctcgtgatccaccctcctcggcctcccaaagtgctgggattacaggcgtgagccaccgcgcccggccggtgctggtgcctttctctgagactcctgcaggcccacggtgcaccgggaccttcctccccgggccctgggacatcctgcctccaccccacctctgacccgagctaccccacagccccggggcctgttgacaggaacaaggctgcccagcaggggaggccccccaacatgggcccctgtcttggcccgtgcctgctggtgtcactgtgccgcctgtcccgtgccaaggtaaatgaggaggcgctgcaggggttgcccggcgccctgcccgagcccaggccacaggccgcttgcagacagcaggtaccttgttggcccgcagggagatggtgagggaacccccgctgtccatgccggtgttcaggcgcagccgcatcacggagggcgtgtccgaacacaccctcaccgagaccctgtccaggggctggaagtgcaccgacaccacgtccatgtcctcccgcgtgactgggtagtttgtgaggcagaaggggctgcggtccaccctgccactcctgcccaggtcctggtggtcggggctcggggacagcagaccagaggaggcattgaagctctggttttggctgctctgcagaaggggctggatggtcacgctccgtggcctgcaagctgccgagaggacaaggggtttggctggaggaaagtctggggatctggggaggggcagggccatccctccagcccttgtgcggcccacctgtgagggcagctacagcactgaaagccactgtcccgaggggccccaccaggctctcagctgtcacttgcagccaccggtcccagggcggtgagggcagcagcaggcggcagggccagggggcaccggtgcaggtgagcaccttctggaagttgctaggcagggtgaccgggcccacggtgagacgcacggggcagcccaggctcccattggacacgcagtcccgcagctccagcagaagctcccgcgtgtaatcggggacaaagaccctgcagcgaggggacacagctggctcaggctctgccattcctcagcccagggacgcagcgtgcccaggctctgctgttcctcagcccactctggtgggggccaggcatctggaccacttcccagcccaaccccaggactcagggccaggctctcgcacccactccaccgaatctgagaaggggccggagggcagagccgggctgccccccaggcccccgctcacttgaggtagctgggatgggagaggagggtctgaggaaggggcacgtccggctccatgatggaaatctcgaccacccgcgtgaccagcagttcaggctggaagacgtaggcacaggtgggagccaagccctagggaaagaacaggtgtgggcgggggcggtgtcagagaatgcaggtgtgagggcatggtctcaccagacgcccccggcatgcagggagcagggctggccccagagtgcagcgtggagcctagagcgaggaccaccccaaagaggtgaacggcagggacaggccatcgccgcaaggttctctgcctccatcccggagggcagcccccctcaccttcaactcgatcttctgggatgaggggggcaggtgggcggccacgaaccagtccccgggggccgggtgggaaacgttgacggaggcattgcttctcggtgtggtgctcagcggcaccccgacctggaaggagggctgtaccgcggtgtcgtccgggaagctggtgcccagcgggttgatgaccggaggggcgccggaacggaagtgcctggagacgggagagcagcaccgggttcaggcacagggcttggccaggcgcgggagggtgggcaggcgggcgggcagccacctacacggtgatctccgcgtcggtgcaggcagcgccgctctcccgggagacctgcaggagccagcgtagaagcacagcatctgggggcacgcggaagcggaagagcctggcactgccgtaccagctgtagaaggacagcctctgcggggcctgcgagaagtgctcggacaccagccccac

SEQ ID NO: 11512 - DNA, 3158 bp, Homo sapiens
aaagatacacacacacagcctggcccagactttactcgctcccggccccacgggcacaaggaacactgccgcaaacgtcggggcccagcctgagaggagcctctgggcggcccaggcctcctggggatccctgccaagctggccccgggctggaaggtgcatgggcagcacacgaaaccaggatccacccactgcccaccggtggccctcacagctccccgggatctgtgtcctcagtgcaaagggcctggcagggaaagctgggcctgttggtcaggcatggaggagctgtgtggtcactggccactggctctcttctgcaccaccgccggctctgacagtgcctgctgctgcagctgctggatcagctccgccacatagatcttgaacaggggtacagggtcctgaaggagagaggggctcatggtgaggccagggaagcccagggcagctggagttccgacggggatgggatcagcagctgccgcccagaggaaccggggcatgagaggccctggagggcagagtcctgtcggtgagatgaggaaccccctcccttggggatgccggaggcacacacatacccctgtcccatccctgtggtcatggataaacagagggaataggggcagccagctgccatgccatcaggggctccctgtcctgacagctacctcaggctccagaccctgggatgctggtggccgagcaaaccctcagtgcaggaacccactcctcctactgagggtcctgggacagaacagggtggggacttggaggggagggagcgggccatgctcctctgggtgggcaatgcagagcagcagctcttccccaagcccacccagtgcaccagccccttgtgcaggctctctccaaggcagcacactcccagaccctgaacaccaggctctgggcaggcagcatcggctggtgctcacacactcaccttctcctccaaaagtctctgcttctcaatggcctcctccagcgtgaggcccacccactctgcctcctcctctgggatggcaaattcctaggcaggcagagatggaaagggcagtgaggcccagggccgggccacgagtccccaggtgtagggagcgggacggaaaccctcaccttgtacttgtcgtagatggctgcccgccgctcggggtcctcggggtgcagctgggggtcctgccgggcaagccgcagcagcatccctcgcttcaggtccatcccaaacttggagcacaggtcctccttcggggtctggcagaaggctcacatggggccaggtgctggtggcagggccccacctacccttccagccaacccacctggctcctctctagccgctggtggtcccaggacaggacagagaaggcccgggtggggccgcctcagcaccccagcctggggggtgggatcagcacagaagcaagtccaagtgcagggaaaggggcggctgtgctcgctcaggccccacgggcaagtcagccacccacagagcgacagcctctcctgaaggcaggaaaccccactggtgctggccagaaaggggcatggccccactcacgctttcccagtgaccctcctgtgcagatgtcagcgtgccccggtgtgatgctgacctggggctcccgtgagtctgactggcccatcccagaccctgtgtgcactgactcgccccaccccgcttgccttgaggatgtaaaagtcgagcccataagcctcatcgatgaggtccagggtccgcatggtcacagtcactgtgaacttcttgtccaggatctcactgtagaactctcgctcaaacagctgtggcttccacactttcttcagcctcttggagagctgagggtgcaacagagcctccatgagtactgctgctttctcttacataccaaggggggcccaggcaactgccctcacctcccccccggaggctccatcacagaaccactgctgtcagactggggacctagagctaactgggccggcccccagcccagtgccgccccagcccgacccgggtcctgactgtgtacccagaagtcagctgctccccaacaagctgggcgttcccgccctggtcacatggttgctgcatgtgtttcagaaacatgtgcgaccccacagtttacaggttgtcacattccaacctggaggtgacacaagtctccccacaggcttcagcagtcccgccaggaagtccaccacaagcagcctcgaagctctgctcgcctcccccacctgctctgctcgcctctcccacctgctctgctcatcacacaggcctcctccccatcctaactttaccccgactccccacggcctctggttgctcccccggcctgagtcaccccacctcacccctactttatcagtcctgtttgccagaactgcggttcttcactcagcgtgctcctttgccggagatgtgtcgcctccaggctgtaatccccagggcccacccaggtctctccaggtaccccgggcgtccggcacagagccggcacagccaagccctgagaggagcccctgaaggccgcctgcggacccaccttgtcgttgttggcatatatttggcccaggatccagccctcgccgccccacaacccccgctgggattcggggggaaagtagatgggaatgggcacgtcctccacacgctcccgctgcccgttcttggggttgatcttgaacttggccccatgaggcctatagtgcacgggagtgggcgtccgctcctcctccagggagcgcaggtagtggccgggcaggcgggaacagatgccctcccgcagctgcagccgcttccagagccacacgggatacttgtgtagaggcatcgcgagcctggcgggaggtgggggctcgcagtcagtcgcagcctggccaggcccccggcactcaccccctaccccggcccccgactctcacccgctaccccggcccccggctctcacccgctaccccggcccccggctctcacccgctaccccggcccccggctctcacccgctaccccctaccccggcccccggttctcactccggcccctgtcccgcacccacctgcccctccccttctgccccggcgcccccccacaccccacctgcccgcgcccacctttcagggttcagagcccaccggaaccggaagccgat

SEQ ID NO: 11513 - DNA, 1529 bp, Homo sapiens
ggccgacacagccccttgatgtggggaatgtcctagaaaggaggaagccacgggggcagggagcacggggactcggaggccttggggtccaaggggagccgaggggagctgtcaaggcccacagtggctgaaccatgaggagctgctccccagcaaggccggctgcagggcttggtgggcctgggctgggcggaaggctcctcccagcgtgggggctgctgtggggacagcaaggaggggtgcagcgagggcctggagaaggctcaggtgcagaccctcagccgtggggcctcctccagtcgccccacagcctgggcctggcacccccccaccaagccagaggggccgaatgccagggcacctcagctacacaaaggctcggacccctagcaggacctgggcgccgcggctgactggctgcctgacggagaatggagcctctctgtcacctgggccaacatgaatgacccttcgtctggtgtctctggggttctggctggagagccaaaggctggaaggtctggacccgctgctcactggggtctggatgccaccgtggagctgcctctggcgcagcgggagaacaagcagagccaccctggtcgtggggacggcacccgtgtggccggggctgtagccagtgaggccttggtgacgggagcggctggagtgccacgcggtgtcccccgtggtcccacagcagccctcacaccatcaaccggtccaccgcgtcccagccatcccaggagggggcggggacatctctgcagtgacaggaatcggctaggcgctggcatctgtgcgcagccgctcggccagggtttatgtgctcggcggagacagccctgggggtgaggagcgaagggagatccgattcaggggccacttggggctaagccatgtacgtatggccgaggccctaagtgagagctggcccagggctagatcacgtggccgtcgaggcccggcctgccgcacggtggccaccagccagagcccttgccgcccacccttcccatccgccgggacgccagcctcaggagtggggtcagatggggcctgtggccgggctcctcagccactgcccactgagctctcggccccccggccagcgccttggccaccactggtatagctggattcctgggaacacctagaaaccgggctgcttggaaacactgtggcgttgccatgtggggctcttcctccgcccgccagggaggctgtccccggtgcccggtgctgtggcccacacccgccaggttgcagaacgtgtgtccccctggcgaggccccccagaaccgtgtttttttttttctaaaggagctgactcggggccaagcacattcctcccggcccccgaggcttgctcttgtccagccctgggaacgcacaggcggccgagcccgtggcctggccgaggaggccgccgctctgcgaggggagcgctgttttccaggccggcgtctggaatgttgctctgccttgcggtgtgagccgactcctgcccccatttcagctgcggccgc

SEQ ID NO: 11514 - DNA, 1528 bp, Homo sapiens
ggccgacacagcccttgatgtggggaatgtcctagaaaggaggaagccacgggggcagggagcacggggactcggaggccttggggtccaaggggagccgaggggagctgtcaaggcccacagtggctgaaccatgaggagctgctccccagcaaggccggctgcagggcttggtgggcctgggctgggcggaaggctcctcccagcgtgggggctgctgtggggacagcaaggaggggtgcagcgagggcctggagaaggctcaggtgcagaccctcagccgtggggcctcctccagtcgccccacagcctgggcctggcacccccccaccaagccagaggggccgaatgccagggcacctcagctacacaaaggctcggacccctagcaggacctgggcgccgcggctgactggctgcctgacggagaatggagcctctctgtcacctgggccaacatgaatgacccttcgtctggtgtctctggggttctggctggagagccaaaggctggaaggtctggacccgctgctcactggggtctggatgccaccgtggagctgcctctggcgcagcgggagaacaagcagagccaccctggtcgtggggacggcacccgtgtggccggggctgtagccagtgaggccttggtgacgggagcggctggagtgccacgcggtgtcccccgtggtcccacagcagccctcacaccatcaaccggtccaccgcgtcccagccatcccaggagggggcggggacatctctgcagtgacaggaatcggctaggcgctggcatctgtgcgcagccgctcggccagggtttatgtgctcggcggagacagccctgggggtgaggagcgaagggagatccgattcaggggccacttggggctaagccatgtacgtatggccgaggccctaagtgagagctggcccagggctagatcacgtggccgtcgaggcccggcctgccgcacggtggccaccagccagagcccttgccgcccacccttcccatccgccgggacgccagcctcaggagtggggtcagatggggcctgtggccgggctcctcagccactgcccactgagctctcggccccccggccagcgccttggccaccactggtatagctggattcctgggaacacctagaaaccgggctgcttggaaacactgtggcgttgccatgtggggctcttcctccgcccgccagggaggctgtccccggtgcccggtgctgtggcccacacccgccaggttgcagaacgtgtgtccccctggcgaggccccccagaaccgtgtttttttttttctaaaggagctgactcggggccaagcacattcctcccggcccccgaggcttgctcttgtccagccctgggaacgcacaggcggccgagcccgtggcctggccgaggaggccgccgctctgcgaggggagcgctgttttccaggccggcgtctggaatgttgctctgccttgcggtgtgagccgactcctgcccccatttcagctgcggccgc

SEQ ID NO: 11515 - DNA, 461 bp, Homo sapiens
cacgctccggtgccagccccggcaggctcaggggaggggagaggatggtttctatggcaacctcactttttgttatttcttattttcttttttatggtttctccaactttgaagctctccagacagtttacagactgtgaaaggaaaagtacttttccttctctgccgagtgcccccagcagggccgccctccagccccacccggagagccccagcgcgggtgtggggaaggggccagggcggggcttcaaaagcaaaccagacacaccagccttcagagggttcgttatttttaaaaacagtttatggagggaatgaattatttttctcctaaaaaagtaggaaagtatttgcaaaagaatccttcagggacctgtagccaggtcagcagtgggggcttgagagcggccaccatgcgagggtcgtgtccatccttgccagcctccgagctggaggccata

SEQ ID NO: 11516 - DNA, 461 bp, Homo sapiens; identical to SEQ ID NO: 11515

SEQ ID NO: 11517 - DNA, 148 bp, Homo sapiens; identical to SEQ ID NO: 11425
  misc_feature (136)..(136): n equals a,t,g, or c

SEQ ID NO: 11518 - DNA, 96 bp, Homo sapiens
cccgaaaaaaaaaaaaaaaaaaaaaaaaaaaaaaaaaaaaattaaaaaaaaaaaaaaaaaacaaacaaaattaaaaaaaaaataaaaaaaaaaaat

SEQ ID NO: 11519 - DNA, 130 bp, Homo sapiens
aaaaaaaaaaaaaaaaacaaaaagaaaaaaaaaaaaaaaaaaaaaaaaaaaaaaaaaaaaaagaaaaaataaaaaaaaaaaaataaaaaaaaaaaaaaaaaaacaagaaagacaaaaaaaaataaaaaga

SEQ ID NO: 11520 - DNA, 143 bp, Homo sapiens
aagaaaagaaaaaaaaaaaaaaaaaaaaaaagaaaaaacaaaaaaaaaaaaaaaaaaaaaaaaaaaaaaataaaaaaaaaaaaaaaaaaaaagagaaacaaaaaaaaaaaaatagaaaaaaaaaaaaaaaaacaaaaaaggag

SEQ ID NO: 11521 - DNA, 116 bp, Homo sapiens
aaaaaaaataaaaaaaaaaaaaaaaataaaaaaaaaaaaaaaaaacaaaaaaaaaaaaaaaaaaaaaaaaaaaaaaaaaaacaacacaaaaaaaaaaaaaaaccaaaaacaaacag

SEQ ID NO: 11522 - DNA, 151 bp, Homo sapiens; identical to SEQ ID NO: 11427

SEQ ID NO: 11523 - DNA, 117 bp, Homo sapiens
  misc_feature (2)..(2): n equals a,t,g, or c
  misc_feature (4)..(4): n equals a,t,g, or c
  misc_feature (38)..(38): n equals a,t,g, or c
  misc_feature (49)..(50): n equals a,t,g, or c
  misc_feature (92)..(92): n equals a,t,g, or c
  misc_feature (101)..(101): n equals a,t,g, or c
ananaaaaaaaaaaaaaaaaaaaaaaaaaaaaaaaaanaaaaaaaaaannaaaaaaaaaaaaaaaaaaaaaaaaaaaaaaaaaaaaaaaaanaaggaaaanaggaaaaaaaaaaaaa

SEQ ID NO: 11524 - DNA, 126 bp, Homo sapiens; identical to SEQ ID NO: 11430
  misc_feature (9)..(10): n equals a,t,g, or c
  misc_feature (14)..(14): n equals a,t,g, or c
  misc_feature (20)..(20): n equals a,t,g, or c
  misc_feature (95)..(95): n equals a,t,g, or c
  misc_feature (107)..(108): n equals a,t,g, or c
  misc_feature (110)..(110): n equals a,t,g, or c
  misc_feature (118)..(118): n equals a,t,g, or c

SEQ ID NO: 11525 - DNA, 118 bp, Homo sapiens
ggattacatactgttgccaactgaaggttggaataaacttgtcagctggtacacattgatggaaggtcaagagccaatagcacgaaaggtactgtttaataataactgactataaata

SEQ ID NO: 11526 - DNA, 18933 bp, Homo sapiens
tccctgacccgtcctccagccctaactcctccctgaccagtcctcctgccctaagtctcctccctgactggtcctcctgccctaagtctcctccctgactggtcctcctgccctaactcctccctgactggcctccatccaagcagagcttgagtattgctggttccctgctcaaacccaccactggttgctggttccctgctcaaacccaccactggcactggcttcccatcacatacagaataaaggctaaatgtctacgcttggcacagaaagtcatcaacaggccccagagcacgtttctggtgttatcttctgctaatgccctgccctcactcctatgctgcagctgaatggaacgagccattatcccctcaggaacgctggcttctcagtaaacgattatagcccagaagctctgtcatcacagaacctagctattggctaatgggtcagctttggcttcatttctctgaataatttatttcaaaacataatcccaaggaacaaggttaggaaaaggggagggtgacagggacagagggagagcctgtgcaaagacgtgttatccagttggcccctgctgtggctggctggttgctcaatcctgtaagatcttctaagaagctttatgagatgtagtgagaaccatctgtcctggggatgagtctgtctgtcggcttccattcctcatgggttatgagttgctccacaggattctggatgtatacagatgctcttcatcttaggaaggggttacgtcccaataaacacgtggtaagtcaaaaatactgtaagtcagaaacacatttaataccctgataagcccatcataaagtcaaacaattttaaatccaatcattgtaagccaggaccatctgtatacccaagacatatacaaggatgttcatagcagctttattcaaaatagtgaaaaacaaaacaatccaaatgcacagcaattggaaaacagacaaataaattgtggtatatttatacagtggaatactatgcaacaacaaaaaaggatgaagcataatactacacacagcgtgagtgagtctcacagacacagtgttaacagagagaatccagacacaaaagagcctatctatgcatgattccatttatatgaagttcaaagacatgcagagctaatctatggtgatagagataagaatggtggttacactgaaatgggaggatcgctcaaacccaggaggcggaggctgcagtgaaccatgatggagctgcactccagctttggagacagagcgagaccctgtctctaaaaaaaaaataaaaataaaaaataaaaaataaaaaaaaatgattgttccattctgtggtggcaagtgggggcttgactggaagggaacacaagggcacctgttgaggtgctgagcacgttctgtatcttgacctgagtgtcggatacatcctggggatacatacgtacataaaaattcatcagggtatacgctacttaagctgggcgtagtttacagtatgtaggttacaacataaaaaagaagtgaatgaaccaaagaatactgggctccctggcgtttcctcttctgcaacccaaggaaataagcctcggtgtggagagggcctgtcctcagggcctggcaaatgtaggcgattcttaccacgtctccttcggtaagcccacctggcaagttctcatccacataatctgtgcatgctcaacatttgaaaccagtggggacccatttggaccccaagagttggtattagagatcattttaaagtgaaaactggccaggcacgatggcttacgcctgtaatcccagcactttgggaagctgaggtgggcggatcacatgaggtcaggagttcgagaccaacttggccaacatggtgaaaccctgttgactcaggatgactcagattagagcaggtgactgggggtgactcaggatggagcaggtgatagaggctaggagggggttgtttactgaaactaggggcaaggagatgaagaaaacgaggaagttaaactttaaaatgaagagctgaacatactgatacattgattctttggagaggatctcagaactcattgtacttaacaatttacaggctaaaacctttgaagaagaatttattatatcctacaaacctgggaggcagaggttgcagtgagccaagattgggccatcgcactccagcctgggcaataagaatgaaactctgtctcaaaaaaaacaaaagttggccagggctgggcgtggtggctcacacctgtaatcccagcactttggggggctaaagcaggtggatcacctgaggtcagaagtacgagaccatcatggctaatatggtgaaaccccatctctactaaaaatacgaaaaaagaaaaaaaaaattagccaagcacggtggtgcacacctgttatcccagctgcttaggaagctgaggcaggagaattgcctgatcccagaggcagaggttgcagtgaactgggattgtgccactgcactccagcccaggcgacagagcaagattctgtctcaaaaataaatacataaataaagttttagagcaggaatgaaaggaagtaaagtacacttggaagagctgtgttggcaactggagagatccgagtgcctcatctgacccttgacttgggattaatacattggcatgagatgtgagcagtgactcaaagttgctcagaaaaaaatcttcccccgctatttagtactgcagctggcacctgccctccccacacactgcagctggcacctgccctccccacgcactgcagctggcacctgccctccccacaccagtatttggtactgcagctggcacctgccctcccctctgctatttagtactgcagctggcacctgccctccgcacagcagtatttagtactgcagctggcacctgccctccccacaccagtatttagtactgcagttggtacctgccctcccctctgctatttagtactgcagctggcacctgccctccccacgtcagtgttcaggattctttctccctgtttttcttttttttccatagttttcacctttctataattcacttatttgttatgtttattgttttgtgaaaggaaaataaatcttgggcccccaaagtcactaagctaaaggggaaagtcaagccgggaatggcttagggccgacctgccccccattctattcaaaatcaccccctgctcactgagatagatgcatatctgattgccttctttggaaaggcccatcagaaactcaaaagaatgcgacctttgtctctcacccacctgtgacctggaagctttctcctggctgcgagttgtcccacgtttgcttggcgttgcccggccttttccagactgaaccaatgttcatcttacatgtgttgattgatgtctcatgtctccctaaaacgtatgaccaccttggcacatgtcgtcaggacatcctgaggctgtgtcacgggtgtgcatcttcaaccttggaacaataaactttctaaattaactgagacctgtctcagatttggggggttcacattttggtaaccatggagggattctgagttgaggtgcccctgacctttgacagatctattggtgcttggtagcagcatgagctaaccttatggctcaaaccaacaggacaatttgctgaggtctgggagcaccccctccagagagtccctgatctctcaaaacttggtcgtgatctaaagtttatttgatgtacaactccccctccccttcttttggagttttatttgcttccaagaaggaaggcaagatttcctgggtccgtgatgatggaaggctgacaactcttttatggagtttgagcttgctcccagcagggaagacaagttcgagtttttttcctgcttcaaggatggtagagagcagtcttcagcctgagacccatccctaggtaagtagctgaactgaggttttgtcttggctgaaggttaacaaccagctggtctgaatttcttcttcccattagagcagtctgtgttcatatcatttgacttctgttgttgttgttttttctggtctttctctcatcagatttgaccaactctacctgacttggtcaaatccaagtgagaattccaaattatgggtaacaaagcctctctaatttggctaaaattccttgcagctgcaaaagaggaaaaaactaaacgaaaaaaaccaacaaatcacgtgcttggtttctgtgtttgctttctgtcttaaaaaacaaacaaacaaaaacaacaaatgctctttcacttacttttcttcctccctatacctcctcctgcctttgccatctgcgggaccaaaaaaatctagagaaggcttccaatgactcgagcccctttaaaggatccggaacaaaggggccactcaccccttccagggtgctctgttttctttgtggagtttcaagagtgatgggcggattcttcttaggtctaaagctctgctgtcttcctgtacggcatgacctgacctctttggctttgggggaaccagagatgaccctgcactgtgagaggatttgaccttggcgtgtgtaatggcagacgagaactacaaagaaggggtggctgagcacagtttacagggaatggtcttggctgtttttttttttgtttttctcttctaggaagctgtgatttaaggatcctaattctagttcagagatgcatcctaaagggtcttctctattgctttttctcccaaaatgaatctcagtttgggttgtctatgtatttgcatgaggaactgaactgttgttgtcataggtaaatgagagattgagttttctcagctccaaagagaaagggcgtttgctcctcccagccgagtactccatagggttcatggcgcctctacttgccagagtttacgtaaagtggaagtaatatggtctttctgcacatttacattaaaaaaaaaaggagccctgaggttgacctgcaaactgtagagttcctgagtcctcttttttctctagtttcttctctgcctgctttaaatttgctgttattttcctattaagataaaaaacactgtttggatcagatagtttttctgtttgtaaactggtgaatttgtatttatttcatggctaaatttctttttttcttttctttctcttttttttttcttttttttttgaggcagagtttcactcttgttgcccaggctggagtgcaatggcgtgatcttgggtcaccacagtctccgcttccctggttcaagtgattctcttgcctcagcctcccgagtagctgggattacaggcatgcaccaccacgcctggctaattttttgtatttttagtagagatggggtttctccatgttcgtcaggctggtctccaactcctgacctcaggtgatctgcccgcctcggcctcccaaggtgctgggattacaggcgtgagccaccgcgcccagctttcatggctaaatttctgaagtaaaagctataggatctttgtgtgtgtgtatatatttaaaaggcctttataatttctataattttatgtttaattggcaattaaatctgttttaatttccctccagcacaccagactttttctctccatacgttatgatgtaaattttgctattcgattttcacctcagtttccttaaaatgcaaattcaaggctatttagctgacaaccgcttagagtagtaaaacaggttatcaagaattcgaaggtgtggctgggcacggtggctcacgtctgtaatcctagcatttgggaggctgagccgcaaagatctcttgaggtcaggagttcaaaaccatcttggccaacatgttgaaaccccgtctctactaaaaatacaaaaaaaattagccaggtgtggtggcaggtgcctataatcccagctactcaggaagctgaggcaggagaatcacttgaagccaggaggcagaggttgcagtgagtcgagatcaagccattgcactccagcctgggcaacagagtgagactctgtctcaaaaaaaaaaaaaaaaagtaaaaaagaatttgaaggtgtaagaaaaaagctctttatgaatctataagatgaacttctttcagcatacctaatacatctgtgtatttatgtgttgttgtgtacacagtgttttgctactgaaaatatataaaagagctctaattaattggcttaagaaaataaaagcacttggctgggtgcagtggctcatgcctgtactcccagcactttgggaggctgaggtaggtagatcacctgaggtcaggagtttgagactagcctggccaacatggtgaaaccccatctctactaaaaatacaaaaattagccggacgtggtggtgcgcgcctataatcccagctactccagaggctgaggcaggagaattgttggatcccgggaggaagaggtttcattgagctgagatctcattactgtacactccagcctgggtgacagagcaagactccatctcaaaaaaaaaaaaaaaaaagctagtgattccatatcttcaaatcaaatttcagtggagtgtttaccgggcaaggaaggcaggggggtcagcttgctgacagcctcaacctgccagccctcagcctgcacatttgtgatcacctggtcacacacctgggcaggaggctgcccctccctggtttgaggaagcaggaaaaggtacccgcgagagacagccagcagttctgtggagcagcggtggccggctaggatgggctgtctctggggtctggctctgccccttttcttcttctgctgggaggttggggtctctgggagctctgcaggtaaggaggcctagaagggcctggtgggcctctcccctagtagggctctgggagtgaatttcagtatgagccacccttcatgggcaagggcaggctctctcgggttgattataatgaaccacagtgctacttgtgaagtgctattattgttgataaagagtgtgcaaatgacagtgtgagtgagtgtaagcgtgcatggcgctgcagtacacactaatcaaccatgacgatgtgtgtgagtgtaagcgtgcctggcgctgcagtacacactaatcaaacatgacgctgccatcgtaaggggtggctgagagtttctgtttatgaacgtgggacagtaagtggggcacggagcgggggtgcagggaggtgccagctggtgatcattgtgcagaaagctgaagaatgtggcttaacaagattctgactcctcccagtttattacctagcatggatttccttcaaaatacagatttcgtgtgaaaagtccaactgccacaaactgcttgggaagggtggatgctgacaggcagggcttttgtgaaagacgggaatgaaccctgacctgtcgctaataggagttgtgccaaactcatcacatacattaaaaaatagaaaaggatttattttttttttagagcagttctatgctccctctaaacctcgagtggagaggccgggcgtggtggctcacacctgtaatcccagcattttgggaggctgaggtgggtggatcacctgaggtcaggagttcgagaccagcctgaccaacatggagaaaccccgtctctactaaaaatacaaaattagccgggggtggtagcaggtgcctgtaatcccagctactcgggaggctgaggcaggagaattgcttgaacctgggaggtggagtttgcagtgagctgagatcgcaccgttgcgctctggcctgggcaacaaaagtgaaactgtgtttcaaaaaaaaaaaaaagctgcagtggagagtctggagttcccatccccaccactcacagcctcccccatcatcagcgtcccccaccagagtggcacatttgataggactgaggaacctactttgatgcatcattatcatacattgtatttttaatcctcacaacggccctgcaagatcggccctgttcttaccaccccccacctccactgctttaaggatgaggccactgtgcttctgggcatccagtaacaactcctcggagccagaatctgactcctcacaggcctgagcactgcaccccgtggcctcctgcctgtgctcaccgtggcctggtctgcgctgcacgtgtcccgttagctccaccttacaggtgcggaaatgcaggcttggagctgagagacttggccagggtcacagggcagagagcagattctccaactcagggtcccaagtccacacgctttcctctccaccagatttgaagattgtaccaggagagccgcagtgttccagagctactgagggggctgggctgggatttgctgtattcgagaagacccccttggacccgagaggctgtgggcttggggagcatgaggaggtttcacagcagaaaggacaccccggggctcctggataagccagaaaatgtgccaggggaagtcgggctccaagggcaccactctgggcttccagctgtgtgggctggaccaagaaggctcagagaaatgatctcaggcttgaagtggggagaagaaactgtattatgaaggcagacgaacagttcctgcaaaggtgagatttgtgtgtgcagctgggccgcactggaccagggatgagagtgggtgcccgggactcgcctatactgcctgggggtgcagcccgcactcctcactatagtcaaatcgactatgcgtgctttccaggggcccgggagaggactccatggggagggatgcttaccttgtgggctttggaatataagccctttcatcttctccgctggtcctcaccacgttggcaaggcaggtattgtgaccctgttttctcaggtgaggacatggaggctgggaggggtctagagactggcctggctagtaggaggctgagtcaggatttgaaccagcagatcatctgaccccagagccggtcgtgggcggcacagcgggagctgcaaccgaggctcttgactcctgcctcgtcattccctgaggtccacaggacaaccagctggggacctggagccccatcctgacgtcctggggagaggtgctaggccccttttgggtctatgagctacttttgggccagtggagccgggtaaagaccatctcaaaccctgtgccaggggaggtcagactccaagagcgccacctttgggcttccagctgtgtgggctgcaccaagaaggctcagagaattagggggttcgtatttgatccttttccttccaagactgggattaccagataaaacacagggcatccagttacatttgaatttcaggtaacaatttttttttaagtgtaagtacgtagccaatattgcatgagaaatactcatgctaaaaagttattcgtcatttatctgaactgcgagttcaaatttaaccgagtaccctgtatttttatttgctaaatctagaaaccctctccaagagactccttggcccactcacagggagagcccgatctccctctagacaggggaggccccctttctcaggccagaaaagatcttgtagtaaactactcaagaggctgaggcaggaggatcgcttgagcccaggaattcaagacctgcctgggcaacagagcaagaccctgtctctagggaagatatcctaccgtagcctccctcggggactcccattcctcccacctcagggccagtcaagggaacaggcctctgctctgggcagaagtgccggcagccgctctctgaaaagctaggtgttgcctcaggggctcccggtgtcctgtggaaaatgcctggccacggtttccatggttcccaggctccaaccctgcagttctcggccctcattcaggaggggcctcggcagggtggggggtgccgtctttcccttgccggagccccaaggactctgccggctccctcgctttggcagcagcactgcccaccctgtctctggaggttcccccgcctcaatccacccagctaccccgaaaggcacaatcataggcctttctcgtcttttaagggttttttacttccatggggaactatgtgttggatgagaaaagtacccggggaaggcgacagaggttcagaaagctctgcgagtcctggacgctggtctgccttcttggctcaccctggaaggtggacgctggccccacacatcccctcttaaagacgcaggccgatagccagcagatcctggggcttgctggccccaagtgagttgtcagggtttcagaggacgccagtcatggcaaccccagctccatggctgccacacaggcctgggcttcccaggactgcctccttcttgttcgcttatgtagatgaaaaatgaggtaacggcactcccctgccccaccctcctcccagaagtgcccagggtgtaaatgcaatagcttgtgtgaagtccactggaacccaggctcaccaagtcagtcttaaccaacacaggccccagcacccgcagagcagacactgcgatgacaacggacgacacagaagtgcccgctatgactctagcaccgggccacgccgctctggaaactcaaacgctgagcgctgagacctcttctagggcctcaaccccagccggccccattccagaagcagagaccaggggagccaagagaatttcccctgcaagagagaccaggagtttcacaaaaacatctcccaacttcatggtgctgatcgccacctccgtggagacatcagccgccagtggcagccccgagggagctggaatgaccacagttcagaccatcacaggcagtgatcccgaggaagccatctttgacaccctttgcaccgatgacagctctgaagaggcaaagacactcacaatggacatattgacattggctcacacctccacagaagctaagggcctgtcctcagagagcagtgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagcgcctcttccgacggcccccatccagtcatcaccccgtcacgggcctcagagagcagtgcctcttccgacggcccccatccagtcatcaccccgtcacgggcctcagagagcagcgcctcttccgacggcccccatccagtcatcaccccctcatggtccccgggatctgatgtcactctcctcgctgaagcccctggtgactgtcacaaacatcgaggttattaattgcagcatcacagaaatagaaacaacaacttccagcatccctggggcctcagacatagatctcatccccacggaaggggtgaaggcctcgtccacctccgatccaccagctctgcctgactccactgaagcaaaaccacacatcactgaggtcacagcctctgccgagaccctgtccacagccggcaccacagagtcagctgcacctcatgccacggttgggaccccactccccactaacagcgccacagaaagagaagtgacagcacccggggccacgaccctcagtggagctctggtcacagttagcaggaatcccctggaagaaacctcagccctctctgttgagacaccaagttacgtcaaagtctcaggagcagctccggtctccatagaggctgggtcagcagtgggcaaaacaacttcctttgctgggagctctgcttcctcctacagcccctcggaagccgccctcaagaacttcaccccttcagagacaccgaccatggacatcgcaaccaaggggcccttccccaccagcagggaccctcttccttctgtccctccgactacaaccaacagcagccgagggacgaacagcaccttagccaagatcacaacctcagcgaagaccacgatgaagcccccaacagccacgcccacgactgcccggacgaggccgaccacagacgtgagtgcaggtaagtggctcctgctggtgatcttcggggatttgggatgcggagtttccaggacgtctccgcacttgaggagtggagaggagggaaggatctggagcctactcagagcctgctcctgctgttgcctcttcgtgatcttctagtggttcttggcgaaatcaggaaaaggcagatggagggttgtgtatggaaaggggtggggatggaagtccggagaaatggtttgcggtctcggctctgcctgtaacaacccgagtgaccttgggcaagtccctgtccctctctgggcctcagtttctccacctgtatttggagagggttggaatgggcactgaagtcctgtccagctctgaccttctgtgaagtgcactgttgagcagctctggaagcttctattccagccatagccacacagaggagcagcaggcaggcatcaggcccaagctgctgctctctgacaggctgggaccccatgaaagtggggcctgctggatgcatttcctgggatttatgccatagatagtgacttaaaataaattaatacaggcctggagcggtggcttatgcctgtaatcccagcactttgggaggcagaggccggcggatcacctgaggtcaggagttcgagaccaggctgaccaacatggtgaaaccccatctctactaaaaatatgaaaattagctgggcgcagtggtgggcgcctgtaatcccagctacttgggagactgaggcaggagaatcacttgaacccgggaggtggaggttacagtgagctgagacggagtgaaactccatctcaaaaaaaaaaggtaagataaaataagcaaatacagcgaaggcttgggagtttaaagctacatctctgaggcaacagggacttctcaggggagaagttcattgtcagaggctgcttggtcagtccagcttctggtcagcctgtagcctccacctccacttcctgtcactctgcccttgggcctcatctctgtgtatccgcagcttgttaccacctttctgggggaggtgggaatacaaatattaatcacaaccactcaatacataaagatattattgaatatctttcatgttataggcaggggtgatataaacatgtttcacacccagtaagcactggccccagcagaacgttctctccggtgccaggcagtgtgccaccagctttgcatatgttatctgatgccaggcagtgtgccaccggctttgtatatgttatctgatgccaggcagtgtgccaccggctttgcatatgttatctgatgccaggcagtataccaccagctttgcatatgttatctgatgccaggcagtgtaccaccagctttgcatatgttatctgatgccaggcagtgtgccaccagctttgcatatgttatgatgccaggcagtgtgccaccagctttgcatatgttatctcctctatttaaccttcaaaacagccttaggaggtgggtaacacgaccccatctgacagggttgaagatggtagctaaactgctctggaaagtgaaggggtggcctgcccctccacacctgtgggtatttctagtcgggtgggatgagagactgagaaaagaaataaggcacagagacaaagtatagagaaacaacagtgggcccaggggaccggcgctcagcataccaaggacctgcaccggcaccagtctctgagttttctcagtttttattgattattattttcattattttagcaaaaaggaatgtagtaggagagcagggtgataataaggagaaggtcagcaagaaacatgtgagcaaaagaatctgtgtcataattaagttcaagggaagatactatgcctggatgtgcacgtaggccagatttatgtttctctccacccaaacatctcagcagagtaaagaataataaagcagcattgctgcaaacatgtctcacctcccgccacagggtggtttttctcctgtctcagaattgaacaaatgtacaatcgggttttataccgagacattcagttcccaggggcaggcaggagacagtggccttcctctagctcaactgcaagagactttcctcttttactaatccacctcagcacagaccctttacgggtgtcagcctgggggacggtcaggtctttgtcatcccacgaggccatatttcagactatcacatggggagaaagcttggacaataccctgctttcaagggcagaggtcccctgcggctttccacagtgcattgtgcccctggtttattgagactagagaatggcgatgacttttaccaagtatactgcttgtaaacattttgttaacaaggcacgtcctgcacagccctagatcccttaaaccttgattttatacaacacatgtttttatgagctcaaggttggggcaaagttacaaattaacaacatctcagcaaagcttgtttaaagtacaggtctttttcaaaatggagtctcatgtctttcctttctacagagacacagtgacagtctgatcgctccttcttttccctggaaagaaaaatactttattatttgttgattagataagacattcatatgatttgaaatggaaaggtacgaaaaggttcaccataaaatgcctttctcccctggctgtgcccccacccagttctctccacacatgtaacccgtgagattgtctcttgtgtgtaattttctgcacatgaaatgtacatacggaagcaaatatatgtgactatttcatcctcctcttttttttttttttttttttgagacagtttcgctcttgttgcccaggttggagtgtagtgctgcgatctcagatcaccacaacctccgcctcccaggttcaggcgattctcctgcctcagcctcctgagtagctgggattacaggcacgcaccaccatgcccggctcattttgtgtttttagtaaagacgggatttctccatgttggtcaggctggtctcaaactcccgatctcaggtgatccacctgcctctgcctcccaaagtgctgggatgacaggtgtgagccactgcgcccagccctgattttcatcttactgttctccatttgcaggtgaaaatggaggtttcctcctcctgcggctgagtgtggcttccccggaagacctcactgaccccagagtggcagaaaggctgatgcagcaggtgagtgggcactttccgggccaggggagtagaggaaggggcgaggttcgcaggggctgcagggaagacccgcaggacacagaagagcagctaccgcacttggaagggagtctcgtttcttacggagaattgggagctgaatctgaggatctctgcctggctttgcttctgcctgccttctccgagttcttcatttccttctctgcaatgtaaacatgtgactcctagagcccccagtttcttctggtccttggaagcttggccttctggcctctgaggcaaaggtcagtgatactgatgggagggtaggtcggactcttggttgcaagtggcagaaacccaagtcagggcagtttatgcaaaaaaaaaaaaaaaaaaaaaaaaggcaaggtctgagaaacctacaagtgtctcttcagcttcagtacggctggatccagcagctccaacgccatcacagggactttctctttctttccctgtcttagctttactcccttcattcttcagagtctttcttcatgtgtatgaaaaggcagccttgttagccatagattcacaagggacttccatctccccacattttcttttcttttttctttttctttctttctttttgttttttgagacgaagtctcgctctgtcgcccaggctggagtgcagtggtgcgatctcagctcactgcaagctccgcctcctgggttcacgccattctcctgcctcagcctcccaagtagctgggactacaggcgcccgccaccacgcccaactaatttttatgtttttttttttagtagagacggggtttcaccgtgttagccagaatagtctcaatctcctgacctcgtgatccacccgtcttggcctcccaaagtgctgggattacagacatgagccaccgcacccggccccctctccccaaattttcatgtcatctggggaagtgcaggtctccatggcctgcaagggtcaccatgactgacaacccagtcaggatcccatagaggaaggatgagccccaagaaaatagggaggctaggcagaaaaaaccgcagagatgtatactctagatgaggaccatgattgggatgtatttgtacaagttgggaaaattctcctaaaacccactggatagaacttccaatggtaaagttccggggtcagggttttgaggatggggatggtgtggcttgttggaggttagactgggtcagctcagtgcagatgtcacgggcctggccttactgaggggtgggttgttctcctaatgtgtggtacaaagtagcagatggggcatgatgggaagtgtctaagctctgctcacagatgtaaccgtgaaaacaggcccagtgcacagtctaatgtggattgcctctttgacagtgcccttgctaatacctgaagcttgcattcagcacctctcacagtcaatgggacagtgcccttgctaatacctgaagcttgcattcagcacctctcacagtcaatgggtgccacactgctgaaaagtggctcaggcttcctgtcatcccttgcaagggtaaacctggcagagatgctggctgggggtcttatgccaggtgtagagttcatagccaggctggacaggtggaatgattgcccttagcagagggaagcaagatatgtccgtggagagtgggatcctttgttgcaggcgaaagaaaacctctgtctgtcgtaagtaaaagggggatttgttggcagcgtcccagagtgcatagaatcaaagcaatgccaggacagcaggcttggaaaataggcaggagggcccccaggagctctggggtccagacagtgggatcaggctggctgggacactgtccctcttgctggtcagtcactattggatgctgccacagccaaggggcatcacgtggcctgcacacacattcacataggttctcgctgcctttttgtctcactggactttttgctccagagccaaagtcctgagtaggaacatttgataggccgagcttagcccttgtactcccatgagcccacagccaggtgccaggggacgggaagaagggatgtctgcgtccttggagttctcttagcagcagtgaggccgatcgtgactcccactgtaaggagttccctaaacatggcacgggggctcgacacccgatggccaaataagtgacaaatgcccccggcatgtgataatcaaagtagcgagtgtgaatccttgtgggagagggaagccaattgcttttgttttgttttgttttctgagactgagtctcactctgtcatccaagctggagtgcagtggtgcgatcttggctcaccacaacctccgcctcccaggttcaagccattctcctgcctcaaccttctgagtagctgggattacaggcccgcaccaccatacctggctaatttttgtatttttagtagagatggagtttcaggtttcagcatcttggccaggctagtcttgaactcttgacctcatgatccacccacctcagcctcccaaagtgctgggattacaggcgttgagtcattgcgcccggctgggaagccagttttctttttctttttctttttcttttcttttcttttatttttcttgagacagattctcgctctgtcgtccaggctggagtgcaatggcacgatctcggctcactgcaacctccgcctcccggattcaagcaattctcctgcctcaacctccctagtagctgggattacaggtgcacactaccactcctggctaatttttgtatttttagtagagatggggtttctccatgttggtcaggctggtctcgaactcctgacctcaggtgacccacctgcctctgcttcccaaagcactgggattattggcgtgagccaccgcacccggctgggaagccagttttgaatctcaggtctaagcccccaaaccagaaatgatttcaggaatcggaaagaaaccgggagatcaggagcaggtcaggcagctgaggcgcaggcaccaggccacatggggttgggcatcagttctcgtccggggacagcccaacagtttgggctcagggattagacaatgagcttaggaaccagctagatctgggtgtgaattctagttcccaactgtgtgatcttggataagttattctatgcgactttcatcccttataaaatgaggatcctaacacctgctttataaggttgctgtgaggtttagatgacataatgtgtgtgaggcaccagcctgtgtccagcatgtaggaggcccaggaagggttgccgtcctccgcatgcactctgccccagtgtcccttcctgtcctctgcctctggcgagctcatgggccagatgggctgaaaggacagctggctcttttgctctccagctccaccgggaactccacgcccacgcgcctcacttccaggtctccttactgcgtgtcaggagaggctaacggacatcagctgcagccaggcatgtcccgtatgccaaaagagggtgctgcccctagcctgggcccccaccgacagactgcagctgcgttactgtgctgagaggtacccagaaggttcccatgaagggcagcatgtccaagcccctaaccccagatgtggcaacaggaccctcgctcacatccaccggagtgtatgtatggggaggggcttcacctgttcccagaggtgtccttggactcaccttggcacatgttctgtgtttcagtaaagagagacctgatcacccatctgtgtgcttccatcctgcattaaaattcactcagtgtggcccagaggc

SEQ ID NO: 11527 - DNA, 908 bp, Homo sapiens
aattgagacagggtctcactctcacccagaactgcagtgcagtggtgcgaccatggctcactgcagcctccacctcccagctccagtgatcctcccacctcagcctcctgaggagctgggaccacagctggctaatttttgtactttgttttgtaaaaaaggggctttaccatgttgaccaggttggtctcgatcttctgagctcaagcagtcctcctgcctcagactcgcaaagtgctgggattacagacatgagccactgtgcccagccttatatacagctattattattaatgtatactgtgtattcatttcaattcttaatctctccacttggatgttgatgaaatacatacctcacattcaacatttctttctttttttttttctttttgagatggaaaggagcctggctctgtcacccaggctggagtgcagtggcgtgatctcagctcactgcaagctccacctcttgggttcacgtgattctcctgcctcagcctcctgagtatctgggactacaggtgccaccaccatgctcggctaattttttgtatttttagtagagacggagtttcaccgtgtcagccagcctggtctcaaactcctgacctcaagtgatccacccacctcggcctcccaaagtgctgggattccagttaatgagcactgctcctggcctccacatttctaaaatcgaagttctgatcttttcctctggacctgccccacctgcatcttccccatctcagttaacgtcagttgcatccttcaggtgctcaggccgaaatcctcagcaccgttctttattctcctctcacattttgcaccaggaaattctgctggctctaaggccatcaaactgtgcccagaatgtggcccctcctcagcatctccagtgctaccac

SEQ ID NO: 11528 - DNA, 1337 bp, Homo sapiens
actttttttttttttttttctgtagcacagaaattgcttcccaattggctttcctgcattaaattccttcctccctcgaaacccatcttccatttaaccagaatgggtatctattcaaaggctgtttcctttcccagttctcgatcatactatttctttacagtacaacttggattgccctgttcaagactgtgaactccttaagttcagagatgcaaattccttttgcatttccagaactttaccccagtatccgaaacaaaatatagactcagtaaatgtttgctaagttgaaatggattctggactctgatttcctcattgtctgcagggagggtgaaattgttgtacttagagaattcagcaagacatttggttagaattttcagatggaagtggggaaaatgaatgaaccagaaagagaaatgtcatgtccaagtcactcaagcctcacagccagagactatgggagacagacagcaggaaagggcctgcccctccctatttaaacaggataatgacgcagatcgggagcctgacccccctgaaactagtgttcgcaactacggagcaaacaggaaggccaagaggaactgaccatcccagtgagattaaacacaatggtctcttttaagagcctttctcccttcagtgtagcaatctgcttttggcactaggtgacagagcaccattcaaacactttgccagaccacttgggttctgctgttcctggttcccaagctatgcctgaggagtgggaagaaaatactgtacagttgaccagaacgctggtacagagagctctaggacacatgacggcttctacccctcaccccacctccaactcctccctgccttttttcccttccctcactgctatcaaaatgtcaagaaagcttattactcctatgtcagagaaacgatctgcttttccaaatacggagaggtgtgacttgtagtttccatgaccactcatgcggtcgtttgaagagaaatgagacagaatgtctggtgtatcaccccactaagactgatagcatcatcaatggcccggcttcctctgattatttttacttcattctatatttgtcatgcaggggatcctgccatggcctcagggttgccccattctcaatgacatgattttcctgtacccaatcccccaaaactttagcctggactcttgtgggtttgcatgcctgcatgcgcaaatgcatgcatgcagaggacagaccctgagaaacagacacattcaaggaaatggccatcatcaaggaagtcagtcctaaggcaggcagctgagggatgaacattgtcaaggtcagtctcagggcaca

SEQ ID NO: 11529 - DNA, 487 bp, Homo sapiens
aaaacatggatatctgtaagtgtcaggattttaattctcagaatacttggtttacacttaggttcttgcatctgaagatctggaatgtcgaattttttgagttggttcctcttgagattatgaagtcacaggcatgaagctttcaatacaggagacagaagatatgataagttatgatataatataagatatgctaattttttcccagtactatttgtcgactgtgttctgacacacttttcactaggtgagctgaatggagctcacagaaaggcaaaagcaggaccccactttgtcccactaatccctggcatccttctgcccactgctgagaggtgttcaacatttcccacaaggcctcctgtggcacccagactgcatttcaggcagtaatttttattttctgggaagtgcttcttctagacccctatgacagttacaaagcttataggagtatcttggacccccccgccgaatcttgacgtca

SEQ ID NO: 11530 - DNA, 890 bp, Homo sapiens
ctggagtccatgcccctaggatggggtgagggagtatcactctgtggggtttcacagcaccctggatcctgccttccagcccctgccaaggtaaacagtgctgcctgcctcctgtggggaatgcaggatggggcaatgccctggcagcagggtcttgcctcagctgatgcaactgtggctgctcctgtgtgcacagatcatgtgcctggaaggccttcctgcagcaggggcagtgtcagaaagtggaagagtggtgtgagcagcttccccggggaaagcctggctgagcaactgaccttgagcaagcactgcagatggcccttgttcctgccgggctcctccagctgggagctctcagcccctggtaaattctggcagtgaaagacacattagcacctccccctacaatgaggcacctagctagacaacttggctgtccgggcttaacctgcgtggcagggaaggacgcctgcccagccttagcctctacgcaatggtggaggcagggagggagagaaccacacagctcccctcatttcccagcagcccccatggagcctagtcaacagggtgtggtcacaggctaaatgagcaaagatgtgagctaatatactggtaggtgtcatgggggctttcagagctgggtaaggagggaaagagatggagatactggttccccactccttaacctgccacctgccttccctgtcctttaccctccctcattctgctggacctgaggaaaatgcaagggaggctaggcctagtggctcatgcctgtcatcccaacactttgggagactgaggtgggagaatcacttgagcctaggagtttgagaccagcctagggaacatagtgagacctcgtctctacaaaaaaattttaaaaa

SEQ ID NO: 11531 - DNA, 891 bp, Homo sapiens
ctggagtccatgcccctaggatggggtgagggagtatcactctgtggggtttcacagcaccctggatcctgccttccagcccctgccaaggtaaacagtgctgcctgcctcctgtggggaatgcaggatggggcaatgccctggcagcagggtcttgcctcagctgatgcaactgtggctgctcctgtgtgcacagatcatgtgcctggaaggccttcctgcagcaggggcagtgtcagaaagtggaagagtggtgtgagcagcttccccggggaaagcctggctgagcaactgaccttgagcaagcactgcagatggcccttgttcctgccgggctcctccagctgggagctctcagcccctggtaaattctggcagtgaaagacacattagcacctccccctacaatgaggcacctagctagacaacttggctgtccgggcttaacctgcgtgggcagggaaggacgcctgcccagccttagcctctacgcaatggtggaggcagggagggagagaaccacacagctcccctcatttcccagcagcccccatggagcctagtcaacagggtgtggtcacaggctaaatgagcaaagatgtgagctaatatactggtaggtgtcatgggggctttcagagctgggtaaggagggaaagagatggagatactggttccccactccttaacctgccacctgccttccctgtcctttaccctccctcattctgctggacctgaggaaaatgcaagggaggctaggcctagtggctcatgcctgtcatcccaacactttgggagactgaggtgggagaatcacttgagcctaggagtttgagaccagcttagggaacatagtgagacctcgtctctacaaaaaaattttaaaaa

SEQ ID NO: 11532 - DNA, 155 bp, Homo sapiens
cacaacctgagagagatcacaggcaagcaaaaaacactcaaacgtgtgtaaaaccaaactttcatctccacctttccgtgttccacctctgttaagggggacagcaagcagcttgaggctaacgcttgttctttgatgacctcctttcacttctc

SEQ ID NO: 11533 - DNA, 155 bp, Homo sapiens; identical to SEQ ID NO: 11532

SEQ ID NO: 11534 - DNA, 2905 bp, Homo sapiens
gccactgtggcctttaatcagtccttctattcacttccgcttctcccacctttactccattgtgcttgcaaatccagtgcccctctggggcccttctagttggtgagtcagctcccatacctgctgcagcactttggtgatactctaagtggtatcgtttgttttatgcaagttttctctgctctgctttattcgttaatgcatttttatttgccatcttttacactagaaatgtatttaaataccttgttgtctcatgaccttctttctttttttcattgctctggcttagtcttttttgtttattttaaatctgtaactggtcttttctctggggtctgaagagagatgagaactgagagcatatgtgcactctgctctctggaactaggagcccaggcctcacctgctgtgcttgagtctttcctcgttatttctgttgagtgtctttttctccttctatactcaatgtttcttcagatcttagggaataaactgaacactgtgatatatatgaatagagtagatatttactaaataattatgatgtccccaaatagatacaaaccaagtaaattaaacaccagacttatttatgttgtctgagaaagtcatatttgaaagaaaatttaccccaaactgttcgttggaccatcctttattcttataaacaggtgtttattcttataaactttattcttagaaaaacagtgtctgcttttctacccccacttttctatgtcacatttgatttggggaaaataaattatacaaaataccatattatcccatcctataaattactcccggaaaacaagtcatgtgtttagaagctgtgccattaagactgatttcttttgcatactttgtgttacaacacttgtcactattgcagttgttggtttacatgcctgacttcctcaaagaggtcctgagagtagagaatgtgtcttactcttgccttctcttagcctagtttggtatttgacaggaccagagaatagaagtgatagatacaatgataactactattgattgtgtttcttttgtttataggcactgtacatgccacttctacccacattatatctgattttaacatttttttctgagacaaatattatatccattttacaggtagacaacgtgagtctcagagaggtttagtaatctctccaaggtcccacagttgtcaagtgacagaaccaatatgaaggcgttaactgaagaatgaaaggaaggagggaatgtcaagcatttggaagcagtgatttttgtaatggtgtgaaggagttaacaggagaaatagcttgttcttgaacagcctggctgaatatcacatcataggaacacagttgcaccggtgccttaggatgctgagagttctgtgaaagtgatctgaaaaattaaacacaaagatgccccatcagtacaaaatgtatgctgggattcattatatcatcatgttaattatttccttctttcttcttccctgttatgctaggatgaaaccaagtccacaaatctataacagtaattttagtagggattttcttcttccttatccaaaggaaaacgctttcaggaggtgtttactccctctccccattcaccctaacttgttcctgttaaagggcccatcatcttctgttgcctaggtaattctagtgcccactgattatctacgaatgataccttcgttgttcatactgcagcgcctctgccatgctaatgtgagataatggtttcttgaagagtgtttgtttccagcctttgcagctcattcaaacttgggagagctctggttgcagcagaaactgcaagcagctggccatatgcattttattgatttattgtattttgcgttacagttgtccactaggtataaggtgacccttagagaacatctatttatagtaactaggggttgggtttctggagttctatagcaaatggacttatttttacatgtgtattatactaattagaatacagaagattcctggttaaataggaaaatacacctaatacctttttaaatgtttttggaatattgtctgaaactattatatttaacaggcaatagccagccaggaattgcttttttctcccttcattttgtttttaaaccaatttaagaaaaattgatgttttttctcaaaatagatgttgttggatgcagcagaatttttacataaataagccattctagtgtcaaaggaagaattatagaaaaaaatattctgatatgaaaatgctatttcaatattcaagagtacaaataggaaaggtttcatattgttggatgttctgcctagcaaaatggttaagaacacaggaggcacactgcatgcttctgaatccaaccttgggcttagcagttgttgttacttgtattttgatagttccaatgcagacatgacaattaattgaggtgcccagtagttaatataaataaaagatgcaagattgtattctattgaacatggttcatggtggaaattaacctatgggagcagacaattcttggaaggccaggctccaggcttcattctttcccacagtataggtaatgcagatgctggagtaaagagatgttctggccgggcatggtggctcacgcctgtaatcccagcacttggggaggccgaggcaagtggatcacgaggtcaggagttcaagaccagcctggccaacatggtgaaaccccgtctctactaaaaatacaaaaattagccaggtgtggtggcgtgtacttgtagtcccagctactcgggaggctgaagcaggagaattgcttgaacctaggaggcagaggttgcagtgagccaagattgtgccactgcagttcagcctgggcaacagagtgagactctgtctcaaaaaaataaaaaatataaaaaaa

SEQ ID NO: 11535 - DNA, 13309 bp, Homo sapiens
tggggaaggaccaaaaggtgacgcaaaatataaagtgcctggctcagttttgatgtcattccttcttgattctgaacctttaaaaagagagaaaaaaaagaggaaaatagtgttaatggattttcaaaatcaaaatatttacattagtaaattggcgtagtgtaaagggaaataataaggttaagtgttgttcttacttttcccagcagtgctaggaagaattggaatgatgggggacggcaccggttctggaggctcctccttgaccaatgacagatctggatacctgctcacttctaccccaaccacactctcaggagaggatgagggaacaaaactgtcaggagtatctcgatcaccacagtgatcctgtatcctgaaaaaacataaacacacacatcaaagtctgcaaatccaccactgggggcttcctgtaccaaccctgctgacatctgtgaatacagctgtaaggatactctgggcagcacctatacgatgagcagcaaatgaatcagctcagagccacactgggaaaaaaatacaagaacaatatttagttacaaaataatttaaatggtatgtttccttttaacgaaagcttcagcaccaaagtttgaagacctgccaaagaggaagatgttctgattagcatgtaacatagagagcatgaaagcaccttttcaaaatcccagatcgttgagcctagggcagcactcctgcagcttgaaaaggaaagagctgctggttggatttaacaataaaaaaggaaaactttaaaaagacaaaaaaaaaaggaaagagaagtccaacacatatgcaatggtcacacctgcattcacctgactgggaaaacagctgtcctactgctgctctttacactggcaagatgggagaaaacttagccattgacttgatcggcccttatttttcttaactgataaagtgaggtgagaaaaacaaaagactggtcccttctgttgagttcaagtttgagtctaccaggccaattgtgaggtctcagactaagttccacaaccctgtggaactgctgtctcccactcctcacgcagagaagtagctgtcatgcaggagacccaagaaaggctggcctactgaggtacagtagaaagaggacctggatcctcaattgggacagattattctccacttcggtccaaagtttccccattaataaagtaagggacttaggttaaataaatgtctcatcaaatagagggtagtgggcagattttccaaagaagagataattatttgatgaagttgtaagaaccctctggatctaaagagttggctagcgatcatctactaagggaacttgattctccccaattagaatcttacagttaaagaactgacacaaagacatcaaaccccagacagttcttaaactctcttccacgacggcgttctctgatatagcaacttctgctctttcattttagacatctacaaacaacaataaacccaataaatcacattaataccctttaaaggacaatgatttctgaaatatgttgcatggagattttccactaccttcatgtctattagattatttaattagattaaataatctaatacttaactgtctattagattatttaactctctatatgatgtaggcttaaaaaaatgcaaactaattatgtttaatggtaacaatgtcttataaactttaaatcctgaagattattcaccaaattgtactcttcaaatgtttttacatgctattcctaaagacattatgccacatacatacatttattttttttaaaagaagaaataactaagaattatttgagaaaaaaataacctgtaccttaattcttcctgattgttatgaggtggtgttgggagggaggctggcacatcaactgtcttggggccctgagcaagagctcgggccaacaagtcgtcctggggtctgaagggcagctgaaatggtttaggtcctagagttttggtaactggaaaagcaaaaacacaaaaccataaatacattcagtcaatattgataaatgggtagaactttacaattctattgccatttcacaatacacaactggcagaggcacatttctccgaggtgtgaaatttggaggctataatcataccttcatggctcactaacactccggcttttccagcaagttcttcagttgttgcaaaaccattggccatcttctgacaagccataggaggtggtgtaggaggaagagaggcagggggtgttggaggattacttaaattattctgctgcaggagaccaaaaaatttaaattatatgctactgagcgaatatgcaatgaccttgctaaaacgtagttctgtgaattttttgcacatagaagcaaggctacagaaatgtaatcaagatgtatcttgcacaccaagaaaacaatacctacaaggccaggaggcttcttagtggaacagatactcgtgattttatggacataccaacttgcttactttacccagcttgactacttaagctctgaaattaagaagctaatttcctttctacctgattttatttatgcaattcttcaagtttcgtggttatagctagtgaaggataactttaaaatgcaatcaagaaattgcaaaatattatcaaaatatcctttaagttctcattaagatatgccctagttctatgaaaaacttaagaatttctggtcttaaacttgtaatacaactcacatccgagatatgagaatctggattgactaagacctttaaaagaagcaacagtactaatgctactactaaagtaactaaatcattaatgtagttcctcttcagacacctctcccagcttaacagttatcaccaatttgtcatttactgattagtctctcaaggagagacttggaatctaccaataacaccatgcaaatcaagtgcaaagtcaaattacaaattttgcaaagataaagaatttcatgaggatgataaaataaggttggagaacagcttatgagttaagatagttttttttttttctttttggagacagagacttgctctgtcacccaagctagaggtagagggcaatggcacaatcatgctcactgcagccttgacctcagggtgtggtggtgcatgcctgtagtcccagctacttggtaggttgaggcactagaattgcttgaatttgggaggcagagattgcagggagctgagattgcaccactgcaatctggcctgggtgacagagcgagaccctgtctcaaaaaaaaaaaaaaaacctacaatagtctaggaattacttgtaattaatacctaaattattagatatacttaaaattgtttaatttcatttttcaaggtaaactactactttttttaaatccccaccatttacaatgatttttgaattcattttaagtgttaataaaggttataaggaaataaggatttccactaccatggaagtacataatagatatttcttgcaatttgtattcttacctataaaaacaacttcaaatgtttatgctagaaatacttcaccaggtaaaattttaaccctgtagctgaacttaagttttaataaaacttggaagagtagatgtaaactaaatacaaaaataagacaagctctatcaattctgacatgttacccaaagatgaagcaagacaacaccttggcagagaaacataccttgtagatcaactgagaatagtagtccgaaaccccttccagggtagcactgccaaaagttcctagaagtcgattcccactattaaattggccactgccataaggaagaaagtgcgcaaagttcactccaatgattggttccattagagggagcagagagagctgctattaaaaaacacatttaagagtaatgtacatgataaaaggaactcagtgtagctcaactttctaagacccgaagcaactttgttgaataaggcttcagaaaaatgagacttaaaattttcaagtatcaaaatgctggagtaagtgagagagactacagacctttgagacttaaaaataagctctgtactaaatgaatgctgccaggcatctaacaagaaaaacatatttcttatctatgctcagcaaaaactggggcatcaactgaggctgggtaccaccaacagcactgttagcaactgtctcccaccttctgtaacaaccacaaaggtgtagaacagaattcacaatgtgtttctttggattcagagtcacaacaaagtactgaggacagatttttttcttggtactgaggctactccttatgaacataagaaaatcttgactatcacctatcaatccatttgtattaccgtaaatttcagatgccaataggatacggtgcaattctgcttggaaaaagtctactaggttccttgtccagatgtcttttagcatttgatctctcgtgtccttgaattgtttgttttttttttgtttttttttttgagacacagtctcattctgtcacccaggctggagtgcagtggcacaatctcggctcactgcaacctctgccatccaggctcaagcaattctcgtgcctcagcctcccaagtagctggaattacaggcgtgtaccaccacgcccagtaaatgtttgtatttttcgtagagatgaggttttgccatgttggctaagctcatctagaactcatgcctcaagtgatccacctgcctcagcctcccaaagtgctgggattacaggcatgagccactgcccccagcctatatccttgacttttaaaagaggctgctctaaatgactcaccctcacctgtttcaagtgggtaaacgtgtcagtgctagagtacatagcttgtttctcctcttcgtcctttttccttttctttgagcgaggtgctgctttctcacccgtcctctgagtccgtttgcttcgctgtttcttggtttcacttcctccatctgtttttggcaactggttgccacatccaaaaccaccttgcatttgagcccccaaagtttgctaatgtaattggaaagggtaaaaaataagtgaacaatttgcatatttggtttttagttcatgcagtgccaagctatgacgcgtcatcctaacatggcactaaaaggtattaaataagtagggaagatagagtggtgtcaatgctggttttccaaaaacaccatccttttcttcaaacgttattctcgagtatggaaatcagtaagctgcgaagcttgaggaaagagcagaactcattagtaaggccacagccctttctggcaaagcattacccctcatgctgacctccctggggctggggaaccccttattcctgcttacttactgcagaagggaaggaaatgcttgtagatggctataggagcctctgcatagtggtcttggtgagttatttttggttccccttaggaactagtgaaatatgaggtgtgctgaaacaattcacaggctccagaaaagctttacagcctatgcatcttaggtgagagaacagatagcaccagacaacaataaaaagaaaaaacactggttcttcaaattagttcacaaccgtatttgactgaaaaataatggccacatacttaaagtcaatgggagagaacgtagatgataacaaataaaccttttctttatttttatcattacaaagtgagaataagccaagccctgaaaaggcctttaagggtagtcctatcagtaccttaaaacacaggaatattttcaggctccattatttctaaatttaacagcagtactctgctatagacgattatagtagctgaacttactgtaatgaattctgcattgaatctctgacggttctgaaaattagtttccagttatattctaaatagtttagcgcatggatggcaacatttttatgtaaagagccagatgataaatattgtaagcctctgtaggccatacagcccctggcataattactcaactctgcccttgtacttcaaaagcagccataaacaattcataaatcaatgagcttggctgcgttcaaataaaacttttaaaattcacggacaaatttgaattttgtataatttttatgtgtcacaaaatactactcttccttagattttttttcaaccatttaaaaatgtaaaagccatttttagctcatggagggaggcgaaagcaggcttagactgctcatctccaggctagttctgtggctctcaaggggtctccagggcggcagcagcatctagagctggtctagaaatgcagattatctggtcccacccagacctgcagaatcagaaataccggggctggagcccagcaatcttggtttaacaagccctcctggtgctcctcacactttagctttgagaatcacctgcctagagcagtacttctccccttcagatgctcaggaatcacctggggatcttcctaagtctacattctgagaagcaggtgtgtggcgggagattctgcatgtgttacaaagctcccacctgatgtggatgctgcggatccccaaggactgcactctgagtggcaagaacctaaaaattaattatatatatatatttatatatttatatttatatatatatttatatatagatgtatatatttatatatatttaaatcactatatatttatttaaatcacactttaatttggggggaggggctactttttaaacttgacgtggttgttccccatgccattaaacattcttacacccacaaattttaatataaacatgctcaaaatgtagtctacgtccttcaaggagctatttaaataatgttaagtggtacaacagaaatcgctatgtgagaacacgagcatcaacacatatttgagattgggagaggtgagaaaggtatctggaaaaagatgactcaagaactgcatttcaaaagataaaaatatattgtccagacgtatataagaagggagaacagaacaggcagaagcagcagcatgtggtatacatagaagggtaaaaagacagaaggctgcaagttattcagtactcctcagggtataagatgtcttggagaaagtggatggagactgtgctggagagttgcctatatttactggtgacaactgtaaaagcataaccagtaaaatttacaaaaattacacaaatctatcaagtcaacactcaatctctactgaatggtcaaagacaagaaaaaaagcaacacttgcaaaaagatgagcttcattaacaatcttaaaatgaaaaaactggacaactaaatataccactcaacccttaattaaaatatgaaaatgaaatccaatttgagaagctctctagggacagctttatgaatgcactggtaatggcactgcaccttctgaaagataaacaggcaagagctattaagcagaccaattcccatgactcaaactccagttttggaactatcttaatgaagttaactgaaataaaggggacagattcttgtaaaggtatatttacaagttagctcttcatgtaaatgaaaaaaaaagcaaattaaatgttaataacttaaaactgatagaaaattgatacatggaaaactacaaaacagtatctacatgtaacattacattaagtatcaatacaacactgtaaccacacaatagcttcccagtgtggtatccctaagagtgccaagggtattaataggggtgcatgggctatcctctgcattttaaagaggttaatggaaattaatcacttatttacaataaagtacatagacatttacttactttgctttagtcatatcaactcaatgtggtaataaccagttgctacacatcacgttatatatgaaatgcaatacatgcctttgctttttaaaaaatagtaaacaaattattatttaatatagtttagatataagtaaaaacatgggttccagagaggtagaaatgacaaaataaaaaatggtcctttagaataaaaaggttgtagaataatgtggaaatacagttgctggtactaatctgctgtaagtataatttaaaacaaaagaaaaaagttgtcgtttttatgatttacacttaccagtccttcagctgggttctgcttctcaactagtttattatcctttgtacagtcatcttctgaacaaatactgccctcaggtttttgattcaaaagagaagatgactttttatttttcaacaagtgtttcagaagttcattccctgagtctcctttggcagcaggggccccagcagaatggggaggactctgtgctgaggagacaggacaggctacagcgtttccttctaccttactaccattctgttcctccaatttaggctcctcttggcctgggcaggactctgtctcagccttttccagttttatctcttctgttttggcaggggtttccatggagagcttgtctacttctgaatttgcatacgtctgttgatttggagttgcttgtgagaaatcactattgggcagtttgttctctaattctgtacatagctggcctgctgccatattgggagtggatgggccgactggttccaccgactcttggtcggcttgttgaggaagctcactgggtgtgctcactgcaggagtagaggtagtttctgagatgcctggagtcggtggggcagttatatctgaatggggagttgatggagccttggtggattctgcatcatcatctcttttcttctttcttgttcttttctttttccctttttcctctgggattatatcagaatacaactgaatgagcgattgggttgatcccggataactgtgtccatgggttatagtagaatcttggccacatgggagactgctattagctactggaggtgctgctggtaaagcaggtgtaaaagaaggcctcactggggactgctggaagctggtcccagaaagatttccatgtccctgcttcacagaagaaaaatttgggcttccaacagggattgatggtgaatcaggaacaaatgaaggagggcctacctgccttcgctcattagtctgcatgaaagtttgggtggagggtgaattaattgatccttgttgtatattctgctgctgtaaaacctgccccatttgctgttggtgttgtggagactgctgaaggggtcctagaggttgcataaaatcacaaggtaagtcggaactgtagaagggaatctgggacacagatgtcctactactacttatctcagagcccaccataccatgctgctccatttccatcctctgctgcaaagctctttgtctatctacctcctgcatgagttggatccgttgtctctcttgctgttctcgtaaacgttccttacgttcccgttcttgaaaactttcactaaagggattgttgtcatcaaattctacccgaggtggtggtccactctgtggatttgcatttgagactgtccctggggctggtgtacaagtttttattggtaactgggcaattgggggctgaattctaggaggattgaggggcaggtgggcaggagcactgttgggttgccatccaggtaaactgggcattctaacagggctagtatggccagaaataactgttgtgtgctgctggtgctgaagctgctgtggcaccatgggaaaggtgggttggctcatggtgggtggagtggcacctggaattaggggtggctggggctggacactgggcatcatggtaggtggggccattgcacattgctgctgctgtttgatccgataatcttcaatcaattcagcatgttctttctgttgtttacgaatctggaataacaaaatgcatcattactcatttctatacagcataggtactgaagtaaaacactggctgatgactgtggttgaggttacacagagggcagtttggccctgcagaagcaaacatattttgcttgggtaactgcaaaagtcacaaaaaaattgaattgataagccttaactaacaactgtcaatctctttaacaacaggatttttataaagttatctgtaaaagtgcttcacatatgaaatatcaaaaacggtttagtaaaatattaaaatcttatggtgaaactcatatatactatttatactatacataaaaaatatacaataaaaaaggttacacaagcagctaattttgatgtcctagaaattacaatatacaatgttagaataacagacttaactcaaacttgaaccatttaaatgttaagatttcatttcttaaatatataaattgtacaacattttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccactgcgcccggcctgtacaacattttaagacaagatgaattaccagcacgaatatcacaccccccacccagattaaaaagactaaatttgttgaacactttcaatttaatggctaacactcaaattataatttctgaaatctatacaagctccgaggaagtattttgaatagtctgtaaatagactcttaatataatggctaatatcaattaattaattcattccaaaaacctttgtgtcccaatgtgctcaatactacaggccagatatcaatcaagacgcaaactatgttctggagaacctcaccatctcattcagcaagctagggaaagaaggaatgcaaaaggatgtgtatatctctcaacatcattcaatttttagataaatattaatatactaaactcaggagttctaatagtttttcaaagtattttcttgggttccccaggtagactaatactttctgcaaataatcgtgtttcatctcttcttcaacagttgtgtaactcctattttcttatttttcctggccagtttactggttagaactgagaaattaccattggttggtgaagtagtaagaaagtacagaaagcacctacaacactatgtgggatatataaggtggtcatccatgtctttcccatgatattttataatactttttaaaacattaccatcaactgcttatcttaatatgattatactggatctttggcaactatgtaatagatgatgtatcccatttttcaagtattagcttctaaataggatttgatctatggatatgcaaaaattaggccctcatcaaaagaccttgtacaaatatgccagatggcaatgaaagtgctaaaaaaaatatactttattaaacatatctttacaagaatattaacctacagtaaacatgaacccagagagtagatttaaagagaaaagaaacctttcattctggaataatcctagttttaaacaactggaattatgatcaccttattgttggtacattattgtggtagctgtggtttgaagataagacacgtgagtccaaatccctaatctaatagttataagcaaacatgtacagtgggggtattttttgggattttttttgttttgttttgtttttgagacaagagttttgctcttgttgcccaggctggagtgcaatggtgcaatctcagctcactgcagcctccacctcccggattcaagcaattctcctgcctcaacctcccaagcagctgggattacaggcacctgccaccatgcctggctaacttcttgtatttttagtagagacgagttttgccacgttggccagctggtctcgaactcctggcctcaggtgatccgcctgtcttggcttcccaaagtgctgggattacaggcgtgagccaccgtgcctggccacgtgtacacagtgtttataacctttacaatgaatcagtttgtaaaatggggataatactaactccttcagaaagatgtagataagacaacgtaaatggaagtgcttcctacagtgttcattatagagcactcacattttttttttttttttttgagatggagtctcactttgtcgccaggctggagtacagtggcgcaagctcggctcaccacaacctctgactccttggtgcagggattctcctgcctcagcctcccaaatagctgggattacaggcacacaccaccatacttagctaatttttgtatttttagtagagacggggtttcaccatgttggccaggctggtctcaaactcctgacctcaagtgatccacccacctcggcctcccaaagtgctggaattacaggtatgaaccaccacgcctggcctgaaccttaagtttttaatttacttgggtaaatatacctaggagttggctctgaacccattttgtacactactattgttttattttaaatacaatttttacatgtttcttcttttccagtatattattcagtttaaatattctgataaacttctggtttataatagaagataatggcaaaatgatttcatttttctggaacagtacttcacataagacataccaatgtattttaagaccaaaacattaagaaataataataatatcaactccaagtaaacaaaaatactccctgggcccccaattcttattccaaactaaacccagtatctccccatgagctcggtcctcagttaagtcgaatactctcaatgatgtataacagaaacatggtctttgcagtgatttcttagtgcagaaaaaaataacgtctccaactataccaaagttgaaaatagttcttcgaagtcgaaattatgagactcaatctcttttgtgtcatttatttagtatgtgctgtgaccgtcactttaagtaaaagactggagctgttatggctgcagttactaagaggtctcagagctgtcactttttggcaatgtacttttaatgccatttaatactagtcaaaaaaaatcactagtcaaagtcactaatgaacaacacaccaaaacattctactcattaattgttggtagtttctattttgcaaacctatttattacctgttctagctgtttctgaaccatgctttgctgttcagtaacatgcttgagttgttctgcatcttcctctggaaattcacgcccagctttcttggcagtacgttgtttagctgaaagggccttcttagattttctgtgagcaccaatttgttcttcaagatacttctgctgcatttgaagcagctgttgggtctcctggagccactcttcatactgcttacgctgtgaatcat

SEQ ID NO: 11536 - DNA, 310 bp, Homo sapiens
atgctacttgaagaacatttctattgcttctgcaaaactattactgttgataaagttctttttcattgcttaattttcttctctgttaacagttacaaagaagttttttctgagatggacatgatggctcacacatgtagtcccagctactgaggaggctaaagcagaaggattacttgagcccagtaagtttgaggctgcagtgagctatgactgtgccactgcactccagcctgggcaacagaaggagactgtgtctctattaaaaaaaaaaaaaaaaaaagagttctctaaagtatacatcctttaa

SEQ ID NO: 11537 - DNA, 203 bp, Homo sapiens
aggtgagcaaaatgaaaaataatggtgaaaaaaaagttagctaaacagtctgaagatttcagaaaggttcagtttggggagaactttaaacactatcctgaaccaccttgggacccctgcaaataactagaaaggattcaggggcaccttgcatacctgacctttacaccatgctgctaacccaacttactgctaagtataat

SEQ ID NO: 11538 - DNA, 148 bp, Homo sapiens; identical to SEQ ID NO: 11425
  misc_feature (136)..(136): n equals a,t,g, or c

SEQ ID NO: 11539 - DNA, 152 bp, Homo sapiens; identical to SEQ ID NO: 11426

SEQ ID NO: 11540 - DNA, 96 bp, Homo sapiens; identical to SEQ ID NO: 11518

SEQ ID NO: 11541 - DNA, 3026 bp, Homo sapiens
agccctgctgagcgaccccgccagtcgggtccatcctgcagtaaatgcacaacccggacggaagtgcctctccgacagcagatccaggctcggagctccagacgctgggacaggtgacccggggcggtagcgagccggacggccttgcaggtggggcggaggtcccgaggagctcctcgggcgcggtcgtctgtgggctctgcgcgccctggaggtcgaggctccggcagcgcgggggttaactcgagccggtcccaggctgcgcggcgacgtcagagttcatttacatagcgcttatttgggttgcgcagtcgtgggcggggtctggacgtcgctgcggaccaatcgcgtgcgtctatgcaaatagcggtcgttctggggaactctgctcccgcggggtgagagttggccgctcttcggccgagctgcccgcgcgtcctttctccgtgcgcgtcgtcaggcgtgtcctctccgcgtgtccacccacaggccgcccgcagaccacccccgccgcgcgcgggacacgacgccccccgcaggacccgcccatcagcccggaaacccctgagctgcttctcccggaggccgatgcccacccgggagcccccaaagactcgcggctcccgggggcacctgcatactcacccgcctgggcctgggcccccggtgagcctgaccgggagggggtccccaggccgggcctctaggcaaaagatttagcccctccagtttgagggactccggtttcccgacaccccgatttaactccagaccacgattcctgtggcagctgcagggactggcgccccgaggcctcaaaaccagcgccccccgccctccgtgccagccccagccgggaccccacaaggcaaagaccaagaagattgtgtttgaggatgagttgctctcccaggccctcctgggcgccaagaagcctattggagccatccctaaggggcataagcctaggccccacccagtgcccgactatgagctgtgagtgtcccccatgtgattcttcatgcctgggatcaggagaggggcactgaggctggggctttgatagttgaataagagtttaccaaagagtagaaaggaaaggatcccttgctgatcagtagtgggattgtccctgtgaataagccactgcactccagcctgggcaacacagtgagatcccgtctccgaaaataaataaataaataggcgaggcgcggtggctcatgcctgtaatcccagcactttgggaggctgaggcaggcggatcacctgaggtcaggagttcgagaccagcccggccaacattgtgaaaccccgtctctactaaaaacacaaaaattagctggatatagtggcgcatgcctgtaatcccagctactgaagaggctgaggtgggagaattgcttgaacccgggaggtggaggttgcagtgagctgagatcgctacactgcactccagcctggacaacagagcaagactctatctcaaaaaataataataaataaattaaaagagggagagaaaaggaacgtttctagtaggggcccagcatggacaaagaaaagcaaattacactgactgggggaaagagtggggttctttacactcacactctgaccctcttcaacctggtagtaagtacccgccagtgagcagtgagagggaacggagccgctatgtcgcagtgttccaggaccagtacggagagttcttggagctccagcacgaggtggggtgtgcacaggcaaagctcaggcagctggaggccctgctgagctccctgcccccaccccaaagccaggtcagcactagggagaaagccctgccccgcagcccttctgagtggcccgacccaagcctctgggacacccactgggtccagatttccaggactctttctcctctcggttggctgggcgccgtgacacatggctaaggtcagcccttgaagtccccactagatgggcatttagtctgtctgagcctcagtttcttcatcccttcttgaattcaactctccctaaaccccctttctactcctccccttgcagaaggaggcccaagttgcagcccgggtttggagggagtttgagatgaagcgaatggtgagtcttgcatcccacagcttggtcttgcacccctgagacttctgtgaggctggggtgcctgtgcccagtttcttttttttttctttcttttgagacagaatctcgctctgtcacccaggcgggagtgcagtggtatgatctcagctcactgcaacctcagcgtcccgggttcaagcggttctcctgcctcagctgggatcacaggcgcccaccaccgtgcctggcaaatttttgtatttgtagtagagatggggtttcaccatgttggccaggctggtctcgaactcctgacctcaagtgatccgcccacctcggcctcccagactgctgggattacaggcatgagccaccttgcccggctcacccggtcgcctgtgcccagtttcaaggagagaaaattgaggctcggagaatgaaaggcagagagttaagcagcttgaaggccacagggcagactgctgcaaagacttccgggtctcgccctgcctaggatcctggcttcctggacaagcaggctcgctgccactacctgaagggtaaactgaggcatctcaagactcagatccagaaattcgatgaccaaggagacagcgagggctccgtgtacttctaagtgcccctgcagatgggcagagggatgcatggggatgcaggtcccttgcatttcttggtatctctcagcttttcctcttgcagctccccctaccaggggtcgctttctcctggattgcaaatgcctcttcagtttggactcagctctgacagcccctcctccaggaaggccttccaggacttcctcctctgggtcctctagctctgaccctacagggactccagatctcaacctgttccctggaagtagggcctgctctccatcccagtgaaataaacatgtattagacacctactgagtataa

SEQ ID NO: 11542 - DNA, 130 bp, Homo sapiens; identical to SEQ ID NO: 11519

SEQ ID NO: 11543 - DNA, 165 bp, Homo sapiens
gggggggttggtttaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaa

SEQ ID NO: 11544 - DNA, 143 bp, Homo sapiens; identical to SEQ ID NO: 11520

SEQ ID NO: 11545 - DNA, 175 bp, Homo sapiens
  misc_feature (46)..(46): n equals a,t,g, or c
  misc_feature (48)..(48): n equals a,t,g, or c
  misc_feature (56)..(59): n equals a,t,g, or c
  misc_feature (90)..(90): n equals a,t,g, or c
  misc_feature (104)..(104): n equals a,t,g, or c
  misc_feature (120)..(121): n equals a,t,g, or c
  misc_feature (141)..(141): n equals a,t,g, or c
  misc_feature (152)..(152): n equals a,t,g, or c
cgcaaaaaaaaaaaaaaaaaaaaaaaaaaaaaaaaaaaaaaaaaananaaaaaaannnnaaaaaaaaaaaaaaaaaaaaaaaaaaaaaanaaaaaaaaaaaaanaaaaaaaaaaaaaaannaaaaaaaaaaaaaaaaaaanaaaaaaaaaanaaaaaaaaaaaaaaaaaaaaaaa

SEQ ID NO: 11546 - DNA, 151 bp, Homo sapiens; identical to SEQ ID NO: 11427

SEQ ID NO: 11547 - DNA, 126 bp, Homo sapiens; identical to SEQ ID NO: 11430
  misc_feature (9)..(10): n equals a,t,g, or c
  misc_feature (14)..(14): n equals a,t,g, or c
  misc_feature (20)..(20): n equals a,t,g, or c
  misc_feature (95)..(95): n equals a,t,g, or c
  misc_feature (107)..(108): n equals a,t,g, or c
  misc_feature (110)..(110): n equals a,t,g, or c
  misc_feature (118)..(118): n equals a,t,g, or c

SEQ ID NO: 11548 - DNA, 151 bp, Homo sapiens
  misc_feature (63)..(63): n equals a,t,g, or c
  misc_feature (107)..(107): n equals a,t,g, or c
  misc_feature (148)..(148): n equals a,t,g, or c
tttttttttttttttccctttttctttttttttttttttttttttttttcttttttttttttnttttttttttttttttcttttttttttttttttttttttctttntttttcctttttttttttttttttttttttttttttttttnttt

SEQ ID NO: 11549 - DNA, 146 bp, Homo sapiens
tttttgtttgagactgtgtctcactctgtcgcccaggctggagtgcagtggcacgatcttggctcactgcaacctccgcctccccggttcaagtgattctcctgcctcagcctcccaagtagctgggattacagacacctgccacc

SEQ ID NO: 11550 - DNA, 10093 bp, Homo sapiens
aaaagcaagtgattcgcctaagtaagaatggggtggcgcctctcctatttttttaaaatagagatagagtagcgctatcttgcccgggctggcctcaagcaatcctttcccacctctgcctcctaaaatgctggcattacagccctgagccaccgcgcccggcccagcgccccgtctcaaaacaagatattacttccgctccaaacaaagatgggccagctaacgagcgcgggggaaacatccgcccggaaggccacttgaaggcacttccgccctctcttaacatggagccggcggaaggggtggtgtagggccgggcgataatggcggcgtcgaggctggagctaaacctggtgcggctgctatcccgctgcgaggcgatggcagcggagaaacgggacccggacgagtggcgcctggagaaggtgaggggatctcgcactgccgcgtagagcccgactcccggggggtgattcctagggttggaagccacctggcccgactccccggccccagtagcctctcgggcagcgccctttccggtcagtcccgccacgtccacctgtagcttccgcccccgtccctgggactccgcccctcccccactggccccgcctcctttacgcttgacccctcccatttgtcggccccgcccccccgactcccatgatcaggtcatgggaaagacccccgggtgacaatccacttttcctccccagtacgtgggagccctagaggacatgttgcaggccctgaaggtccacgcgaggtgagtgcaggcagcctcagggctttcacatcagcacgtggctgtgctactggacatcccagtaccgctatcccagctgggacccttccctgagctggggaccatggacaggttttgtttttcttcttcctgccttccagcaaaccggcctctgaggtgatcaatgaatattcctggaaggtggattttctgaaggggatgctgcaagccgagaagctggtgagaaggggtgcccctgccccctcagcccccatcaccgctcactttggtccccaggacctgcccctccagtgacttatcttcccacatttctgcagacctcctcctcagagaaagcactggccaaccagttcctggcccctggccgtgtgccaaccacagccagagagcgagtgcccgccacaaagacggtgcatctgcagtcacgggcgcggtacaccagcgagatgcggagtgagctactaggcacggtagggctccttccctggtccctgggaatcccttggacaggaataggggttctatgcttgtaggcagccagaaccacaatactgtcagatacaggaaccctaagggggtccagcaatctcttccctgggtcatcacacaaggctgcccaacagaggggcattgtggctaaggctttgctagatgaataggaatttggtacaaggcaaaaatggaatgtgtctggttaagccccagagttggcccaagagcagggtttgagtcctggcttgcaacttacaagacacataagtttcttcagccgtaaaagaggatgacaagttcctttctgagcactttatgtggatcagctcaatcttttaaaatatgagttgttgtggccaggtgcggcagctcacgcctgtaatcccagcactttgggaggccgaggcgggcggatcatttgaggtcaggagttaagaccagcctgaccaacatggagaaaccccgtctttagtaaaaatacaaaattagctgggcatggtggctcacgcctgtaatcccagctactcgggaggctgaggcaggagaatcgcttgaacccaggaggcagaggttgcggtgagctgagatcaagccattgcactccagcctgggcaataagagtgaaactccgtctcaaaaaaaaaaaatatgagttgtcgttaccagtttaaggttgaggaaacaggctcagaggtcatgggatttccccatgtcctgactgaaggtgaggaggttgaggtcagaagggacaggtttgggaacaagacaaggggggtgacttcatggcatttacttttttttttttttttgcgatggagattcgctcttgttgcccaggctagagtgtggtggcgcgatctcggctcactgcaacctccgcctcccaggttcaagcaatactcctgcctcagcctcccaagtcactaggatcacaggcacccccaccacacctggctaactttttgtatttttagtagagatggaatttcattatgttggccaggctggtctcgaacttctgacctcaggtgatctgcccaccttggcctcccaaagtgctgggagtgagccactgcacccagcctcatgccacttacttctttccacaggactctgcaggtgagtcaccatgaacacaacaggacttgagggccagctgactaggacaagacatgtatccttgctgccccggggcctccatgccgagactccatgccctgactccaacaggagcatcaccaaactacacctggaggaagagccaggacagaggaaatggccccgagaggaaacaaagctaggcacagtggctcacacctgtaatttcggaggctgaggcaggtggatcacctgaggtcaggagtttgagaccaacctggccaacatgacaaaaccatgtctctactaaaaatacaaaacttagccggatgcagtgccacgtgtctgtagtcccagctactcgggaggctgaggcaggagaattgcttgaacccaggaggtggaggttgcaatgagctgagatcacaccactgcactccagccggggcgacagagcaagactccgtctcaaaaaaaaaaaaagcaaaaaaattagccaggcgtggtgacgcacacctgtagtcccagcatacttgggaggctgaggcaggaggattgcttgagcctgggaggtagaggttgcagtgagctgagattgcgccagtgcactccagcctagttgacagagagagactctgtctcaaaaataagcaaataaataaattttttaaagctaggcactcccagcctatgggaccaaggctaggctggagggagggacctggggtctgagggaaccgagacaggagtaaggagaccctcctagaagagggggtattcaagcatggtcagaagccaacggggcagcagacaagatgaggaaacagcattccaagcagtagacccagcacaggcaatgctcaggatgccggaaacgggaaaccaacactcgccttttttgcttggcctgttttgctttcagagcctgagatggacgtaaggaagagaacgtgagtgtctgcggccctggggcagtagtggcaattgggcggtgcggcagggacggggtagcagtggccaaaccctggaccaccgaggcactaccacaaggatctaaaccaaccagaagccacttctgtggatgctcttcccagaagtcaaaggccaggcgcagtggctcacgcctgtaatcccaatactttgggaggctgaggcaggcagatcacctgaggccaggagttcaagaccagtctggccaacatggcaaaaccctgtctctactaaaaatacaaaaaattagccgggcatggtggcatgcgcctgtagtcccagctactcaggaggctgaggcaggagaactgcttgaacctgggaggtggaggttacagtgagccgagatcacgccattgcactccagcctgggtgacagagcgagatgctgtctcaaaaaaaaaaaaaaaaaaaaaggtcgggcgcggtggctcacgcctgtaatcccagcactttgggaggccgaggcaggtggatcacgaggtcaggggttcgagaccaccctgaccaacatggtgaaaccctgtctctactaaaaatacaaaaattagctgtgcatggtggcaggtgcctgtaatcccagctactcaggagactgaggcaggagaattgcttgaacctgggaggcagaggttgcagtgagccgagatcatgccactgcactccagcctgggcaacagaacgagactctgtatcaaaaaaaaaaaaaaaagaaaatgtgttggtcttctcccctttcccactccatctctcatgtcctcctccccccgtgtgtgaaatcagtggagtggcagggtcccagccagtgagtgagaagcagtcggcagctgagctagacctcgtcctgcagcgacatcagaacctccaggaaaagctggcggaagagatgctaggactggcccggagcctcaagaccaataccctggccgcccagagtgtcatcaagaaggacaaccaggtgtggggactgggggagctctccagcctctgccctggggcatcagagaaggcttcccagcacaggagcattgtggctggggctttgcgggatgaataggagtttcgtagaaggcaaaaatggcattcccagcagagggcacagcaccagcaagcgacaagaggtgcaggccagtcccagggaagtagagagaggccattcttggccccagtcctgttgacaccttttccacctcccccacagaccctgtcacactcactgaaaatggcggaccagaacctggagaaactgaagacggagtcagagcgtctggagcagcacacgcagaagtcagtcaactggctgctctgggccatgctcattatcgtctgcttcatcttcattagcatgatcctcttcattcgaatcatgcctaaactcaaataaagacccccgcccaccttgtctgtcttccgtctgtcccctgcccccatctagcagtgcctttcaggctggccaatgagatgggagggtttttggaggtccctgaagagccacagacagacagtgcatgagcaggggaagaaccacctcagggccagatgcgggggctcacgcctggaatcccagcactttgggagtccaaggcaggtggatcacttgaggccaggagttcaagaccagcctggccaacatggtgaaaccccgtctctaccaaaaaatacaaaaatcaggcaggcatggtggcgcacgcctgtagtcccagctacttgggaggcttaggcacgagaatcacttgaacccaggaggtggaggttgcagtgagctgagatcccagtactgcactccaacctgagcaacagagcgagactccattgcaaaaaaaaaaaaaaaaagattctaaaaagaaaaagtcagtcttggcaggtggtgactcatcaaacgctgcctccgcccatgttcctctggagcctaccccacaatggacgaggcccagccccaggaggccctaggagcctccgactggcagacttgtagccgaacacagtgccttcagcgatgtaaggccagggtgaggccaaagggcagaacaggggcttggagggtcggggaggagtggggccatgacaggagctcagcctggaggagggcgcatcaacacgaggtcttccctggaattaaaggcaatagttcaaggacacagctcagccacactgcagcctcagctctcgggacactacagatccctcacagtcactcgacaaacacacatgggtcgtgcccagtgctcactggagactctgccctccccaggtcacagtctgatcacttcaaaggagaactgggtgagtactagggtaggggtcctgaaaagggtcgtggagtaggaattctggggtcctgagccctgctctcacaccagctccagacagggcacagcctgtgagagcaactgagggggctcagtgacgagggcttggggtgtctgccccatggcagcattgacggcattgtggggacacttggaggtgcccagtggacccccactgacgtgggtgtaaaatccttaggtagggttgtgtggttttttttgttttgttttgtttttgagacagggtctcgctctgtggcccaggctacggtgcagtagtgcaatcatagctcactgcagcctcgacctccaggcctcaagcaatcctcctgccttggcctcacaaagtgctgggattacaggcatgagccactgtgctcagcccaagtagagatttttaaaagtgctactggcagcttttaaaaagtagaacatagagccaggcgtggtggctcatgcctgtaatcccagcactttgggaggctgaggcgggcggatcacctgaggtcaggagttcgagaccagcctggccaacatggtgaaaacccatgtctactaaaagtacaaaaaattagctgggcatggtggtgggcacctgtaataccagctacttgggaggctgaggcaggagaattgcttgaacccaggaggcggaggttgcagtgagccgagatcacgccactgcactacagcctgggcgacaagagcgagactccatctcaaaaaaaaaaaaaaaaaaaaaaaaaagatcataagaaggagacagccaggcatggtgactcacgcctgtaatcctagctactggggagtctgaggcaggaggaccccttgagcccagggactggaggctacggtgagcagtgatcatgctactgcactccagcctgggtgacagagtaagacccctactcaaaaaaaaaaaaaaaaaaaaaaggaagtttatgcctgagacacagggatgattccttattagaaagccacgttggccagggcaccgtggctcacaccttgtaatgccagcactgtgggaggctgaggtgggaggaccacttgagctcaggagtttaaggccagtctgggcaacatggtaaaaccctgtctctacaaaaaatactaccagctacttgggaggctgagacaggagaatggcttgagcccaggagttcgaggatgcagtgagctgtgatcacaccactacactcctgcctgggtgacagagccagaccctgtctcaaacaacaacaaaagccagctacattaatgcctcagaaaacaaaatcacagatgctgaaatgacaaattgtactgtttagcctccgttacccaaagtctcctaatttaaaaagaaaggaaatagatggacatgttcctcacttcactgaaaaatctcaagccaaagggagcattgactttaatgggcaaatactcaaaacttctgccatcaaaatgaggaataggccaggtgcggtggctaaagccacctgtaaccccagcactttgggaggccaagataggcagatcacttgagctcaggagttcgacaccggcctgaccaatatggtgaaacctggtctctacaaaaatacaaaaattagccaggcatggtggcacgcacctgtaatcccagctactcagaaggctgaggcaggagaatcacttgaactcaggaggcagaagttgcagtgagccaagatcgcaccactacactccaccctgggtaacagaatgagactccatctgaaaaaacaaaaacaaaaaaacggggggaatggaatggggaaggatgcttacagtcgccctgcctccataatgtaacatagtcttgaggtggtagtcagcacaactagacgaaaaaaagaggctgggtgcggtggctcacgcctgtaatcccagcactttgggaggccgaggcgggtggatctagaggtcaggaggtcgagaccatcctggctaacacggtgaaaccccgtctctactaaaaatacaaaaaaaaaattagccgggcatggtagcgggcacctgtagtcccagctactcgggaggctgaggcaggagaacggcgtgaacccaggaggcagagcttgcagtgagccaagatagcgccactgcagtccagcctgggcaaaagagcgagacttcgtctcaaaaaaaaaaaaaaagaaaaaaaaagaaaaaaagaaatggggccaaatatggtggtgcacgcctgtggtcccagatacttcaaaggctgaggcaggaggattgcttgaggccagaagatagagactagcctgggcaacaatagcaagaccctgtcaatagaataaataaaatgccaggcatggtggctcatgtctttagtctcaactacttgggaggctgaagcaggaggactgcttgagcctaggagtttaagacctgactgggcaacatagcgagaccccatctctaccaataaaaatttaaaaattatccaggtgtaggccacctggttggctcaccaggccacactggccaagatggtagaaccctgtctctactaaaaatacaaaaattagccaggcatggtggcgggcacctgtaatcccagctactcaagaggctgagccaggagaattgcttggcccaggaggcggaggtagcagtgaaccgagatcacaccactgcactccagcctgggagacagagcaagactccgtctaaaaaaaaaaaattatccaggtgtggtggtgcgtgcctatagtaccaattattcaggaggctgaggcaaatgatcacttgagcccaggagcccaagtgatcatgctgcactgagctatgatcgtgccactgcactccagactgtgcaacacggtgagaccccatctctaaaacaaacaacaagaaaaaaagaaatgagattgaaaaataagagaagaaaaataagaaatgagaaggcaaaattatttgcagatgatatgaccgtatatatgataggcccaagcgatgtgactaaaaatatttcaataaaagaattccttaagctagcaagagacttatagatatttaaaaattcatttcttgtatactatatatgtatatagctttaaaatgtattaaagcatcccatttatagcagcaataaaaaaagatacactgcctgcttaaacgaattttgttgacatttgaagaactttttttggagtcgcccaggctggagtggtacagcagcacaatcgtggctcactgcaacctccgcctcccggtttcaagtgatctcctgcctcagcctcctgagtagctgggattacaggtgtgtgctaccatgcctggctaatttttgtatttttagtagagacggggtttcaccatgctggccaggctggtcttgaactcctgacctcaagtggtccacccacctcggcctcccagagtgctgggattacaggcataagccaccttgcccggctgacatttgaagaacttctaaaaatcaacaagaaaaaacatttgcaggatataacaggaaaagaattacgaaatagagaaatagtctctaaattttttcactcatacactaggcaatatttccttttttttgagacagtctctcaactgtcatccaggctggagtgcactggcgcaatcttggctcactgcaacctctgcctcccgggttcaagcgattctcctgcctcagcctcccaagtagctgggattacaggcgcccgccgtcacacctggctaattttttatatttttagtagagacggggtttcactatgttggccaggctggtctcgaactcctgaccttgtgatccgcccgcctcggcctctcaaagtgttaggattacaggcgtgagccaccgcgcctagccttagtaggcaatattttcaactttgaaagtacaggtgaggggccagcgctgtggctcacgcctgtaatcccagcacgctgggaggccgaggcaggcggatcacgaggtcaggagatcgagaccatcctggctaacacggtgaaacctcgtctctactaaaaaatagaaaaaattagccgggcgtggtggtgggcgcctgtagtcccagctactcaggaggctgaggcaggagaatggtttgaaccctggaggcggagcttgcagtgagccgagatcgcgccactgtactccagcctaggagacagagcgagactccgtctcaaaaaaaaaaaaaaaagaaaagaaagtacaggtgagggaatccgttatcatgccagtgccgccaaggttgtgggaaaacccctgtatctcttggagcataaatggtacaatctcactaaggagtaacttggcagtatgttccaaatgtaaaatacacacatcccagacaggaggctgaggcaggaggatcgcttgagtccaggagttggaaaacagcctggacccataaggacatttcctctcaaaaaaaaaaaaaaaaaaaaaaaaaaaaaa

SEQ ID NO: 11551 - DNA, 118 bp, Homo sapiens; identical to SEQ ID NO: 11525

SEQ ID NO: 11552 - DNA, 195 bp, Homo sapiens
  misc_feature (3)..(3): n equals a,t,g, or c
  misc_feature (30)..(30): n equals a,t,g, or c
  misc_feature (32)..(32): n equals a,t,g, or c
  misc_feature (37)..(37): n equals a,t,g, or c
gcncccaatacgcaaaccgcctctccccgngngttgnccaattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgaacggataaca

SEQ ID NO: 11553 - DNA, 1721 bp, Homo sapiens
ggacctgcctcctaatccccttacttctctgtccatctcccttccccagcatcgtgcatctgaggcatttgagatcctttttgaagtctgtccaggccttccttttattcctgtggggccagacaggggcttaggaagggccaaaggaccatcatgaggctaagttgccccagagccccaggatggatgggcccattttttccttattccctgctcagttttttcccctgctccttctctagtccttctttcatatttctccttctcatcttgaaaacaggatgttccctcttcccttgctgtcccatttctcccctgtgtccttatttctcccagtctctatcccctctcaagtccagggcaggccgatgctattggtgcttcttcactttgagacccagttccatatttgtctttagtgtatatcctcttcctgatacctccttcagtccctctctgggccccaaggctgagaatcagtgttaactgggtaaggatcatttgcttcctacccagctcaatctgccctggccatagggcttcccagggaaggaagaagagggaagaatccaaccactttccaatccagtgccaattggcccactaagcatcctaaaggtgaatgtgccctgtgccaatctctcctcaggactgagtcaacccccttcaacctcctcacctctctaaacaccatccatagtaacatgtgcattactggggtacctaggagtcaggacttttgacttcaggccagtcatttcctcccgatggggaaagggtgagatttacatccccaaatgcttgagtccctcagtgaaagaattagtttttgtttgtttgtttaagattttggggaagagatttgaggaggaaagaaaggagatggggtgagagggtttttaagtctgaaactctctgtcatgagctgtccccatggttactcaaggacaaggggggacagttttgcctacagctccagagacacagagaacaaaggggtgaccttcatttttcttcaagccggcctctgtgggggtctgtgagcagcttctactggatctttgtttggattctgtgtctgtatttataatttatttgaaatgtgctgggtagtgttctcatttgggggctgaagttagcaactgggccttcagctagggaaagcagttgcgggcagggggtggggggagattatattcactcctgccaaggactcccagcccaggactctctttagagcaaggaagcctcgttctctttcttctcaagaggctctcttgttctccatcaggagagccttgatttaggctacggcctcactctctatggccaccctaagaggaaaggctacttcacctcattacctccagagggctgggcagggccaagtgcctcataggactcatgttctctccaaccagggctggcatcactgctttgcaaagtggggcctgaggtagaagaaggtgtctggtttctccagctgctgtaggaggctaatgggcagggtacttgccctttgtcccactagactctaacccagcaccagggtgcccacctaggacctttcctggacatgagtttccttcactatcatagtcatgagcctcctacttctgggattgcagatcaggggtggggggagaatgttgcatgttgttttctggtgcttgttattatatatttgaataaacagtgctgcaagtacttgccatgaagga

SEQ ID NO: 11554 - DNA, 1651 bp, Homo sapiens
ggacctgcctcctaatccccttacttctctgtccatctcccttccccagcatcgtgcatctgaggcatttgagatcctttttgaagtctgtccaggccttccttttattcctgtggggccagacaggggcttaggaagggccaaaggaccatcatgaggctaagttgccccagagccccaggatggatgggcccattttttccttattccctgctcagttttttcccctgctccttctctagtccttctttcatatttctccttctcatcttgaaaacaggatgttccctcttcccttgctgtcccatttctcccctgtgtccttatttctcccagtctctatcccctctcaagtccagggcaggccgatgctattggtgcttcttcactttgagacccagttccatatttgtctttagtgtatatcctcttcctgatacctccttcagtccctctctgggccccaaggctgagaatcagtgttaactgggtaaggatcatttgcttcctacccagctcaatctgccctggccatagggcttcccagggaaggaagaagagggaagaatccaaccactttccaatccagtgccaattggcccactaagcatcctaaaggtgaatgtgccctgtgccaatctctcctcaggactgagtcaacccccttcaacctcctcacctctctaaacaccatccatagtaacatgtgcattactggggtacctaggagtcaggacttttgacttcaggccagtcatttcctccccgatggggaaagggtgagatttacatccccaaatgcttgagtccctcagtgaaagaattagtttttgtttgtttgtttaagattttggggaagagatttgaggaggaaagaaaggagatggggtgagagggtttttaagtctgaaactctctgtcatgagctgtccccatggttactcaaggacaaggggggacagttttgcctacagctccagagacacagagaacaaaggggtgaccttcatttttcttcaagccggcctctgtgggggtctgtgagcagcttctactggatctttgtttggattctgtgtctgtatttataatttatttgaaatgtgctgggtagtgttctcatttgggggctgaagttagcaactgggccttcagctagggaaagcagttgcgggcagggggtggggggagattatattcactcctgccaaggactcccagcccaggactctctttagagcaaggaagcctcgttctctttcttctcaagaggctctcttgttctccatcaggagagccttgatttaggctacggcctcactctctatggccaccctaagaggaaaggctacttcacctcattacctccagagggctgggcagggccaagtgcctcataggactcatgttctctccaaccagggctggcatcactgctttgcaaagtggggcctgaggtagaagaaggtgtctggtttctccagctgctgtaggaggctaatgggcagggtacttgccctttgtcccactagactctaacccagcaccagggtgcccacctaggacctttcctggacatgagtttccttcactatcatagtcatgagcctcctacttctgggattgcagatcagggatagggggagaatgt

SEQ ID NO: 11555 - DNA, 267 bp, Homo sapiens
tcatctagtccctgcgtctgatctccagtcatcccatgactcagtgtgccttccactgtcttctctggcctctgcctgcccacagaatccaccatgtgtgaaccagagaggtccaccagcctagaaaacagcccttcagagggtcctgatgaggccttcctggactcagctgggagcaagataaattgcaactgagttgcagcttcaagaaagtaaagccagtaagcttgctggcagaatccatttcttctatcccctcaatcctcc

SEQ ID NO: 11556 - DNA, 267 bp, Homo sapiens; identical to SEQ ID NO: 11555

SEQ ID NO: 11557 - DNA, 1074 bp, Homo sapiens
gccatggaggaacccacccagaccggcagcaacctccatatgctacgtggacaggtgggcgtgccttcacctccacccctacccccgatttgcctacccagccactcactgttagtgtccctggacttggaaactcagctgggagaacatccagccatggaagggaagggaaggggtccctggggtggggggcgggagccagccaggcttctggagtgtagtagtgacagccagcctgcctgagtgagcttgagcaagttgcttggtctctctgtacctgtaaaatggacgcagaaaatttgcctactctccaagggtctgtgtgcggtcaccaaaagcctggcacagagtgagggacgagtgcttgggagatatcttgatgccgacatcctccctggggatgtgtctggcaaagcctcctggtagtgggcaggtgggtaggtttcttgggtgttccctgaccttgacttccccctcctgcccacaggtgccccttgtggtcaaggccctgcagcggcagcttaaagatcggagcgtcagagcccgccagggatgcttcagcctcctcaccgagctggcgggtgtcctcccaggcagcctggccgagcatatgcctgtgctggtatcaggtaggctggactgcaaccaggtatctgctgttctgggccacttccagaacccagaccccacccctgagttgagcccccagttcctgagacagtctgagacccaatcccaggctcagtccctggtcaagagtctccagtggcctcccactaccagcagtgagaacaaggctggctccagtgagttccctggacatgtttccctcagccctggccactggtcagggctgacttcttggaaacttctgcagaagagtttaggtgcttcagtccagctcaggcacttgtaggtaccccagccttgcttccagggagggccgtgttgcatcagaggcggtggcctcataacctttgcattcaccctgcaggcatcatcttctcgctggccgaccgctccagctcctcaaccatccggatggatgccctggccttcttgcaggggctgctg

SEQ ID NO: 11558 - DNA, 19970 bp, Homo sapiens
ctctatctaaaccccagttttctcatctctataatggggaaataatccctgtctcaaaaggtcgtcatgaagctaaaataagattatgggtttgacatgcttagccccatccgtagcactcagtagatgcccattaaaaggtagggaatgttccccatagggtatctataaatgctgatcatcaaaaagtgaagcacagtgcccagctctctctcctccctgtcccttctcccccgagccacagacctgtcctgggagatgagggttccacgtgtgtcttgttcctgccccagagagtgaagacgagtacagcgatgacgatgacatgagctggaaggtgcgccgggcagctgccaagtgcatcgcagccttgatcagctcgcggcctgacctgctgcccgatttccactgcaccctggcacctgtgctcatccgccgcttcaaagaacgcgaggagaacgtcaaggctgacgtcttcactgcttacatcgtgctgctgcggcaaacacagcccccgaagggatggctggaggccatggaggaacccacccagaccggcagcaacctccatatgctacgtggacaggtgggcgtgccttcacctccacccctacccccgatttgcctacccagccactcactgttagtgtccctggacttggaaactcagctgggagaacatccagccatggaagggaagggaaggggtccctggggtggggggcgggagccagccaggcttctggagtgtagtagtgacagccagcctgcctgagtgagcttgagcaagttgcttggtctctctgtacctgtaaaatggacgcagaaaatttgcctactctccaagggtctgtgtgcggtcaccaaaagcctggcacagagtgagggacgagtgcttgggagatatcttgatgccgacatcctccctggggatgtgtctggcaaagcctcctggtagtgggcaggtgggtaggtttcttgggtgttccctgaccttgacttccccctcctgcccacaggtgccccttgtggtcaaggccctgcagcggcagcttaaagatcggagcgtcagagcccgccagggatgcttcagcctcctcaccgagctggcgggtgtcctcccaggcagcctggccgagcatatgcctgtgctggtatcaggtaggctggactgcaaccaggtatctgctgttctgggccacttccagaacccagaccccacccctgagttgagcccccagttcctgagacagtctgagacccaatcccaggctcagtccctggtcaagagtctccagtggcctcccactaccagcagtgagaacaaggctggctccagtgagttccctggacatgtttccctcagccctggccactggtcagggctgacttcttggaaacttctgcagaagagtttaggtgcttcagtccagctcaggcacttgtaggtaccccagccttgcttccagggagggccgtgttgcatcagaggcggtggcctcataacctttgcattcaccctgcaggcatcatcttctcgctggccgaccgctccagctcctccaccatccggatggatgccctggccttcttgcaggggctgctgggcaccgaaccagctgaggccttccacccacacttgcctatcctcctgccacctgtgatggcctgtgtggctgactctttctacaagattgcagccgaggccctggtggtgctgcaggagctggtgcgggccctgtggccgctgcacaggcctcggatgctggatcctgagccatatgttggagagatgtctgctgtcaccctggcgcgacttcgtgccactgacctggaccaggaggtgaaggagcgggccatttcctgcatgggccaccttgtaggccacctgggtgaccggcttggggatgacctggagcccacgttactgctcctcctggaccgcctgcggaatgagatcacccggctgcccgccatcaaggcgcttacgctggtggccgtatccccactacagcttgacctacagcccatcctggccgaggcactgcacattctggcctcattcctgcggaagaaccagcgggctttgcgactggccacactggcagccctggacgccctggcccagagccagggcctcagcctcccaccgtctgccgtgcaggccgtgctggctgagctgcctgccctggtcaacgagagcgacatgcatgtggcccagctggctgtggacttccttgccacagtgacccaggcccagccagcctctttggtggaggtcagtggccctgtgctctcagagctgctgcggctgctgcgttcgcccctgttgccagccggggttctggcagctgctgaaggcttcctgcaggccctggtagggacccgtcccccgtgtgtggactatgccaaactcatcagcctgctcactgcgcctgtttatgagcaggctgtggatggtgggcctggcctgcacaagcaggtgttccactcattggcccggtgtgtggcagccctctcagctgcctgtccccaagaggcggcaagcacagccagtcgcctggtctgcgatgccaggtcgccccactccagcacgggggtcaaggtcctggcattcttgtcgctggctgaggtgggtcaggtggctgggccaggccaccagcgggagctgaaggcggtgctcctggaagctttggggtcacccagtgaggatgtgagggctgcagcctcgtatgcactgggccgtgtgggtgctggcagcctgcccgacttcctgcccttcctgctggagcagatcgaggctgagccccgacgacagtacctgctgctgcactcactcagggaggccctgggggccgcccagcctgacagcctgaagccctacgccgaggacatctgggccttgctgttccagcgctgcgagggtgctgaggagggcacccggggggtggtggccgagtgcattgggaagctggtccttgtgaacccttcgttccttctgccccgcttgcggaagcagcttgctgcaggtaggcacacaggtgtgggcaaggcagcccacctcggaggtgggcagtttgccactgagcatccaggcagctggggcagagtgagctatttcaagtcactggatacaagaatcacggtatctatacgacagaggcaaggaagctacagaggaacacacagtgatacctgagacttaaagccttcctcctatgggactgtgggatagaagggacagagtccttgattggtccctacaacaaatacatttaaaaatctcatgatgttggctaggcatggtggcacatgtctgtaatcccagcactttggggaggctgaggtgggtggatcacttgagcctaggagtttgagaccagcctgggcaacatggtgagaccctgcctctaccaaaaaaaaaaacaaaacaaaaaacctcatgatgccaacttcataatccttgatgtggacagtagcttagtgctccacacagaggtcaacaaaaacagttttcccagtagccgtagactgcagcctgcagagggtcagctctttcggctagcctgagccaagagcagacgtcagtatagacggggacaggctgacatgcccccgaggcttggagagggctgggcaagaaccaggaggggcaggcgttttggcttgtcgtgttttggcacaccaggtgtcttagcttcaggaggtggaaagcagacaggtagggtcatcaggctcctaggaaaatgagagttcccagaatgaaaggccagtgggcttcgagctggccagctggccccttacagaaccagtggatgctctgcttgacagaatgcaggtacagtgtttggtaacctatgtggtacctacagtaattaatactgagtaaatcaagagctgctgttgttactaggtaggttagtgatttcagttaaggccttcttgggttgctgggttcgtaagaagcagttgtctggcctcaggactggatggaagaacattgttgaggacactgtctattacatcacacaaccttgagagacgagagtgttaagatgcagaggagccctgctttgcctaaacacctatttgtttctatctcacgtgcactgttgaaccagccacccggtcacatttcctttttagcaccaactgctgggaagcttagagccagatgagtggtctgcttctagtaggttcctgggacttccttattgatgctctctgtacatcttcctgctagtctccttctcacctccctgccttcagtcgtccttggccttgttcttgttttcagttcacttaatcttactctcttgtgcctgtcttcatcagccaccctaaatcttcctgggagccagtcaggctggcaagggaaagaggtaaaagctgaaagtctgaattcagtaactcttccattcattcatgccttagcaccaaatggtaaacttttcctcgaggctgaacataaagcctgtggggtggaaacaccttagcccattcactgcattgtgctggggttgggcagggagcaaagggggcgagccactgaggagagattcagacgcaggtggagcgtccacccattcgtttccttcattaagggaatgtacttcccctctttactgggcttctctactcagaaagcaagcggcaaagcacaagtaagcaagctctctgtgaccgagcctggaggtgatccgagttctgttaggcctccctgaccaccagccagaacgcagccccaggaagaggggcccagccaggaattctggatctgctgtgtggccctagacatgaacttaaaccctctgagtctctctttcctcatatgtcaaagagatgatttttattggtgattttattggttcttttaatactactttattattaataggatcattgttaggactcattgagataacatgtctgaaaaatcccaaggcctgagggaaggtctttgttggagcagttcctgtcttggttattggttccctgtttgcagcctgtggtgttacctgagcactggcagtcctactgtttcagctgcagcaggaagaattgaggggagattcaaggctgccaagggaaatggtagaatccactttcccagagatggggagggggtacagttctgttttccagggaagcagggggaggagcctaagcaccttctgatctgtgagcctccaggattggcccctgcccctcactaactcacctcttcttgtcctgcaggtcggccacacacccggagcaccgtcatcacagcggtcaagttccttatctcggaccagccccatcccattgaccccctcctgaagagcttcatcggtgagcacctacctcttgcccctccaccttgttcagtgcccccacccagtccttgagcttgggctgatgtttactacccaatagccaagggcaatgggagacccgggaggtgtgcccatgatgggcagcagggcctggccctccagttaaaaggcctgggttcacatccctgccttcctactgccactcaatcatgggtgggtgtggcatgcccatcacacctctaagcctcgctttcctcatctgtcaaatgggcgtgagaaactcttattatctgcattttctagagttgtcctggaagcccatgggcaactgagggagaagatgcttcatcaacatatagactcttgggaatggaaaaccaccagcctctcacatgccttagcttttgcgggccccaaagtggggcagggaagagtgctccccccggccccgcctgtccactagatcgccctctgtctgaggggccttctggcctgaggagcccaagcagccttcactgggaggagaggaactgagacctccctctggggctcggcaggaccactgggtttttcctaggaaggcagagccctcgccccttcagagcttggagcctgcagcccctcactgggccacactggagtctcagcccacatctaggcagggcagcccagtagagagaggttttggagctcacctgcctcaggttcaaatcctggccctgctattccctgggtgtgtgagtgtggacaagtcttctcatcctcagctataaaatgggggtgctgggccaggtgcggtggctctcgcctgtaatcccagcactttgggaggccaaggcaggtggatcacctgaggtcaggagttcaagaccagcctggccaacacggtgaaaccctgtctctactaaaaatacaaaaatgagccgggtatgatggcaggcacctgtaatcccagctactctggaggctgaggcaggagaatcacttgatcccgggaggtgaaggttgcagtgagcggagattgcaccactgcactctagcctgggcgacagagcaagactccgtctcaaaaaaaaaaaaaaaaattagttgggcatggtggtgggcacctgtaatctcagctgtttgagagactgaggcaaaagaattgcttgaacccgggaggcagaggttgcagtgagccaagatcgtaccattgcactctaatctgggcaacaagagcaaaactctgtctcataaataaaaaaaaaggaacggttgtgctgatactcatctgccaggggcctgttatgtgggaccaaggggccagcagacgtgaccgtgttctgcactggagaacacgtgcagaagctctagcaaggtcatcggcagcaactttgtcccttgccctaatgcagtgggcacatgccccccctccggcctgatttcctccattgtaacggagctgcccttggctagcaccaccagcgaccttcacatgggggttctggcttgctttaaaacatttgaactggtttttgagctctcactgtgtatcaggcaccacactaggccctttaatatacctcatcatagtggatgctcacaagcaaggagctgtgagcatccttgctctgctgggagccttcctgcccttcccagtgcatcacatcaggggcacatggaggtggcttgtcccctggctggcgatggtaactttgatcacccagttcaggtggataccgccatggtttctctccactctaaaattactctttttttcctttggaatgaatatgaatttttgagtacataaaataagtattttatgtaaacatccttgttctcatcaatttttttgcccactaggtttagcatccacggttgtttcttgcctgggtcaatgattactgtgatatttgccaaatggtgactttctagttccattattctttccatagttacaagtttgcattctactgtctggaagaactttttcttctctcccacttatttattcatcaatttatttgtcattagagactcatggcttcttcccacttcattccgtgggctatactgttactgtctttaattttgatgcattggaagcccttcaagctggttcctattttttattgacatgtttcaatcttttttttttttttttgagagagtctcactctgtcacccaggctggaaggcaatggcacagtcataccttactgcaacctgcctctcaggctcaagcaatcctcccacttgagcctcccaagtagctgggattacagatgtgcgccagccaccacacctggctactttttaaattttttttataaaaacagggttttgctatgttacccaggctggtctcgaactcctaggcttaagtgatccactcaccttagcctcccaaagtgctgggattccagacgtgagcaccccagtgcaccagcctccatcattctcttaagtgtatccttgcttttggcacgatgagatgctccagattcattgcgaacctctcctgccccagtcctggaatcagccatttctccaaggagtcctgattccttttagtggagaatggtattttgaatccaaaatctggacactagatgtgcctgttgctgttggggcctcattgcttctaggccctctcagcagacagaactaggaaatgcatgtctatacgcagagacacaaacacatacgtgtatacatgtgcttccagatgcacacccatgcacatctttctttgtccctccttctttccctccctgcctctctttctctccctctctcttctttctcttctacctacctacccacctattttgaaaaccttgagttcatagctgcttcgtattgcagtctagccccctttccatatgtgtaactcctttctcttacagtaagaaacccagctcccattatctacaagatatttattttcttaatcctgaaatacacagaaagtagtctgagaattgctgactcttatctctgtgaaaactaatactcgtgtgtagtttttttgtgtttcgctagagggcagctagtcaaaatactcgaagtggcttggtttgttctctccttcataagctgggtggttatgtggatcattttaaatacagtttttgttggtttgtttttgcagggggtgggtatgggtacggtggttcactcctgtaatcccagcactttgggaggctgaggcgggagaataacctgaggtcaggagttccagaccagcctggcaaaaccccatctctaccaaaaaatataaaaattagccaggtgtaggctgggcgcggtggctcacgcctgtaatcccagcactttgggaggccgaggcgggcggatcacaaggtcaggagatcgagaccatcctggctaacacagtgaaaccccgtctctactaaaaatataaaaaaattagccgggcatgctggcgggcgcctgtagtcccagctactcaggaggcttgaggcaggagaatggcgtgaacccgggaggcagagcttgcagtgagccgagattgcgccactgcactccagtctgggcgacagagcgagactccatctcaaaaaaaaaaacaacaaaaaaacggggtgtggtggcacacgcctataatcccagctacctgggaggctgaggcctgagaatcgcttgaacccgggagatgaaggttgcagtgagctgagattgtgccactgtactccgtcctgggcgacagagcgagactgtcttttgactcaaacaaaaaaatgataaatacagtttttttgcattttggttttatttttagggattcccccatccttatttctttattaagtatataaaacattaacaattctaaaatgtttaaactataatggctgggcgtaatggctcatgcctgtaatcccaacactttgggaggctgaggcagaaggatcacttgagtccaggagtttgagaccagcctgggtaacatagtgagacccccatctctaaaaaaatttttttttccaaaccaacatggcacatgtatacctatgtaacaaacctgcacgttgtgcacatgtaccctagaacttaaagtataataaaaaaattttttttaagtttaaactctatatcatagtccttttctgctactataacagaatactacagattgggtaatttataaagaagagaaattcattcctcacagttgtggagactgggaggtccaagaacatggcaccagcatctggtgagggccatcccatggtggaaggaagggcagaagtgagcatgggagacagagagacgagaggcggggcttaacaggagctccctcccatgatcactgacccactcctgtagtgacggcattaatccatgcgtcagggcttcaccctcgtgacctaatcacctctcaatactattaccatggcaattaagtttcaacatgagttttggtggggacattcaaatcatagcactgtacaagtctgggcacagtggctcatgcctgtaatctcggcactgtgggtggccgaggtggtggattacttgaggtcaggagttcgagaccagcctggccaacatggtgaaaccccgtctctactaaaaatacaaaaattagccaggcatggtggttcgtgcctgtaatcccaggtacttgggaggctgaggcaggagaatcgcttgaacctgagaggtggaggttgcagtgtgccgagatcacaccactgcactccagcctgggcaacagagtgagactctgtctcaacaacaaaacaaaacaaaaacaaatcatggcactgtacaaaaaggagtatcctgagaagtgctggtgactctgtgtaagtttcttgacctctctgatctttaagagcctcacctgtaataacaagttcacattcacagagtccgtgctgtgtgccaggcactctgctctgtgcttttaatgcattaccacattcaaaaaatttttttctttttttttttttcaagataatgctgaggcaccacattttaaattctaaagacagtcccatagcataggttctgttacgactcccattttacagatgaggacattgaggctctccaaggtcccacagtaaattggtagagctggaatggaagccacatcagctcaagcccacattcttatctggcctttgaagggttgtttgtgcctggcacaaagtagatgctcaccacacccagcttacccccattcagccagttctgcacgtgcacagtaaccagatggccggggtggtgagggaggtgactttgtgctttggctgtgcatcccccacgcccctcatgttcttctgccaggagagttcatggagagcctgcaggacccagacctgaacgtgcgccgtgcgactctggctttcttcaactcagctgtgcacaacaagccctcgctagtccgggacctgctggatgacatcctgcccctcctctaccaggagacaaagatccggcgggacctcatccgagaggtgtggagcagagctggggacccaggggaagctgggggtgatgccacctctcatgcctcactgttagggcattattatctcatcagagcaggtgccggggccacatggcctgggtcaagtcctgccctgactccgagctgtgggaccccagccagggcaacctgatcctctctgagcctcagtttctcctcgtgagcacatgagggtgctaattgtgtctgcgtcatagggttgctgcaacaatttggtgagtgaggtcctgtaagtgttcagaaccaccgcaggcacacagccagcgctcagtaaatgttgatgtttgacaggtgttcactgaacatctgcactgcgcccaagtgccaggactcagagttgggcctgactgggtttctgccaccaaggagttcatcgtggccccctaaaggacagagatgccaactctgctgattacagacagcccccgccttacaatggttcaactttacaatggtgcaaaagcagtagcgttcagcaggctcctcaccttatgatgggattgcttctggaagccaacttacaatggacctattgtgatgtaatcccatcatacaccaaggagcagctgcgtttcacttagagcccacctggtaaaggaaggattcgggggcagaggttaaaggtgatttagtaagtttgagctgtggaatactagcagcattgaggccctttaagctgggctttgaagggtgaaaaggtgtttaccattaaaacagggcttcatggttgaaagcttcagaaagacctgggtgtcttttttgttgtttttttttgagacaggatcttgctgtgtcacctaggctggagtgcagtggcacaatcacagctcactgcagcctcgacctcctgggctcaagcgatcctcccacctcagcctcctgagtagctgggactacaggcgtgtaccaccacacctagctaatattttgtatttttttgtagagatgcggttttgccatgttgcccagacgtctcaaattcctcctgcctcggcctctcaaagtgctgggaggacagccatcatgcccaacctacctgggttttaaattccagttcagccacttacaagcagtgtatccttaacctgtccagctcagttaattaacctgcccaactcagtttcctcatctgtcattaaatgggatcagtaacatttacttttttttttttttttttgagatggagtctcgctctgtcacccaggctggagtgcagtggcgcgatctcagctcactgcaacctccacctccctggttcaagcaattctcctgcctcagccacccaagtagctgggactacaggcacgtgccaccatgcccggctaatttttttgtatttttagtagaggtgaagtttcgccatgttagccaggatggcctcaatctcctgacttcatgatccgcccgccttggcctcccaaagtgctgggattataggcgtgaaccactgtgcctggccagtaacatttacttctgatggcatttgtgatgcttgaatgaaacgtcatcagtcaagcagtcagcacagtgcctgccactcagacagtgcctgctcagtagattataagaataattgttcttattgccactgttatcacttgggggaaatgacactgcaggctgagcaaaggcatggagacttgagagtataaggcacgatttggggctggcatggattgtggaatagagatgtggggtttgtagcagaagctagaagaggtgtccttacaccctggggccatatcaccaaccttcatccctcctgcaggtggagatggggccctttaaacatacagtggacgatgggctggacgtgcggaaggcggcctttgaatgcatgtattcactgcttgagagctgcctgggccagctggatatctgtgagttcctgaaccatgtggaggacgggctgaaggaccactacgacatccgggtaagaccaagccccctgccagatctatgtgcccctgtaccaagggatagtcgggcaccattggggccatgcttgtttgtccttgctccctactccaggcacccaatgaaaatagctgcattgttgttttctgataagaaaaggaacctgtgtctcaaacacctttggtgggagtctacactgggcaggctctttggaggatggtttcacagcaaccagaaaaaaaaaattgtccaggtgtggtggcttatgcctgtaatcccagcactttgggaggctgaggcaggaggatggcttgagcccaggaggttgaggctgcagtgaaacatgatcacaccactgcactccaacctggacgacaaagcgagaccctgtctcaaaaaaaaaaaaaaaattcccagacgaaatttttgaccctgcagggcactttcagctgtggaatactagcagcattgaggagcgagctgcatctcttcgtgttgtgacctgaaagagctccaagccccaatgttgagtggcaagagctagttccagaagttaggaccattttcttaacagacagagtgagtctggggctggtggagacgtcggtttcttcaatttatatctttctatatcatttttttaaatgttaaagtttattcacatatatgatagaaatcatttaattgtggcgaaatattaataatacaagttactatcttcagtaacttactatctgcaggtgaagtgtttttttttttttttttttgagacagggtcttgcactgtcactcaggctggagtgcagtggcttgatctcagctgactgcaacctctgcctcccaggttcaagcgattctcctgcctcagcctcccaagtagctgggactacaggtgcccaccaccacactcagctaaattttttttgtatttttagtagagacggggtttcaccatattggccaggctggtctcgaactcctgacctcaagtaatctgcctgccctggcctcccaaagtgctgggattacaggtgtgagccactgcgccaggctccatcttcactattttaaagtgcacagcacagtggcagtaagcacattcacattgcggtgcagccgtcaccactgtccatctcagaactcttttctccttcccaaactgaaaactgcacccattcaacactctatgaatttgactactctaggtttctgcccttgtaagtggaatcatacagtatttgtccttttgtgaccaacttgtttcacttagtctgatgtcctcaaggttcatccatgttgcagcatgtcagaatttcccagtgttgtatgtacagaccaccagtttgtttacccattcatccatcgctggacaaatatttgggtgttcccagcttctggctattatgagtaatgcgactgtgaacctaggtgttccgatatcctttggaatcctgccttcagttctcttcactttacccagaagtgaaattgctggatcatacggcaattctgtgtttaatgtcttaaggaactgctatactacaactttatttttaagtttttatttatttgtttgagatggagtctcactttatggcccaggctggagtgcattggtgcaatcttggctcactgcaacctccgcctcccgggttcaagtgattctcctgcctcggcctcttgagtagctgggattacagatgtgcaccaccacgctcggctaatttttatatgttttagtagagacagggtttcgccatgttggctaggctggtcttgaactcctgacctcaggtgacccacccacctcggcctcccaaagtgttgggattacaggcatgagccaccacgcccggccccatattacaactttaaaaaatatgtactgtaagcgtgagtcactttttataaggaaaaattaatacaaagtaatcaaaagtaacccatacttgttttaaaagatttacacaagatgaaagcaaataaagaagcaagtaataatcacccaaaagcttctccacacccagagaggcctgctgtctcagtgtgtttcttgggatgatgcacatagaccctcattcattagtcagccagtattaagtgagtgccaacacgccaaggtcaatgtgagaggtggggtccctgttctcaaagctgtggagatgagtttatgagacctgttttctagaaatgggatcacacacatgctgtttttttccccagccttttaacttacatttactgtatgttgtttgctttgcttttcaatatatatcagtcctgtcaacagctgcaggagttcccatttctgttgcactcactgctacacatgtatgttatttgcacattttcacaattacagacaatgctgctgtgaacaccctggtgcattactgtgacccacggtgtgatcggtgggcttctagggtggagtgcatgttcctgctaaagcatccgatgcgcgtggtgaggctgcacctcctgcagcgggcgtgcctctgaccactccagacttggagttcctgggacgctccttcctgcacttcctgtctgcctgtctccccctcggctttattattgctttaaactcttgcttcctgccaacccccaagaaagagaaaagaagaaacaacataagttctctgggattccagccccaagatcttggttgagaaagggggttgggttttccagtgtatgccatgcaaactagtggaaaatgatggggcgcacaaagctgaacaggactttccaccacagggttccgggaggctccagacgggaggggtgtactcagcttccatcatctgggtgtgcctggtattaggcatcttgtggggctactgaccccaggacacagagtgaggagttctgggccagcccaaagctccaccttgtggggatttttctccaggatcgagcaagtctgtttcttccatccagtctggccatatcctctcatgcctgccctccaggagcgcaggacagggcctaggcaccagtgcagccttggagtccactctgctgccaccccctggggtgaggagggtgggtgttacagctatagagcccacagctttgcgtcatcaagtcttcaagtgagcctttagagagggagtgaacaccgcccagttcacaggggagacggaatcttgtctagttctagggcacagggtcatggagtagccaagagtcatagctcctgaagtccagcaccgctgctccttgctgccgtgggctgggcctcctcctttgctgtggggcttaggggtcagggtgtggagatgggtagggcgtggggatttcagacaaccagtctttatggtgtgcaaggcttctttgtgaggacttgactattttcaaaagacaggacaattattcccctacaggctgaatctaggcctgcagccatgtttagttgttgttaaaagtttttgtttggttttgaaatcaggtgtcaacatttaaaaatcgagactttttttttacatgaaaattgggatttcttttgaaaacaatccagtggccccaagctacatgtttgcactcccacctggccacactcagccagagctgccccagcagcccccttcactcatccccagcatctgcctgactggtgggcatctgagcttgagaacgactccctccctggtgcttttctgatcctccttgggtcatccaagtgtagttggcaaagaaagtgtcaccatttgaggaaacagacccagagagggagagactctggcaggacttcacggtggtctgaacttgggcttcaggtttcagttgtggggcctctgctctttcccagggctggctgctgctcttgctcctgcaccatttcactaagaaccatctccttcctctgggcagatgctgaccttcatcatggttgcccggctggccaccctgtgtcctgcacctgtcctgcagagggtggaccgactcattgagccactaagggccacctgcactgccaaggtaagtccctggcccagccctagcccaggccctggagcacctatggagtcctcggccagtcgttcagttacccttactgagcacttcctgcagtgcaggtgatgttgtgaaagtgcttcatttaatcattgtcattgccctataaagtacctcttattatcattgtatacacaggggaacagaggctttgagaagttgttattggccaaggctacacagctagtaaattgcagagctggattcagacccacctctgtctctccttccattcattaaacacttcctgggtgctgagcctcgtgggagatactaaagatgtaacattgagcctgataggttccctactgtcaatctctcacctccttgttgggaagctgggtcagatgactggtctaggacaaagctgctgctagactggagtgcctgaagggtctggaggagggatgtggggtgcaagccctcatggaaagctggcgttgggagcagagcctggcgcacctacgtggtacctagtaaatacctgttgaatgaaagaatacatttgggttttttaaggatgggaatcattaccaaaaggagagcagtgttttaggttggcacttaaagaggagagatacccataaagtggtgattttcaaaaatgaaatcttctgtggataaaacactaaaattggtagtttattcatagaaacctgccttgtaagtttacatttttaacatatgcttattattgagtccatccaaaaaaacacttctacagggccaggccagttttgacagtctctcatttctggttttctctgagctctatggcaccaagaaaagtcccagttcttaagagggaggtatatatggcactgcagtgccagaacattcttgcagtaaagccgaggtggcaagagaagctctgccctgagtttccacaagagccactcatctggccacgcggaggatgctgtctgttgggcattgggatgagcatgggtaaatccacacccacagtccttacccatgaccctgaaatctaccaagctctgacaaccaaaagctttttaggaacctgtttgtcacacaacttgacttgaagtggcatgaggctatgatctttaattcttaccaatgtaccacttttatataagggacttgatcatctgaggattttggcatcccctgggatcctggaaccaaactcccatggatactgagggacacctgtactactcacattactcatacatgtagtagagtattcatgtatttgattacagggtattgtacaaaacccctcgggaatgttatctgcacagtattacctttctaaaacccaaaatgtcttggattccaaagcacatctggctccaggggtttcagagaagggagtgtggacttgtgtcgtttaatcctcttggcaactcttacgacgaggcagctcttacttatagatggggaaatgaggctcaaagatgtagttacctgaagtcacagctcttgggggcagagccatttgaacacaggactctgcaactccaatgccaagctgttacccactgcattgaattctttaggaagagcccagcataataaggaacttgaactttagtccataagcagtggaggaattactgagctcctctgcctaggtaggagatggtgggggaagaggaaacagaaactgcaggaggtagtttggggtgcttacactccggctgcatctgcaaaactgattgcggggcagggacttgagtatggggaggaggctgctagaagaccatcgcagtgatccattcattcagtctagtcatatggtgctaagagctggttttaagcacagcaaatataggctggatccctgcagtctgtaggaggtaagtatgggaacacagtacttgccactgtcaattaacaaaaagcgagcacttcagattggctgctcagaggcccctcaggctgtactcaagctgatttgaatggcaaagaacctctgtggggaaactagccagtgcaaaagcccagaggtggagttaggaaatagctggtgagacagaagcctcaggagacctcgcagcagggatttatgttggggaagatgatggggcagagaggaagccaaagaccagtgaggaggcagtggtgtgggccaggctcaataaaggatggctgcttctgctgtttcctactttaggtcaaagctggttctgtgaagcaggagtttgaaaagcaagatgaactgaagcgctctgcaatgagggcagtggctgccctgctgaccatccccgaggtggggaaaagccccatcatggccgacttctcttcccaaatcagatccaaccctgaacttgctgccctctttgaaagcatccagaaggattccgcttcagcccccagcacagactcaatggagctcagctagtcccctcagcaccaaggtgggccctcgcttaagagaaaggagcccacccaagtccgaggcctccccatcccaccatcgcaggtctctacttttgcccttccaccatctcactgggggccctgtcgctcctggtcagggcttacagtgccttctccagggacccaactcaaaggcccccagcccaagctgtgaggctgccaacagttgggccccttccttaactcaggacagtcatccaaagaaatagggtgaggaagttttccagtgacttcacactgtacccctccatagtctgtctggttccttcagagggtgtctctgcctcacaaactagtagtatttagaaataggctgtgctgtcagctgtaaaagatcaggaggcagcagacaccactctggtttcttcactgcattcagcaatgcctgaagttagtgctcaggccgggcatctcaaaagaaaagatacttgagttattcacattttaaaattcaaaacggttcatttttaagtggcagtgatgaatcagaaatttggaagatgatacgggtttcttttttccagggaggaggaatgggttgggtagggaactggacaggcttggacctcatgtttcatttctaatttcaaaatacttattagcaaattgggcaacaatgggcatcttccatgccaccacccaggcataaccagttggtttgtttccttctgaggaaggtttcaaatgtgtctagtgttcagtattgaggacaaagaaatacaagtggcaggcccaagtattttctgtgatatcccaggttaataaagattagattctaagttacttctttcctc

SEQ ID NO: 11559 - DNA, 2955 bp, Homo sapiens
ctctatctaaaccccagttttctcatctctataatggggaaataatccctgtctcaaaaggtcgtcatgaagctaaaataagattatgggtttgacatgcttagccccatccgtagcactcagtagatgcccattaaaaggtagggaatgttccccatagggtatctataaatgctgatcatcaaaaagtgaagcacagtgcccagctctctctcctccctgtcccttctcccccgagccacagacctgtcctgggagatgagggttccacgtgtgtcttgttcctgccccagagagtgaagacgagtacagcgatgacgatgacatgagctggaaggtgcgccgggcagctgccaagtgcatcgcagccttgatcagctcgcggcctgacctgctgcccgatttccactgcaccctggcacctgtgctcatccgccgcttcaaagaacgcgaggagaacgtcaaggctgacgtcttcactgcttacatcgtgctgctgcggcaaacacagcccccgaagggatggctggaggccatggaggaacccacccagaccggcagcaacctccatatgctacgtggacaggtgggcgtgccttcacctccacccctacccccgatttgcctacccagccactcactgttagtgtccctggacttggaaactcagctgggagaacatccagccatggaagggaagggaaggggtccctggggtggggggcgggagccagccaggcttctggagtgtagtagtgacagccagcctgcctgagtgagcttgagcaagttgcttggtctctctgtacctgtaaaatggacgcagaaaatttgcctactctccaagggtctgtgtgcggtcaccaaaagcctggcacagagtgagggacgagtgcttgggagatatcttgatgccgacatcctccctggggatgtgtctggcaaagcctcctggtagtgggcaggtgggtaggtttcttgggtgttccctgaccttgacttccccctcctgcccacaggtgccccttgtggtcaaggccctgcagcggcagcttaaagatcggagcgtcagagcccgccagggatgcttcagcctcctcaccgagctggcgggtgtcctcccaggcagcctggccgagcatatgcctgtgctggtatcaggtaggctggactgcaaccaggtatctgctgttctgggccacttccagaacccagaccccacccctgagttgagcccccagttcctgagacagtctgagacccaatcccaggctcagtccctggtcaagagtctccagtggcctcccactaccagcagtgagaacaaggctggctccagtgagttccctggacatgtttccctcagccctggccactggtcagggctgacttcttggaaacttctgcagaagagtttaggtgcttcagtccagctcaggcacttgtaggtaccccagccttgcttccagggagggccgtgttgcatcagaggcggtggcctcataacctttgcattcaccctgcaggcatcatcttctcgctggccgaccgctccagctcctccaccatccggatggatgccctggccttcttgcaggggctgctgggcaccgaaccagctgaggccttccacccacacttgcctatcctcctgccacctgtgatggcctgtgtggctgactctttctacaagattgcagccgaggccctggtggtgctgcaggagctggtgcgggccctgtggccgctgcacaggcctcggatgctggatcctgagccatatgttggagagatgtctgctgtcaccctggcgcgacttcgtgccactgacctggaccaggaggtgaaggagcgggccatttcctgcatgggccaccttgtaggccacctgggtgaccggcttggggatgacctggagcccacgttactgctcctcctggaccgcctgcggaatgagatcacccggctgcccgccatcaaggcgcttacgctggtggccgtatccccactacagcttgacctacagcccatcctggccgaggcactgcacattctggcctcattcctgcggaagaaccagcgggctttgcgactggccacactggcagccctggacgccctggcccagagccagggcctcagcctcccaccgtctgccgtgcaggccgtgctggctgagctgcctgccctggtcaacgagagcgacatgcatgtggcccagctggctgtggacttccttgccacagtgacccaggcccagccagcctctttggtggaggtcagtggccctgtgctctcagagctgctgcggctgctgcgttcgcccctgttgccagccggggttctggcagctgctgaaggcttcctgcaggccctggtagggacccgtcccccgtgtgtggactatgccaaactcatcagcctgctcactgcgcctgtttatgagcaggctgtggatggtgggcctggcctgcacaagcaggtgttccactcattggcccggtgtgtggcagccctctcagctgcctgtccccaagaggcggcaagcacagccagtcgcctggtctgcgatgccaggtcgccccactccagcacgggggtcaaggtcctggcattcttgtcgctggctgaggtgggtcaggtggctgggccaggccaccagcgggagctgaaggcggtgctcctggaagctttggggtcacccagtgaggatgtgagggctgcagcctcgtatgcactgggccgtgtgggtgctggcagcctgcccgacttcctgcccttcctgctggagcagatcgaggctgagccccgacgacagtacctgctgctgcactcactcagggaggccctgggggccgcccagcctgacagcctgaagccctacgccgaggacatctgggccttgctgttccagcgctgcgagggtgctgaggagggcacccggggggtggtggc

SEQ ID NO: 11560 - DNA, 6611 bp, Homo sapiens
tgaccagtttgcattataaatatttatgactaggttttgaacaggagacaatctgtaagattcctgtctagactagaagtagaaaagctttattatacccagcgcagcatttctgctaagttgaccaggatggttacagaaaaacatcctgtaagcatttctgtctcataagtaccacatcccatatccctcatgacctatatactacagaagatgcctgtaatcccagtactttgggaggctgaagcaggattgcttgagctcaggagttcgggagcctaggcaacatggctagaccacctctacaaaaaaacttcaaaaactacccaggtttggaggtgtgcatctgtagtcccagctacttggaaggctgaggtgggaagatcacctgagcctggggaggtcaaggctgtagtcagtgtgccactgcactcccagcctgggtgagagcaagaccccgtctccaaaaaaaatcaggaccacgtgtcactaaattctgagtaccagtcaagaggctcaattgtcaccagttaggtccccgccttggcaaactgctgtaacattatacctgaagcagcagctggtgggagggttataggagactgaaagtgcttttccagttaaccgtggtggattacctggaagagcaatttgtacatcatcctgttctttttggacagaagttacaggatgcaatttaggcatcccgtaagaatctgtgtaagaaattcatctggatatttccatgcatattttctcaattctcacaagcatcacatggaataacttgtcacctaactttacaaaagcaaggctaagaatgactacttgtggcttgggagccacaagcttcttcaagtgtctcagaacctacctggtgtgagggccaagtctgtacccctcatacccagcctcaactggagatgactaaggctagtctgtgcacttgaggccacattcccctgttcaaggactgagtgtcctttacaaatcccctccaaatgggagattccaaaggggcttaagcaaaagaacaatctctgtggcaaactaagttggccaagaagctgaagacttaaaatcaaggaaggaagatgccagatggcagtttttacatttatttaaacagaaaacgtgcacatgagctgcctactcattttcttcactgcgcagcctggcattggggttggtgactctgatggccagttgggcagctctttccacgatggctttgcggttcttggaggaaacattgtgagcgatctcggcacagtaagatctgcaagagaatcaagtaggtaaggagcaagacagccctcaacacacttggaaaattccattggagaggcaatgagtcccagcaccaagctaagagagggctgcttggtaagtggctgtggaatgacacctacatgcccccaaatcctgactatggttccctggtggtgacaagaatgctttcattaaaaagtaccctcattgtcccctctcatccttatagcagccttgtaatccaggcattacctccattttacagataaagaaaccaaggcccacagcaagcaatggacagggatccggggcgaacccaggcccacactccaggttcaaaggttctcccccagtcacagggtgcttgaccttgcccatgaaggttcagaactctttgcaaaatggtcaagagcagaacccaagagtctgaatggagccaagagcacctggtttgactgctgaggatacaaagcaagttgagaagcaacaatgcttaaagtcacccagtcatagccatgcctattacctgaggacttcagatccagttctaactcattcctcacaactttttaagaggcagctacactgtgccccatttgataaccaataggcctaacaagcacacttcagtaaggaggtgatttatgaagccacccacagtggttaagaacagacattccacccctaaagcattttcagcaaagagagaagcagcaggactgtgaggagtgattgaggcagtggacacacagctcttttcaagaaccctgccttaacagcaagacagcaaatccagacaattcttgttttatatgagtccactcaaattcaaagcaattgtatttttaaatgtttctacgttttaaagacttaggttatattacacttctcatctgtctttacttttcaaaaaaccctcctgtccttgtccatctatatatttgataatcacaatcagagtgtacccaccattttaaatgtgtcccccctggcttgggcattttccacactacaacactcgaatcattttgagtggacccacaacattttatccagcactctacaattctctcattatattttcagttgtttccagtgggttattgctgcaatgactagctttagtttgcctgcttttccattccttaaggacaaatgcccagaaatggaacttagagatcaaacgtcaaagagtatttctatggatcttaaagactgccaagctgcgcttacagagcatatgccaaccagccaacatgtgcactgcaactgagtaatcatgttggccatacaacaggtattgcctgttacagttcaactcatacagccaactgtggtttcagtatccaccattaattccttcgcccatcttttctaacagaaattttcagcatttcaacgcctggttaaatttccaatcttggaaggtaaccacgttagaatactggtcttgttcatttttattacttgtatctacaaccactgtaggtgaaagttatctttgtaaacgtaaacacaaacatcctagttagtcacacacactccatgttctttctagtttacttaggaaaattcagctttttggctttcatttaccagtaagtgaagaaaataaactgtcacttcccatgagaatttttcattccactgccctagttttaatctaagcaggtcactgagtcttttatacacaaagctcaccaagtgtctaacttactcaaaacacctagaactagctgggtgtggtggagtgtgcctgtggtcctagctaccaggaaggctgagataggaagacagcttgagcccaccttgagtttggggctgcggtgtgccatgatcacagctgtgaacagccactgcactgtagccagggcaacacagagcctgtctatctctaaaatcaaaccaggccaggcatagtagctcatgcctgtaatcccagcattttgggaggctaaggcaggcagaccgcttaaggtcatgagttcaaaaccagcctggccaacatggtgaaacctcatctgtactaaaaatacaaaaattagccaggaatggtggtgcacgcctgtaatcccagctcttgggagggtgaggcagaagaaacgcctgaaactgggcggtggaggttgcagtgagccgaagtcatgccactgcactccagccccggcaagagagcaagacttcatcttaaaaaacaaaaaccaataaaacccacctggaaccaatgccctgcaaaccctccatgtgctttcacctctacacctttgtgtaagcactctctgcctgccaagtttcctcctgttctccatctaatgcaaactttccagagccctcctgcccctgaagataccccttaccacagcacagacttaagagccccttaaggtctgaggtccatgtttgaccttctcccgcttgtaagccaaaaataaaattcaaaggcccccagcaaccatctgaatgcactccctccttgaatagggcactcttggtttccacaacctcttactgtagccaagacattcctttctagtgataaccaattctcgacgagaaacagaaaatctatccaaaacctcgaagtgccgcctttctggaccaaaccaatgtatgccttatgtgtatttgattgatgtctcatgtctccctaaaatatgtaaaaccaagctgctccccgcccaccttggacacatattcttagggtctcccaagggctgtgtcacgggccatggtcaactcatatttggctcagaataaatctcttcgaatatttcagagttcaactcttttgcttgacaccttcataaagaaagcaacattttggaaacaacagccaaaggatattgtagtagtggaaagtggctattattgcagtgttcacaaagcagtcttttcctggtcttgggtctctacacttagaagaccaagtcacctccttcagcaaaggaaacaccttgaattccccaacaagcattctctaaaatcctgcaaggaacaacttctgattccctcagagaatgtacaacaccccccgccaaaatgcatcccaagagtttgtagagttcctgccagaagtgctcacacagatgcaaacttctgatcactgaaaactagaggtgggacccaactcacttgttgcacatcagcagcacttccagctccttgacgttgtggaccaggaacttccggaagccactgggcagcatgtgctttgtttttttgttgcttccataaccaatgttgggcatcaagatctggcccttgaatcttctacgaaccctgttgtcaatgcctctgggtttccgccagttacgctgaaggaaataatacacaggtgggttagcgtctgtgcagagtgcgaactcttccttttggggagggaaaaaaaggaccaaatgaaaaggaagtatgccacacagtagttgcctttggtaacaggacttcactatttccttacttttttggtgggaaaaaccaggagctcgtggctttagccactagggatgaaggcacccccaccattgccactcccaagcaatggaggaggcaccaatgggatgcgaggggactgtgtagatactgagatggcaagcacagctgcagacactgctctcagcacctgagttttcttgtctataaaatagggatcctgctgtcacaaggcaacccaaaatacaggacacaaatgcaaagccctctgaacacatcaaaacggccaaatgtcccttttcattaaagtttcgcttcacacatcaagagacataagtaccagcactagggcacactgggggagacctgtatttctacagaaagctcttccacaagccagttcatcggtcaaagataatcctgactaggtgatgtcagaaactgttggaaactcttttcttcaccccacacccatttccatcccaggaccacataccttaattttgacatatcggtctgactggtgccggatgaacttcttggttctctttttgacgatcttgggcttcacaaggggtctgagggcggccatgatgccttttggggaagaagcggccccaggtgaggaagaatcctggaaggaggctttcctgcccagggactgaacactgtcgcagagtgtcttccaatcgccagctacggagcaagctgggaatggaatgggtgcctctgccaggcttgctttccctccctttccgaagctggcagaatactaggcactctccagatgcgatcccaggaggtcaagggtcacctcacccactcagagcccaaagaatgccaacagctgagcaaatcaaaactgaccccaagacactctcaatttgcaaggggcagcaaatcccaccccaccagtgtccgaacccccagatggtccttccggtagtactggccttgaccatctacttgaacctgagtcttttcctcacctgtaaaatgaagatgacactgcgcgctgaatgcctgcagtgcctgtcacagggtaaatgttcaataaaaccttctaattccctagggagctgctgcgctaccacaccctcaacacacacaaaaccaccatatacctctgaagatgcctcaaacctggagatcttccagtatcaactcacaccttcctcagtgtggtcttccgagccattgatttcctacagcagcaccccttctgctctcttcgcagccatcaactggcccagagtgggtactcaatgaaccacgtattcaaaacgactctgccttctggcccatgatatcctcgaaggcaaggtgggggcagttgcatcttcatattcccagagatactaccagaatttctgcctgcagctggaccagccgacctacagctcgtctttccttggcggtcccgcagcagcagccctcgggccagagactgcagcggaagaagccggccatggcatgaacgaatacacgtgggccgacattggtgagcgctgggatccacagatcccagctgaaagctgtcaagctgggccacccctggtcgtcccacggcccccaggagaccccgaagtctggcctcaactagcaccctccaccgccaaggaacaaacaagcagcccgcagctctgaatacaggcggagggcaggaggctctgggacgcaaagccctatcaactcggcggcttcgttctgttcctgtacacgctccagtaagctgacaataacaatacccacagacactaccgcgctgaaggggaggcctccgcaccactgggcgacggggccagatgaatcccgcaggaatgcggattgccacggattaacacttaccgagaaggagatggctgccacctccgtaggcagcgccgaggaagagagaagggacggtggcg

SEQ ID NO: 11561 - DNA, 317 bp, Homo sapiens
attacatcacacaaccttgagagacgagagtgttaagatgcagaggagccctgctttgcctaaacacctatttgtttctatctcacgtgcactgttgaaccagccacccggtcacatttcctttttagcaccaactgctgggaagcttagagccagatgagtggtctgcttctagtaggttcctgggacttccttattgatgctctctgtacatcttcctgctagtctccttctcacctccctgccttcagtcgtccttggccttgttcttgttttcagttcacttaatcttactctcttgtgcctgtcttcatcag

SEQ ID NO: 11562 - DNA, 467 bp, Homo sapiens
gtattttcttgtaaatactagaatcttattatcaatttctctattttaaaaagcctgatgatattttggtcagtattaagttgaatctctagatcatttttgagagaaatggcttcttataaaactttaaagatgctgttttcctgtcttctcacttgcagtgtctctaatgagcaatatgctgtcatctttaacttttttcctctatatatatgttttttatctgattgctttaaatgtttctctttatcactggttttgagcaatttgattataatatatcttggagtaattttcttcatattttttgtacttgatatccatcgatcttcttgattctgtgtgtttataatattcatcaaattgaaaccattttggtgattatatcttcaaatataatcaaatgcaatcatattttgtctgtccttctcctctgttagtcttcaaggactccaactatatctatg

SEQ ID NO: 11563 - DNA, 467 bp, Homo sapiens
gtattttcttgtaaatactagaatcttattatcaatttctctattttaaaaagcctgatgatattttggtcagtattaagttgaatctctagatcatttttgagagaaatggcttcttataaaactttaaagatgctgttttcctgtcttctcacttgcagtgtctctaatgagcaatatgctgtcatctttaacttttttcctctatatatatgttttttatctgattgctttaaatgtttctctttatcactggttttgagcaatttgattataatatatcttggagtaattttcttcatattttttgtacttgatatccatcgatcttcttgattctgtgtgtttataatattcatcaaattgaaaccattttggtgattatatcttcaaatataatcaaatgcaatcatattttgtctctccttctcctctgttagtcttcaaggactccaactatatctatg

SEQ ID NO: 11564 - DNA, 295 bp, Homo sapiens
gccaggcgcggtggctcacacctgtaatcccagcactttgggaggctgaggcaggcagatcacaaggtcaggggatcgagaccatcctggctaacacggtgaaaccccgtctctactaaaaatacaaaaaatcagccaggtgtggtggcgggcacctgtagtcccagctagttgggaggctggggcaggagaatggcgtgaacccgggaggcggagcttgcagtgagctgagattgcgccactgcactccaacctgggcgacagagcaagacactgtctcagaaaacaaaaaaaa

SEQ ID NO: 11565 - DNA, 279 bp, Homo sapiens
cacacctgtaatcccagcactttgggaggctgaggcaggcagatcacaaggtcaggggatcgagaccatcctggctaacacggtgaaaccccgactctactaaaaatacaaaaaatcagccaggtgtggtggcgggcacctgtagtcccagctagttgggaggctggggcaggagaatggcgtgaacccgggaggcggagcttgcagtgagctgagattgcgccactgcactccaacctgggcgacagagcaagacactgtctcagaaaacaaaaaaaa

SEQ ID NO: 11566 - DNA, 2796 bp, Homo sapiens
ccttcatcaattctgggaaattttatctattttcactttgaatatgtcccaggtgcattgtatctattttatgaccatgaaacttatattagatctagatgagacttattctatttgccatgtctcttaaacttttatttctatttctttatatctctgtgaagagttttgatttagttttgtcttttaggtcagtactcttcatgtcagatctaatccactgtttttaccatcaattgcattttaaattataatgattatgtttcactttctataaaatattacagttatctttactaaggtataatttacataaatatataatgtatttagatatatttacatataaatacatacatatttacataaaattaatttcagtgacttcaagggtacaattcatcggatatttatatatttcctatacatataatatatattatacatatttcatgattatacatataatatagcacaatatgcaatatatgtaatacatatgtataatcatgcaatattatatatcataatatataatatattatatatgtgttatatattataaatatatatgtgtaatcatgcaaccaccaccacagtctttgaaaatatttgtatctgttcttctgggaatttttccccctaatcttctgtctcatctttttttatagtatcttgttgctttcacatatttacatttattttatgtattctatcatttaaaaatatttatgttataatgtgcatccagtaaatctataatctgaacctcctttttctttttgagacagagtatcactctgtcgcccaagctggagtgcagtggcgcgatctccctcacggcaacctccgcctcccgggttcaaagaaattctcctgtgtcagcctcaggagtagctgggacttcaggtgcatgccaccacatccggctaattttctttttgtatttttagtagagacggggtttcaccatggttaggctggcttcgaattcctgacgtcaggtgatcaacccgcctctgcctcctgaagtgctgagattacagacttgagccactgtgccccgccaatctgagcctcttatggtctacttatgctttaatttttttttcgtaaattaatctcatggttgcttctctccttgaatgttttgtacatatgtactgtgtctgcatatttttgcacattttcatctgtgacaattctgtatggcctttattgtaggtatgtccttcaagagaagattggcatttgcttttgctagataactcacaggtacccaagaacacttaaaagtttgtattatgtaatgtttcacacataaacagaattttcatttatctatataagggaatgcatacatatatgcatatgtgtcatgtgtaagtaaaacaataaaataaatgcctcttcgataccgacagattaagaaacagaactttagatgaacactgatatggttaggcttcgtgtccccacccagatctcatattgaattgtaatccctataatccccataatccctatgtgtcaagggagagaccaggtggaggtagttgaatcatgggggtggtttcccccatgctgttctcatgatagtgagtgagttctcacgagatctgatggttttatatggggctctttccccttcactgggcacttcttcctcctgctgccttgtgaagaaagtgccttgctacccctttgctttccgcaatgattgtaagttttctgaggcctccttagccatgcggaactgtgaatcaattaaacctttttcctttataaattacccagactcagcagctctctacagcagtgtgagaatggacaaatacaaccactttttacaataacttcttaggacctaactatccactctggtgttcagtttcctccccattttttttttttgtacctgaaaatatttcttttgaataaatcatgcatttctttatatattcagcagatatattttgaatactgactaggtgtcagacatgattctaagtgctaggaacacaaaagtgagcgaaacagacaaaacctcctgctcttagaaagtctccattttagtaggggcaagataacaattaaaaggaataagtaatgcatttagtataccaaatgggaatcaatgctacaggggaataaataaggaaaagagtatagagagtgtcggtatgggcagaaagtacaccttgaaatgggaattcgaggaaggcttcactgagaagaaagaattgaagaaggtgaccagtgaagttgtgtggaagctgggaacagtaaaaacaaatgccctgaagtgttagggtatagataaataaaagcaagggagtctgcttggctggagcagagtgatcatggtgagaggagctcagagctataacaagggtgtactatgtaggcactggaagaaatttggcttttactccaagtggaactggaagcctttggaatgcttccagaatagaagtgatgtcatctgacttatgttttaaatagatcaatctggatgttgtgttgagatagactggaattggtcaaagataaagcagggacaccccaggaggctattatagcaacctagatgacaaagggtagtggttttcatcagaacaatagcagtggaagtgacaggaagtggtcaggtcagattctggaagtatttttaaggtaaagaatacaggacttgttaatggattgtatgtgggtgtgaaatagaagagtcaagaatgactacattgttttggcctgaacaactgcaaggatagatttaatatgaactgagagaga

SEQ ID NO: 11567 - DNA, 2796 bp, Homo sapiens
ccttcatcaattctgggaaattttatctattttcactttgaatatgtcccaggtgcattgtatctattttatgaccatgaaacttatattagatctagatgagacttattctatttgccatgtctcttaaacttttatttctatttctttatatctctgtgaagagttttgatttagttttgtcttttaggtcagtactcttcatgtcagatctaatccactgtttttaccatcaattgcattttaaattataatgattatgtttcactttctataaaatattacagttatctttactaaggtataatttacataaatatataatgtatttagatatatttacatataaatacatacatatttacataaaattaatttcagtgacttcaagggtacaattcatcggatatttatatatttcctatacatataatatatattatacatatttcatgattatacatataatatagcacaatatgcaatatatgtaatacatatgtataatcatgcaatattatatatcataatatataatatattatatatgtgttatatattataaatatatatgtgtaatcatgcaaccaccaccacagtctttgaaaatatttgtatctgttcttctgggaatttttccccctaatcttctgtctcatctttttttatagtatcttgttgctttcacatatttacatttattttatgtattctatcatttaaaaatatttatgttataatgtgcatccagtaaatctataatctgaacctcctttttctttttgagacagagtatcactctgtcgcccaagctggagtgcagtggcgcgatctccctcacggcaacctccgcctcccgggttcaaagaaattctcctgtgtcagcctcaggagtagctgggacttcaggtgcatgccaccacatccggctaattttcttcctgtatttttagtagagacggggtttcaccatggttaggctggcttcgaattcctgacgtcaggtgatcaacccgcctctgcctcctgaagtgctgagattacagacttgagccactgtgccccgccaatctgagcctcttatggtctacttatgctttaatttttttttcgtaaattaatctcatggttgcttctctccttgaatgttttgtacatatgtactgtgtctgcatatttttgcacattttcatctgtgacaattctgtatggcctttattgtaggtatgtccttcaagagaagattggcatttgcttttgctagataactcacaggtacccaagaacacttaaaagtttgtattatgtaatgtttcacacataaacagaattttcatttatctatataagggaatgcatacatatatgcatatgtgtcatgtgtaagtaaaacaataaaataaatgcctcttcgataccgacagattaagaaacagaactttagatgaacactgatatggttaggcttcgtgtccccacccagatctcatattgaattgtaatccctataatccccataatccctatgtgtcaagggagagaccaggtggaggtagttgaatcatgggggtggtttcccccatgctgttctcatgacagtgagtgagttctcacgagatctgatggttttatatggggctctttccccttcactgggcacttcttcctcctgctgccttgtgaagaaagtgccttgctacccctttgctttccgcaatgattgtaagttttctgaggcctccttagccatgcggaactgtgaatcaattaaacctttttcctttataaattacccagactcagcagctctctacagcagtgtgagaatggacaaatacaaccactttttacaataacttcttaggacctaactatccactctggtgttcagtttcctccccattttttttttttgtacctgaaaatatttcttttgaataaatcatgcatttctttatatattcagcagatatattttgaatactgactaggtgtcagacatgattctaagtgctaggaacacaaaagtgagcgaaatagacaaaacctcctgctcttagaaagtctccattttagtaggggcaagataacaattaaaaggaataagtaatgcatttagtataccaaatgggaatcaatgctacaggggaataaataaggaaaagagtatagagagtgtcggtatgggcagaaagtacaccttgaaatgggaattcgaggaaggcttcactgagaagaaagaattgaagaaggtgaccagtgaagttgtgtggaagctgggaacagtaaaaacaaatgccctgaagtgttagggtatagataaataaaagcaagggagtctgcttggctggagcagagtgatcatggtgagaggagctcagagctataacaagggtgtactatgtaggcactggaagaaatttggcttttactccaagtggaactggaagcctttggaatgcttccagaatagaagtgatgtcatctgacttatgttttaaatagatcaatctggatgttgtgttgagatagactggaattggtcaaagataaagcagggacaccccaggaggctattatagcaacctagatgacaaagggtagtggttttcatcagaacaatagcagtggaagtgacaggaagtggtcaggtcagattctggaagtatttttaaggtaaagaatacaggacttgttaatggattgtatgtgggtgtgaaatagaagagtcaagaatgactacattgttttggcctgaacaactgcaaggatagatttaatatgaactgagagaga

SEQ ID NO: 11568 - DNA, 488 bp, Homo sapiens
ccactcctactcatcacagggcctttgcacatgctcttacactcgtgtccaatggaacttaccccatggtttccttcaggccttcatagcacttctcacagatccaagtttccctttattttgagttcatctgattaggatccatctttaccattaggacttaatctcttagggctggaaccaagtcacttaaaaatgcacaaaacgcacatagtatacactgagtagctacgtgacattcattgttttatgaattgataagcctattatgaactaaaaacatttttcagtgtatttaacttagagttatgtggtacaaagtaaataatacaggtgccttttttttttcctcaatttggctgcctaagtgcaatacattaagaaggttattgccataattttactgtgctggctggataacatattttagtaagtagaatgtaatctcaatatgccagtaagtagttttgcctctgaagaagatgttc

SEQ ID NO: 11569 - DNA, 487 bp, Homo sapiens
ccactcctactcatcacagggcctttgcacatgctcttacactcgtgtccaatggaacttaccccatggtttccttcaggccttcatagcacttctcacagatccaagtttccctttattttgagttcatctgattaggatccatctttaccattaggacttaatctcttagggctggaaccaagtcacttaaaaatgcacaaaacgcacatagtatacactgagtagctacgtgacattcactgttttatgaattgataagcctattatgaactaaaaacatttttcagtgtatttaacttagagttatgtggtacaaagtaaataatacaggtgcctttttttttcctcaatttggctgcctaagtgcaatacattaagaaggttattgccataattttactgtgctggctggataacatattttagtaagtagaatgtaatctcaatatgccagtaagtagttttgcctctgaagaagatgttc

SEQ ID NO: 11570 - DNA, 1633 bp, Homo sapiens
ttccaaattcctccctcctgtcccctatatcattgctgtcatttatttgacttatacattagctgtaattattaatacgtcgttacaattaacattttgaacaaaatgttatatgttagattacttaaaaatacaaaaatagaagttttgattttacctttatttattctttttctaacgcttttcctttttattcctaatggttttttgtttgtttttgtttctttatatttttagtgactgaattaacttattagcaacaaggctaatggaaatcacttgagcctctctaagtctttctcctcccttgacacatttggaggactgagggaactaagtgatttctaatgtctttccagctctatttttcagtgattttagtttaggctttttagttctttcatttcttacaagatttgcataccaaattgttaattaaaaacaatccacattttatcctatagttgtctagaatgttcattgtcttctcagttctcttgctttttttccaatttgccatctgccagtttgctgacttggcaatatttccactatccatgtgccagctttgcaacctctcagcaaggctcgcagctccttctgcacgatttgagggtcttggcataaataggaccaggaaggcagagggaagccttccaaccactgcagtgcaattgctcccctataaaagccaagcagttcaggtccagcatcctcaggccgtgattgtagataaactctctgtgatttcattgaggagtatttgtatagatcagctgaaattcatggagatggaaaacattattaaacccggttatgtgacttcttgaagttacattgtgagttatgaaggctgcattcttttaaatgggttttggaatttagttgtgatgaacatttgaggatttagaaatagaaaaataaattgtgtaaacccttcgctttctgtctgcatgcgtgaagaccacatagatagcttgtttgcttctgctacagtctcattgacttctctgccctcgtcagtcttcctctccatgttttccccacttatctttcttacttcagtgcagaatttctttctttattttaatgtctatctagttttttattatttctatcagtgctttatagatttctcagcttagttttgccttggacaacttcttctctattcacaggtatcagctgggattgacaagggttagtttcttcgtggaaaaaaaaaatgggagctaaactgactgatggaagcagctgccactaatagactttggtttttgttttaatcttcatggaagggtttagtttgcaaattcttcctgcttggatatttaggagcctttcctaaggaagggaccagaattattttctttatgtaaaattttatatgtgtttaaaattctgtcctctgtgtgtgtatatgtgtagtacatatgggtataactggccttaggaaataggttcaagtgcttacacaatattgatcagtctaatattttaaacatattatctcaagttatttgtttgagtatagtatactttgaagggttcctcagcttcacttttaacctattttttatttctatttcctctacagtagcattatcctatagttatcctgatatccatttaa

SEQ ID NO: 11571 - DNA, 1633 bp, Homo sapiens
ttccaaattcctccctcctgtcccctatatcattgctgtcatttatttgacttatacattagctgtaattattaatacgtcgttacaattaacattttgaacaaaatgttatgtgttagattacttaaaaatacaaaaatagaagttttgattttacctttatttattctttttctaacgcttttcctttttattcctaatggttttttgtttgtttttgtttctttatatttttagtgactgaattaacttattagcaacaaggctaatggaaatcacttgagcctctctaagtctttctcctcccttgacacatttggaggactgagggaactaagtgatttctaatgtctttccagctctatttttcagtgattttagtttaggctttttagttctttcatttcttacaagatttgcataccaaattgttaattaaaaacaatccacattttatcctatagttgtctagaatgttcattgtcttctcagttctcttgctttttttccaatttgccatctgccagtttgctgacttggcaatatttccactatccatgtgccagctttgcaacctctcagcaaggctcgcagctccttctgcacgatttgagggtcttggcataaataggaccaggaaggcagagggaagccttccaaccactgcagtgcaattgctcccctataaaagccaagcagttcaggtccagcatcctcaggccgtgattgtagataaactctctgtgatttcattgaggagtatttgtatagatcagctgaaattcatggagatggaaaacattataaaacccggttatgtgacttcttgaagttacattgtgagttatgaaggctgcattcttttaaatgggttttggaatttagttgtgatgaacatttgaggatttagaaatagaaaaataaattgtgtaaacccttcgctttctgtctgcatgcgtgaagaccacatagatagcttgtttgcttctgctacagtctcattgacttctctgccctcgtcagtcttcctctccatgttttccccacttatctttcttacttcagtgcagaatttctttctttattttaatgtctatctagttttttattatttctatcagtgctttatagatttctcagcttagttttgccttggacaacttcttctctattcacaggtatcagctgggattgacaagggttagtttcttcgtggaaaaaaaaaatgggagctaaactgactgatggaagcagctgccactaatagactttggtttttgttttaatcttcatggaagggtttagtttgcaaattcttcctgcttggatatttaggagcctttcctaaggaagggaccagaattattttctttatgtaaaattttatatgtgtttaaaattctgtcctctgtgtgtgtatatgtgtagtacatatgggtataactggccttaggaaataggttcaagtgcttacacaatattgatcagtctaatattttaaacatattatctcaagttatttgtttgagtatagtatactttgaagggttcctcagcttcacttttaacctattttttatttctatttcctctacagtagcattatcctatagttatcctgatatccatttaa

SEQ ID NO: 11572 - DNA, 1633 bp, Homo sapiens; identical to SEQ ID NO: 11571

SEQ ID NO: 11573 - DNA, 433 bp, Homo sapiens
gtataattcattttattaatattttgtatccaccatgctagattactgtgaggcaaaagcaaataataataattacctatacttacaatgtgctgtgtgccaggcaccattctaaacattccatgtgtatttcctcatttaaccctcacaacattactatgagatagatattgttatgattcccatcttatagataaggaagctgagaccgagagagggtaagtcatttgcccaggggtcacacagctaattagcagtaggagaggagtctggtggtacagctcgtaaatctgtttagcttctaaacggcttctgtactagtctgagatgagccttacctaagcagctcaggcagggacagagccttgtgatcattgttataacagagaggtgctcagaggtcactgggctcagaggaatgccgcatctcaca

SEQ ID NO: 11574 - DNA, 433 bp, Homo sapiens; identical to SEQ ID NO: 11573

SEQ ID NO: 11575 - DNA, 433 bp, Homo sapiens; identical to SEQ ID NO: 11573

SEQ ID NO: 11576 - DNA, 3110 bp, Homo sapiens
gtgataactccagagtaacatcagtccaagtcatttatcaagttatttttaagtataggcagaagaagacgtaatagtaacatttaaaataatatgatgcctgaagtcagttttgtttctaaatgttccatggggtagtcaccatggtagaggcaacatttttggaggcaacttgaggagtatatatttcactgttattcttaagagagtcaaggccaaactggctggctgagcaacattttcagataactaacatcttgaagctatttacattttgaaaacttagatactgtaaattcatcacccaaaaataaatgaataggccagaaaaagcattccttggtatctttctctctgattactgaattaccatttactctgcttgagacatgtccaagaaccatgagattgctcagtctcattttcttaagttcgtactgcaatctacaacaagaagcaagaataaacagcacgagacagcagacacacaatccccattggagttaatttatgagaatcagtgggcgttcctctcgcttcttccagatgttagtcttgctatctcttttggctagtggtggtctgccccttcttttagtgggggatgtattagcttcaaaatcttcaacagtgcttttccttcctggcgactcttctccagggtgctccatgatcactccactccctccatctaggatgtgccttaaagctgggtcctcaggggaacagacggtggttccactctcactgctgcttaggtctaaatcttctaagtaaaggatcttgggctgatgcatgcttttgatgaatgttttctccctctcgagctttctacttgagtgaagctcattcatgtccaccccagagtccagactggtgtcattgctctgggttctcttgccctttttcaggtctataaaggagtgcctcacttgtgcaactggctttccatcaagagacacaaaccaggctctgggatgcggggagggctttcctttggacagctccaggagggtctgttctgaaattccttgaagttccgatgaaaatggagtcattacaacagcctcatttagtgttccaggaacagagacggattccagtaagctgcttgagtatcggctccaatctgaagcctgggatggcaggctctgttgaccttcaagtatgatatcctcttccctggcatctgggggctgtgcatgagaatgaattggcattttgggcaaggtctgcgtaaagttctctcgatttactggttccatcaattggccatagactaactgtccctttcttggcaaagtagctgacttagcagtatgtaattgttccggtgtggagaaaaggtcagatgtttgaaggatggcaatgggttggctgtaaatatgcataagctgttcaggaatatgggaacgcccatacgcctcctcattacctgtgagatacctcttttcatcttgagcatcacctagagatgaagatagattgttgttaatatgtttaggttgtttggaccctacattgggctccaaagactgtgttgggtttcttgagtaattattttgattgactgatagaaatgaaacatcttcattgtagattttaaaatcgtcccgagtttttaccatggaaactctttcttctgtttctgcctttgatggttcctttttctgaggactatatgaggagtttttggcattgaataactgcgacttgtcctcagcttttaatgcaactttaactgtactgatatgatttatgtgtgttgttgaagttgtctggtctctcttgaggacctcaagtttagtgatatttctttctcttttctgtggagtaccacacttgtccctagagtagaagagaaggcaaaaaatatttaaaagttatgacacaaatggttcatttattaaaaatcactcccaatctacatatcatacatgcaatgctattgtgagatatgtagattaaaaataaaaaaggatatattataagattaaatttatttctacaaataaacttttcaatgtacagaatatactgaaatgataccataacttgatagttttctgtgtttatagccattttcttacctgcaataacaaagtagtacagcaaaaaatccaatgacaatgactattgttcctcctaatatggctgtaagaaacactgtgtggtaggcagttatgtccttggaatcttcatttatacctgaacctacatggttcaatataaacaaagagaaaatgttattttagatcaaattctcaactatgtcacatcctgggtgaggcaaattgaataagtgtacatacttttatttgtttgcccccctcctatgacagatttccctatgggtgaagtaaaccttccctatcctttggcttaattgactgactcgctttaaccaatgaaatgtgagcatattaaatgagtttgcatggtgtggctctgccctcttgctcaagacttctaatatgtgaatagcatagcccagagagttgttattccttcaacctggggtctagaatgagaatatctgttgaactgaatgaagccaagtccaacagcgcagcagacaatcctgaaacactcatgaaatgttaagtagcaaataagcgtttgatactgttagccaccgagacagcagggttgtttgttactgcagcaatggatatgacagaagatgctgagatgctgctatagaaagcttaaaacatatgacattggcttctaggccaggcagtgagaaaactgtttcaagaggccgtaaaactggtgacccaagtaacaaaaaaattggtaaaataaactgggcgaaaatatttttaactaacttgagctttgtgcaaagagattttaagatagaatgttgattatcagctgcatttattttttatctagatatttaatctttaaatattttaaagacaaattcaaaaaaaggatttaccaaattaagcaggggtctaaagaaatagaatacaaaaattctaaaacttgaagcattaagagttgcagctccttctacctgggctctagagtgaacagagcacaactgaccaactatcctcctgctatgagaacatacgtatacgaatgccattgtgata

SEQ ID NO: 11577 - DNA, 557 bp, Homo sapiens
tatttgcctagggtctttatgttctttcagttaacacagaacagtaggaaggttatttgacacgttagaagttggaggaaaaaattgcacatctagctataattttactgaagctaatgtggctgttttggttcactgaacttgtttacatggtttgggtctctatgctgctcccatgttgaataggagggaatgaaaaataaagcaatttaggatttttacccccacaagggaaaggtgcttcagacatttgccttcagggaaattttaagaaaaatgggatcagttgattttaatgaataacgagcttttatttttaggatgtatgaatggtaattcagagttaattaaaaagttgttcacattgaatgcttgctataatgaaaagaacatagatatattacttacaaaactgaaaaaagaagttgcaaaggctttaagtgacttagggaaaaacttttacttttcccctgaaattgaaactgttttccttacacatcttttaagaaaatcaataactggatatacaactatcctgaaggtatttttgagcctca

SEQ ID NO: 11578 - DNA, 18535 bp, Homo sapiens
agttgcagagctattttgctgcatgtgaggatgagatccctgccatccggaaccatgacaaggtcctacagcgtctgtgtgagcacctggaccacgccctgctgtacgggtaaggtggaggaagtttccaaagatgacggagcacaacccaggccatgagtagcctccacagagaaacccttagcctctctgccttttctttcttctctccccttggcagaaagggatttgtcccactcaagtgggccacagtctctctgtagttaccccagtaaatcatctctgggcagacataaatgatggagggaggatttgccacaaatgatatgatggtgtgaaggtgtgctgggtgcctgggagacctgctggggatccatcacttcctgccttgcgctcactgctggaccagccgactgcagcttcccagggtggccccatgcaggtcacagcagctcctgtcctgttttctcagactgcaagacctctcctctggctactgggtgctcgtggtgcattttactcggagagaggccatcaagcagatcgaggtgctgcagcacgtggccaccaacctggggcgcagtgagtagtcacaaggagacgctggggaagggaccagctccaccttcggtgggtagcttggggctctgtcccaggtttaccctcagggtcagccctgggaggcaaattacctggtggtgtccagtagcagtggggtgttaaaatgccagcaccaggccaggcatggtggctcacacctgtaatcccagcattttgggaggctgaggagggaggatggcttgaggccaggagtttagaccagcctgggcaacacagtgagaccccatctctacaaaaatttaaatattacatggatgtcttggtacacacctatagtcccagctactcaggggctgaggtgggaggatggcttgagccccggagtttgaggctgcagtgaggcatgaccacagcattgcactccagcctggaagaaagagtgagaccccatctctaaagatttaggaaaatggccgggcacagtggctcatgcctgtaattccaacactttgggagggtaaggcaggaggatcccttgagcccaggaatttaaggctgtattgagctgtgatcacaccactatactccagcctgggtgacagagtctctgtctcaaaaaataaaataatagtaataaataataaatttataaaatgccagccccctccatgaggcctcttttctccccacatatgatggttttttggcacagcagtgatggggagaaagagggcgagctgccagcgagagctggactcttatggaatcccagcctgagcacgtgctatggagtctggtttctctccctgagctgggatcactgttagcctacaggatcagtgcagagtcctggcgtttcttgacctgtctgaagtgtgcagtctgccctctttatcagaatttcctggccagctacatgctgaggtctgactaggaaaataaagcactcaggggttatggtaccccaccaagcacaaaggccactgaagtgcctggtcccattacctgctctttctttcctttctgcgcttgcttggcaaataaaagccagcagtctgagaggccttcctgccggttactcctgcctttgtttgcaggccgtgcctggctgtacctggccctcaacgagaactccttggagagctacctgcggttgttccaggagaacctgggcctgctgcataagtactacgtcaagtgagtgtctgggacggtctgtctcccctagcctcagagctccctttcagctacctcccaaaggctcttgtcatgcagacagcacagtgtgccacatcagtgatgccagagagccattagaaccttgccagtagctgggtagccttcaccaggagcaccggtgtcccatctgggctcctgggtacagtctgggtctctgctgctccctggtcctcctcccaggcttcagacctgaccagtgcccatgctttggctcagcctttgctggggttgctgcaggaacagagtgtgtacagcagctgctgagagcctgacaagccttgtgctcgtccatctctgaagacactggcaggacagtgcagtgtggctgctaacccagtaggagatcgctgagagggtggtgggcaacagctatatcaagctgggtgccgtccaaggtggaggacatcacgtgtcagatttcaacacagctggtatgttggtaaggttaggccaggctggtaaacagacccagaggcaccatcgtggcttctcatgtcttgcaggaatgccctggtctgcagccacgatcacctgacgctcttcctgaccttggtgtccgggctagagttcattcgtttcgagctggatctggtgagacaccagggctctcactgcttgtgggaagcagaggagggggcagggtgggggcagggtgggcggtggcttcatttctcaggtcttgttgagggagcttgttgagtatgactgggcttgagcaaaacttgtttttttgggcgagggaaaggtttcagggtccatcgaattgagtgagaagagaagtgatggcaagaattcctggttcaggtgactttttcctatctccctatccaacttggagaaaagccacattgcctggagtatcttagcccagaagaactggccttcatgtttaggatgtgaagagttagaaggacaaggcagtttcagcctggtgcttctggggttctgaaaagtgtcatcagctccatgaagagccttcagccaccctcttcaagttctcaagtttctctccccatcacaccctgtacaaatgggatgctggcccacatagagccaaagaggctcccaggcacctcttggactgggctcaaaatggatgcagctgccccgtcctaatcaaatgaccttccttgggccaggcgcagtggctcacacctataatcccagcactttgggaggctgaggtgggtggatcacctgaggtcaggagttcgagaccagcctggccaacatggcgaaacctcgtctctactaaaaaaatacaaaagttagcggggtgtggtgatgggcgcctataatctcagctacttgggaggctgaggcaggagaatcgctcgaacccgggaggtggaagttgcagtgagccgagccacgtcattgcactccagccagggcaacagagtgagactctgtctcaaaaaaaaaaataaataaatagagagagagagagatagcgggggcatcaaagggtgtagctgagttctgacagctctgtcttccatcagcctgaagtccacagctttaaaagccaacactattcacattgctcttcttagcagcttttctttgaatttactaccttaagccattgatttcccaaagaggcacatctgtgtctcccaggcctggatcctgctgtctgcagaaggccgctgcacgaggcctcccaccaaacgggcctcctctactctctcctcaggatgccccttacctagacctggccccctacatgcccgactactacaaacctcagtacctgctggactttgaagaccgccttcccagctcggtccacggctcagacagtctgtccctcaactctttcaactccgtcacctccaccaacctggagtgggatgacagtgcgattgccccatctagtgagggtgagtggccccagggcagaaaagctaagcccctgttgtgaaacagacttgaactgcttaagcctggctgggtgatgtcttccttggctagttttggtctggtggctgaaatttgcaattaaacagggctggccatttcccagatcttcatctcctcagagtccctgtggtggctaaaaagtggattctgggcacaaaaagctgaaattatatatatatatatatatataaaatatatattttttaaggttagacccttttccagaaggttctagtcacatgcctgtggcagttttctaagcaaggaaggtttagcagtgggacctggaaaccttgtcgcagggttgagtgttgcctgttctggggagcttgtctgaccccacattctttgcagaaggaggttaagcaacccctagaagaagagagaaccaggcaggtctgaagcgcagggaaaccttgccactgtgtcctgtgtgtccgtccgatttctctgagttccttctgcgctcgctgatgtgtttgggatggtcgcaccctttgcatcagggaccgaggaagaagctgcaggtcattttgttgtcttgacccaatgatttactggaacagcctggtttctttcaaaccttaggccctggtgttcatggataaaactggccattttcccctctttatctcctgtaggagaccagagcccttcatttacttcaccccaccacctcacctccagggaaggggatcccagccccaatttagccctggggcaccctagaattgcctcagcattgagaccttgaccttcccctttctttatttctgctgtaccacgggttatatgtcccaggaagggaggtccctctcaaacttgctgttagcaagacctgcattgctgaccgtgcaagctgaagaaggcggcacagtctccttaggttgggcccatgggccaccttagaggagttggaggggtgggccttgccggaagagccagggcaaggatggatccatggatggaggtgtcccctcagcaatttggagattgtgcaactgcagctgccagggcagtgtctccttgccctgctagggtatggagggaaggcacgtaagaggtagaaaacaaagctaggcacaggcagccaggcttctctctgccagaaccagcttctggatgtggaaaggggtcaccctgacaggtctttccagctggttggaggctcctgggccagcgcctgagctgagaggcagtcagggccctagtaagtttccccaaggttgttggatacaatgtagaaagttgaagttttcctctcctattttctccccatgtctcccaccccatttcccctcccctccctccagtcatccttccactgcctgtgtttctaatcttcagttttgtccctcgtttttgtagattatgattttggagatgtgtttccagcagtgccgtctgtacccagcacagactgggaaggtgggccagagtccgctgttaccctcttttcctgttttgcaatgtttccatgccaagcttgctgcatgtatcaaatcagctccttattatttataataatatccataatcataataaagccaagtttggtgttctaatagatggaattctgcagtgggaaaactcaacctctagccataggcaaatcccttctcccagtgcagggctcctgcctttgctcagtggcctttcggagtcactaagtggctgcatttcgggggatacagggtcacccttcctgattccagtgccagctgatgctctcggggtgtgtagggcctgacccagtgaaccaagacttgttctggaaaaccatgcctttaaacatgcgggttgtaagctcctgcgggtcagatgagcatcgaagagaaagagcttgattctttcagtctgttcctaatggcttcctcttgggtgttttggagtggttgaggtccaagtcaggaaactgcccaggtacagctgaaacttcctacagacagaatctctttgaagctttaaagcagattaaaaggaaatctgccagccctcccaccctgtctgctgggcagtagcagtgcctgggcatttttctgcctgaaattccacttcataaattcacaaagctattcccaggttgccacgattactcaaagcaaaggctatgttgccaataaggtgaatgtttcccccttaaatctgaggccatagcagatccctgttattttactttatgttattttattttactttttgagacggagtctcgctctgttgctcaggctggagtgcagtggtgtgatcttggcttactgtaacctccacctcccgggttcaagcaattctcctgcctcagcctcccaagtagctgggattacaggtgtgtgccaccacgcccggctaatttttgtatttttagtagagacagggtttcaccatgttggccaggctggtctcaaactcctgacctcaggtgatccaccccacctcatcctctcaaagtgtgggattacaggcatgaaccactgcacctggtccaaatccctgttattaaagagcctcctaccctctgggccacttccagcctggaacaggggaggtgagggaacctggcctctgaacaggggaggtgagaactgccacaccctgaggatgaggggcacgtggctctccccgcattattagagacgtgattgctgagtaatgggtgacaggtgatccgttcccagataatgtgagtatgaaataccttaactctgtgagaaataagatgtggcattgggaaaaataaactatgacacttggccaagagtagcattgaagggtcccctgtttgagttaaattagcttggattccagaattccatcataacatcatgtaccctcttagcccctcttcttgcagcacacatgctggatattgtttttttttccctccgattctaacaactaacccccctcctgacacgcctgctgcagtcacttgacaagcagggcctgaccttcctctacagcctttcagagctccctgcggcctgagaactaacagcccagttgcactgcttgcctcagggcagggtgagatttctggagttcctggagcaggattcctgagctcactctggcagctcacccggggaggctctgtcttctccttggacctggaggaaggcaggacttggggcagctccaaactctgagcctggggtggccttcccctggtctttggcttatttacagagctggtgggcatgcgggccttgacacccaccacatctcatgatctgcccactcacctctcagggctcctcttgggtgcaactgcgtgtgctgaggagaatcacaggagccggagcaagaacacatgggcttggcaggagcctgctttgggaccgagagacgcggttttctgtatcttagaacttaggctctgagatccccggaaatctggaaaaagtccccgatgttgctggtcttttctggcagagctactcattgcctttagcctcctcttttgtccttatattaaaagacagcagacttaaaaaaaaaaaaaaagggccaggctcacacctgtaatcccagcactttgagaggctgaggctggaggatcgcctgagcccaggagtttgagaccaacctgggcaacacagggggaccccgtctctactaaaaatataaaaattagccaggcttggtggtgcacgcctatagtcccagctactctgtgggctgaggcagggcaggaggatcacttgaacccaggaggtcgaggctacagtgagctgtgattgcgccactgcgctccagtccgagcgacacagcgagaccctgtctcaaaaaaaaaaaaaaaaaaaaaaaaaggacggtgtgctgcatcagcagacagctgccctgtggcttccaagggcactaagttgacagctggttgggcccccagtggggctgtggggtgcatgtttgcctcttttcttccgggcagacagcggccagcaagatgagcattggccggcaaatagagcacgaccagccatggcccttgccattgaccctcacccaggcagtttcaccagctgggcctcagctctctgcttgggtggctcccatctgccactggccgtatgggctgtgtgcttcacctgcccgtgctccctctcctgccctgttccagtaaccaggggcagatggctgggtggggcgggatgtccaagccagctcccctctcgggggccgtgtcagggtatgagtcagaaaggaccagtcagtgagctgacacttgaatgaaatggagttctcggccgggcacggtggctcacgcctgtaatcccagcattttgggaggccgaggcgggcagatcacgaggtcaggagatcgagaccatcctggccaacatggtgaaaccccagctctactaaaaatacaaaaattagctgggcatggtggcgcatgcctgtaatcctagctactcgggaggctaaggcaggagaatcacttgaacccgggagttggaggttgtagtgagccgggctcgcgccactgcgcttcagcctggcgacagagagagactccgtctcaaaaaaaaaaaaaaagaaagaaatggagttctcagcaccacccttgcaggggcacctggtcctgcccccgaggagtgtgtagggtcaggggtgctggggagaagcagcctggggggcggcctctcggacccctgtctttgccccttcgcaccttgctctcattgccctgctctgtcatcttgtctctactctgtgctctgggcatttccctctgccccatggttcccaccccttgggctcccatcctgtctcctagcctctgcccccactctgcacccctcactttctctgctgtcttcctccattcttctccctttgtgttccttttacctctgcaagggacccttcagaggactttgggcacctctcagccctacaagtggggtatggggctaacggggctgctgggtacccctgtagcgtcctggcaggaaggctctgagggtaacctaagaggcgtgcagcctggctcctctctagggctcccagccacccatggaggcctcgaagtcaccattcctatgggacttaagcctggagcttgagcctggaggctgcttcaccgcgggggcccttaacacaaactcagccaaattgttgtgagctccggaggccccaggggtggtggagatggtgttccttccaagttgctcctaaagtacaaaaccccatgtcctgttaggttgtggcttctactcgaaatggggccacccctgtcaggtttccctgggaggaactggccagcctgcctccctcctgggctaacgcatgctctgggggtcggggaccccggggggtgcctgacagggtgtctcctgcttccttgtcctcccagatggagacctcacagacacggtcagtggtccccgctccacagcctccgacctgaccagcagcaaggcctccaccaggagccccacccagcgccagaaccccttcaacgaggagccggcagagactgtgtcctcctctgacaccacccccgtgcacaccacctctcaggagaaggaggaggcccaggccctggacccgccggatgcctgcacggagctcgaggtcatcaggtcagcagggaggggcccagaaaggagctgaggtcctggggtccaacctgtccactcccagcatcagctgttcatccagggcagaccgggacaccccctgagggcagttgcatgccttcctggaaacccttcccacctctaggaggttctttgagcaagaggaagtggaggcctgtcctagtcagctcggctgctggaacaaagcaccgcagacaggcggcttccacaacagacattctttctcacagctctggagcctacagtccgaggtcagggtgccggtgtggccagcctctgatgagggattcacagatgtccctcttctcgctgtgttgtggcggggagtggagagagagctctctagggtcccttttatgagggtgctgatcccattcctgaggatcccaccctcaggacctcatcaccccccaccccctgataccatcacattgggagttaggatttcaacacaggaatctggaggggacacacacattcactccattgtagggctcaagcccttggaagcaggtggcacaggcagcgaccgtggctggtgtctggggccatgtccaggctgccagggcgtttgctgggtctgcctaagatcagaaagcaccttcaggctgtacttcttcccaagggagttcttggaagttaagatacaatttctgagattcattgaaagaaaagtatctttgtcatatgggcaggacatggaaaggaaggacatggtgggtggccagcagggactgtcaaccagagcctccccggctccctgacctccccgaccccctcttaaaacttcacactgactaagaggagaagccctgtgtgcgtgtcagactgcccaggcttgctggcctgaggcgggggattgctccccagtgactggagccaggaggccaccccatgggctggttccagtccacagcagcatcatgctcagacctggggtcccttagctaagcccgctccagccaacctggaaccagagtgggacccggagcgtgagcccagaaagcgctgagtgctttctgggtgattcctccatgatgatgcctgagggaagtgaggtcagctcgggatccacatccgaaggggggctgagtggagggggcattgcctgaccagccatggcctgtttttctttcctagagtgcagctagctcagctgttccattaggaggaattcagtagacccactctggggttcctctggctgcagccatctgtgcccagcccatgctacccccaccccgcccctgccagcaaagggggtgcctcggggcctgagccactgttgtcctctgacccagtgcctccacccagcactgcctaggaccactgacgcactagctgtgccctcagaggctacatggccagcattgccaccgtgacccagcctggttttcctcagcactggactactcaggggttaacactctccccgtcgttactgtcccagggtcaccaagaagaagaaaattggcaagaagaaaaagagcagatcagatgaggaggcaagtccactccaccccgcctgcagccagaagaaatgtgccaagcagggggacggtgacagccgcaacggcagcccaagccttgggcgggactcgccagacactatgcttgcctccccccaggaggagggagaggggccgagcagcaccacggagagcagcgagcgctccgagccgggcctgctgatccctgagatgaaggacacctccatggagcgcttggggcagcccctgagcaaggttatcgaccagctcaacgggcagctggaccccagcacctggtgctcccgtgctgagcccccagaccagtcctttcggaccggctctcccggggatgccccggagaggccgccgctttgcgactttagtgaggggctttcagccccaatggacttctaccgctttaccgtcgagagtccaagcactgttacatcaggtggcggccaccatgaccctgcagggcttggccaaccgctgcatgttcctagtagccctgaggctgctggccaagaagaagagggaggaggaggagagggacagacgcctcggcccctagaggataccacgagggaggctcaggagctggaggcccagctgtccctggtcagggaggggcctgtgtctgagccagagcctgggacccaggaggttctctgccagctcaagcgagaccagcccagcccgtgtctgagtagcgctgaggattctggggtggatgagggacaggggagcccttcggagatggtccattcctcggagttcaggtaacaagactctgcagctggcatgggactctcccagcccttgaagctggggacactgtgcctctgacctccagataaattaagcactaggaagacctagcctgagtgagaaggggtgtgagcctccctccctaactttggctcctagtgggaggcggaggcactaccccctggctctggggtggggtgtggcctctctcaccgctgcctgcctgacatctcgccctcctgacttggccctcacagagtagacaacaatcacctgctcctgctcatgatccacgtgttccgagaaaacgaagagcagctgttcaaagtaagtcctaggaactcaggagtgagcaagagacggcaagggcaaggcgggatgggccaccgcccccgctggagcggcaggagccacctgcctgacccttgtctgcttcggcccccagatgatccggatgagcaccgggcacatggagggcaacctgcagctgctgtacgtgctgctcacagactgctatgtctacctgctccggaaaggtgcccgccgcccccgggcagacagcgggttgtagacgaggctgactctcagccccttttccccagtccccttgccctctgagtgcctcccggctgcctggcatgcagtgatggaaaggcaccccaaggaaggtgttgccagcagccctgagacgtgagcctggggctccctctgtgagcactccacgccattctcctactgcagggcaaggagaggccctctaagagagggggctgtgtctaagaaaatggggcagggggagggaaaagaggcctgtggggataataggccttggggtttcctctctcaggggccacagagaagccatacctggtggaagaggccgtttcttacaatgaacttgactatgtgtcggtgagtccaggccccgcagttgtgcgcctgctgtaggtacagggcttctcaagccacttacccatagaactgcagggcgaggcacggccccttactcccctcccggggttgggcaccaacttaactctcagagaggcttctgtacacgatgctgggggtaagaaccaagcttgaggttgcctcttcccgtgctagacttctgaccgtccctccctcactcatgccagcccctggcctctggggctttacttggtggtggcccggggtgtgcttcttcctccccagcaagcgctcagcctggccaagctgccttctccgccaggcagcagctaagccccaagtgcatgtcacggtgtggtttctggcaggttggccttgaccagcagacggtgaagctggtgtgcaccaaccgcaggaagcagtttctgctggacacggctgatgtggcgctggctgagtgagtggcaaccccgcccctctggaaggattggagagttcgcagccgcccataggtgtgggtggcctgggggtcaggggtggaggtggaaagtgggagatccaggaggggaaaccagatgtattccctctggaacctgcatctgctcagagaggcaggcaagtagacgacaatcataggactcatgtggtcagcccaggtgacctcagcccctggcgactcttgggggtgctagcatgagttgttggacaggaaggcaggcagagagccatgctgctgggccaggcgtgcccttgaacgcctgcatccttgtcgtggctcaaggtcccacccgttgacgtcctgcccaccctctttgtctgtcttccctcactgtcaaaatccaaggccccttggccattgagaacgatcaggcctgttccagttgtcatttgatgaccttggacctgcgtcattgccgcacctgccgccctggtcactgggtctagccaggtctctcccccaagtttctgtgacccctccaggccagcagcgctcaagactaagccctgtccagttgaggccctgttcccaggcctctaaccacaaacctcactccctatgcaggttctttttggcttctttgaagtcagccatgatcaaaggctgtcgagaacctccctaccccagcatcctgacggatgccaccatggagaagctggcactggccaaatttgtggcccaagaatcgaagtgtgaggtaagaacctggggaggaagctgagtgcagcccctgagatggcagagcagcagccgccttggcgtgagcgttaagggatgcacgtggatgtctttgccatttcacaatcgcctacctgggcggggcggggcggggcggggcggggcggggctttcccaccctggaagggaggaaagtcatgtccaccttcctacctggggtgtgtcctaaggttaagacaccctcgctcggcagggcacagtggctcacgcctgtaatcccagcactttgggaggccaaggcaggcggatcacctgaggtcaggagttcgagacccgcctcgccaacatggcaaaaccccgtctctactaaaaatacaaaaattcagccaggcgtggtgatgggcgcctgtaatcccagctacttgggaggctgaggcaggagaattgcttgaacctggaagatggaggttgcagtgagtggagatcacaccactgcagtccagcctgggcgacagagcgagactccatctcaaaaagaaaaaaaaagaaccagtccgggctcagccacctgcctggcccaggccttacttgctttgtcccccgtgcccgcccccgcatcaggcatctgctgtcaccgtgcgcttctacggccttgtgcactgggaggaccccacagacgagtccctgggccccacgccctgccactgctcaccccccgagggcaccatcaccaaagaaggcatgctgcactacaaggcgggcacctcctacctgggcaaggaacactggaagacgtgcttcgtggtgctcaggtgggagccctggcagctctaggcctggggcttgggccctggggtggctgggctgtcaggtccccagcggggatctctccgcagcaggtcactgagggagcagcctgaggagaggacgcctcccttccctaccagagcttggagttgacttagctcaggctgttagagcttctctgtagagccagtcatctttggggccccaggaatccctgagtgcctcaggggaggatgcaggcttggtcccccgatgaaccttgagctgcgccccaggtctgctgaggtggccacattccctgctgggcccccaggcccttcttcaccctgccttccgtagatgacagcccctggtgtcctttgcctcaggttcatggccgcagcatgtgcgtgggaggggaaccctgggacctgggctccgcctggccccagttcctgggacaggcctcactcgccctgtgttgtgcccctgcagcaacgggatcctctaccagtacccggaccgcaccgacgtcatccctctgctctcggtgaacatggggtaagtgtcccgggagaagcgggtgtatcctggggcccagagctgccgtttccctggtttgagatggctgcccctgttggcagttcagcctcgccctcaaccccaccccatccagcggccctgacaggtggcctggggcttccacgctctgagggctgcaaggagcccacaggaggggaggagggaggcagcaaggagctcctggcttagaacaggtccagtctgatgggggaggcaggcccttccccagaagctcccggcctgatgggagatggacgttcgggtatttgggaggaacagcaggccctcaagaggaagcatgcgtgaatgaatgcggccgattctcagagggccagtgggacagctgattcccaacccctcctggccatgcttgggtatctagaggatcttgggcatcctggaggtgaaaggcatcgcacagcaaggcggtgggtggggctcccagacctctcctgggagctggaggggcctggagaaccctctggtatcctccagcccccaagacggtggggcagaccctgtgccgcacaccccgcaccaaccctgggggctgtcgccccgtgctgcccttgcctcctcgctcccgtttcaccctcctcctctggcccaggggggagcagtgcggtggctgccggagagccaacaccacggatcggccccacgccttccaggtcattctctccgaccggccctgcctggagctaagtgccgagagcgaggccgagatggccgagtggatgcagcatctctgccaggctgtgtccaaaggggtgagcttcgcctgcccctaccgctcacctggcttgcctgacccacccagacccccagggtcccatccctaaacccatagtcacagagcaacctgagggccaagacggacctccagggggcagcccaggaatggaccctggagctcagaggcatcacccccatccccgcctctgctcccgatccctggagggagatccctggagggagagcagaagggctggctggtcccctggagtgtggacttctggtgcagaccagccctggaggccccagcctgcctctcccctgccccgctgccaggtcatcccccagggcgtagctcccagcccctgcataccctgctgcctggtcctcacggatgaccgcctctttacgtgccatgaggattgccagaccagcttcttccgctctttgggcacagccaagctgggcgacatcagcgccgtctccaccgagccgggcaaggagtactgcgtcttggtgagctttgagtgggggcggggctgcaaggcctgcagaaggaaagctctggctgctcacccgggggcctggctctccctaggagttctcccaggacagccagcagctcctcccgccctgggtcatctacctgagctgcacttctgaactggaccgattgctgtctgcactgaactctgggtggaaaaccatctatcaggtacccagctgcccaggaaacccattagccagggaccctgtggagtgggagccactccccggggagaggaacccctgctgctcccaggacttggccctgcctccagggtcctgggcacagccatgtaccagggcgctcctgcctcagccccgggggtgagtgcctgctgctcttaaaacaaacccagaagagtcctcactgtccttgccgtctcttgctgcgcacaagcctgccaggctgggagcccgaggccctcaagccactcagcattgctgcctcaagggcctgggagggaaggggtgggccctgggaggtgggtgtgggactccagccccggtggttctgcctctggtttggactgggccttgggtgattgagggtggcctggcaggagagagctgtctgggggcagaggccaaggtgggcatgttggtgccagccccagactgagcagacacacctgacaggcacaaaaacttagaatcaaaaggacaaaaccctgactcccagtgagtctgaggccaaagctgaaaacagaacccaagaagcttaattcctgacctcagttccaatcaaacagcacgaattgtggtggacctccagctgtgctcagatggggggacacaatattggcagtaccctcttccttgccctccaggctgagtgccagtgtgggagcgtgctcatgagagccctgcacaagcgggttttgagcacatgctacgctctagccccgtggaagcctggactagttagaggcagagaacagctcaggacagacacctccctgcagagccaaacagagtgcagcgcctgcctcgctgggccatcctgagagctggggccttcccaggaaagagggagctcggggggcaccaccccatcctcagctcaagcccctggaagagcgggagaaactagcagcgtggaagatgttcccagggagagatggggagggcctgacaggggctccgtggccaaggcagaggcaggcctggtgcccacaagccctgaagactcctgtggccctcagtggccctcatctgttctctgcacgccccaacacaggtggacctcccccacacggcgatccaggaagcctccaacaagaagaaattcgaggatgccttgagcctcatccacagcgcctggcagcggagcgacagtctctgccgcggccgagcctcccgagacccctggtgctgaggcagagctggttggcgtccctggtgggcaggaaaggaaggcacgccagccggcaggcacactgtcacggctgttgtcatgctgtcgggagcctacagtccacccctgccctgggcggcagaaccaccgagtgtggcttaagacagggtccctccactccagggatccagatcaggtgcccggcacccctgggcatcctgcccgacaggtagcgaatggaggtcgctgggggcagagggtccgagccctgtgggctctgcggatgcacgccctcctcccgggcctccgcctcagtctgcagaatttctgccgagtggcaccgagaacaccatccatctaaggacgaacaaaagaaccaggagggcgggacccccctcttcctctcctgggttgggggctggggccctgagtgcccagccatccttgttcgtgtttgaacactctcctggccacgtggggaagcgggaacacggggtgtctgcgcatgtttcctcctcctagctccatcactgcgcacacagctgcctgcctcgccagatgcaggggggcgggcagccctccctggctgccaggaggctctgcatgcccacagtcctgccctgcctgtcccctcaacccggcagtgcctgtagcaccgaggagcaaagggggtggatggggggcttggagaagggcggagcccaccagcctggcatccatgttgacatcttctgactgtcccctgcttggctggagccaggcccttccctagagtttcgtcaagagcctcctggggaaggggtcaggtggtttgggttttgttttttaaaataaaatagacatgttatattgccaa

SEQ ID NO: 11579 - DNA, 5288 bp, Homo sapiens
atggagtctcgctctgtcgcccaggctggagtgcagtggcatgatctcggctcactgcaacctccaactccctggttcaagcaattctcctgcctcagcctcccgagtagctgggattacaggcatggtggggcccggctaatttttgtattttttttagtacagacagagttttaccatgttggccaggctggtctcaaactcctgacctcaggtgatccgcctgctttggcctcccaaggtgctgggattacaggcgtaagccactgcacccagctaccaaaacaattttgaaaaagaatgttgagggggctggggtggacttgttctgcccataccaaaatgctgaataaagtgaaaattttaaatggaggaccagcacaggaatatataataggccaacaagaagtagttttaaaaggggcatattacatcacagatcagccaggcatagtggcatgcatttgtagttccagctacccagcaggctgaggtgagaggattaggaagagctggaccattaattaacattaataaatacgagggctgggtgccgtggctcatgcctgtaatcccaacactttgggaggccaaggcaagcagatcacctgaggtctggagtttgagaccagcctggccaacacggtgaaactggatccttacctcatgccatatataaagctggatccttacctcatgacatatataaagatctaaacataagggaacctggccgggcatgacggctcacccctgtaatcctagcattttgggaggccaaggcaggaggatcccttgagcccaggagttcgagagcagcctgggcaacatagggagaccctgtctctatcaaaaataaaaataaaataaaataaataaaaacataaggggaccaaaaaccagcagtgaaaaaacaaaaaagatctaaacctaaaaaccaaaatcaaattgtcctaaaactataaaagaaaaaaggcacttttgtggccaaccgtggtggctcatgcctgtaatccccacactttgggaggctgaggtgggcagatctcttgagctcaggagttcgagaccagcctggccaacatggcaaagccccatctctactaaaaaatacaaaaattagccaggtgtggtcgaaggtgcctgtgatcccagctacttgggaggctgacgcaggagaatcacctgaacctgggagacacaggctacagtgagccgagactgtgccagtgcactccagcctgggcaacagagcgaggctccatctcaaaaaaaaaaaagaaaaaagaaaaaaggcacttctgtaatcttacattgggaaaaatgggaaactataaaggaaaagactggtagatttgactgcatcaaaattaaaaatttctcaatagggcaaaaaaatgacaagtgaagtttaaaggtcaattgataacgggggggaaaataatatataacaacacattaggttaaatccttaaagagctgtaacatggctgggcgcggtggctcacgcctgtaatcccagcactttgggaggctgaggcgggtggatcatctgaggttgggagttcaagaccagcctgaccaacatggagaaaccccatctctactaaaagtacaaaattagccgggcacggtggcgcgtgcctgtaatcccagctactcaggaggctgaggcaggagaatcgcttaaacctgggaggcagaggttgcagtgagccgagatcacgccactgcactctagcctgggcaacaagagcaagattcagtctcaaaaaaaaaaaaaaaaaaaaagagctgcaacaaataacaaaaacacaagcagccagtggaagattgggcaaaggctgtgaatacttagttcctagaagaagagaaacacgtggctaatatggatgttccactgcgcttttaatcagagaagtacaatttaaaacaggtactatttttcaccaaatggactggaaaaaattagactaattatatgcagtgttggccagcatggtcggagtgtaaatcagtcagacattctagacggccaggtggcaggacccaggcagattgtgaatgtgtttgtctgttggctcagcagttccccttgcaggcactcaccatacagaagcatccacacaggactgcacaatggtcactgcaatattatgtgctatgtccaggaactggatatgatatccatatttaacaatggttgaagtatggtacatcataatgatatggaaatatacatggatataccttaaaggcaaaacaagtttcagaatgaatatagcatgatcttattttcctttttttttttttttttgagacaagttcttgctccaggctggagtgcagtggtgccattacagctcactgcaaccttgaactcctgggctcaagggatacctccccctgaccctgcctcagcctcccaagtaggtgagactataggtgcatgccaccatgcctagctagcttatttttatttttatttttcgcccctgctggagtgcagtggtgcaatcttggctcactgcaacctccacctcctagggtcaagcgattctcctgcctcagcctcccaagtagctgggattacaggaatgtgccaccacacccagctaatttttgtatttttagtagagacggggtttcaccatgttagccaggctggtctgaaactcctgacctcaactgatttgcctgccttggcctcccaaagtgctgggattataggtgtgagccaccacgcctggctaatttttaattttttgtttgtttgtttgtttttgtagacacagcgttttgctatgtggctgaggctggtctcaaactcctggcctcaaacgatcctcctgcctcgggcctcccaaagtgttgagattacaggcatgagccaccactcgtggcattcctttttttcttatttctttctttcttttttttctttttttcttaggtctgtgtatacaggaaaagagttggggggatacgtgcacaccaagctgttggcaatagtaaatgggagcaagggggcctttattctttatacacacctctgtgttgcttccatttttacaatgaacaaatgttttcagaataatttttctttaaaggtatcttagctgagaaaagagtctgagttccagccctgggtcctgtcacttaactaaaaaccatattgagggacttaacctcgtctctgtaaatacacaaatatacacattcttttccatgtgggaattataattcaagagaatgaataatattctgttttttgtttgtttgtttgttttttgttttttgtttttgagaaggagtcttgctctgttgcccaggctggagtgcagtggcgtgatctcagctcactgcaagctccgcctcccgggttcctgccattctcctgcctcagcctcccgaatagctgggactacaggcgcctgccactacgcccggctaattttttgcattttgcttagtagagacggggtttcactatgttagccaggatggtcttgatctcctgacctcgtgatccgcccacctcggcctcccaaagcggtgggattacaggcgtgagccactgcagcccagccctgtttttttttttttttttggagacagagtctcactctgctgcccaggctggagtgcagtggcacaatctcagctcactgcaacctctgcttcctgagttcaagcaattctccttcctcagcctcctgagtagctgggattacaggtgcctgtcaccgcacccagctagttgttgtattttagtagagaacgaggtttcaccatcttggccaggctggtcttgaactcctgacctcgtgatccacccgccttggcttcccgaagtgctgggattacaggtgtgagccaccacacccggccctgttttggttttttaattagaacattgcactagatctctaaggatgcttccagctgtaacatctgtctataggctctctgatctcagatttactcagattttgaaattaaaaaaaaaaaaaaaaaaaaagctctaccccagtgtggtcgtacttaatactgaagtgtgcagtaatgtttccagctgttgctgagagggattatgcagtttttgcaggcttattcctctttctttcagctctagaaatctttccttctggtgctctgatttgcctgcctctgggaggaagggaagggaagaccctgcaggactgaggtttgtcctggctgacaggcctgccaggcttgttccgggctgcagagaagagaggctatttttgttgtgggagctgaattgttggtctctctccaggagcacatgcttgttggtgtggttgatgtatcttgcctgctgtggccatctctaccactgcttccagaaaacacttgagaatacgtttgtcccaagaggttaaacctgagatcaggatcaggcatctgtgctcttgtcttgtgttccactcccttctggccattggaagggcagtagcagaacaggatatggctaacatgaacttggagagacttttctcctagagctgtgcttgaaaggggccctctctctgtaactgcggttgcagtgaactcagtccaatatctgggctttcttgtccttcagtaggctgatggagctgcccttgccctcaccagcctggtggggtttgcacagtgctgcagttcatctcacctactgtccaaatctccttttatcagcccagtccaggaacagtggtgtccttcttggtgtagggcttaacgtgagccttgcatgcacctagatccatatccagcattgcaggcaattctagtattccatgtcaagaaggctggcaagaaggctggtggggcaggtgccccagtccatcggcccttagtatatgcagagggtagctccaagtggggccactgtgatatgaaggaggattgtttgaattcaggagattgaggctgcagcgagccgtgatcacaccactgcactccagcctgcatgacagagtgagaccctgtctcaaaacaaacaggccgggcacagtggctcacgcctgtaatcgcagcactttgggaggccaaagtgggtggatcacctgaggtcaggagcttgagaccagcctggccaacatggcgaaacctcgtctctactaaagataaaaaattagctgggcatggtggtgggcacctgtaatcccagctactcgggaggctgaggcaggagaatcacttgaacccaggaggcggaggctgcagtgagccgagatcatgccactgccctccagcctgggcgacagaacaagactttg

SEQ ID NO: 11580 - DNA, 6544 bp, Homo sapiens
cccccaccctctctcctgggccactgaggagaggggagagagctggtgattccagaagggtgacccggacagcctagctgggggctccccccatattcccaggcccagaagacagacccacagccctgcccttgtctctgaggctgaagaccccctgactcccatgctgtgcttgccgctctgaaacaaacagaggctggaactttgtggtccttgccgagttttgtaggggtcactgtcacatgcttgtgccctggaagccccaaggctcttcctccagctggctcccttgtctccagggctttggaggatcagggtagggagggctctgtctctaagccaggtgtcaggatcagaatcatgggtagaaggtgccattcagctcacagccgcacccagaatcctttgcagccctccttctttatttttttcccattgcattctgggagtccacatctggctttctcagccactgttcatcaccaggggttttaggaggaaggcttggctcctgtcttcccagacccaccatgcctggagaggtcaggatggaactacctcattcggcaaattagccccaaattgagcgctgaatcgtgtcccatgagatcaggcgccatctgtaaagtctcctctggaaatgccaatccatccttcccccagctgcttcctcggggaggcccctgcccccaccctgccagcccttcccagtctcattagaggaagctttccaaagttctcagttatcaagacctcatccagctcgtccaaaggcttcagggatggaaacaaaccagctcgtctcagaggccagcaagctggggcctgtccgccacggtgccctgtgcacctttgggctgccctggcccccactctcccgggccgcccaccacaggctcttaatggggccgggtcagtcctacatgtgagatgggttagggcaagtctttgccatcccccagatggctctgtcttcttgtgtatggcagggctgggactgctgtcccttgtacagttttctgtcactggtgggcactggacaggcatagcagactctcttgtggccacactaggttgtcgcctttcaggcagtgtcccgccacctttgcttcccgctccttctggacattccagagccctgcaccaaacccttacttggtgtctgcacctcctttccctctctccatcttccaatccctggaaaagtctggtctgagtgtgacttgggaagctttcagtgctgctgtttggcccagctcattactttctccctttctctaccacagcaaacacattctccaccatgtcagtctaaagagtctaaaggggccgggagaagcatgagcgaggggcagattctagtcgggagcccatgccctggaaatccatctttcttcatctttcccattgaccactttgggtttgacctgcacatctgcagtgagggcagaattcaacaagcacaactcactggtctttcagtcaacgtgctagaaaccgatgacttattaatctctaattttttggcgcctctttcattgaatgagaattgctttcgtatagttcacattagaaaaatgcctaatatactaaagtaaaccaaacgttgtcacttttctcttgttcttgaaacattgcaaccaaaaaggtcagcacaaaggccttcacctacgtgaagacctcctggtaggatctgtccatgggatggagaaccactctgtccagatctggggttgggtcatgacaccagctaccaattttagaatattatttcttggtttctttatgaaaaatgggtgctagtggtaattgctttgtggcttagtaaactactctgtggatgatttccaaacattcaaagccaatagccttgttattaacaagatattttgagtacaatatggctcattgacttttccattacatctgaggattccagagtcctctgttcatccctgggatagagtgagccctcttgcgtcttccagggtagctcaggttggcccagtttgggccagtccatttttggaggtcactctttcccccctcatcccctcacctccttctctttacccccttcacgtacttcctttctttcttccctctgttattcattcatcaagcaggttaaagccattgtgctaagatctaatctgaggacactataatggccctgtcgtcagggaagcccgtgatcgctcgttttcaggggtcttaccggtcagcaaccttggcattgatacataggcactctacagaatttaagttttcagaggtaagtctgttgttctgattaatctgcattcattcagcgaatgctcaagacaagccaggcatgctgagaagcggcgctctagttgtatgtaagatgggcattcctctgctctcctctattctccatgtcgactgagaagagtataataagaacattgtaccctctccacacttaaccctctgggattctttattataatataaaccaccgtcgtgaggcatttacctgttggatggaaggtagacagcaacaagattttaatcacctggtcaccagaccctcacggcccatatccaattcgaatttcagaaatttctctgtttgctttaaataactctttacaaataagggtcgggcacggtggctcacgcctgtaatcccagctctttgggaggccgaggtgggcagatcacgaggtcaggagatcgagaccatcctggctaacatggtgaaaccccgtctctgctaaaaatacaaaaaattagccagatgtggtggtgcacacctgtagtcccaactattcggcaggctgaggcagtagaatcgcttgaacctgggaggcggagattgcagtgaaccaagatcgggccactgcactccagcttgggtgacagagcaagactccatctcaaaaaaattataaataactctttgcaaataggaaagtgaagctcaagggtaaccagtgaggctatgaaattgccagtgaattaagaccagggctagagtcaacagtccagaacccctatccgtatgaacaggggcccgtttctggttgaaatcaaggttaggatgcaactgagaaaataaaagactgcactttggagaggcaagcacgctatccgggttgttgttttgttttatgtcttggtgcttaggtgaggacttagctgggtttattcaaagtgggcgggtctgggctattcttgagaatgtcccttccatttctgagaacaagtcagccccttctacctgcctccacccaggagactgatgcacaagatctgtttgtgaaagcctgatttaaaaagaaaaaaaaaattccttaagccaaatggtgttccaagttggttgctgtgacaacctccaggaagagccacttgttaccctctattctttctagtgctttcagtcagtggcaacacataggccccttggaccgtggggatggcggccctgagattctgtcagtgggaccaccctgggcctcctttctacctccactcagcaccctgttggccaaggagaatttctgcggtgggaggcagtgctctgctagtcaggattgataaacagctgggcacaccgaaacagtgtaccaacgaattcaccaaccaggggtttctttccctaccctttgtgaaaaccaatcaattactagatgagtggatggatgcagaaaaatctgggctgagccaaagtcccttttggaaatacaagccataacattcgaaggacatcagcgaccttggcttgtttaggtgattttacttccagctgcaggtagtcttgacaaggagtgtttaaacagaaggctcaagatgcattccttgtgtaggtcggagagagcacttctaatgttaagtggggtacagatcagctgcccccccacgtagcctggacatcgtcttatccccataatccttgccatccctacaaggcccatcgccaccaccttttcccaggtttattgaggtatgattgacatccagtaaaattcaccctttggaaatatacagctctgtgaattttgacaaatttagtgtcttgtgaccatcaccaagatcaacctgtttttaaccctccaaaaaattcccttctcctgccctctttccctggcaaccctgattgattatctgatcctataattttgccttttctagaatgtcatataaatggagtcacactgatgtcgccttttgagtctggcatctttccctcagcttaatgcttttgagtcattcatgatgtgtgcgtgtggtttgttccttctccttgccgggaagtatttcattgcatgggcgtactactctgcttctttatttttacactgagcctttcgccctggaagttcttggcccagggtcttcaacttgtttgcacgaccacttccagcttgctgcttccttcagttccccaggctcctcctccaaatgccagctgtgcccacaagctgttcttagggctcacactcgccttttggcgcgtggtgggtttttggtagtgcagaaagaatccagggatgggaggggaagggacggatgggtgctcaattgctgctcacgtctgctgcaacctgaagcttgcatctcagccagcagatctgctcccttctgggacccaggcttcagtgtcacacggtccttggctatgtattgggcgttggaggctttgaaaggcgagcagaagcagcatggacaagaaggctggggctggccctggggctcatcatgatgctttcctggatctgttgcttcatctgcaagctgagggtgtttgttctagatgagtgtctcaggccaccggcaactgcatgtacctcctccctttctcatttccaatgatgtaccctgtacacgtgttcatgctgtgtctggctctcatctgcacaatcgtgcatagaattgcctcaagtcctggtgagagagatgccgtggtacttttccatttagattcaaatggagctaaaattaagagttttatgagctgttaagaatgaggtagtttctcctaggaccccccaaagacagtgcaagtaatgaccgtttggatctcattcgtcgatctttgatagtatgttctggagtctactccccaggagccaggacaggcgtgaagatggagtccttgtcgcagctggagccttgcctagctggtgatcacacagcctggcctgtacctgcaccccactggatggtggtacatggtggcagggacaggaccacacccagttaaggccagaccaggctgagtgtgacccctgaggtaaacactccactaagctgtgtcttgttcatgccccctgctcagtgaaaggtgagtcccgagaccagttgggtacctctctatgcgaaccagagacatttctggatccaggccaggtgaagattagggccaggaagcctgagcccccggggcctcaaggtagggagccgaagaggctgccaggactctgctgggttgaaatttgccggggaggactcttgtctccccctcaggagtatttttgttgaggctttcctggaggtgaagaagcaattcccattgcagcaggttagagcgagaatcagacagagggcaaaaaccaattcgcttctccccacgttctaaatgctggggcatggctgtcaggagggcttcctgggaggtgtctctgggggtggggtgaggttggggcgatggcctttggagattgcgtgtggtgttcaggactgttccttggtgtttgagggaaactttagtgggattgcagtggaatgtaaggtcagggcacgtgggtgctctctcggggtggggtgactgggagacctagagggaaagcctgctatgcagggggagagcacaggactggccctgctctgcggcctcctttgtcccataacctgaagttaagtcacatcccctgtcgggacctccgtgcactcatctgtcaagtgggggcgcttcccttccagcatcacctgcagcagacgggctctcgggagtcgtgggttccaggcagctgtgtggacccagggacagacattcaaagggacgccagccatccttagtgacaggggccccaacttagcatcccttcccttccgttaggaaggagatgaccggaagcaaccccttcacagacacgagcacatcggcaaaccctatgaaagtggaattttctaacaaaataaacttgcttgtttgatctgttttctgtaacttttgctaaatactttatacatttttcatgttaaagagccgtgtctcccgccagcactcctcaccccggtatgaatgtgtttcctccacattgtatatccttccaccctctggctgcctagatcagtaaataaaattgatgtaatataatttataagtaacactgttgaaaccctgatcccagtggaggctgtaacccacctgcccccgcaccacccccctgacccctgttaccgcatttgtgtgtattaatgctgaagaattaaatgtttaaagagtttaaattttgaaggcgtttgctatatacagttgtcctgcattattataaagagttttcaggaagttaaa

SEQ ID NO: 11581 - DNA, 3386 bp, Homo sapiens
cccccaccctctctcctgggccactgaggagaggggagagagctggtgattccagaagggtgacccggacagcctagctgggggctcccccatattcccaggcccagaagacagacccacagccctgcccttgtctctgaggctgaagaccccctgactcccatgctgtgcttgccgctctgaaacaaacagaggctggaactttgtggtccttgccgagttttgtaggggtcactgtcacatgcttgtgccctggaagccccaaggctcttcctccagctggctcccttgtctccagggctttggaggatcagggtagggagggctctgtctctaagccaggtgtcaggatcagaatcatgggtagaaggtgccattcagctcacagccgcacccagaatcctttgcagccctccttctttatttttttcccattgcattctgggagtccacatctggctttctcagccactgttcatcaccaggggttttaggaggaaggcttggctcctgtcttcccagacccaccatgcctggagaggtcaggatggaactacctcattcggcaaattagccccaaattgagcgctgaatcgtgtcccatgagatcaggcgccatctgtaaagtctcctctggaaatgccaatccatccttcccccagctgcttcctcggggaggcccctgcccccaccctgccagcccttcccagtctcattagaggaagctttccaaagttctcagttatcaagacctcatccagctcgtccaaaggcttcagggatggaaacaaaccagctcgtctcagaggccagcaagctggggcctgtccgccacggtgccctgtgcacctttgggctgccctggcccccactctcccgggccgcccaccacaggctcttaatggggccgggtcagtcctacatgtgagatgggttagggcaagtctttgccatcccccagatggctctgtcttcttgtgtatggcagggctgggactgctgtcccttgtacagttttctgtcactggtgggcactggacaggcatagcagactctcttgtggccacactaggttgtcgcctttcaggcagtgtcccgccacctttgcttcccgctccttctggacattccagagccctgcaccaaacccttacttggtgtctgcacctcctttccctctctccatcttccaatccctggaaaagtctggtctgagtgtgacttgggaagctttcagtgctgctgtttggcccagctcattactttctccctttctctaccacagcaaacacattctccaccatgtcagtctaaagagtctaaaggggccgggagaagcatgagcgaggggcagattctagtcgggagcccatgccctggaaatccatctttcttcatctttcccattgaccactttgggtttgacctgcacatctgcagtgagggcagaattcaacaagcacaactcactggtctttcagtcaacgtgctagaaaccgatgacttattaatctctaattttttggcgcctctttcattgaatgagaattgctttcgtatagttcacattagaaaaatgcctaatatactaaagtaaaccaaacgttgtcacttttctcttgttcttgaaacattgcaaccaaaaaggtcagcacaaaggccttcacctacgtgaagacctcctggtaggatctgtccatgggatggagaaccactctgtccagatctggggttgggtcatgacaccagctaccaattttagaatattatttcttggtttctttatgaaaaatgggtgctagtggtaattgctttgtggcttagtaaactactctgtggatgatttccaaacattcaaagccaatagccttgttattaacaagatattttgagtacaatatggctcattgacttttccattacatctgaggattccagagtcctctgttcatccctgggatagagtgagccctcttgcgtcttccagggtagctcaggttggcccagtttgggccagtccatttttggaggtcactctttcccccctcatcccctcacctccttctctttacccccttcacgtacttcctttctttcttccctctgttattcattcatcaagcaggttaaagccattgtgctaagatctaatctgaggacactataatggccctgtcgtcagggaagcccgtgatcgctcgttttcaggggtcttaccggtcagcaaccttggcattgatacataggcactctacagaatttaagttttcagaggtaagtctgttgttctgattaatctgcattcattcagcgaatgctcaagacaagccaggcatgctgagaagcggcgctctagttgtatgtaagatgggcattcctctgctctcctctattctccatgtcgactgagaagagtataataagaacattgtaccctctccacacttaaccctctgggattctttattataatataaaccaccgtcgtgaggcatttacctgttggatggaaggtagacagcaacaagattttaatcacctggtcaccagaccctcacggcccatatccaattcgaatttcagaaatttctctgtttgctttaaataactctttacaaataagggtcgggcacggtggctcacgcctgtaatcccagctctttgggaggccgaggtgggcagatcacgaggtcaggagatcgagaccatcctggctaacatggtgaaaccccgtctctgctaaaaatacaaaaaattagccagatgtggtggtgcacacctgtagtcccaactattcggcaggctgaggcagtagaatcgcttgaacctgggaggcggagattgcagtgaaccaagatcgggccactgcactccagcttgggtgacagagcaagactccatctcaaaaaaattataaataactctttgcaaataggaaagtgaagctcaagggtaaccagtgaggctatgaaattgccagtgaattaagaccagggctagagtcaacagtccagaacccctatccgtatgaacaggggcccgtttctggttgaaatcaaggttaggatgcaactgagaaaataaaagactgcactttggagaggcaagcacgctatccgggttgttgttttgttttatgtcttggtgcttaggtgaggacttagctgggtttattcaaagtgggcgggtctgggctattcttgagaatgtcccttccatttctgagaacaagtcagccccttctacctgcctccacccaggagactgatgcacaagatctgtttgtgaaagcctgatttaaaaagaaaaaaaaaattccttaagccaaatggtgttccaagttggttgctgtgacaacctccaggaagagccacttgttaccctct

SEQ ID NO: 11582 - DNA, 8994 bp, Homo sapiens
tgtagacgtgtgtgggggcctcctgagctaaggtgacctgcctaagctgagacctgataggcagccacgtgtcagggggtgtctctcaccttcctgccaggtcgctaccccagactcatcctcacttgcctggggaagtgggggtgcccctcccatccctcctccctgcactggcttacagctgatgccctgggtcctgagtgtgcgtctctactctcccaacagcttcacagcgaggtggagaagcccctgatgaacttccgtgagaacttcaagaaagacatgaagaagtgcgaccaccacattgccgaccttcgcaagcagctcgccagccgctatgcctcggtggagaaggtgagaggcccaggacgctgggccagggcaggtgcatgggggactgcctggaagaagggggactgggaagccagcagtggctccatacgccaaggctgagtctttgtccccaggtaggggaatagggggatgtccaagcctcgtgcctacgccagagcaccccacccatccaagggcagataggagctgcctccctgtggtgctggaatgaccacccagagggccaggggtgcgaggagaggctgcagctgcagtgggcagtcgagtggctgttggcgaccagttaaaccccgagcctagcagtgctgctgctggttcacgtggggccccgtgtttaagcctcacctggctgagtcgtcctgactcagtcaccgcctccctgctctccttcctgctcagggatgaggctgagtcctgggtggtctcacctccagggaactgatgttcagccttagagggaagagagtgtgccccagggactgattcccagtccccagtgccttagagaggagaagggggctcaaactgctgggacaccctgggcccagccaactgccgccacccaaggaccacagagatgccagtggtggcctggaggaaaggcagtacagtgaggggaacaagagggccgaggcttgtccagctccagaacgggagggctgttgctacatcctattaagtgctgcagggaggtgacacagatggcctttgtggtcccttccaagcagaggggctgtgactttaggactgcctaggtccccagtctttgtacaggctccatcgggaaaaaaacgtggtttgagagattgaggtaggctgagtccagatgtcactggaagaggcaaggacgaaaagagttgggttgtagcctctacctagctgggtggtgccactctggctgctgggcctctctggaccactgtggcatcatccacacaaacaaggggcgaaaggactccaaagggaagctgggctgcgtggcccaggaggcccactggctccgagctgtatgagcagcttctccgtgtccttggaccccaggcccggaaagccctcacagagcggcagagagacctggagatgaagacccagcagctggagatcaagctgagcaacaagacagaggaggacatcaagaaggcgcggagaaagtccacacaggctggtaagtgctgggcacccgcctggcctggtcagtgcacacagaaggagagggcacggggctaggagatgaggtgactggcgagggtgcatctctcctttgcaagactgcagcgaggaaattacttcccttgtttgccaggaggtaccccctcttcccttctctctgacccacacccagagatctcaaagaaagagactttgggggtcagaggaaggacacaggccgggctagttctggggcatggtagaggctggactccttactctctccctggtcgtggctttttttgttttccgcccaagccccagatctctgaccaggaggtggacaaactccttcatgcactgagagctcagggccctgtccctgttcagagcccacagaagcacacagctcacccaagctgcccacttccccaggaagcaatgctctctctgaaggttcacctatggggatgggctcctgccctgggaacagaggctgacactttgtttaaagaaataaccagatttcagtctcttgggaatagtctcccaatgagttggtttctgcttccacctagtggtcaaagttagctaatacacaaagaggaagagaaggcctggtagaaccagtgaaaacctcggtaactagatctaagggaagccacgtttcactgcacgagaggacacgcatgttgcctctggaattagaatgtgtgccgtagtattagagtttggtctgtaggtccctttcacctcaatttctggtgaacctgttacaattccttcattatagaagaaagcagccaccttacatttcaaaataaggtaagatagaaataagtcaataaaaaataatgtaatagaaggataacgtttattatacaaatcttataatgcacaataataaattacaggatcaagaagtagagggcacagtatatttattggtagagagaagggggggcacagaaggggaagagatctgtttaaattattaagttattaaaaaaataacttataggccaggtgcagtggctaacacctgtaatccggcagtctgagaggctgaggcaggaggatcagttgagcccaggagttcgagaccagcctgggcaacatagtacctcatctctacaaaaaaatttgaaaaaattagctaggcatggtggtgcatgcctgtagaatcagctactcaggaggctaaggtggaggatggcttgaacccaggaggttaaggctgcggtgaactatgatcacaccattgcattccagcctgggtgacagagagagactctacctcaaaaaacaattatattgcaaaaacagtattggtacatggcaaaatattttaatcagcagacaagaatataaaatgctattcacagaaataatcaccatctcttcctagtgttttgatttttaaatatttaaatttatatacatttgatcatacaatctatcttctgaacttatttaatatatcttggaaatacctctttttcatttctgtaaatctttttgcccatccattcatgcatatcaaactttttaatggctggccagtgtccagttgtatgattgtacccaaatttgtttcatcattcccttaactgaggtttaggactcttagattgtttcagagtgcttgccagccagtgaagctgtgttattgtacctgcatctttgtgtgtgcctaagaccagatctgcatatagagagaatatagttgctgagtcaaagggtattattcgtcttgatggatatttccaaattgctttccagagagagcacctatcaacagcatctatgaataatgcctgttctctaaatgcttatcaacattgtgtgttatcaagatttgaaattggtagtgagtggggaaaaatgatattttgtttttaatttgcttttctccataacccaggttgagtatgtaaaatatacatataaatcattgttgtactttctgtgaactgattaactcatatcctttccccactgaccatagattctttatctatcagggagatgaatcgtttttcattttaattgcagatatttttcctagattgtcatttgtcttttagttttgttctttgtaattttttttttttgcttgtttgtctattttttcttgctgtttttctgtacagtgatatttcccataagaagcctagatttcggagctgatttagatctttttttttaatcacctagagggttttttcttactttttttttttgtttcaggtgtttatttttgtttttgtttttaaaatagtgaaggccggccgtggtggctcacgcctgtaatcccagcactttgggaggcccaggcgggcagatcacgaggtcaggagttcaagaccagcctggccaacatagtgaaacctcgtctctactaaaaatacaaaacttagctgggtgtggtggtgtgtgcctgtaatccaagctacttgggaggccaaagcaggagaatcgcttgaacccagaaggcagaggttgcagtgagctgagatcgcagcactgcactccagcctgggcaagagagtgagactctgtctcaaaaaacaaaacaaacaaacaaacaaaaaaagacagtgaaatatgtaacccaccagacatttatttttccttacactggtggtctaaccatattccacaggttcttatttgtggtggttttatttctgctattttcattatgttttgctatttgggttttcatttgatcttcgaaccaagaattgtttcaaagaaaatctttatatgtttacaagcaagggctttgttgttgttttctaatcttgctatttttttttacatagttttattgcattgtcatcagataatacggtctctcattcctgtagtttggaattattttgtgacgaaagtgacagtccttagacctaactctgaaaaataccgcctcttctgagcactcgctgtggccagcctccatgctttagagcattgtctcttttgatcagcacagtccccctgcagggaggtatttttataccctttacaaatgagaagactgatggcagagaaaatgagaaccttccatgaggtccacagtggtggagcggcgaagccacaattcagtctcctctcattccagagactctgcttgtcgccattttgctggacagcctgttgctcaggaaatgccacctgttctttccttctgttcctttcctccctcttcctcatcttttccaaggctactagaaggaaagacatcagatcctcagggatcatcatcatcatcatcatcatcatcatcatcttcatcaccaccatagcccatattaatatttggctctctacgcccatctctattctaagtgctttacatattttgacatatttattcctcataacaacttggtaaaggtacaatcgttatctccattttacagatgaagacacggaggcaagcgcaggataaccgacttgtctacgattacatagctaataagtagttgagctgggatgacaacaaaggcttttttttttttttttttgagatggagtcttgctctgtcgcccaggctggagtgcagtggtgcgatctctgctcactgcaagctccgcctccctggttcatgccattctcctgcctcagcctcccgagtagctgggactacaggcgcctgccaccacgcctggctaattttttatatttttagtagagacggggtttcaccgtgttagccaggatggtctcgatgtcctgacctcgtgatccacccgcctcggcctcccaaagtgctgggattacaggcgtgaggcaccgcgcctggccaacaaaggcattcttgtcccacaatccatggtcttaaccaatactgttctaaaaagttccaatttcaagctcttgggctgccatagagagaaggtacagcccccttcacctactctgtttcccaatgctgtggaagttcctgaagcaatttctcaaaatcagcattgacacacagggctcagggagtttcacagtgtacagagcagcacgccgccctcctcctcggccaggcaggagctcttgctagaaatgcatttgcatttcggaggctgaggcgggcggatcacaaggtcaggagttcgagactagcctggccgatatggtgaaaccccatctctactaaaaatacaaaaactagccaggggtggtggcgcatgcctgtggtaccagctactcgggaggctgaggcagaagaatcacttgaacccgggaggtggaggttgcagtgagccgagattgcgccactgcactccagcctgggtgacagagccagactccgtctcaaaaaaaaaaaaaaaaagaaaaaaatgcattttacggtgcagcatccactttcttctctccggttcagtgcctcttgggatcaagggtccagtcattggccttggaccaagaacaaaatgaataaatgccttggtgtgggctctgttattcaaggcacactcgcgtctggtgtgtggcatagctaggggtatggttcgcagctaggcctggggcctggagacataaccttccctgttctctttgactttcctatcagagtacctatgagccacaatgatgatactataggagtcactttgactctactcgaattactaaattctactctagcattctgcttctagaattactagagaaaattacttcactttggggttcactcatgagctttttccatcgtgagcaaacaccatgatgccttcctcttgctggagccctgtgaggatgaggaagctacgctgagacaaagccgtgcatgagagctgtgctgctctgcctgccacgtgcacacacattaccagagcgtctcataaacatgcagtctctgattcagtaggtctcggatctgtcctgggtttctgaatttctagccgaccccagggcatacaagtgccactggcccacagactgtgatttgtgtagcaaggttccaaggtgctggtacgcttagtaatgtttgcaattacttcgcagtgtgttttctttctaattacaaaatgttctaaacatacatatgataacaaagtaatagagtagtcctaaagattgaatagttatgtttgcctcggatctttctgtgatgacataaaatgcaatagaaggagctgattcctgcccactcaccctttctctgtttcccaaggtagccactctcctgaagctggggtgtgctcctccagtgcatgttttagactgtgactacagatgcgttcttttgtgtttcagaaggacatcttgcagtgtgttcatgcacacacacacacacacacacttacatgatctgcaaatttatcttccttaattattcttagcaccaaattgtgtgtgacatgttttaaccaatctggactccccagtgtaaaataaaactgccatctttagagagggaagcatttcttgggctcatgataggattgggggtcctaggaataccctagacacacacacacacacacacacacacacacacacacacacacacacaaaatgagaaccaccatcctgaatccttggtatctggggtcaggcttcagggggacacctgagctgggttctcatggggctgggttgcccccttccttccctggctctgctttcttcttcttcctactgccatcccttttccagctttccagcggccaccatgaccccagggggaggagaaggcttggctgtggggctcagggtggggcacagagtcatggtgaggataggatgcttcatgatggtgactgtggtctttttccaggagacgacctcatgcgctgtgtggatctctacaaccaggcccagtccaaatggtttgaagagatggtgaccaccacattggtaagcgggcagggatgtgtggacatggcagtacagaggctgacacagagcagcccctggtggttgttggtgggcgcggggatgatggggtggagtgaccctggagatggtcatcaaatctacttcagtgttggggtcgaaacctcaatgtgagccagcttatgtggattcagatctctgctccagcgcttcctagctgtgtggatgtgggcagggttgggttggatatggctacatccttcttgggctgtcccctgagaggtcagggtcaactgaggactctcctcaactaagtggacaagggcctctttaggaaaaatagccaagctataggaagagaggaccgccccacacatgcacacacacgagttgcaggtccttggtaggagatccttgcaaagtggatggatgggtgaggatggagctaggcagtggggtgggggaggcctctcaccaagggtgaacaacaggcggcagggccgatgatgctcttgagtatttcttgtaaaggggcagcatctccttatcagtcagcacctgcctgagtggacagtgaagtgtggctggtacttgggccagatgggacaggaggcatcatgccaggtgctcatcggatcagcccactgcctaaagccacccctgtccatccagcacaggactaaccagctgccttccccaggtgtcagcccaccagagcagattagaggcctccaccagggacagtgacctagttttcctcctggttaatctcctaattaagccccctgctttacccccctttctgattaatcacctgggcagtgacctagttgtatgcagagtaacagccggatcccctagattccaaagacacaaaaccatctagaaaccagaggacaaaccctttccacgctcccctttgacaaaagctgtgccacgtgcagcccagtctgcctccctggcccggtctctattgcggccacagcactaggcataggcagaggaagggaggctgctcagcagaggcccagggacaaggtcccaggaatgtgtggcatggagctcccacatgtgcccccttgttataccccatcagggcaccagggccagggctgcatgggtgcattgccatgagtaacagcctgatggactctggtttaaatcctgttcctcccataattccgtgtcgctttgggtgagctgtgttgttgcctctctaggtgttagttccccagttcccttgcttggagaatggggataataacagaaacgatctcttaaaattgtaacgaggacagttaaggaacgcacgtaaagccctcagcactgtgcgtggcggagcaggatttcaggaagtaaaacagccgctgctgctgtcatcagcttcaccttcaccttagatatggggcacgctcttcatcagaccccagagagtcagatgggacagaatgtccacagccagtgacttgcgttttgtggtcttggtggggggacccccaagtggaggggacgtgctcagagttctctggcctttgctttctcggcaggagctagagcggctggaggtggagagggtagagatgatccggcagcacctgtgccagtacacgcagctgcggcatgaaacagacatgttcaaccaaagc

SEQ ID NO: 11583 - DNA, 1459 bp, Homo sapiens
ccttccacccacctccccccatggcccgctgcacgcctctgggccccctggcacagccaacccccccagtgcaaaccccaaggccaagccaagccggatcagcaccgtggtctgatgaatggagagagtgagctggggaacaggaaagtctggggagccacaggagagggaccttgcaccctctttgcttcctcggttttttcaaaaatatatatacacatagcaatgtcctcctccccatgtcctccctgccttgggacccgtcctctcacccccagcagttgccatggggtttccttccagattcgaggatccttgccacttgaagcctggactcagggtgctccagcgctggggagtggtgagggccttccagagatcctcgtactctttctcccgtcttcttcttccccacttttccctggaggtctagctctgtggcctcagacctctgggcctgtgtgagctctctgtgagctctggctggcggagaagggcaggtgtccggagctgtcggggtgaaggcttccctggggctcctctggccgtgtggggctaggagagcgctctgtagagttgtggccaaacttcagctggcttggccctctctctgacctcagggcctggccacacacttccatgtgtctttttgcctgctggaggacacggaccattgatgcacttggtgggtgggaccctgcttgtgttggccccacgtggggcagtgcttcctctctcgagccagtctatgccctttctccagtaggccccagcccagacctcttcggcttcaggaacttgcctcgccctgcaacgttcttatcctgatcaaagtccagacaggttttggggggggctcaggtctgggatgagaagggcactgccctccctcacccatattgcatgcccccccgccattcccttacacctaccccacctacaactgaagacaatgcactttacagatatcacccacacacacctcgctggggcaggggcacccagcatcagccctggggagagaggctcccaaagggccaccatgagcccaagatatccttcctgaggcagagattgaagccatcagagctggggttgggagccagaatgcctgagtccttctgtccgtcagaatctccgctgcctctccagcccttttgcagccctgtttatttattataaatatattttttacaagccccagctcctcttcttgccccgcatatccagctcctcactcagctcctgcctccctctcccctctccaccatgggctgcagtatagacagacagatggaccctggctgtacgaagggccagggccactggggcttgggggcgggggagggtggcagtgggaggggctgtatggagaggagctggggttcaggcattgtcttttttcctccttgtatataagaatgtatatttgatgcctcataaaagaccttgtgctcac

SEQ ID NO: 11584 - DNA, 607 bp, Homo sapiens
tttccaaagctcagcttttagcgctcaaatcctggctcggtgacttgcctgtgctgcatttggcaagtcacctagcccttcagagcctggccttccacctgtaagatggggataacaaccttgcaggacagttaacagatgcatgtgaagtgcctacctcatgccagacacacagtaagccacctacagaaaccccttatcttgacatgggaggtgttccacaaggtggcccagccaatctctgtggtcctaactctcattcctcacccacacattggccatccacttactattccccaaaaatgcctctgtgtactttccaaactcagcattttacttgtggctttcccccctgccacaatactccccccaacatccctgatgaaggttttcccaacccttgcaagatgggcttgaagaacccatccttcacaaaatgtgcccttcatcacatactctgagatccttccccaccaggccttaagtggcttgggagtgacactggtctgaatcatctccatccagaacattgccccatatagtgcctggcacagcacagatggcactaaaattttgttgatcaaatgaatgaatgaatgaatggttc

SEQ ID NO: 11585 - DNA, 3705 bp, Homo sapiens
ttttttttttttaagcctgagctctttaaaaaatgtttctatctagagctttctaatgtggaactctagaaggtttattagaagaaaatgagaaatactggttgagcgtggtggcacatgcctgtaaccccagcactttgggaggctgaggtgggtgtatcgcttgaggtcaggagtttgagaccagcctgaccaacatggtgaaaccccgtctctattaaaaatacaaaaattagccaggcgtggtggcatgtacctgtagtcccagctacttgggaggctaaggcagaagaattgcttgaaccccagaggcagaggttggggtgagccaagattgtgcccctgtactccagcctggctgatggagtgagactctgtcttgaaaagaaaaaaaaaaagtaagaagaagaaaatgagaaatagttcttataagatgcggaaaaaaacagcactacttgggaagtttaacaatgtatgtactttgaaaaggagagggagaagcaggaaagttggagttgggggatgcaggtaacagaggcgtctgaagaactgaatgtgcttaaagctcctttcttggacgggcctggtggctcacatctataaccccagtgctttgggaggctggggcgggaagattgcttgaggccagaaacccaagaccagcctgggcaacatagcgagatcccatctctacaaaaaaatttttaaaaaattagccatgcatggcagcacacacctgcagtcccagctacttgggaggctgaggtgggaggattgcttgagtctaggagtttgaggctgcagtgagctatgactgtaccactgcactccagcctgggtgacatgacagagcaagactttgtctctaaagaaaaaaaaaacaaaaaacacttgtttcttattcagtgtcagtagagaaatctcacccacgccaggctaacacagggcaggagagtatctgtgaacaagttttcatttctcccaaagggtccacaggttctgatatgtggatttcagctcatgaacttttaacaggacaaacaagtcatacagattcatctgaacaactataacacaggacaagttctagggcttgtaaaatccattattttaattttcgatgcttgtcttgtaaatctaatggaaggatattttacctcagcttatgaataaaaataataattgtagctcccagtattaagtgactaacaatggctggtaatttactaacgtcatctcacttcacccttgcaaaaaactccaagaggaactaaatacctcattttacagacaaggaaatgaaagcccaagtaggttgagaagatttgcccttagctgcagagtgagacagacaaagcagaaatggatttaaggtctttcagattccacttccctatgtcatctagtagccccgtgacagagatgcctactgtgttctttcaccccagcttcatctgcccaatcctgggaaagctgaaagactggctattctattaccatgttattatggaagaggcagagaaagatgctgtcttgaaactcaaggcatgcactgcactgctggccaggccaatttccagcccctgaagcctttgcccgatttttgcatcccctcgccctcagtgatgtttaagcaagttttctgagttgcctcacatttctagttttcctcttgctggtctccagggacaatggataacattgagtcactcttgctacatcttttcttttttttttttttttgagacagagtctcactctgttgcccaggctggagtgcagtggtgcgatcttggctcactgcaacatttgcctcccgggttcaagcagttctcctgtcacagcctcccgagtagctgggactacaagctcctgccaccacgcccagcttgtttttgtatttttagtagagatggggtttcaccatatttgtcaagctggtctcgaactcctgaccgcaggtgatccacccgcatcagcctcccaaagagctgagattacaggcatgagccactgcccggcctctacaccttctattaatagttgctgttccttgctgccttctcctgggaggctaagtcaacactggggatgatgggtatgcagttagaaataccaaggaatgggaaaacagtgtaaggagcatgtctgcatttctccacactagagccagccaaatgggacaagtgtgctcaatatagttaagacacattaaatgaaatgtttctcaaattgtctattacctagcacctgaagctcggccttcagtatttctccaaaggccctttaaaacaatgctagagtgggctcagctgtgcagaaatcttgtggtttctgctcatggtggaaccacatgctaattgtgctcctcagagctccaagcagcagacatcaaaccttggcagcaacactcagaccttcctatgccagtgatttgcaggaagctgtaacactgcatgggatttacacagggtaaacaactcacttaggcctctgaaggtccagctgagctctaatgtttacacaatgattcttcttgggctttggcaatctgtccttggtagctcgatttggggacagccactctcctacaactgccaggagccacataattgccttttcaaccacagtgactttaaatgagcttccaaatcacttttttttcctgtttctttttctttaatttataaaaatctcaaagacaactgaagaaagtagttgttgaaagttgttctaaaaaattgcctgactaaaatgggaggatgggcaaaaatcatttgcataaccacttgcctatatcaattaaatttcaattttatgcatttctcaggcctttaaacttaaaacaattttccaaatattaatggctcatttttgacacaatctttcttccactgctcaacctaaatcctcctctggctttaccccccacacttaggaagagaaaggataaaagggtaaagatagtcatacatgacccccatgaacaaaaatagtagtcaggggaaaagacacagatgtagagttgggtactgagtctgggtggggtgggaaaggaagaacaaacaaaagggcaaggacgtcaggaagcccagagagcttgggggaaagcattacaaagctgtctatgttttagttaaaggccatcaagttctttttttttttaagagacagggtttcactttgttgcccagactggagggagtacagtggtgtgatcgtagctcactgcagcctcaaaatcctgggctcaagtgatccccctgccctgacctcctgagtagctgggattacagatgtggcaatcaagttctaaagaatgcaaaaaaaaagaccaggatagggtgtacagtagttatagaagacacagagaaaaaaatagaactctgaagaagagaatgaggtggggcaaaaaataagttaaaggagaaagtttgggagaaccatagggttagaagaagactcaccgtcttcatctgctatcgaactcctgggccgtgaaggtggaaagggagtaactgctaccgtttcttaactgtcccacaggccagtcaatgccttttgcacttgctaggcggagatctcctgggaagctctcattaggagaacgactcagactctcccctgggcagtactggctggagtctggggcaggaggcacagatcccggccaagcatcttcacaatagaattatttgcttgaac

SEQ ID NO: 11586 - DNA, 432 bp, Homo sapiens
ggctagacactgggttctaaaacttgcagaacctatacaagacctgaagcccttgtggaagtggctgtatcttctgaactaaaaatcagaccacaggcacattgatgggaacaggtttttaaagtgggactgtcctgaaaatgcactttatctagtcactacatccatgatggtccctccaaagcactacaccaaaaagagttagtctgaaatagttagcctttcccatttctaacatcttgctaatctggattcaaaattcacatacatggaatgaagacccaattccttccctaaagttcatgacaactttaggaaagcacatgaactaacctgcaaagacaagtcaaagaatccactgtatggtggtgacttcgtgttaatcaagtccttgtttctatgcaaatcattttaagtttcagaagagacaag

SEQ ID NO: 11587 - DNA, 324 bp, Homo sapiens
ttttttttgagacagagactcactctgttgcccatggtggagtgcagtggtgcgatctcggctcactgcaacctctgcatcccagattcaagtgattctcttgcctcagcctcccaagtagctgggattacaggcgcctgccatcacgcccactggctaattttttttttgtatttttagtaaagacagggtttcactatgttggccaggctggtctcgaactcttgacctcaggtgatctgcccacctcggcctcccaaagtgctgaaattacaggcatgagccaccgtgctgggtccctaactatatatttccaggcaccat

SEQ ID NO: 11588 - DNA, 3548 bp, Homo sapiens
ccagagcagcccacaggacctggccaagctgcagagaatgtcaccatccagactgtgtcctatggggtacaagaggagctgcgggaccaggaggatgaccaggaggaagaggaggtgagtgcatgaggttaaaatgcagattccagcatgagcaacacaaggagaccccgactctacaaaaaaaaaaaattgaaaattagcctggcgtggtggcatgtgcctgtggtcccagctaatcaggaggctgaagtgagaggattgcttgagcccaggaggttgaggctgcagtgagctatgattgcaccactgcactcctgcctggtgatagagcaagagcctgactcaaaaaaatataaataaataaataaataaataaataaataaataaataaaatgcaagttcccagagccccatcaccagatatcgagatctaagaggcctggattagggcccaggaatctgtatactaccaaagaaaagggacttgggacacatgtacagccgatgctttgagaaacactagctttgagttgactatttcattgttcaatagcacttgttcttgttttcttaattatataaataatttaaacccagcacactcaaagataacattttggtggatgattgtgtaagtctcttattcacattttcccccagcccactccccagaagaaatcttgctgtacatagttttataatctgattttatttctctaagcaacatattttagtattgctccatgtaatttaatgtattcctgagaggtgattgttaatggttacatggtcttccattgtgagttcttccatcatttattaacatagtctcctggtcactggtcattgaaagtgtttcttttttttttttttttttgagatggagtctcgctctgtcgccccggctggagtgcaaaggtgcgatctcagctcactgcaacccccgcctcccaggttcaggcaattctcctgcctcagcctcccaagtagctgggattataggcacctgccaccatgcccagctaattttcgtattttcagtagagagggagtttcatcatgttggccaggctggcctcgaactcctgacctcaggtgatccacccgcctcggcctcccaaagtgctgtgagtacaggtgtgagccgctgtgactggcccattgagagtgtttctcttctttcacaattgctatcctatgatgaacaaccctggatgtaggtatttaccttctttcctcgtgataaattcctaaaagtggaatcattgtgccattgttaaggcttttggtagaaagtgccaaggccagcctacatccccacctgcggcagaagagactgcttgttgctccatgtcactggccactgggcattgccttttaaaaaacctcttgccagcctgatggggctgggctgatcctgggcctggtcaccaaactccactgttttgcagagcgatgccacttcaacggagagtgaaagtgaagacaacttcctcacgctgcctcccagggaccacctgggacttactctcttctccatgctctgctgcttctggccactgggcattgctgccttctacttctcccagggggtaagagcacctggggcccaggtcccttctctggcccgtcactctactggagggcttggcatcccgtctgcaggatggggtcaggggcctggcaggctgggctgtttggctgggtgtggggacactcctgttcatcagcatgtctctctccctagaccagcaaggccatctccaaaggggacttccgcctggccagcaccacctcccgccgggccctcttcctagccacactcgccatcgccgtgggggccggtctctacgtggctgtggtggtggctctggcagcttacatgtcccagaacggtcatggctagtagccagtagggcctgcatcctgactcccctgcccacctgaggaagcagtggggcttggagttgcagaccctatggaaaggcccggcccctgaagatgatcccgtgagagtggcttgctgagggggagacccccattccacagcctgcagagctcagccttcacttctgcttgcccgctgctcccagccccagagcagggcccggggcgccactctctaacccaggctacagacgggaaacagaaggcagggctgcccaccaggccatcccagcagggcctagctccatccattctgcccattccctagaggatctcctgccctacagccagcccaccacctaccctgccaacctccccacagagaaagagcaggaggttacagggagaaaagggggtgcccagagcacaaggggacccgtcccaatcctttcagcccacagggatcttcacctggggacagcctgagcttcccccaactccactgtctggccccatcatgcccagacctcagcaggccaagaaggaaatacgtggaggcaagggggcctcttgctgtctctgattctagagggtgcttatctctgcatgggcttgtgaggcactgtagattctagatagggaagaggagcctcggtatgtaaactctgaaccaagggcaggttcttggagcttcttcatgcgggtgcaaaaggcagttgcaatgacagagaatagagggtcctgaaatattgctgtactacatgactcttcctactctccccccactccccgcccctatcatccttttctgggctttgcctgggggtccgtgagctggtgccatcacaagtagactagacccagagagtgccctcagctcaccagccactgagcgcacggccctaggtccagccctacagaaaacgcagcaaggagagaccctagggagtagtgagtatagatgagggaagggactcagggaaggaatggcctgctgagtagtcagcggtgcttaggaaggcttcctggaggaggtatcccttgagcaagtcctaggatgaatagaattcatctaagggatttggtcacataactctttgtatttgtaggcagggatgtggcaggaaccttccatgggaagcttccaggctgtttggattctgcctggaacatctgggctggagccaaactacagccattcctaagggttctgccaactcaaggaggaacgtcacacctgtctctcaaagaccaatgatgttttcccatctctgaatgctagggggtcagtggtgggtacctggttacccctggggcatcttcactgatatctctgctcagtgccagtctcaacaccctcagccactagggcacatccagaattttagagacatctccaggtaggcggggggcagcaccaatgtgggcaggcctgtctggactcaagctacaggcccctgctgtgcatgatgtgggaacctggtcattcccatgccccatccagagcccagggctgtggctccaccactgagcatcccttgtcccactgtcctcccctgcctcgggcactgcccagccctccactcctgcatcacagcagttttaaggtcccattattgtactgatttatccttgtaataaatgtttctgtaacacctgg

SEQ ID NO: 11589 - DNA, 7237 bp, Homo sapiens
cctattggtagcctcttttacttttttatttttttatttttgagactgagttttgagttgagttttttttgagaccgagttgttttatttccgcacatgaatggtagttccagctactcaggaggccaaggtgggagaagcgcctgagcccaggagagaaccatcgagaggtaattcacatggagtacagttcgcccaactgaagtgtgtaattcgagttttcagcatattcaaagttgtacagccatcaccacagtcaactttagaccattttcagcccaaaagaaactgggccatcgcccctctgtctccccgccacctgcacgcatcctcccggcctcaggttccgggccgtgtctgttctggccatgtgttacgggatcacgcagcaccgtggttccagggctcatccacactggagtctttccttcatatggctgagtgacatcccacggtacagacagtgcattgcatctgcccgtttgtccactgatggacgtttggggtgtttccgcctttggccgtcttgagtcacgctgctgtgtaaggatgagtttgcaggggatggatgctttcattcctctggggcagatgcctaggagtgtcatggctgggttttgggctcaccatgtctagtcggttgaagaactactttccagacttttctacagtggctgcatgcgttgagttgagcctcggggatgggcccctgtctgggtgttctgctatggccaggctgatgggatcccaggaggtgactcttctcaggacacttggcccagccactctgactttgtgaccaggacgggaagcacctgtggttccactcgcctgcctgtggagtgggagtaacagcacagggctgggatgaggatgatgttgctttttcctggaaaaacaatctctcaaccttacagaaacattgcagacacacagcatttctcccccgagccttttgagagcatttcctgacttggtgccccagcaccctggatactttgtggcccatttcctcctacagagacattcccttaaccacagcacagtggtcacagagggagctagagccaggtgtggtggcatgtgtgtagtcccagctaccctggaggccaaggcgggaggatcgcttgggcccatgaatttgagtgagcctgggcaacatcaagaccccgtctcaaaccaggaaaaatcagggaattagcgtggatacctcactgtgtccaaccctcgaaccctcagtccttggttgtctcagtgaagtcgtttgcagccctagggccctgttcagattctctcatttctctgaagatctctagctcctgtgaggggagggtggtgtttagaagccgatctggctgggcccttgctattccgatctcattgttcacaggtgttctcagctggcagagctggggcagtgtgtgcacagcgcatgcctgttctctacctgtcccgccagccaccctccatctgtctagattaaggtcttcagaaaaaacagaaccaatgaatgggttttgtgtctgtccactccagctgcgagaacaaaatagtagggactgggcagcttaggcctgggagggtgagtttccgttctggaggattccgagggagtgtcggcagagttgcttttcctgggccccctccttggcttatcttaatcagtggccaccttctcacggtgtcctgaccatatttatttttttttggagaaaaagtgtcgctctgtcgcccaggctggagtgcaggggcaccatctcagctcactgcaatctccgcctcccaggttcaagcgattctcctgcctcagcccctgagtaactgggattacaggtgtgtgccaccacgcctggctaatttttgtatttttagtagagatggggtttcaccatgttgatcaggctggtcttgaactcctgacctcatgatcctcctgcctcagcctcccaaagtgctgggattacaggcgtgagccactgcgccgggccgtcctgacctcccttacaaggatgtcaggaaggttggactggggcccagccctgtgatctcatttaaccctggtcacctccttagaggccccatctccagtcacacggggagttagggcttcaacatgtgcttgtcaggggatacagtcctgtccatagcaggcgtgtgtgtgtggtggtggcggaggggagagtgccctgtttgttgtgaggagtcggctcacaggactggggctggcagttgggagttctgcagggcaggcggccggctggagaccccggaacgtcctcaggggcggggaccccggtcttttaagtccttgaccaggcagactggatgaggccccctctgcagaggcccacctgctttccttagtccaccgattcaaatcagcctcatcctggaaacaccctcaggaacatcggggcgctccacccgaagctgggtgccggggtctgctgcagcgttggccgctcactgtcttatcggctgcctatgcctgccccactcgtgttaggagttgacctctgggagaggcggtgcctccagctgtgatggacacccagggtgtattctagggtttcccttctgtgtttgaacctccctttgccgaaggaactctggcttacattacccccgatactcacttcatgcagaaccgaggcccggagtgggtgctgcgccccttcccgcgtgggtgccctcctcaccttcggctctgccacccccgcgggaaccctcctgcctggtcacctgctttcacacccagctgcgccacctcctgcagggcccccggttcctgtggggctctgacaccaggacacccgctcttcacccagcctgggccgccgtggccccccgcccctacggtgcagctctgcccttgttggccctgtctgaggctcccgagggagcttgagggagctcaggggtgcctggtgagcgggggtctcctggatgctcctcttccaagctcagaggctgacctggcaagtggcagcaccccacctccccatttgaagcccacaaggaggaagaaaagaaacttcttgactcacccatcacggagacccacggccatcccgagaggtgtggccacgtgagcaacaacgctccacgctgggtgtgggcgagggtcttccagggaccctaagccttcttaaagaacaacttggagatgtacttcatgcagcgttcagttccccgttgcgggtgcacagtcgggcggccgtgcactgcagcacagctcattgtagagcatctcagcgccccagagagcaagtcccgacgcagggccccctttacctggaggtgactccggggaggggcctgtggactcgcagggtggtgaggcgagtgtgtgcatgtacagcttcctcccgcagccaaacggtctagaacaaacatgctgtgtcctcgctgacttcagagcttcagtagcaacccacgccacagcttcacagttgacagttgtcacaggctctgctcggaggtgacgttctggggactgagcagcagctctggagttacagacttagaggggccgtctccgggcccccctgctttttcctcctcgcctcggtaccagtagatggagacgccagttgcagtcctgccagcccacagtggctcacgttccaaaggctcttccctgcaggctctcagccagcctgggtcactagaggtgcccattttcctgcctggcatggctgagcagagccaagaaacagccttgaaccccaagacctctccctcagccagaatgttctctgcgtgagcttctcatgctcaaatatgaccgtgacctgtaacatctcccggtaggccttgcgggaagtagaggcattgcacgggcgagggaggtaagcagggagcagcccccggcgagggtaggccctgcagctgcggcaggggtgaggggaggggctgagaggtggacggcaagtcaggcagcgccctgggtgttgtggggcggttcacgcaggggtgtgacctggccaggcaattttggacccacttcctggccgtgggatcgagggtgggtttggggacagttctgccagcagccccggggttggaacatgtctcacagaacttccactgttgcatatactgccttataaagatagaccggtaatggggactgtcccccctcattagcccggaagttcccccagagggcacaagaccccacgcggtgatgttgaggcctggacggtggtggtggatgaagaagaggcctggtttgcagtgtgtgtggtgctgtggcctaccaggaagagggcccaggagtgggcatgcatgtgcccagcccccagcccacgtggtagggagccggccccacagccatagcctggagtctgaaagggaacatctccatctctgatggggaccttttccccaaatggactcttctaccgtgaagagaacggcaatggccagcgccgcggtgagctgctcggagattatccccacaagcatcacttacctctacacagggctggttttacttcctgaaccggattcgccggaaggagctgcaggagactgcctcggagtcttcccgcagggaccatctccccagcgtgcggcctctcccctgtgtagcctctcccccatgtgacctctccccctgcggcctctcccccttgtgacctctcccctgcgtgtcctcccccatgtgacctctcccctgcgtggcctctcccccgcgtggcctctgccccatgtgacctctcccccctgcggcctctccccattgtgacctctcccctgcatggcctctcccttgtgtggcctctcccccatgtgacctctcccctgcgtggcctcccccatgtgacctctcccctgcgtggcctctcccccgcgtggcctctgccccatgtgacctctcaccccgcagcctctcccccttgtaacctctcccctgcatggcctctcccccgcgtggcttctcccccgtgtggcatcacccgtgggttctcattgcatggagccctggccccttactgtgggtgaggagtagggggaggattggccgttgggttctgggttccgcagtccaccgagggcagtctggccctctctgtgcctcccccagggatgttgccggccctttgtccccttctgtcacgtcccctgtcacctgccctctaggacctgcatggctgcagtcccaccagctgcctctggggggtgcccatggccctggaatgggcttgggggagaacgcgccgccccggggcctccaaccctttgctccaggccacttgctccaccctctcttgctgccccgtgtgacccaggatctgtttgggcgagtgcctcgttctctccctgagtggagcttctgcaggtgcttcacgaaggctggcacccacctctacctgtgtaccacggcctgggatggaccctgcagctgtggccctcctggcactatccctaccctgtgccctggtgggtgtgcagtgggaacaggcaccctggggtccttggaggctcagcctcctcagccctcacccccgagaccccatcgtggcgcctgtgtccactcagggattatcccaagcctggccagaggtcgggaggggacagagggagccacataggagcctctaccagcccctttcttaccacggggtgggggcgcttccctcccacagggtctcaggcttgtgggctccccccagctgcccaggccccagagggcacttctgacccttctctttggggtctgccctggggggctccaggccacttgctccaccccatccctcttctggagcctcccagcacctcagttccgactgtggggaaaacagaaccctaggaagcaacctcacggctgtgggcaggggagggcggccgggagccccagctgccccacagggacattgagtgaaggcagagcctgggagggaagtcagatccgtgcatgggtcccttcctgttggtgttggcgtccctgagtgagcagccatccgccgccccctggaaagagacctggagaagcagcttcaagctttggagcccagcccagctgctagcagcccctgggtcacagtgcgaagggggaaggcaggggcttgaggaagaaagtgagaggattgtgcctgggggcccctggagggccagtctggaggcgcgttggggtgaggcggtgctggctgtgcccgtctgagatgggcagagggaaggcgcccagggctgagcccagggtccccaggccagtccctcactgctctggggttcagtttcctcacctgcacaaagggcgggtcccgtgctctccggaggccacacggggtctccctgaggcactgagtctggcttgtttctggaaactgaggcacaggaggacgttgataaccggccttcctctgttctctttcccaggggtgcagctcgtccgtcccatggtttcagatttgcccggtgtgttgcaaccaccacctggcactcagcttgcccggtgccgcctggccccgcagcctttcccaggccttgcaagggtggcacagatggggaaactccatctgcaggggcgtcacccccgagggatgtgtcctccacactcccttgatggtcacgtgggtcccgggagggcgcgtgtgactcttcccaggattgcagcgttggggcgttgtgccagcctggccccgtgggtgcggagtgccgtggacccctcggccctcctgaccttgtttccctttgatgtagaagtctgcatggcatgaattccagtgacaatgggccgggccaggctccctgtgcccctggtaccgctgcccagggccggtctctgcagtcaccctccttccttcctggtggctcctccctccctcctttgttcttctttcttttcctgcctaaatgtttatcgagtccctcctgcattaagtacccgtgctgtgcaacaaattaccttgaacttggtgacttcaccaccactgcatgtcagcgcccagccgtagacgagggtttgggaggcatggctgggcctgcccagggctccctggctgaagtgggtgctgaagctgccaggcactggaggctgggcctctcgcacactccctggctgttgggagggtgcattcttctttcttccttgtcttctagaggatgcactcttggctgtaggcctcccgtttctctcacgggctattcctggggttccctcagatcctggaggtgcccacagcccccttccccgaggctcccccccccacacactttgcttcttcag

SEQ ID NO: 11590 - DNA, 7233 bp, Homo sapiens
  misc_feature (6195)..(6195): n equals a,t,g, or c
cctattggtagcctcttttacttttttatttttttatttttgagactgagttttgagttgagttttttttgagaccgagttgttttatttccgcacatgaatggtagttccagctactcaggaggccaaggtgggagaagcgcctgagcccaggagagaaccatcgagaggtaattcacatggagtacagttcgcccaactgaagtgtgtaattcgagttttcagcatattcaaagttgtacagccatcaccacagtcaactttagaccattttcagcccaaaagaaactgggccatcgcccctctgtctccccgccacctgcacgcatcctcccggcctcaggttccgggccgtgtctgttctggccatgtgttacgggatcacgcagcaccgtggttccagggctcatccacactggagtctttccttcatatggctgagtgacatcccacggtacagacagtgcattgcatctgcccgtttgtccactgatggacgtttggggtgtttccgcctttggccgtcttgagtcacgctgctgtgtaaggatgagtttgcaggggatggatgctttcattcctctggggcagatgcctaggagtgtcatggctgggttttgggctcaccatgtctagtcggttgaagaactactttccagacttttctacagtggctgcatgcgttgagttgagcctcggggatgggcccctgtctgggtgttctgctatggccaggctgatgggatcccaggaggtgactcttctcaggacacttggcccagccactctgactttgtgaccaggacgggaagcacctgtggttccactcgcctgcctgtggagtgggagtaacagcacagggctgggatgaggatgatgttgctttttcctggaaaaacaatctctcaaccttacagaaacattgcagacacacagcatttctcccccgagccttttgagagcatttcctgacttggtgccccagcaccctggatactttgtggcccatttcctcctacagagacattcccttaaccacagcacagtggtcacagagggagctagagccaggtgtggtggcatgtgtgtagtcccagctaccctggaggccaaggcgggaggatcgcttgggcccatgaatttgagtgagcctgggcaacatcaagaccccgtctcaaaccaggaaaaatcagggaattagcgtggatacctcactgtgtccaaccctcgaaccctcagtccttggttgtctcagtgaagtcgtttgcagccctagggccctgttcagattctctcatttctctgaagatctctagctcctgtgaggggagggtggtgtttagaagccgatctggctgggcccttgctattccgatctcattgttcacaggtgttctcagctggcagagctggggcagtgtgtgcacagcgcatgcctgttctctacctgtcccgccagccaccctccatctgtctagattaaggtcttcagaaaaaacagaaccaatgaatgggttttgtgtctgtccactccagctgcgagaacaaaatagtagggactgggcagcttaggcctgggagggtgagtttccgttctggaggattccgagggagtgtcggcagagttgcttttcctgggccccctccttggcttatcttaatcagtggccaccttctcacggtgtcctgaccatatttatttttttttggagaaaaagtgtcgctctgtcgcccaggctggagtgcaggggcaccatctcagctcactgcaatctccgcctcccaggttcaagcgattctcctgcctcagcccctgagtaactgggattacaggtgtgtgccaccacgcctggctaatttttgtatttttagtagagatggggtttcaccatgttgatcaggctggtcttgaactcctgacctcatgatcctcctgcctcagcctcccaaagtgctgggattacaggcgtgagccactgcgccgggccgtcctgacctcccttacaaggatgtcaggaaggttggactggggcccagccctgtgatctcatttaaccctggtcacctccttagaggccccatctccagtcacacggggagttagggcttcaacatgtgcttgtcaggggatacagtcctgtccatagcaggcgtgtgtgtgtggtggtggcggaggggagagtgccctgtttgttgtgaggagtcggctcacaggactggggctggcagttgggagttctgcagggcaggcggccggctggagaccccggaacgtcctcaggggcggggaccccggtcttttaagtccttgaccaggcagactggatgaggccccctctgcagaggcccacctgctttccttagtccaccgattcaaatcagcctcatcctggaaacaccctcaggaacatcggggcgctccacccgaagctgggtgccggggtctgctgcagcgttggccgctcactgtcttatcggctgcctatgcctgccccactcgtgttaggagttgacctctgggagaggcggtgcctccagctgtgatggacacccagggtgtattctagggtttcccttctgtgtttgaacctccctttgccgaaggaactctggcttacattacccccgatactcacttcatgcagaaccgaggccgggagtgggtgctgcgccccttcccgcgtgggtgccctcctcaccttcggctctgccacccccgcgggaaccctcctgcctggtcacctgctttcacacccagctgcgccacctcctgcagggcccccggttcctgtggggctctgacaccaggacacccgctcttcacccagcctgggccgccgtggccccccgcccctacggtgcagctctgcccttgttggccctgtctgaggctcccgagggagcttgagggagctcaggggtgcctggtgagcgggggtctcctggatgctcctcttccaagctcagaggctgacctggcaagtggcagcaccccacctccccatttgaagcccacaaggaggaagaaaagaaacttcttgactcacccatcacggagacccacggccatcccgagaggtgtggccacgtgagcaacaacgctccacgctgggtgtgggcgagggtcttccagggaccctaagccttcttaaagaacaacttggagatgtacttcatgcagcgttcagttccccgttgcgggtgcacagtcgggcggccgtgcactgcagcacagctcattgtagagcatctcagcgccccagagagcaagtcccgacgcagggccccctttacctggaggtgactccggggaggggcctgtggactcgcagggtggtgaggcgagtgtgtgcatgtacagcttcctcccgcagccaaacggtctagaacaaacatgctgtgtcctcgctgacttcagagcttcagtagcaacccacgccacagcttcacagttgacagttgtcacaggctctgctcggaggtgacgttctggggactgagcagcagctctggagttacagacttagaggggccgtctccgggcccccctgctttttcctcctcgcctcggtaccagtagatggagacgccagttgcagtcctgccagcccacagtggctcacgttccaaaggctcttccctgcaggctctcagccagcctgggtcactagaggtgcccattttcctgcctggcatggctgagcagagccaagaaacagccttgaaccccaagacctctccctcagccagaatgttctctgcgtgagcttctcatgctcaaatatgaccgtgacctgtaacatctcccggtaggccttgcgggaagtagaggcattgcacgggcgagggaggtaagcagggagcagcccccggcgagggtaggccctgcagctgcggcaggggtgaggggaggggctgagaggtggacggcaagtcaggcagcgccctgggtgttgtggggcggttcacgcaggggtgtgacctggccaggcaattttggacccacttcctggccgtgggatcgagggtgggtttggggacagttctgccagcagccccggggttggaacatgtctcacagaacttccactgttgcatatactgccttataaagatagaccggtaatggggactgtcccccctcattagcccggaagttcccccagagggcacaagaccccacgcggtgatgttgaggcctggacggtggtggtggatgaagaagaggcctggtttgcagtgtgtgtggtgctgtggcctaccaggaagagggcccaggagtgggcatgcatgtgcccagcccccagcccacgtggtagggagccggccccacagccatagcctggagtctgaaagggaacatctccatctctgatggggaccttttccccaaatggactcttctaccgtgaagagaacggcaatggccagcgccgcggtgagctgctcggagattatccccacaagcatcacttacctctacacagggctggttttacttcctgaaccggattcgctggaacgaactgcaggagactgcctcggagtcttcccgcagactcatctccccagcgtgcggcctgtcccctgtgtagctttcccctatgtgacatctccccctgcggctttccccctatgtgacctctcccctgcggtcctccctcatgtgacctctcccctgcgtggcctctcccccgcgtggcctctgccccatgtgacctctcccccctgcggcctctccccattgtgacctctcccctgcatggcctctcccttgtgtggcctctcccccatgtgacctctcccctgcgtggcctcccccatgtgacctctcccctgcgtggcctctcccccgcgtggcctctgccccatgtgacctctcaccccgcagcctctcccccttgtaacctctcccctgcatggcctctcccccgcgtggcttctcccccgtgtggcatcacccgtgggttctcattgcatggagccctggccccttactgtgggtgaggagtagggggaggattggccgttgggttctgggttccgcagtccaccgagggcagtctggccctctctgtgcctcccccagggatgttgccggccctttgtccccttctgtcacgtcccctgtcacctgccctctaggacctgcatggctgcagtcccaccagctgcctctggggggtgcccatggccctggaatgggcttgggggagaacgcgccgccccggggcctccaaccctttgctccaggccacttgctccaccctctcttgctgccccgtgtgacccaggatctgtttgggcgagtgcctcgttctctccctgagtggagcttctgcaggtgcttcacgaaggctggcacccacctctacctgtgtaccacggcctgggatggaccctgcagctgtggccctcctggcactatccctaccctgtgccctggtgggtgtgcagtgggaacaggcaccctggggtccttggaggctcagcctcctcagccctcacccccgagaccccatcgtggcgcctgtgtccactcagggattatcccaagcctggccagaggtcgggaggggacagagggagccacataggagcctctaccagcccctttcttaccacggggtgggggcgcttccctcccacagggtctcaggcttgtgggctccccccagctgcccaggccccagagggcacttctgacccttctctttggggtctgccctggggggctccaggccacttgctccaccccatccctcttctggagcctcccagcacctcagttccgactgtggggaaaacagaaccctaggaagcaacctcacggctgtgggcaggggagggcggccgggagccccagctgccccacagggacattgagtgaaggcagagcctgggagggaagtcagatccgtgcatgggtcccttcctgttggtgttggcgtccctgagtgagcagccatccgccgccccctggaaagagacctggagaagcagcttcaagctttggagcccagcccagctgctagcagcccctgggtcacagtgcgaagggggaaggcaggggcttgaggaagaaagtgagaggattgtgcctgggggcccctggagggccagtctggaggcgcgttggggtgaggcggtgctggctgtgcccgtctgagatgggcagagggaaggcgcccaggnctgagcccaggtccccaggacagtccctcactgctctggggttcagtttcctcacctgcacaaagggcgggtcccgtgctctccggaggccacacggggtctccctgaggcactgagtctggcttgtttctggaaactgaggcacaggaggacgttgataaccggccttcctctgttctctttcccaggggtgcagctcgtccgtcccatggtttcagatttgcccggtgtgttgcaaccaccacctggcactcagcttgcccggtgccgcctggccccgcagcctttcccaggccttgcaagggtggcacagatggggaaactccatctgcaggggcgtcacccccgagggatgtgtcctccacactcccttgatggtcacgtgggtcccgggagggcgcgtgtgactcttcccaggattgcagcgttggggcgttgtgccagcctggccccgtgggtgcggagtgccgtggacccctcggccctcctgaccttgtttccctttgatgtagaagtctgcatggcatgaattccagtgacaatgggccgggccaggctccctgtgcccctggtaccgctgcccagggccggtctctgcagtcaccctccttccttcctggtggctcctccctccctcctttgttcttctttcttttcctgcctaaatgtttatcgagtccctcctgcattaagtacccgtgctgtgcaacaaattaccttgaacttggtgacttcaccaccactgcatgtcagcgcccagccgtagacgagggtttgggaggcatggctgggcctgcccagggctccctggctgaagtgggtgctgaagctgccaggcactggaggctgggcctctcgcacactccctggctgttgggagggtgcattcttctttcttccttgtcttctagaggatgcactcttggctgtaggcctcccgtttctctcacgggctattcctggggttccctcagatcctggaggtgcccacagcccccttccccgaggctcccccccccacacactttgcttcttcag

SEQ ID NO: 11591 - DNA, 15734 bp, Homo sapiens
ggcgggcgcaggaggcgcgtgctcagtgtgctgggtaccaggcgactccgggacagggggtctcggccgtcggcgtcatggtttcgcgcgtgcagctcccgcctgagatccagctggctcagcgcctggcggggaatgagcaggtgacccgggaccgggcggtgaggaagctccggaaatacatcgtcgccaggactcagcgggccgcaggttggcgggggtgtgggcggctggcgtctcgggggccggctgggctggtgcgggtgtgggcggcggcggccggagctgggggccctccgagccctgtggaacctccacgtggccgggccgggcaggcggggtccactggcctgttcccgctgttaccggcccacggcccccgccgccgctttccctcgtggtgcggtgactctggtccctctgcgagaacgctcctccccagccccgtaacccctttcctagctcaggcgtcccctccctccagtagaccatgtactcctgctgccctgctgtttgggcacccagtatttttccctcatggcagcatttcccactgtttgcagttttctgttttgcgttaattattggattgttttccgatttccactcgagagtacctctctgagggccgagaatctacttcttgttcatggtaccaggtggttctccgagcgtggtcccccatcagcagtagcatcccctggacatttgttagaaatacacgttctatgccgggcgcagtggcccaagcctgtaatcccagctacttggcacgtcgatgtgggaggatcacaaaggcccaggagtccagcctgggcaacatagcaagactccatttccatcgcaaaagaaaagaaagaaatgcaagttctaggatcccagccctactaaatcaggactggcatctgctttatgaagctgttcaagtgcttctgctccccacactcagcctgagaaccactgctgcaggaacaggttgccagacacataggacttcagtgaatgtcaactgagtaatgttttaaattaaaattttttgttatttttctgagtgagacagacctcactgtcatccgtggtggaggagtgcattggcacgattacagctcactgcagcctctacctcccaggctcaagtgagcctcccatctcagcctccccaatagctgggactactggcaccgtgcggccaggccagctaagttttgtattttttgtacaaattggggtcttcctatgttgcccagactggtcttgaactcctggcctcaagtgatcctgcctcagcactcaattccaaagtgctgggagtacaggcgtgagccaccgcacctggcctcagtaatttctgtttctctcgtagtctgaatgcctgagttcactttcttcttttagtatttgagatatattacaggagagtgcagaagccctcagtataatgctggatgaattatcaccaacagattaaccttgtggccactgtccagcttaggaaaccgtcaaggttcgcaattttgaatttccaaaatggagtatggtgcctgataccttgtagatctcagtcggttttactgtgtgcgtgaagtagcagttacctggagtagccgcatagccacaggcgcggcaggttctgggttagaaggattgtttgaaggggagggccagattctgccccccagttgcctttaccgtaagtgggactttggtctcattcaggcagtcacgtttctgtggcttcctttctggcactcgaaggtgtgggattcatttggtccaaccgttgctgttttgatgcaggtggttttacgcacgacgagctgctgaaggtgtggaaaggactgttttattgcatgtggatgcaggacaagccactcctccaggtgagtggggggagcagcagagcaggtacagaagcagcgggggaggatggatgggcatctggtcaacccagtttttcttttttttttaagtcggagtttcgctcttgttgcccaggctggagtgcagtggctcaatctcggcttactgcaacctcagccttctggtttcaagcaattttcctgcctcagcctcccaagtagctgggagtacaggtacctgccaccatgcctggctaattttttgtatttttagtagagacagagtttcatcatgttggtcaggctggtctcgaactcctgagctcaagtgatcctcccatctcggcctcccaaagtgctgggattacaggcatgagccaccgcgcccggcctggtcaacccagttttaatatggccagagaccgtggggaggtcgtatagccttgacgcttggttcggcacggctggtgggcctgggcctttgttaggtgagtcttacacttgctgaggtgttgatgtgattgactgagccgtgcactgcagcagcactggcatgggtgaaaactgggttttgtgtttgtcctgggttgcaaacaagtgctgaaatagtggaaaccacggggcggaattcaagtctcctgagacaaggacgtctcctgctagccttttccaaacattgtttctcaaattgtgaattttgtgctctccttcaaaatctcctgggtggtgagggtacttagttaagttcaggttcctgggccatattccatgcccactgaattatcaaggggaggctgtgaaatgtcccttagcaagtattctgggcgatggctggcacggtgatgtaggcagatagccagtgatctatggggtctcgcagccctcttcctcctgatggttagggggctgtgagtcccaaggctcccttccgctctcccacgtccctctttaaccgtgactctgtggcttagggcacagcctctgtcaagagggcagtgcctgctgtggttgtgtgagaggctgttgaccccagctgtctagaggggcctcccgtggttgtgtgagagcctgttgaccctggctgtagaggggtcttttggagcaggggtgaaacctccagtgcactgagctgagaccccctggaagccgactctctgtgatgagtgagtgagtgagtgggtgagtgggtggttgcgtgtgtgtcattgtgagagcctggtgcttcaggggctgagggcgtttttgttgtttcctacacaggaagaattaggaaggactatttcccagctcgttcatgcttttcagaccacggaggcgcgtgagtatgctctgctgtagttgggtgcatttgtagatgtcagaacctctgagcatcagagccaccagacccaggaggtttgtgttctcaaatccagagtaaggaatgcctaagggcaagagagcgccagctggtgtctgtgggtgcttagcatgtgtgcagtgctggtgtaagtattcaacatggattagctcatttacccaaaaccctcatttcgagcctaatgggctaatatcttacactttaaaaataaagtgaaaagccaggataatgtcaccaagagattggactgaattccgcctgatggtcctgaggttcctgcagttgatttttctgactcctctgttctctggtgaccggagttgagaagttcttaccctgcctgtctgtaggactcacttgaggagcctctaaaaatcctcatgtccagatcctggtccagcaagatccagttctgggggtagggcctgggcatcagcattttttatctatagctatgtaaagaacgggttcctccatgttctcacctccctccccagagtggcttcgtgctcctcagtggttctcttctggcttattccttctccagagcacctgttccttcaggccttctggcagaccatgaatcgcgagtggacgggcattgacaggctgcgcctggataaattctacatggtgaggcagccaccagggtgccggcgggcgggggcagcgcgggtctcagtgcctggccaagcgagacaggcggcacctgggcagggaggcaacctgaggcagtgcgaccctgaagccaggggtgggaggtggagccgagactctgggcggtccctgaccagggctctgcagctttgtccagtctctgagggtcattgaatgggcaaggaattcgacccttaaaacaccacacaaacttttggttcagagaaggaaagtgacgattgctctcctggtgagagtcgatggtgacaccgttgttaccttgtcaaagaggcagagtgagtctggaggcgcagcagaggagctgcggtcacgccctagcatgagccctggagtgcttagcctgcgaggctgggatggatggtcacagtgtgggacttcctttccctcctccctcattgtatccccgttcagggcactgatttgccctgagaatacaggggaacactggggtttagaggtgcagcgtgttgctgcccggacctgcttctctccttccctccttccctcttgttgaaccatgaggtctcgttactaaggtggtggtcattgtaaccttagagcaggcctgagatacagggacattgtcactgtgtaggagtcggtcacccaatggggacactgaaaggggccatgtccgggtctcactgaggacagatgttgatctgccactctggcttcagtgtccagctcagattcgggccaggattgtgcagacagcatatataccagtgattctagaagtggagaccagggcgggaaaggcctggagctcaagaaggaaggaggctccagggcaggccaggggcccggccatgcactcagacagagtgcagactcttagggacaatggggctctgcagggaggccaccctactgttttgctgagatgtggctgctgggtccctggatggatgcgttctgctgctttccatggctcgtttctgggtgccccttgtgtggctgagtccagcagcacagccttgcgtcagggctagcctcggtggcaccgcagggtgttgtgggggataggcctcctgtgtctgcaagaacagtgtccgggctgctgggctgtgctctgtcatcggggctcctgggggtccgcgtgtcctctgctgctactgactgcagctcagaccccactctgggcgtgtgggcatgctgggtcagtagcctaaaggggggacaactgcagaagggtgttgagccccatggagggaaatggcattgttgattcacgggtgaggcttggcgggagggccttcgctgtgtagtggaccgcagaggaagtgagctacattctgcccgttgcggggggtttggtgaggaccagccgtgtttcagacctggttttgcggagggctccaccgcccgtgggggtagccgtgcctctttcctggttctcccttatgaatcggactgttccgtttcagccccggtttatggactggagtcgtaggactgtcccctattacccccgaccccccatgcacctgcttcctgccagctggggccttggagccggggatagggcatgttctcagcccagggttctgagggcttggtggtgtgtcctccagcgtctgtctgtcagcagctctgggggccggctgtgtgctggggccggcagaggtcaccacggccatgactttatcctgcagcggatggtggtacatggggatgggtggtctggcgaagtagggctgggcttctgctaatgccaacctccttctgtgtcaaagctcatgcggatggtcctgaacgagtccttgaaggttctgaagatgcaaggctgggaagaaaggtgggtgcgcggcgggcctgctctggggggacgctgttctcggggaccgcagtcgtgtttgtcatttgattctttgccataaggagatgtcagcctttatattaacgcatgcccccaatcgtgcttagagagaagatagtttttaaagtaaaaatcagtttgtgtgtttgtggaaatgatgccatttatcctcaggcttggaggccagttctcactgggagtcagaagggagttttttaatgaaagggtgtccagccgaggagcttcttataaaaacacggcatgttccgcttcattagcaatgctttttgtttttttgaaataggtgtcactgttgcctaggctggagtgcagtggcgtgatcttggctcaactacagccttgacctcccgggctcaagtgatcctcctgcctcagccgcccaactggctgggactgcagatgtgcaccaccaggcccacgtaatttttgtatctttttttggtagagacgagttctgtcctgttgcccaggcttgtctcaaactcttgggctcaaacaatctgcctgcctaggcctcccaagttgtaagcaatgttaattgctcctaattctaaaaatatgtaaattggctgggcgcggtggctcacatctgtaatcccagcactttgggaggccgaggcgggcagatcacaaggtcaagagatcgagaccatcctggccaccatggtgaaaccgtgtctctactaaaagtacaaaaattagataaatgcatagaaaagaattagcaggctggttatggtgggttaaggggatctcttgagcccaggagtttgaggctgcagtgatctgtgactgagccactgcactctagcctaggtgatagagtgagattctggttttttgttttttttttttaaagaatcagcaggaattgaactgtggctgctgagtttctctaggtttgagttgcatgggtgattttgcatttagggcagcggtgcctctggtttggagggattttcattcttctattccctggcaggactctgatgccaggagtctcattcattctgggccttagcattgtggattaccccataggggtctcatggcttaagctgaattaaatgttaaagggatgattttacttgtgttaactttttttggcatattattacaagagtacttttctccctgtaactgagaattcagcacaggaatcatgtggaagacctcggtgccttcccccaatgcctgctgcggtcccagtgctgacagtggggtccgctcttcccgccctcttggatctcctgcaggcataaccaggctgtcattaatatccacgccattgccactggcctgggaagtcggtcccttgcatctgtgtgtcttcctcttggtctcagcacctgttcttgcctctgtctcgtttttcctgagccttagagagcatcacttttcctttccatcacgagtgattctccagccttgctacggagcttcctaaggatcacacagtttacagatctgagttaggcagctgcgttattaagcaccccaggaggtccagatgcatgtaggtgctacacattattctctggggctgtctagtcttcagatccagggcctgtgatgccatcaaacccgcctgccagggagagctctggtggacgtcacagttggaatgcgtcgtgcggcagggcccaggaagccagcaggtggctcatggtcctcggcccctttctgggcctccaccttcctttctctgcctgtgctgtcctgacgtgtcttccccagcggtacccagtggaggcagtggagaggaacaccaggcagggcgtctcgtctcagccaagcctttctctctgctagcaatcttgaggacagagggaaggcctgtctgaatgtttacacgtgctgcattttgtagctgacatgcacactcaggccatacgttctggtggtggtgctggtcacataactccctaactgcaagactgccttgcgctggaggagacctaggatcgttgatatcatctgcgtggactttaaggctggcatgtttgcagacagtggcgcctgcccgcacttaggttcccatcagagcgtgtaaccatgggagagtggggggcacggctgtcttggggctcatcgaggctgcctgtcatgtttgctttttctttcctcagacagatcgaggagctgctagagctgctgatgactgagatcctgcaccccagcagccaggcccccaacggtgtgaagagccacttcatcgagatcttcctggaggagctgaccaaagtgggcgccgaggaggtgaggctgggctccgacggggcggtggagctgggcgtttgtggaggaggaactgagctcccgctggctttccccgtagcttacggcagaccagaacctgaagttcatcgaccccttctgcagaattgctgcccggaccaaggagtaagtggtgggtggcctgatcgggcccgactccttcactgagttcttccatggggctgctgttgtgggggtgctgctccctcgagggatgaatctgtctcagagtggccgctggccgtgtgggtggggagaggttgcaggggagtcggcggcttccgcttgggaatccagcataacgggcctgctcaccggcctctgctctgcccctcagttccttggttttgaacaacatcactcgaggcatctttgagacgattgtggagcaggccccgcttgccattgaagacctcctgaatgaactggacacacaggatgaggaggtggcgtcggacagtgatgagtcctctgagggtggtgagcgtggagacgcgctgtcccagaagaggtctgagaagccgcccgcaggtgggggtcacactgcgcctggcttctcctcggggcctgtcctgggctgagccagtgcgatctcctgctgggttgctcctgccacctcctacctggtccccttgtctctgcccctctccacagtccatcctcagcatagaagccagagtgacttctgtgggcaccaagcacacgtcgtttcccctcatcccccagcctctgatgtgctccacgccctctccggacccctgggctcctcggtctaacgcatgcctctggctcagttggccccctagactcgttcctgccttggtgccgagtctctccgtccctcccaccgtctctccccccatcactctctggggctggactctttcagcctcctggcctctcccagcccccaacgcagtcctccccatagcgtcactctgtggcacgggatgtgaatcacttgctcctcgtgttcctcgttcctggcccgtctccccagaggacagcaagctctgtccatattgaccatgactgggttcaggcctgagacctcagggcacctgactgctctgtgtgcagtgtgtgtgaggggcaggtgtactcacctgcccctcactgcctgccagaggcctctgtgggcagccgtggggtccagcctggcccattttttgttttgatgctgcactcattgtccgagcctgctgggtggtctgagctctaagtgtggcatcctggtgctgtggagggcatgtctttgaccacgctcaggaccccagtatgccccaaatcagtgctgtggccactgttccccttggcttcctaatcagaagaccccctccccaccgcccccagcacttggcccggccaccctgtatgcttctccctggtctctgccttgcccttctctctcagtagctgaggtgcctggcaggtccgctagtgcctgctgctggccccctgctgccagctacagagcagacccttgtcacatgctgccccacagctgcctgttgcccaaaaacctttcttctgcagacagtgccatcaaagccccaaatgcccagcctagctcgagcacccagccgaaacatcagctcccacagcttctggaccaggccaccctgaggctcctcacttccagaacttttgacatggcctttgttgcccaagatgccagcttgtagtcagccactcagggctgtgtaggcacctgtgccctgggacatctttttttcctttgcaggcctgaggtggcacctctcatcctgtccatacgagattagaggtcacatggcacctagtatctgccttgagctgtgggctttcccgcctgtgcccatgttctgaccagggtgcagggtgggctgtccgttcccgggtgtttcccgcctgtgcccgtgctccgaccagggtgcacggagcgggctctccattcctggatgtttggggccagcacacgttgggcacaggtagggttcacggggtcccttttgttccaggctccatctgcagggctgaacctgaggctggtgaggagcaggcaggtgacgacagggacagtggcggccccgttctccaggtgggttccctgggctcatggctgtgccctcagcctttgcccctctgtgctaccgcttgctctggaagaggaggggggcgttaggagggaggatggcagctgttggcatggagagttacccggacaggggttagctttgaaggagggatgggtgccccaaccctgcccgcctgtagacgagtgggatcattgagagtggggctggggcctgggaaagtggggctggggcctgggagggtgggctcaggcagaactgcattatccagggctggcctcacctcacgctgtcctcttgcctcacacatgggcagccccccagatttcctgcggccccctcgttggggtgctggtggggaatgagatggcatgtgccaagcggctggcctgtgggtcccagcgaggaatccactcagccagtggggtctgacttcaggcaaattggaaacttaaatgttttaagttttaaatatgattatctgcagactgaataaaatgtggctatcttgggttaaaattgatcaatttaacctatgttgttcgtgcttgtctgtgtggttcctagagtggtaaagctgcaggcaggctaccggcgggcgtgtgccctgcagtgtgccccgcagtgtgcatcttccagagtgtgccccgcagtgcgtgccccgcagtgcgcccgcagcttgtgtggtgcccgctgtgctgtagagtgggtggagctgcaggaccctcagtgagggtgggctgtgttcctgtgagccgggtggagaacctgcaagtgggaccaagtgctatctgggtctcaggggttccacgttctcggagcacgcagagcgtggctgaccttgcctctgtgacgtctctcttttgaaacagtttgactacgaggcagttgctaacagactgtttgaaatggccagccgccagagcaccccttctcagaacagaaagcgtctctacaaagtgatccggaagtgagtgtgtgagggcgctgcgtcctccctgctccccttggagttgccctttcttgctcagatctgggtgcctttgccttgtcctgggcccttccgcagcccccggggtgatccccgctaggaccctgagaccgtccccagcccctggggttcccctggctaggaacctgcagccgctctagctggagcttcctcctcctgcggaagccgcagctgtggtaagtgggtatctgtcttactctttcaggctgcaggacctggcaggaggtgaggatcggccgggcactgacaatggcaccaccttggaggtggagctccatcctcgtgggagtggtttggttctaggggtctcatagcacgtggagtctctttgcagagaggcctggtggtgtttctgagggacagggaggcagggcgcagggttccacagctctcgtttttgtggtttttgctgagtggttctcagacttgagtgtccattggagtgccccagagcctgagagatggggtgctggcctcaggggctcccaagcactgaccgcggtgctgctgctggtctgttgggcagcacacgtctgttcttggcagcgcgtggcggatggaactggcataggttatcggaaggacggtttcctagtgggcgtcgatggttagagacgtaggcgtttcccctggtgtttccttatgaaaagtttcagacctgcaactcagttggaaggattttatagtggatgtctgcgtgtccctgccggcctccagcatcagcacttcctgtccttgcgtgaagctcctctatcccagcatcacacccctgcatccgccagcgggcgcgtcatcagctgtagtccagggtttggtttttttattttttattttttgaggcggtgtctcgctctgttgcccaggatggcgtgcagtggtgtgatgcagctcactgcagcctcgatctcctggtctcaagcgatcctcccgcctcagcctcccagtcgctgggaccacaggcgcacgccaccacgccggctaattgttgtattttttgtagagacagggtttcgctgtgttgcccggctggtcgtctggggttttcgggacagcgcgcgtcagtgaggtgcgtgaggatcgtgtgcatctggcaggttttgatgcagaaagttgccttgggccgccagcatgagcattgtaggctgtagactttggtgtacaggttgagcgtctctaatctgaaaccccaaatccaaaatgccaccaagtccaaagctgagtgctgacaggaagctccagggaaatgctcgtcgcagtgttttctgtttggggttttcaggtgagggctgttgaactggtgaatatgatgcagacgttccaaaacaacctgacattcaaagcactgctggtcccaggcatttggggtcgtggacgctctatgctgtacctgtgtcctggatgctccaggaactggcttttccagatgggcttgggtctcagctggttcgtttcagctgtggcgggtactgaacacgctgctcctgggcattagaacagggcgctttctcacacacattgtcaggaggtggtgctggctggggcctgctggaagcagcgagcctcaaaccataagtccccagcccccgagagccccctgacttctgccctggttctcaggcattttccctgaagatgagatcccagagaaggcctgcaggcgcctgcttgaagggaggcggcagaagaagacgaagaagcagaagcgtctgctcaggttgcagcaggagagaggtaggactagggggtgtgttagtcatggagccggcgtcctcacctgcttgcttctcccctggatgggggtcacctgcagtgtctccccctgaagcatgagtgccgagtcccccatcctgggtgcctgctatccacgcatcccggaaatgccctgtcctcggcatccctcctgtaggcctctccctgcctcccccacccaccttccttgtctgcagctcccccgagctgtgtgcgctgccctccctcccggtctggagacatcctcctggctgggctgcctccttccgtgcctccgtcttagatccaagccccgtccgctcctctcccgcaccctccagagattcctgagtctctccacgtcttccttccccttcttccctccacttcttccctccacttctgtccttgatttctggggctgccttccgtgttgggcctctggccacacgagtgtggttggcatgtgatgccctcaccaggggcaaccctgggtccgcggcagaccactcagggcctggagctgcctacctgcagtggagggggttgagcacagtgccgggcagggcagggggcccatggcaagaatggggtgcagaggaggcacatggtggctttgccccacactgggaagccttccctgttactctctccatgctaaactggccccagggcctagggattcaccccttcccttgcccagagctccgtgccattgaagccgtccatctcatttcccatgaggcagtggcctcctctttgtagccggcccttggctgtgtgaaccctgtcggccctggcgttcaggacctggcactgcctggcgtcctgttcttccacctccccttctgccttgagcccagtcctgcctactcctctgtgcctttgctcctgggtctcatgaccctgtcctcacgctggtccttctgaggtcagcccttgctgaggtcctgagccgtgtggatggagcttggcgcccacactggacacgggatgcgtctggctggctgttgtggccgtgttgtcctcccaggtctgtggtgctggcatcctcagcctgagttggagtaagtggaaagagcccgtgttggcattctctggctcatggggtcttgctgttttgtcagggaaaggtgagaaggagcccccgagcccgggcatggagaggaagaggagcaggaggaggggtgtaggggccgaccccgaggcgcgggcagaggctggtgagcagccaggcacagctgagcgggccctgctccgagatcagcccaggggccgtggccagagaggggctcgccagagaaggaggacacctcggcccctgaccagtgcccgagcaaaggcggccaatgtccaggagccggagaagaagaagaaacgcagggagtgatgtggccgggccaaggacaggcagggagggaggccaggcctcgcttgcaccgcgggacgaggctgaccgggctgttctgtagactcaggaccgtggctccagaactcctgtgccaggcgggagggaagggcggcactggagagatgggcccatcattaggggccagcatcccaggaactggacctttccccagagcctccgcctgtggctgtgatgaccttgggccagaaggtcaaactccgaagactgaaactctgcctgcagcaggactggccgcccctgctgtggggggttcagaaaataaaatgccgcgcagcccttgccaggggaagtgtcgcttcaggtgtgtcctacggacgtgtgggaggtggcaggcgccagcctccgagcagtgtggtggtttatattcatgtttgtggaaaaatcttgcaagacatttctcctttcacagaactgcccaggtgttaacagggctgtctggacggggctcttttgcttccccctcaatctggggtctagagttgtgcaaggaattcagctccagtaaggcctggattgcccggggtgagcgtgtgtgtggtgggaagacctggcttccgcgagagccttgttcctggaggcaggagcgccccgccatcctgggtacccgcgggtccgcaggctgcgcacctctttccctcagccaggtcaccctcagcgtcctccctgcccctctccccttcacacctgctggagcctgtgagggaggtggcgggtccccactgtggcgacggagagctgacagtagcccagggctttccacctgcatggaacaagggcctgtctgccgccagcgctgtggccacagcctgcataggtgacaaggggccgctgcgttgggttttgcccgcatcttctgttccatgggtgcccagccagccaggccgtgtgggatccagcgagaggccagggcttggagtgggcctgggaccaggaaggacctctaggctgtggctggccttgtgcagaccctggactgcatccggttccccaaagccctgctgcattcgagtgtcccccaaccccgggcaggtggcacctggtgacacctccttcagtcccactcagctgggcggccggggcaggcttagggcacagttaggggccaaggagagggaaggccagggcccctgttctaggggttagggttctttccccaaaggaacttaaaaagacaagcgtggccaggcacagtggctcacacctgtaatcccagcactttgggaggccgaggtggccagatcacctgaggtcaggagtttgagaccagactgaccaacatggagaaaccccatctctactaaaatacaaaattagccaggcgtggtggcacatgcctgtaatcccagctactcgggaggctgaggcaggagaattgcttgaacctgggaggcagaggttgtggtgagctaagatcacgccattgcactccagcctgggcaacgagagggaaactctgtttcaaaaaaaaaa

SEQ ID NO: 11592 - DNA, 276 bp, Homo sapiens
ctcacacctgtaatcccagcactttgggaggccgaggtggccagatcacctgaggtcaggagtttgagaccagactgaccaacatggagaaaccccatctctactaaaatacaaaattagccaggcgtggtggcacatgcctgtaatcccagctactcgggaggctgaggcaggagaattgcttgaacctgggaggcagaggttgtggtgagctaagatcacgccattgcactccagcctgggcaacgagagggaaactctgtttcaaaaaaaaaa

SEQ ID NO: 11593 - DNA, 141 bp, Homo sapiens
gagagtctcgctctgtcgcccaggctggagtgcaatggcatgatctcggctcactgcaacctccacctcctgggttcaagcgattctcctgcctcagcctcctgagtagctgggattacaggcgcacgccaccatgcccag

SEQ ID NO: 11594 - DNA, 9361 bp, Homo sapiens
agaaccaaacacacatctggatcaccgagacataaaggcctgaagaagacccacttcatcaagaacatgaggcagtacgacaccaggaacagcaggtatgaagcggagccgggaaccgggccagggctgtggtctccataagcccacggggtcctgcccctgtcagccaagcaatcttccctccactcccaaagctcccgcccaccccacactccacacctctagaggtgggccctcctccccaccacactgcttgctccacatcagccgagcacccgcaggtccctggtgtcaccacagcgagatcaccctctctgggctcccaggtgaagggtcacacgtggacactagcctccagcaacagtgctgacgtgaaggaaaactggagacacagaaacgggtgtggctgtgagatgtgtggggaggagggctgggctttgttgggagcacggaggagaggctgaataaaccaaacacctggctgcccaaagctggcggagggccgcagctggcaccggctgcaccctgagaggctgtgtcggggaggccgcaggggctgttcctgtggccccgtattcccatcactgcatgtcctgaggtgtcctgaggtccagagtgctcccttccttctggagctccccctgccgggcaccctccttgtggtgactgtgggtctggatggacccttgctccccatcagtcctgtacagctcccagcagacgtgagtgccagccctggctcccgtcatccaagccagagagggggagaagttctcccactgttgtccccctggtgagaccctgggcccaggcagggcagagccagcgtccaagggaggagaaacagtggcttctgcctgtgctctctgggcccggggcccggctgctcgagcgccttggaagggagcctccaggccagcctctctgtggacctggatcaggccctttctggtggtgttgagccccgctccacccaggacctctgaggtctggctcgaggcagcccttggcctcgccatcctgtcccctctggctgcctctcatctctgaatgagccaagatcctgaggtgaggccgccagccctacccgcactgggtcaggaaggagccttcgggatgtcactgctgtgcctgcccacgtgcagcggcgtcccagggaggggaaccccggtagctcctgtagggaatccactctgagagcttgcgggggccaggcttagtgacggtggccacccggcctcctgggctcaagtccccttggacagcatgggcagtttcccagcacctgaatttaggcagaaggaattttccatggaaatgtctgtagctctggaagcagcagtaccttgagccccgctccccggccccgtctcccctgactccgtccccctgcaggatcgtgctcatctgtgccaagcggtccctgtgcgcggccttctcggtcctgccctatggggaaggcctgcggatcaggtgagtactcagcgcttgcctcgcatgcggtgtccatctaggcagaaggcaaggcctggtctcggccaggcccaggaggcatcagcgggcactgcgcccccaggtgcggctgcccccgggctcatgcgaggctcagcatgtcaacctccagcaaagctcctcaggaacccggggccgtttcgggtcctcactctccagaggagccggtttctgttcacgctgtcgatgtacaggtggctgggctgtcccacctcctgtggacagagccacttggtgctgtgaccatccaggcagtcgtatccgtgcgtaattcagggaaggaggaaacagctatggggtggggattatgtgtggccctggcttaaaaacagtggtggagaaacctgaccaggcgtgggcacatgtacctagtgggctagtgaaggtgggcgccaccccgggggctctaccagccagtgtctgtactggggaagcggggctcaaaaacccctccttccatgaaagcactcctgacgtgcgccttcctggtcacaccagtgccgcctttctttcccgaggggctgtgctgacattgttcccgagagcacctcgggccagcggacaggtgggctgggctgccagagcctgagttcagcgcagaccacagccccttgcctctcccatgtttgcagtgacctgagggtggacagccagaagcagaggcacccgtccggcggcgtctctgtgtcttccgagatggtctttgagctagaaggtgtggagctaggagcagacgggaaggtaagagcctcttcgctggtggacacccagcgccgtcagggccaggcaggcgggtgggagcagtcccacgtcagtgcccacgaggcacacgtgaagctgtgcttcactccacgtaaaacgcaagggtggagtggatgcgggcccgtgcagccctgagaacgtggccctggagcccgtcggactcccccgcctggccgtgcctgaggtctgcgccactgccccacagccaggtgctcctggacacccccctgctgcagggtggggctcgccaaccctctggcctctgtgctggtggtcagcagtcttcagaggcagggagaacgttacaggctacagaacccagataaagcacagtagtgttccggaatgttctagctatgtgaggagcagcgtctagctcagacgcagcctcaacggcttgatctgagttgttcccttcattttccatgcagggctcctggcatgtgcgtctgggcttcctgcagcgggagctcactttgccctctggtcccgggaggcagagctgaggccagatgcatttgcttttccaggtcgtgtcttatgcgaagttcctgtatcccaccaacgccctggtcacacacaagagtgacagccatggcctgctgcccacacctcggcccagtgtcccccggactctgccagggtcaagacataaacctgcccccaccaagtcggcaccagccagcacagaactaggtagcccacgtgccttaaccacggcctggaacagggtgacccgcgtgccttaaccacggcccagggactgcagcagcatcagcaagcccctttcaatctgtagccctccgtgcagatggagcctggggaacagggtcaggagaggaacagctccacactgaatcgctatccctgggcttggcctgagccaggcagtggggaggagctgcatccacccacagatgactccagggagggcccctcctctcaggacatccttttcttgccctaagccctgggcccttcaggagagaaccatggcctagagcccctcccctgctcggccttgccccgccatggcgctggcctgccaggccttggggctagatgggtactgctcaagactcctggtgggtcaggggttgcctctcttacagggagtgacgtgggggacaccctggagtacaaccccaacctcctggatgacccgcagtggccctgcggcaagcacaaacgtgtcctcatctttgcgtcgtacatggtgagtgccctctcccagggcctgggtgcaggcagctgcacacctgtcctggctcggggcgtgtggggcaggctgtgggcaaagctgccccaggggcgtgacgtgcccccatcccggatcgcagcagcacagacagtggcggtgtgcagggcaggccagggagcagtgctggccactccagctggggtccacccttgcccttccgccctcggcacctggcaacctggctctccccacaccaagcaggcatgggctctggagttctctctcttgagccattttgttctcagagattcggggcctctcaagccacaccgtatgcatgtttgcaaacccaggacagtgagaaatccatcgtacccagcaggcaggacccatggactgtgcgaggggccggcccaaccctgcccactctctgttgcagaccacagtgatagaatacgtgaagccctcagacctcaaaaaggacatgaacgagaccttcagggagaagttcccccatgtcaaactgacgctgagcaaaatcaggaggtgaggacaccctctcagaccatctcatcgtcctgggaggccctgccagcctctcctctccagtttctggtagattctctccagcttgacaagtctagccgctgcccatccccaaccccctctcgccatccgaccaggcccccagcagcagctcccccacctccaccgcccgccaagccaggccccccgtggccccatcacactgcatccccccacacaccactgggtctctcacagccagaccctcgcagcagcccaggatctttttaaaacttgagtgggacaaggcctctgttgtgcccggcccctcccagtgtgtgctattttgtgagtagattccgtggcccttcccctggcccacaaagcgcccccatccaggcatgctgggtgctcgccaaggccgtccaggtgtgcctctgctctcacattgtgccacgctgatgacccatgaccggaggaaagcgagcagaaggcggcggaactgctgggctcacgtcgggctcctggccacggccctgtactgggggcctgccctgccggcctctgccccagtgttccagagggcagctcactcaataccctggcacctcccttcaaggctcttcctaaaaccacccctcatcagagaccactgccccccaccgagagcagagcctgtcctctgtggctccacccaccaggcacaggtgggagctgccatgggtgcccacccacgggacgggggaagccaaaacccagcctgccggtccctgcccatgcgccctgccctgggcgttatacatggtacggcggagggtaccatcccctgaaggatgcggtggtgtttcttgcggcccaaagctacatcgctccagcctcggttggtggtggcagggggctgcctcctcagccccagccagagcccccagggacatggcttctgtcttaacccacagcttaaagcgggagatgcggagcctgtcggaggagtgcagcctggagcccgtgacggtggccatggcctacgtgtactttgagaagctggtcctgcagggcaagctcagcaaacagaaccgcaagctgtgcgctggcgcctgcgtgctgctggctgccaagatcagcagtgacctgcgcaagagcggcgtgacgcagctcatcgatgtgagtgcccggctcggcaggcactgcaggcagggtcatgacatcgagccagggccactgctgggatggggctggccgggtgggaaatgtggaagagggaaggctcccgtgtaacccttctctcttctcccctgcagaagttagaagaaaggtttcgattcaacaggcgcgacctgatagggtttgagttcacagtgctcgtggccttggagctggccctgtatcttcccgagaaccaagtgttacctcattacaggcgcctcacccagcagttctagcagaggccccacagaaggctcagggcaccgaggtgcacttgccggcctgggaggtgtcccactgaagccccgcgcctcctcctgccagcacccccagcacctgctagcaggaggcacctggcctccgctggtgcagctttcctttttgcctctttgccatttccttggaaagagacgtcgctttcatccccaagtgcaccgtccctccgaggggatttctgagaattctcctgcatttttacataaactaaatgtgaggtttgttactggtatttttttcacgtgcctgagaccagcctggtaccaggaccttttgttcacagcgtgcagcagcgagccggctgcagtgtgtctcccctggcctcgccttctgcaaaccaccgcagccaccacagcgtcagggtggagatctgggtttctagacctcactgaacacactggaatggctgagtttaacttatttaggcattcatcttggagatgtggtttttcgggttccccagcagcatctcccgacaccaactgtgccgctggctccctgccacctgaagccgagctcctccagagctttctccgcccacctcactgcatcccaagtggagcttttggtgtccagttaggccagcgggagcagtctcctgatttattttgatctcattcttggactcttggacctctctgttcttcaagcatcgtgtcactgtgaaatcctaacgcccctgtgtcctacagaccgacggcacaacagacagctgcccatcccatgccatgctctaccctctgcctctcaccaggagacactctgggcctccaggacaattgctgcttgccggctcttatttttctaagcaatattgtgatggagaaaaataacatatttattgggatttggttttttgggtcttttttttttaagggaacaaaaaatggttaaatgaggtctgctgaagttgacttgaaaacacacttgaccctcaggcaggagggcactgaccacaccccacacaacctcaaagggtcagtgcgtcagtgccttttcttctgaggcaggaaacaggtgccatcttggccacctcggccagggcagcccaccatgctaaaaggaccccaaatggtggtcgttgtcccttctgtgcaggccagcagggccccatctctagtttttccacgtctgtctgaagttcttgcaacaaattctgcatggtccagcgctccagctagctgcctcatcaaaaacactgaataaccaaggactgctgagtttttcttcatggggggtcagctggtctcaaaactggccactgcctcagccaccaagctttttcctaccactaccttataaacctgcctggccctggaggggctctgggacgactttgtctctagcccattaatacaatacatcctatgctttctgtgcagactggtgcttccgcagaaaggagatgccaattctgctatcacagaactccaccagcaactccacccgaccccagcagtggtgcaggacagctgccagcacccacctggccctcctccttttccacagccactcactggggccaccaaaacccagagatggcaggtgtgtgggacagactggaggatgaggacaaaccaaagcctttgttctttcttattgtggagcgtccccttccatcaagcagcctgccctcaagccaaggatcatcccctggaacccagtatgcacccagaggggactcagcttcaaagctgctccaccatgctgggtcccaggcagctttcctctgaaaagcaacctctcctgccacccagatcccatctcaagagctcgcccatgttacgagcatgtaaaggactgacttcctagtaactgttgcagtttacaacctgccctccagggacacgtctccatggtttttcctacacatgaatgcgagaaatggctgataagcacagtaatttaagattgcgtattcatgtagtgagatttagtcattaaccaacccggtctttgtgatgtgtgaagccttcccttcagttatgtcccatttttatgatgccaaaagctgccactgtgtggtattcgaggattattgcaacaaagccagtagttaaaccaaactacagtctcagcctgtcattctctagaacacatccaggtgtcggagctaaggtgttcagctcggctgtgactatacagaaccaggcctggcgttgcttccgcaccggtagcagttgtggatgtcagtgtgcataagcaagtatcagacctcagaatgtttgagttattttgtcttagatatctgtttttaaatggataatgtatttgtcctttaaacctcagttttgcaatatgtttcacagcttgtctcctttcaactaactgggtaccctaccccacccgtcacccactgacagcaaaacctcaaccctgggcctacagacacagaatgaacctgcacaggtaggttttcattatttatttatgacaaatattccacatctgtgattctctccagtcaaaagttcctagaaccaggggaaaaggacaacgttaagaccacgcctctggagcagtcctagtccactcactctgcccaaatgtgagcccccaaccttactttgagacgatgccatcggccttggccaatcggagaatggaatcatctgactcacccttaagaaaaaaaaaaaagcacactaagaatatttccactccggctgcctgagatggcagaaggtcagctgtgccaccagcccacgtctctcccccgctgagcgaatggagacaggcgcagaaggggagccacctctcccggggcagcctgcagcctgactatggtggagcggggtcgggggggcacctcctagtgagaggcagagtctgctgcctgagtgtcttctcagagcacccctcttccaccctcaagaagcggcaggcggccagcccagtccagctggctcaaactactctgccagcagatctactcaggcaccatcacacactccaatgcgcacggtaaagtccacgatgtcccgaagtgatgagcaaagcccagggaaacactcaccatcctacgaatggccccgcagatagcataagttttaaactggccattaaacctgcctgtgaccttgtcaacctagaaagagaagaagggtcacaaaccactcccccaggtttgggaaacaccaatcctcaaagccagcctctgcctgtaccttcaccccaggggctcctccacaatgggacagcctgcctttcccgcacatatatcacaaccttcccgcctcccgggctcccagctcacctcggccacgttcatctggatggatgcgtggtccttggcaccgatgatgcgattgctagcggagctgtggagaaagggcgcagtgagcagaggggacttgggcggtaagaatgaaagaggggacgagggaggttgggggtatatgaatggaaaagagtaacgtcgggggcaggacaagttagggacgtgacgaggtaaggacgggaggggtgtgggggaacaagggcaggcgaggggacgtggtggttaggtaaggacggaagagaggcatgtggggggcgcttaccatttccgcggcacgtacaggtccacgaactcgccggcgtcgttctgcatttcgaggctgggctgcgcctggggagtcaccgcgcggcgccgtgagtacggccggaaccgtgccccggctcccggcgcaaaccggcccctagggtcacggccccagccgcacccagcaccccgcaccccgtcccccgcgtccaagcccccactcccgccccagccccagccctgagcccgaagcccgcgccgcgcgccacacctgctgccaccacaccgcgcgcgagagagaaaggaagcagctagtcacccggcagagatatcggcgggcaaggaggggcctcggcgag

SEQ ID NO: 11595 - DNA, 683 bp, Homo sapiens
cgcacttccgcttccggcaaggaggttctcggaccccagcctgctggccctggggcgcggggcgtcgtgggggtcgttgtcgttgagggtcgttgccgtgtgtggcgtcttagcctggcccctgggttgtgccccacggacgcagtcgacccctctgagcgcctcgggagccccgaatagcagctgggagaaggggcgaggactgagcctcgctgcccgctgccggccgggctagagatacgggcgtgccccccattgtgcgcctcccgccctccggtcccctcaccctgcggccacctggggcgtggggcggtgctcctgcccgtgcacgtagccgctgcgagcggaggcctgctcacctggtgcctgctactcactcccccgggccggtgggcgaaggacacccgcaggaactcggcagaggagaaattcagacggctcccgagggtaggaaaagaccccggcccaccgtggaatctgaaacacccgaccactctgccatcccatgtttcaccagtcagacccccagggcagggcaggggaagcagaatgcaaactggggcaccgtttccctgaagcgtgttggccgcgtttgtcgtagtgctagaggtgcatacccttggaccccgaaaacccattcctgggaatttgctccaaggaagtaaagatgttacaaagatgga

SEQ ID NO: 11596 - DNA, 8292 bp, Homo sapiens
gagacaagcaggaccgggatcccggccccgggtcttccagaaacggcggggcgaagcgcccaggggcctgtgcgtccctccctgctgagcgagggggcctgtcattgccgtgggcgtgacccagaccccaaccacagtgcatcccgccctggcccagccagagaaggaagctgagtctggggtctgctgggccagcaggaagtcccagcagggtgtgaagcaagactttccgggccactcctggaatcccccagcagataaaggcggcccctccaccgggcgctcctagcggtctcccggaccctgccgccctgccactatgtcccgccgctctatgctgcttgcctgggctctccccagcctccttcgactcggagcggctcaggagacagaagacccggcctgctgcagccccatagtgccccggaacgagtggaaggccctggcatcagagtgcgcccagcacctgagcctgcccttacgctatgtggtggtatcgcacacggcgggcagcagctgcaacacccccgcctcgtgccagcagcaggcccggaatgtgcagcactaccacatgaagacactgggctggtgcgacgtgggctacaagtgagtgtggcaggggggcacgggctggactggggatcccagaggcaaaggtgtgcaagtgcccgccagcgggaccatttctaggcctggtgctgaggccacctggctgacaccctgagcagcttactgaacctcacaaggtcatttcttcctcgggtcaccacgtgggccggggcaggtgctcacagcacaaagatgcgtgagaaggggggatgggctgaaatccaagccccgctcccgctcccgggaagaaggggcaggctttgcctaacacacaccaaggtgtccgcgacgccttatgaaggcgccccttcctgatgcctggtgcctttgttaggaggcggaaaaccaggctgactcagtgcggagctgggttccagggtcagctcatcttattgctggctgaggcctggggcgggtcctcccggcttcagcttcctcctcggcaaagtcaatggaatcgcggcccatctgctccttatatgagccaatacaggcaaagcacctaggaactgcctggcacacgggggcccgcaaagccacgggctattaccattaggcacctactatgtgccaggcagtgtgccagatgtggcatggagaacggtgccactctagcctcctggggttgaaagaccagcagggagaaacaagccaaggccacaggtgaattcagacggtgatagaggcgatggataaaaggaaagaggtgagggagggtgacctcaggctgggaccagacccacacaggctccttggaagggtggggcaagggaaagcctccctgagagtggctgccttggctctgggatgggggagcagacagaggcctgcaggtggcagggggtgctgggggcaaagccaacggggttgagtgggcgggtcctgtgggaaggacagggtggctgaacacagccgggcgagcggaatgaaatgaggaaagggcaggaccaggcagggctttgtggaccacagtgaggactgtagcttttactccgagatgggagccatgggaggcttccccccgcagagcagggaccagggctagtgtaggtacaagagactccctctggctgctgtggggagaacagactgtaaggggtgccggctgaagcaggctgaagcaggtccggggccacgcctaccagctacctcctccttagaatgggctgcagtccagcctgacggtttccacagggagggaactttcaatcctgcaggctctcagacccaggtaagcatcagaatctcctgcagagcttattggaggaacatgcaggtccccagagaccacttcaatagaccccacccaggggacacatgttctcaggacctcctaaggctgtgtctcacacacacacacacacaaaacccacccagagaagtctagaagtgtccaaaggtattcccagcccttccagttcaagattttatcaaagactccaacttcaacattttgtttccaagactcaggcgctctgatcctaagtgttcccatgaggtcacgaaggcccgagcctcgggtccacatcaccacatacagaagcagccgctgtctggccctcagcttttaggattccgaatctggttctaacgttctgaatcccctttccatgtcacgtcaccttctctctctgagcctcgtttcttcacctgtaaatggggcttctgactgtacccgcttggcgatggtggctgaggtttcaatgagatgcattcatgcaacaaatgaccagggagaaccaaccacccccgaccccagcaccatcatgccaggctccgggaatatggcagggccataaccagccagtcccagcagccagcatcaccagcagggccataaccagccagtcccagcagccagcatcactggggccagattctgggagctggcttcctaagcagcagattcgggactcaagattcggaagttccgacattctgtgcgtcattaatgacactgtgagcgcgggggctgagttggcacatactgcagctccaaggcactgatcttctagttcattcccatttgccaagtcagacacgctcaatcagatgtgctgaatgaatcagccttaaggatctgctgccaggcttgggaacctcaaagaggcaggtgctggggctccagggtcggtatctggttacgaccccaactttgagtctgtgatcctgtcccccagtggaccccgagggcaggaagcaagctggggcaaaggcagagttctgagaggcagggggctctgagtagcttgtacaaattatgtcgctttctgagtctctgctctctctgcttaagatgaggatgataagagtccctgccttggctgggcacggtgactcatgcttgtaatcccagcactttgggaggccaaaggcgggcagatcacctgaggtcgggagttcgagaccagcctggccaacatggtgaaaccccatctctactaataatacaaaaattagccgggtgtggtggctcatgcttgtaatcccaggtactcaggaggctgaggcacgagaatcacttgaacccaggaggcagaggttgcggtgagctgagatcacgccactgcactccagcctgagcaacaagagtgaaaccccgtcttaaaaaaaaaaaaaaaaaaaagtctctgcctcagagggctgtcctgcaaggattcagtaaaacaggacttccacaaatcctctagggaggcaggagagagcaacgcacaagatcacatgggtggggaccatggaggcctggttaaaaaccccagctgtgccccagacaggctgtgtgaccccggggcaggtgattctaccgctctgattctgtctatataaaacgggggtgatagtgactcacagggttgctgtgaggatggaaaaaggtgtatgcagagctgtgcttggcacatggcaggggcccaataaatgaccacagtcattgttactatcgtgggaaattaacgggtgagaaggatgctggggaagttgtgtgcaccacggcagtaacggaggcagggtgagtggaggaaggaggaggagtcctcctcgggaaaccctccctcactcatcaagcccccccacctccccatgcagcttcctgattggagaagacgggctcgtatacgagggccgtggctggaacttcacgggtgcccactcaggtcacttatggaaccccatgtccattggcatcagcttcatgggcaactacatgggtgagtgactgtccagccagttgggatgggggctgacacggggccctacgctatcacttccccttcggggaagcccctgcctgactcctacctctgcctcctccagatcgggtgcccacaccccaggccatccgggcagcccagggtctactggcctgcggtgtggctcagggagccctgaggtccaactatgtgctcaaaggacaccgggatgtgcagcgtacactctctccaggcaaccagctctaccacctcatccagaattggccacactaccgctccccctgaggccctgctgatccgcaccccattcctcccctcccatggccaaaaaccccactgtctccttctccaataaagatgtagctcaaaatgtgttcctcagcaggtcccaccacacacctcccctccttctctccctcccacaagaccaaagccctcccaccccttcccctcccagcactctcctcactggtgcttggaacccagaggccccggccctgaaccaagaccccggagatcccagctcgagagcaacatcacagctcagaacccagaggtctcaggtcagagcccaggaatcagcaccaaggcggccgggatgtcaccaacagtgggtcctgggggtcctcctgggcagtgaaccacgctgcaagacacctccttcccaccacacagccaaaggcatcctgcgcagaaactttgcttggactcctttagggacgggctgctcactactcctcccaggtctgcccttgcactgtttagagagtgtacaagcttttcctaggcctgagtcccaatctgcctccgaggcacagacacacaggtcccaattataccccccaatttctcttcctccacatttctccccactccaccctcaccctttagtcataagctgaggggtccccagggcaaatatgtttatttacaaaatgcacacatcctccctcccagcatgcactgcctggggagagggcagggtcagggcctcacacacctgagaccccaggggcagcaggagggacggggccagggcagggactgggcagggctggaggccaccctggccccaccccccacaccatacccagcaagtgggtgggggatggaggggtagtaccccttctccacgttatgaccgcatgtccagtcggttcatgtactcctgcaaggccttcaggcgtgcgtctatttcggccatgtcagccgcctggtgctccgagctgtactctgtgagagcaggtgtgggtatgggggctgtgaggggcctgaagccccagggagttcctgggcccaatataccactgcccgcactaccattccaacgggtcctggggctgggagaggggatgtggagtcccaggctcacctttgatggggacccagcccccggagttggccagagatttctgatggtggctgcgttccacggggggagacttctggtgatggggaaggtaggaaagggggtcacccaccgtccctctatttctgtccccctaaatcccactggaaatcctgagcctaaggaccttggggaaaaataaggcctgacacctactggccattcattatctgcaaaataacctcctaatgtcctcacagagccctcacctcacatgtgaggtgatgccattaccaaccctggttaactgataaacaaaaactaaggtacagagaggctaaagaactgccttgaaccatacagctgggaagaggaggagacaggtttcaagacctgacagtcagaagccaaagccctaaagagcatcacgtgcccctcattattccttctccaatctaatgctctcaaaacgtgctgttcccaggccaggtgcgctggcccagcctgtaactccagcgctgtaggaggctgaggatggcttgaggccaggagttccagaccagcctgggcaacataaagagacaataccacccccttatcctgtctcaaccccaccctgcccccccaaaaaagcctagtcccagctactccataggccgaggtgggagggtctcttgagtccaggagttgaaagctgccgtgagctacaattgccccactgcaccccagcctgaaagagcgagacgcactcttaaaaaagccctattgccaaaggcattcagagtcgcctctgcacctgatccccaggaaggaatcacaggaaatgggggcagctgtgttccagtggtttatgttgccccttctactcaccatattggacccactccagggcgttgggctgggaggcttcccacggcggcggtgacccctgagaaaaaggagtaaccaaggaccagtggtggggaggctctggtacttcccacctccccgacctttgtggtttcaaggcccccaggctccatcacccaatttccctgcaaaagactgtttctagtctccccagaaaccctttggaggcgatccttttcccaagttcaagttttaccctctggagagcgactcagagaaatcctccaaatcgctgcaggagctggcagacgagcagcggctgcggaaactgtccactagagggagacggagggcgtgaccgctggccctcgctggccccgcccagtgcttcccaggccctcccagcccgcccgccctgcccagtgcctcccagcccgcccagccccgcccagtcccgcctagcccggcagcccccagctccaggccagttacctgaggagctgcggtttcgggagcggttaggggcgtcccctcggccagtcaaggcagcagggggctgggtctggcgagaccaggagacggacggaccgtccccgcttcccccactgcctaagcggttccgctgctgctgcctgggaaaaaagaaaggagacgccggtctgtacgcccaactcctgcaggcaagggggtcactgcgcccctaaaggtcacagccacgccagcgaaagcctgaggtgacaggcctacgagcggaaagcacgcagaaacacagacgaggaggtaggacggacggaagggagagcaggcggggtatccggcgagaagcgagcaggtggcaggggatggagactgatggtggcgtggagagatgagagcccgggagcgggcacgggccagggacaggggcaggtgagggaggaaggggcactgacttcatctggatctctctctgcttcctttccttggctttcacaaaggccgtggggtcgaagcggagcgcgcgaccacctaggacggcgtgggagaggaggcggctaggtccggagacgggccttggcagcgccagtgcgtcccctccctaccgcagggcaggggcacagacctgtgggcgagggcgaggggcgcgcagggcggccccgaccccggctcccgcggccgctctcccgggatgaggagcgcgcggcgccgcggcctcgcgacgcggagcgctcccgggacgatgaggcccggtcctcccgcgtcgggggcggctgcaccggcggagtccgcctcctgagaccacagaggcagctgtcagcttcccgcccgccccgacaaactcaatcgcgagactcctccccgaccgcaccttctccgaaccctcaggcctaccccatcaactcctagacgtgcactcctgggcccatgaccctctcgatatcttcccccccagacctcacccaattggacccctaaaacacccctctgtcattcccctacatcctttcaacacaccgccttcaacagacccttctttccggagtcttccacaactccccggaaactctttccaattttccaccacccaccccataaatgccagcggacctcaccctgatcccacctgctgcgccgcaccctttcgcaccaggagaccctagggcacgatccctttcccagtccctcctgaacgccgccccaagcctgcgcatctccgcacagcccgggtccacctcctaaccactgcacccaaatcctgtctggactccagacggggtccgctaagccccgcctccccttcagccccgccccctccaccctacctggccccgccccgcccccttaggctccgcctcatcagcctccacaccctcagggcccgcccatccgcccaggcgcctggcaggcctcgctctcaccccctcttgtacaatgccagctcgctggtcagcgtcttcagccgggcgcgcaggctccgctccgatgccttcgcctcctcgagctgccgggaggggagaggggcgcggaggtccaggctgaggccgaggtccgcgcctcgctggccgccccgggcccccgctgctcacctccttggccagacggcggcagtcctggccgcgacggccggccaccctgtgcccgaggccgcgctcctgccgcagctccagctccagcccgcgcaccagcccgcgcagcgcctcggcctcctggcgtgccgcgcgcccggccagcgcctcctcgcgcgatcggcccagctgcgcctccagctcccgcttctcggacgccaggcgcgacacc

SEQ ID NO: 11597 - DNA, 123 bp, Homo sapiens
tttttttttttttttctgagacggagtcttgctctgtcacccaggctggagtgcagtggcacgatcttggctcactgcaacctctgcctcccgggttgaagcgattctcctgcctcagccccc

SEQ ID NO: 11598 - DNA, 1810 bp, Homo sapiens
agccaagagctctatctatgttttgttcaaatagccgagtaatctactatcttggcagtaattacttctgctgcatttctaatgtgaattgcatgtgagagcttatgaatacactcttttcaagtgtatgtgggttttcaaggtatgtatttgtgtttgatcctatatttcctttgttataacattctgcttttcatcactttgacagaatatttgtaaattttctggagagtgagtttgggtatatgctttgaggaatatgcttcctcattacaaaagatatggaaacataattgattactacacttgcttatcaatagtattttgattttgtttaaatgaaatgtttaagatacgtggattgctatgcattcatgttttagatttatcctctccaggcatgatttatgccattcaataattaaaataactaagttactttagaaaaagtgcctattaaacagagtactttgtttagaggacgtatatttaaataaacttatacagctaaagaaactgactttcacttcctcagtgacttaatttcactacatgctgatttgtcctttgcagtatttagctcagaccaagacagaattgtatgtgctattagatttgcaaattgctgatctcccagtgactttccctcttagatcccagttgagtatggttaccttgagaactgtggtattagccatgttagagcatgctccactggggagttctgtgcagtctatttttaatgctatttaatgaaggagcgagcgcctcactcagcaataaaagaagcatgagggaagacagagcagtgcatggttatggatactggacaaggatatttggaaaggtaaaggctgaccattggatatggtaattttaattaagtcctaatatatcatatgaatggaaatatggatttttgttagagaattatacatgaatagttcaataggtgttttcgtaaacctcttcactagttcttagaaagaagactcaataatttgagtttttaaaacttgagggacatactaaccagggagttcctgcatgcagactatttttaatacaagctgtcatattcttgggtggtgagaagtacagaaataatttcaaattcctaaaatattgttcggtgaaaggtttggagcttgtaaaacgttctgcgaataaaataactaatatgcttctaagatactacaataacctgaagctctgccttgtgaattgcttcattttcttttatgaacttggagtctaggtccagaattgtcacaactaagagaagcaggaagttttgtttggacttgatagaatatttggggtgttttctctccttagaattaagataagccctacagattatcttactgaagtctaaatattttaaaaatataagtagcagaggcagcactggtaacttttgtaatgtcacaataaagggcaaaatatcttaacattatagtgtgtacaatgcaagaagccatctgtctgcaacatttgtatatatgcagaacacctgtcttgaggtagaaagtgagaatgttcaatcagaaaggtcttgtgttgattttcatattaacaacatactataatcaggttattcttttgttcagagtaaagctaattagacaaaatgcttaagtagttgcaaggttaataaacataagagaaagtaagcagtttctattaaatggggaagttagtcatataatttttaaatgaagctgttagaacaatgtgcaaagttgatctggatttttgccaattcctatgaaaaataatccccagaaataaactactaaggaaaata

SEQ ID NO: 11599 - DNA, 316 bp, Homo sapiens
atttctttaagttttttgatgtttgattttctaccagtatgacactcagcctctcaaaacaagaaggacattccccaaagttgaaatgaatctgtataagatttcattcaaatgcagaataaattcaaatgattcctaacccctcctcatctactttggagataaaaactgctatgattgttttaagtaaacagagaagtggagatgacaggaaatcatttttcatttgttaaaaatcagaaaacctttgacacacttttagataaatacacctactcctttgatcctttgtgtatgtattaccacagggcttaaa

SEQ ID NO: 11600 - DNA, 276 bp, Homo sapiens
ctggtatcacatggtagtagcctatttagaaatttgtgaatctctaatcacaaaaagaattgacttccttaaaaatatattatatcacctggaaagttctgaatatattttaagtcagcgatgatgcatttgtaaaacatatacttcctttctttagacaaaggatctttatgattctagaagctctacatttctgtggacttgtattttattttttattctagcattttatgttaaatatgataaatgaatttcaagcagcaatgtaagcaaatg

SEQ ID NO: 11601 - DNA, 6277 bp, Homo sapiens
ttccatcagtgagtatcaccagccttttgcgacagctaatgaacctacctcaaagtgcagctacaccagcactctccaatcctcacctcactgctgtgctccagaacaaggtgatcttgcccttttaactccttgaactttgtgaaatgtcttaatttgcgttatagattaaaataatggctgctgtatctctagcaacttgggaaaaaggcttctttcagtcaagagttacattaagctcctagtaaccggctagaaataacagtgttttcaacaaaatgggattttatgtgtctagtgtgaaataaatttgatttagtagctcgacagagtcatcagggatccaggctttttcactttttttcctctgccattcttaccagtggcttccatgttcattattcctcatggtccaagatggctgtggaattcatgattcagctttacatcaagaaggacaggtggatgtggagggcaaaaagatgtggaccagctgtccatcttccttattgagaccttttccaggagttctaaccagaaacttctacttactgttaatagccaggacattgtcacatggccacacctaagtgcagggaaggctggaaaatatcttttagtttatgccattgtcatgacacataagagttctgataatgggtaggaaggcatattaggcaattagcagtctctgtcataacactatgaatagtagaatcatccatttcatattttatttgcatcaagtttaaagattcagagattcctaggggaaacataatatgaaataaagaatatgaatttttagtccttccctgctactgtctagctttgtgaccttggacagatgatatcacattgctgaatcagtttcctggtctataagatggaggtgatgatgtagacttcatagagttgtcctggtacttaaatgagataacagttgtaagtggttcgatataatgcctggtacatagtagttactcattaagggccattctatgtacagtagagatgaaaaagtggtctcaaggcctcttgctcctttgcaccagaaaacctaccaaagcatgactctaaaggtcagtgtatcagaggaagaagaggtgacagtgcctctggggttctggagtgatccggaatgtgcctttctgttatttggtctcttagttttaattttagtaaaggcagtagtattttttttctgagaataacatgaaaagggattttttttttttaaatcagggtcttctctgtcacccaggccagagtgcaggggcaagatctcggctcactgcaacctctgcctcctgggctcaagccatcctcccacctcagcctcccaagtagatgggactacaggcacatgccaccacgcacaactaatttgtgtattttttgtagaggtggggtttcgccatgttgtccaggctggtctcaaactcctgagctcaagctatcagcctgcctcgacctcccaaagtgttgggattacaggtgtgagctactgcaaccggccatgaagggaaattttgtggaaaagtgagtgagtctagaaagttggaatggaatcccaaagtactgccagccttccttttatgatccatttataggtatgagtcatacatttaacctaaaccttcttgtccctatttgtattttcttttttgagacaggatctcactctgtcacccaggcttcagtgcagtggcacagtcacagctcattgcagcctcaactttctgtactcaaagcgatcctcccacctcagcctcttgagtagcatgtgccaccatgcctgattgacttttttttttttgagacagagccttgctctgtcactcatgctgcagtgcaatggcgatatcttgtctcactgcaacccctgcctcccaggttcaagcagttctcctgcgtcagcccccaagtagctgggattacaggtgcccgccaccataccaggctaatgtttgtgtttttagcagagacagggttttgccatgttggccaggctggtccggggctcctgacctcacgtgatccacctgcctcagcctcccaaagtgctgggattacaggtgtgagccaccacacccagcctccgattgatttttatattttttgcagaaacagggtctcactatgttgctctggctggtctcgaactcctggactcaagcagtactgcctccacctcccaaagtgctggaattacaggcatgagccaccatgcccatccccagccccctgttcatttttttttttcttttgagatagagtcttgctctgtcacccaggctggagtgcagtggcgcgatcgcagctcactgcaagctccgcctcctgggttcaagccattctcctgcctcagcctcccgagtagctgggactacaggcacccgccaccacgcctggctaattttttgtattttttagtagaggcagggtttcaccgtgttagccaggatgatctcgatctcctgacctcttgatccacccgccttggcctcccaaagtgctgggattacatgcatgagccaccacgcccgtcccatattttaatcctatgccccaaagactacatttcctgattttactgtccactaaataaaacacatttttatatgttacttttttttttttttttggagatggagtttcactcgtgttgcccaggctggagcgcaatggtgcgatcttggctcactgcaacctccagctcccgggttccaacaattctcctgcctcagcctcccaagtagctgggattacaggcatgtgccaccgtgcctggctaattttctatttttagtagagacggagtttcaccattttgatcaggctggtctcaaactcctgacctcaggtcatccacccaccttggcctcccatagtgctgggattacaggcatgagccaccacacctgaccatttttatatattgcatactctaaagcatgttgctgaattttaattatagatacggtgtatacatctgtttaccctttctctctttttattttttagatttttattaacattctgtctaagactttgtatttccagatagagatgtgctttttaatggaaagtttctctttataccatgtttatttcagttgtgtttatttgtatattttcctacagtttacaccttgtttcttaattcaaaatatcttactgtaatgcttttttcttattttttcctgatttttaatttctgtaccaaaattggtcttcatttactttcttttttagcctatttctgttctcataaataggagaaaagtcaaattctacattatccatggcaaggaaaaaccatcttttaacctcagcatggggaacagagaggcgtgttggacaccatgactttccgtttctgttggctgcgcctggtcactgctatggcagaataaagcctggagagagacatagcctttcaactcatgcttgtctgatctttacctggttttacagaaaagcacagtagtgaggttattttgatttagagctgttccccatctgatgccaggatcccttcaacagtggtggaggaggtttagacacagtgttgagtttgattccctctgtcttttctcgtagtttggcctgtcactgctcctcatcctcctgagccgtggtgaagacctacagagttcagaccctgctacagaatcaacacaaaataatcagtggtcagtgtggactgtttcttctcttattttaagttctttgaggtaatcttttaaatttttttctcctgatattattatgggtcttccctgtcaggacggaggtgatgttcatggcaacacgagaacttctgcggattccccaagcagccctggccaagccaatctctatacctacaaacctagtgtccctcttttctcgctatgttgaccggcagaaactgaacttgctggagacaaaactgcagtaagtttgaaacaggagagtttcacatctcactaaagttgggactttagaagttatggttgggaggctgggtacggtggctcacacctgtaatcccagcattttaggacacccaggagggtggatcacttgaggccaggagttccagaccagcctgaccaaaatggtgaaaccctgtctctactaaaaaaatacgaaaattagccaagtgcggtggtgcatgcctgtaatcccagctattcggtaggctgaggtatgaaaatcatttaaacccgggagacagagattgcagtgagctgagatcacgccactgcactccagcctgggtgacagagcaagaccctgtctcaaaaaaaataaataaaaagaagttatgattggggtggaggggggaataaaactgaatttggtggaagagattgactttttattaactatttgtgtatctgttagatataaaacactgaactgggtacaacagggccttcataaaagatgaccaaatgctaagggtagagaaataatctcgggtattttgttatgagaagtcttacaaagatgtaactgtaatatgaaagattgccttctgttttaactcatttatacaattttcctttctctcctttgtactcctaggctagttcaggggatacgataaaagatctccaaatgtgtcctgtacctccttttggctgccacctgcactgctgccatcaccaatggagtgtttttaatgagggaaggaaggtagctttttccccaaagcaaagtcttgtgggatcgattcctgtttacaggggttgtctctctaaatgtcagatatttccccactgctctatgaaatttggctgggtgatacttctgctggtttctttaccttctgtgttacagttctgcatgtcctacttttactcagttctgttttgcattttctttgccctagagacacaagtgtaatctctccctttatccctccactactccacctcagagtagattgtagcctgccaaaggattccttccctcatcctattgaagttgttttttcattgccccatattaatatgactatagaagagccaattaagtagaaatcaagatatacacacacacatagatacacacacacacaccccatacatgtatttatgtggtcttcagagggtccttaaagaatgaattttagattgaaaaatatttagttgtctcattacctcttctaaacacaaaccagctgatgtattttaatctgtttctgttctatcttgtaattaatttggtgggttctacttgttttaacataaataaagagtatgcagcacgtttaataaaatcagaactcttaattggcttatgcccaggtctaggctgagaagtcctttttcttcttcccacctttatttccttagtttctgtccaccttaatcgaaacaacacatggttatgtctttttcctgctacaactacagggtacttgagcctttcccctcaagtgcattcgaagtcacccaggatgatcctcactagtagcctgctttggcagtgtggctttttgcacacttgccctgtcttcctgagactacttcagtaagccatgcttccttcttccccacttttatttggtgtcatgaatagaaacttccaaatgtaaccatggaagctaagtttggcctgctttgctttttagtctccacaccatgggcagaactgctgtctttactacttcatctcacccaagtcccgttcccaggcagccaggggcctgggtttgaataattgcagggccagcctgccatgatctttctcacttactcctctcccattcagcaatcaaccagactaaggagttttgatccctagtgattacagccctgaagaaaattaaatctgaattaattttacatggccttcgtgatctttctgctgttcttactttttcgaatgtagttggggggtgggagggacaggttatggtatttaaagagaataaacattttgcacatacatgtattgtacaacagtaagatcctctgttaaaaccagctgtcctgttctccatctccatttcttcccatgctgtaaccccaggctccaccagctgttccccagtgatgttacctagcttccctctaccgttgtctactgaccatttccactacatgcctttcctaccttcccttcacaaccaatcaagtgaatacttgattattatctcttccttactgtgctttatcttttttgtttggattggttctaattaatgaaaataaaagtttctaaatttacatttttatagggtattgtaaataaaaacaaattgtatacttaaaaatga

SEQ ID NO: 11602 - DNA, 23798 bp, Homo sapiens
ccagccctcagcgcatgcgcaggacgagtcgcctgagggaactgatctcagctcgggcccgcgttacatcctcctcctcttcttccttcggcccagctttccttaggggctgcaacccggacgccgaggccggtttcggagtggggagtgcccattttctctccttcccacgttcctggcccccagacgccatttgcaggcgggtggcttgggtcagcctccccgcccccacccgactcccgtcacgggagagcgcacaccgcgccccgagaaccaatcagcagccgcgttaggtaagggggccgcgagcccgcgcgaggctagcgcaccggcggcgggcggggcgctccggcaggccccgcccccgccttggccattgaaaggtcgctgggacgtccggcgggggtgcggcactgagtagggggccggcgaccgtcaattcgatactgggttggcaggaatgggggcgggggacggaaataacgtgtaaatgagaaacttatgctctgcgagatccaagtacagcctgcaaactgcccgtcaagtactggggaggccgccccaataacgtgtaacgagaaacttgagttgggttccccgagggaagctttgtaaagcaatgcctaaatccgggggaggctcccttctagaaccccgtagagagaagtttaaatcctagggagtccttaggaaaatgtgcaaatcgactacagttctgggctggggagtgccccacgaagtgggcttacatactcaggaatcgggagagtctccccaaatatttgcaaatagtgaggttctgggagatccccgaagggagtgtgtgaagcgatgcctaaatactgaggagacactccccaaaaatatgtaaattcgatttgttaattttcgggaagtcaccctagaagtccatcagcagacacttaaatagaccagctttcctaagtttgggggtaatccccaaaggagcccggaaacagcattggaagtccccagcttgcatgtgggtggggttttttttttttttctttgagacaagagtctcgctctgtcgcccaggctggagtgcagtggcacgatctcggctcactgtatcctccacacctggtttaggtgggcttttaagttccaaggaactccccacattcagatactgtggaagctcccagaataaagggcacagggaggccaggtgcggtggcttacccggggaatccgatcactttgggagaccgaggctggcgaatcacttgaggccaggagttcgataccagcctggccaacatggcgaaaccccgtctctactgaaaatgcaaaacttagcccggcctggtggtatgcacctgtaatcccacctacttgggaggctgaggcaggagaattgcctgaacccgggaggcagaggccgcagccagctgagatcgtgccactgcactccagcctgggcaacagagcaagaccgtctcaaaaaaaaaaaaaaaaaaaaaagaaaagcattcacacaggggcgcttactttgcacaggaaagggcatcctcataggccagtaaacagaaacctcagggctgggcagtatcccaattgaggcatgaagacaagtacttaagcactgggtagatttcagaataatgtgtaaagacacttaattgcaagtgagggaggagtctcagattctggggagaatctccatcccagactaagcagtcatttcggtatggaatgagtcattttccctaagcagctgtaaacaggcccttgtcctcctctgtctaggaaagcagtcttcagcctggcttgtggctctgggagaggtcatgtagcacagtaggagaggagctagacaagccacttgtctggctagcaaaattatgactgcatcttgtaaacagacccttccattctggagagtctcggagggacctgtttatgtcattatgaggtggggcaggggaggattcatggagggatttaacagatacttccaagctaagcaagggtcagcaaactgtttttttgagacagggttctgcttttttttttttttagacagggtcttgctttgttacccaggctagagtgcagtggtgcagcatgatcatggcagccttgacctcccaggctcaagtgatcccaccacctcagcctcccaagtagctgggactacaggtgcatgtcaccacgcccagctacttttttcttttttaaatgttatatagagacaggatcttgctatgttgcccaagctggtctcgaactcctgggctgaagcagtcctcctgtctcggcctcccaaagtgtcgggattacaggtgtgagccaccatactcggccattcagtaaaactttctgttaaggccagagaataattattttaggccctgcagactgtattgtctgtctcagctctgccattgcatcaagaaggcagccacagacagtttctaaattgatggatgtggccatgttccgataaaactttctatttacaaaaacagaaagcagaccagatttggcccctaggccacactttgtcaacctgacttctgagcttgagcagatagccccactgagttctacaaacagttaagtagtcaaataccaccctagactgatgtgtgaacagctgggaaaactctctaaggacctgtaaacagatactgaaatggtggagagtgggttgcataggtagccagacattatataacatctcaaatagaataaacactggagacaccttgaaatgaaattcactgtgagggaaggcagaccgtcaggaacggaagacagacagacactgaaatgtagtgggataccaggtgaaaataggcccttgagtgttggaacctcaccatgacatacactagtaagtggctggagccccaccatgacatacactagtaatgactaatcaagagtagctgttggactgaggatcacattgctggtttgtaagcaaatgccttgctgcattttggtaaggagaatatcctatttttatgtgaacttgcccctgtgagtttatttatgttggagcattttaatagttgggaatagttttggctgcaagtaagagatagatgtgtatttgtttttcactgcctctcgaagtaggcaattcaaggttaacgtggaaccccccaaccttgtgtcttgttttattgtaccttccattaaattgccttacagcccaggatagctgcttgagctccaacctccacacccacattcctgtcactgggaggaaggggcagaaggcatgtgccagagtctgtgaagggaagtttctggaagctgccaagccacacttctagtgtcataccatagccagaaagtacttactcacatggccacacctaactgcaaacaaggatgagaagtttgttctggatagccatgtacctagctcagaactgagggttttacttttttggaagaagtcaggagtggatgttgggaaccagcttgcagttgctaccacaggcccagagctctgttgaaaggaagggccttggccgggcatggtggctcacgcctataatcccagccctttgggaggctgaggcaggtggattgcctgaggtcaggagtttgagaccagcctggccaacatggtgaaaccccatctctactaaaaatacaaaaaaaattagtcgggtgtggtggtgggcatctgtaatcccagcttctcaggagactgaggcaggagaattgcttgaatctgtgaggtggaggctgcagtgagccgagattacgccattgcactccagcctcggtgacaagagcgaaactctgtctcaaaaaaaagaagaaaggaagagccttggttgggcacagtggctcacatctgtaatcccagcactttgggaggccaaggtaggtgcatcacctgaggtcaggagttcgagaccagcctggccaacatggtgaaaccccatctctactaaaaatataaaaattagccaggcatggtggtgggtgcctgtaatcccagctacttgggaggctgaggcagaagaattgcttgaactcaggaggcagaggttgcagtgagccaagatcaggccactgtactccagcctgggcgacagagagactccatctccaaaaaaaagaaagaagggacttcgtatagtctaggatatgccaagtagagtaggaagagactctgtcatcctgaaatcccctcattccctccataggtaaccatgtctgagtctggacacagtcagcctggactctatgggatagagcggcggcgacggtggaaggagcctggctctggtggcccccagaatctctctgggcctggtggtcgggagagggactacattgcaccatgggaaagagagagaagggtgagtgtctggacccaggagcagcattcatgtatctatttggttccacgcacctgccatgtgccaggcactaatccagatgccggggatatatttgtaaacaaaacctaccaccctcatggataaagaaggtggagagtgataaaggagactgttctagataacatggtcagagaaggtctctctgaagaggtgactttttagcagagacttgaaggagatgagagaataagccatgccagcatctgagatgaagagcattccagacagaaagaacagcaagcgcagaggccctgaggtggcccatatctggcgtgttcaaggagtagccataggaggccaggatggctgcaattgatgaggaaggagggagagagataggagatgaagtcaagtaactggggccaaatcatgtaggacctggtaggccttggaaagaactttgtatttcactgagtgaaattggcattggagagtttgagctgagaggtgccatagctcatgttttaaagggtcatgtcataataacaacaactgttactctttttactgagcagcctatactgtgcttgcactgtgcaaagtcttttacatcctttgggtcttcctgaacccttacagctaccccatgaggtagattctatgatagatctgattttcactaatgaggaaaatgagccccagaggtgaagggacttttccaaaatcagagtcaataaactttgggtccaggactcagatccaggtccagcttagtctcacatatagcatcgctctgcctgctgtagagagcgccctgggctgggaatcaggagggatcggcttgtgcccaggcccagcctcgctcccctcctgtacctaggtgactcactgccagaacctgccccctgggcttttttctctagggccctgtccacctcagagatgtcaggtagggtggaagtaggtgacaactggggccagcttctgagctataaaactgtacaaacatgaagaatagttttttcacagtgagctgggctcttacttgctccttctcttgggccacagtgtaaatgagaacacgtagtctctcttccttccacataatgccctcctggggaatgttatcccgccacaccttcaggtttaatccttgaacaagcacctcctaaacctcatctttgtctctaaatgtgctactgagccctggcagcctcttgtcacacccatgggcttcttatcctctgtgtcccgtgctgacctcggcatctttctgccatttttcctcttcccatttttttctcccatatcagtgacagcccattgggccttatcctgaatgcctctctcgcctctcccctgcttcctctgtgctagtcaggcaccagtgctttacattctgccgcctggttatatctgtgtgtcttctctctaccctcacagcgttcatcccaggtatagactgaatatccgaagtgctccaaaattccaaatgttttgagcaccaacgtgacatttaagggaaatgtttattggagccttgcaaatggatttggggtgctcaaccagtaaatatgcaaatattccaaagttcaaaaaaatcccaaattcagaacacttctggtcccaggcatctgagataagagatactcagcctgtatcatctcccccttcctagcctcctggaagtccacagcctctcctcctgtagtttttcccttgaaacttcttttcgaagcactttcacttcgtctttttgtttgttcttcaccgtaagccagtgaagtgagcagggtttaagtaagtgtcctcagtatattggtgaaggaacagacacagttaggggtcaagactctcatgaggttactcaaggaaccagagaaagaacgggactcagactcagatttctcccctcttcagcagactgagggtaagttggggaggcatgaagaggtcaaggcttgggatcagcctgccagctttgccagagcaggagggggctgaggcagaggtgatcaggatagcaagtgccaccagcagctctcacatagtgagcacctgccatgtgtcaggtgccatgctagacacttgatgagttctctctcctttcatcctcatcatagtctgtgaggaaggaattcccatacccactcacagatgggaaaatgaggcataagtgaaggtggcgagggtggttccttattcaagttcacacagccaacacgaggcgggatcaggtttgcacccagacctgtctagctcctagttcctttcctcctgggcttgttgcctcgcagaggcagctgagcagaatgcttgaggatttggttctgcagccaggctgcctgggctttgtgactttgggcaatctgcttaacctttctaggcttcattttcttcatctgtaaagtgggggtaataatagtatctatctcacagggctgttggtaggatcaaggtagttaatatatttcggcatttagaatagttcatggtacataaagatctggaatgtccaggagagccattcatgagtaactgccctccctcaccacaggatgccagcgaagagacaagcacttccgtcatgcagaaaacccccatcatcctctcaaaacctccagcagagcgggtgagcagagaaggagggaggagggggagccgttagggaagggattgcccccattgatgggattttttttacctccgtagtcaaaacagccaccacctccaacagcccctgctgccccgcctgctccagcccctctggagaagcccatcgttctcatgaagccacgggaggaggggaaggggcctgtggccgtgacaggtgcctctacccctgagggcaccgccccaccaccccctgcagcccctgcgccacccaagggggagaaggaggggcagagacccacacagcctgtgtaccagatccagaaccggggcatgggcactgccgcaccagcagccatggaccgtgagttggggctgggcagtaccaggttgggaactggcgtctcctcacagatcctcactgcatcctctgtctcctgctttctccaatctccagctgtcgtgggtcaggccaaactactgcccccagagcgcatgaagcacagcatcaagttggtggatgaccagatgaattggtgtgacagtgccatcgaggtaccgaggggtcctgccctgcctgagcttccgcacatcctgcatcctctgatcttccacctctctgtaggcaacaccagactggagggttttgaggcaacttacagcagtgagagggggtggtatcagaacattctcacctaaccagagcggaatttcaactagctcggctgtgcttgctagttggtaaaatacagaactcctttggtaccgattggtaaagaagtactctcactaccaccccaggacccctgggatctcccgtgccatccacagcaggggagtcttttggaccctgctccagtacccttcttatttggttgaaacccttgctggtggctcatgcctgtaatcccagcactttgggaggccaaggtaggagaatcacctaagcccaggagttcaagaccagcctgggcaacataggaatactccatttctaccaaaaatttaaaaattagccaggcatggtggcaggaggcatccaggccactcaggaggctgaggtaagaggatcacttgactccaggaggtcaaggctgcagagagctgtgatcatgacattgcactccaacctcaacaacagagtgagaccctgtctcagtaaaaaaaaaaaaaaaaagaacaagaagcccacgctgtctcagtgtcaactgttttgaatgtcactcccccaaagtgacccccatccatcccaccaccccctgctctagttcagacctcacattcctagatcatcatacataacaccagtctcccagatgttgtgtcccttcttctgctttttctcccctagacctgtcacacccctgctcagattgtcccagaggtgtcacctctcctacccagcagcctggacttattagcacagcctcaagtccatttattgccttgcccctgccacttctgtgtccactctcacattggaattaactggggagctttaaaaaaacaaaaaacagaacaacaacaaaaaaccaaaccctacccttcagcgctattaaggaaaactttctgcagtgatgaagatcatatatatttgaactatccgtccagtatggtagccgctatccccagatgtggctttagagcacttgaaatgtggctagtacaaccaaacagaatttttaatgttgtttaagcttactaatttaaatagccatgtatgatcaatgcctactgattgaacagggcatccatagatattctgctttaatgtgttaaagcacgttaaatcctgattgggcccaggatttgctttatttatttaggagacggtctcgctctgttgcctaggctggagtgcagtggcaccatctcggctcactgcaacctccacctcccgggttcaagcagttctccagcctcagcttcccaggtagctgggaccacaagtgtgcgacatcacgcgcagatagttgtttttttttttgtttttttgtgatggaatttcgctcctgttgcccaggctggagtgcaatggcacgatctcggctcaccgcaacccccgcctcccgggttcaagcaattctcctgcctcagccttccgagtagctgggattacaggcatgtaccaccacacccaactaattttgtatttttagtagagatggggtttctccatgttggtcaggctggtctgtaactcccgacctcaggtgatccgcctgcctcggcctcccaaagtgctgggattaaaggtgtgagccactgcacccagccgggttttgtatttttggtagagacggagtttcaccatgttggccaggctggtcttgaactcctggcctcaagcgatcctcccaccttggcctcctaaagtgctgggattacaggcgtgggccacaacacctggcctataggattcgcttttaaaaaacaaaacaaaacaaaattttaaggtaattctaaggagcagcagccacagttcagaacgtagctgttttccttgaggagtgtctcttacaccccctggtggtgaaagtcagcagagctggtggcccagagttggtctcagttaatttccagaggggctcttaaatcccacagacaacagcatatgaatgtaaaaaaaaacaaaaaaacacacacacagacgaaagcctgggtggctcctgtttgcacaccactccctttcatgtgctttcccaggtttgccaggaatctgtgccagtagccctcagtcgccgagtcctatcttctccaacctgcccttctgttcctgtgactctcactttcacttctccaagatcagacttccctttttcccgctgtgttcagccacactgacttccttttagcttcttgaccatgctaggctcttttctacttcagagttctcacagacactgttgtttgtgtctaaaacatttcacataatcctaccatgacacggaacagaggccctatgcctagttgaaggggttgggactataggagtttctcttcatatatgataaggcaggtgggggagccacaagggtctctggagtccccccctcattccagctccagcagctgacagacttgtcagagtcatttatgtattttcccacagtacctgttggatcagactgatgtgttggtggttggtgtcctgggcctccaggggacaggcaagtccatggtcatgtcattgttgtcagccaacactccagaggaggaccagaggtgaggggctatcagatagggtgcaggagggaggtgggcacccactgggagcaggggcaaggtgggcttgggtgtttcaagtggtgttaccaaaggactttggaaagttgcttttcttctgtagacctcagtgtcttcatgagatgaagatgataatgggctggactaaatctgtgtagctccaaggcatccaatcctgttcctccctccctccctcccttcctgcctggcctcaggaaatggtacaggtcctagacaagaagtgggatgatgtagttgttaaggttttggatttgggcccacctcaggctcagccctgcaacataactggttgaccttgggcaggtcacttcatttcccgtatcccctgtccaggtagatttttggagaataaaataagatcaagaaggcaaaagttaatgagcacctggcatagagcaagtatcacagaatggtagctgatacgatctgagaaatagagtggggaaagagatctggagacagagagtggtttctgtaccagcctcagtcctactgtgtcaccttgggaaaatggctctgcttctccaggctggggaggatcagacatgaggattctctggcctgaacaacattcttgagtaaggatggaatgtgattatgaagataaagcataagggcacaggagcaggttttggggaggggagaacttgagaaacaggtcccgaaactgggggcagagaaggaaagggaaaaatgtaggaatttgggaatgggggagatacacatctcattaagggagaatcaaaatggggaatgagaatggatagtagccactggggtggtgaagaacagagacatgttgaagttacctaaaaatacagggatctgtttttttgtaaagcaggtgatactaccctggcctccatggatgagcgtcaggagtccattaatcccttaacagtatatgcagaattttatttattcatttatttttgagacagtgtcctgttctttcacccaggctcaagtgcaatggcacgatcatagcccactgcatcctctacctcccaggctcaagtgatcttcccacttcagcctcccaagtagctgggactacaggggcatgccaccacaccagctggtttttaacttttttggtagagatggcgtcttcctctgttgcccaggctggtctcaaactcttgggctcaagcaatcctcccgctttggcctctcaaagtgctgggattacaggtgtgagccaccaccgttggccgtatgcagaattttacacacatttgcagtcaggcttttcttctagggaaaaggtccctagtttgcaccagatctcagagtgggctgatggagatctagaaaaggtgaagaccactgttgggcgaatacacatcccataaagctggagctgtgaggttcctctgcctctctccctcctcttctctgctcactcatgactcagtttggttccattttggaatagttccaggtcttagataacattctttccatttcagcttttcaccccaactagcaaattttccccatgggtctcagttcagattcctgaggtagggagaatcctgtcacccagcttgtctttttgagccacgtcagcctgtggtgtggtagacttcagtatcaactcttttcatcaggtctaggttttgcctcctaattctctctctctctttttttttttgagacagtctcgctctgtcacccaggctggagggcggtggcacaatttcagcttaacacaatctccatctcctgggttcaaccgattcttgtgcctcagcctcccgagtagctgggactaccatgcccagcttatttttatatttttagtagggatggggtttcgccatgtttaccaggctggtcttgaactcctgacaggtgatctgcccacctcggcctcccaaagtgtcgggattacaggtgtgagccaccgtgcctggccttcctgctaattctctttctaattcatctgtttcttccctccttcactcccacctccttagtccaagccattattatcttacatgcaggataccaagaggtttctgtctggtctgcctgatttaattcagttttgacaagtactgtattaattgcttactatgcgccaggcactgttctaggtgctggggatacagtggtatacaaaactggaaaaaatctgcccttgtgggacttatattttaatagggaagatagtaaacaaaataaacacactattcggcacgttagaatataacacaatggaaaagggttatagggaggtaatgttgggcctaggttacaggttttaaaaattattactattttttaagagacgagggtcttgctctgtcacccaggctggagtgtagtggcctgatcatggcttcactgcagccttgacctgggcccaagccatcctcccaccttggccatatgagtagctgggaaccacaggtatgcaccaccatgcccaactaattttttaattttttgtagagacaggatctcactgtgttgcccagactgggctcacgtgatcctttgaccccagccttctgagtagctaggactacatttgtgtaccaccatgcctggctaatttatttattttttatttttgagacaattgtcgctttgtcacccagggtggagtgcagtggctccatcttggcttactgcaacctctatctcctaggtttaggcaattctcctgcctcagcctcccgagtagctgggattacaggcgtgcaccaccacatccggctaatttttgtatttttaatagagacagggtttcaccatgttggccaagctggtcttgaactcctgacctcaagtgatcctcccaccttggcctcccaaagctctgggattacaggcatgagcgaccatgcccttaatatttttttttattttttgtagagatgaggtcttgctgtgttgcccagactaggttatagttttaaataggatggtgagggaaggccttgctaaggggaacgtttgagaaaaagcatgctgggaggagcattccagtgaaagggactggcatgggcaatgcgtctgaagtgggagcttgcccatagtgtgtgtagaagaacgtggcagccttagaaggggagtggtaggagataaggccagagaggcagagcgaggcactctggcactgggccttgtaagcctatctccactttttccaccgtacggtcctcaccacatagcagcaaggggacctttcaaaccacagtctgatcctgtcactcctctacttacatctctccagcagcttctccaggctcataggccaaagccttaccatgctccacaagggtctgtgtatcctcttcttgctccctcccctcccacatgcaccatctttctgctcttgccatgctggtctttgagtcctagtacaacaagccacctactttctgccgatgcaaccttcctctgcgtccatcccccacccagtgccaattaactccctctttctctctcaccctcagcattgtcatttccctctccagggcagccctttctggctccaccaactaagcaatctgcacttggagcactgcacgcctcttctttctaacacccacagttactgatttctggtaatttgtaaactagaccagaagcttcacagaagccgacttagtcttttttgttcactgctatatcctggtatctggcaaataggaggttttccgtatagtgtttgtaaagtggaaggatgcctgctttgtgtcagacaacagattatgcatcttgaggggagatagaaattaccccttgagaggtaggtactattaccctgattttacagatttcaaaaggtaaaatcactttgcccaagtcacagagtcaccaagttgaacttagtggtttagggcacggccctgctctgcctgctttgccctcatattcccagcacccagcacacgtagaagtgagggagactcacctgacaggggaagatgctgggaacaagacccaaactctctctcactgtgggagtggagggcactcagtgctctctctccaatgcctgggatctagtaggtttatttgataattaacagctaaaagtatatatcattatatatcaggcaccattctaagggctttacacataccgacctcacagtaatacacagagttttgatcatgtggttatccccgttttatagatgaggaaactgatggaaaaaggttaaggagtgtgcctaaagccacacagccaggaagaggcagagctgggatctgaatcctggcagactggcggagtctctgcccttcaacacctcagtgtactggcttcattaattgaactaatggatctctttatggataggagtgaaattgtgtgcttcaaaacatgcactacccccgcctcccaccccctgacatgggccacagatgaaaagcttagggagcaggcagggcaccacggctcacatgctcagctcacagggtcacacttcggatgcatccaaggctgagaaccagagctctcacacacccctgcctgctcctctccacaggacttatgttttccgggcccagagcgctgaaatgaaggaacgagggggcaaccagaccagtggcatcgacttctttattacccaagaacggattgttttcctggacacacaggtgccagccccgcctgcctttgccccaccctgccacatcctgcattgagcctcttcctggaatgtgattaagccagaaccctgcgtggattccatgtgcttccagtcaagccatggacatactggctgccctggggcaaattgtgtcttttcttggcccttagtctcttgtcacttttgcccccatctcattcgccttctacacagtagcctaaaggatttctagtatagtgctgaaaagtgtgggccctggagaatgtgtgttctgatcctgtctgttagttcttaccagctgggtgactttcagttttaaactcccttaaaccacagctctttatctgtaaatagggatggtaactgtacttagcctcttaggagtttcaaggattcagtggaacaatccaggcaaagtgcttggccaggacctggcacaaggttagtgctcaggctcgtcactgtcgttagcactgactggtcctgcgtttacctggcagttttcctcggcttctcccttcctctcaggcaaagtccagattccttaagctggcattcggagggtgtggcttgcctccctcagactgcctatcctcgcctctggaggagccaccagacccccagcacacacacactgatctctctcttctctggacttcgcatatcccgtttttacctgaaaccaccaacgaattgtgtgaccttgtcaagttatttattttcattcctcagttttaagtgggaaaaacaatactgcctgcctcataggggttttgtgaggtttcagtgcatcgatgcaagtaaagtcctaatgacagcacccaacaggagttaggtgctaaatacccttagcaattaataccattatcagtacaataggctctcgccttgcgtttttgcctggctaacgccttcttcttcctcaagactccactggggtgtggcctcctctcagaagccctccccttccactgttgcccatatgcacctcccaccatagcatgtgatttgccaccgtgtctgttcccactccctgcctgcccgaagctcttcagagcagagccctggctctgggggtgagagctggggcacagggcctggccctttagttggcactcatagttggtggaacagagttctggtcactgtggcattgatgacacagagtggaaaatctacaaatgtgatgtgagccttgtgtgccaggccctgtgcaggggccatggagacctggagacaaaccaaaccggctgtggtctgggtcagagacctgtgaagaggaggacggaagttaaacaagacagaatagagcactgctcaatgtttggagtttgagaacgcgagcagttgtgaaagcccctttctaaaagaatttcactgcagtaagaagccagtagactatcaagctaatttaatttagctcttaaagttttttgattgaatgttcctttaagaaaaaaaagtccggtgagctcaccactgattcttatacatactgatgcagtttttaaaattctcaccagttttcacactaattattttttttttttacctaagtaattatcttagcaaagttttgaaagcgtatgaaacaactgacaacaaaatgagcctttaagggacatgactcatttgagtaaacgttaaaaattcattagcacaaagcagtttcttctctttgggcatgaggtgcttgcgagcaacagtgatttgtaaaggagctggaaaagtgtatcagctttgagttttttttctttaacttccttttgctgttctaattagaaattgcctgcctttgtttctgaccttgttttgtcctgagatagacaatgtatttgccttgagcgtgtgaaacttgggtatctgagtgacactctgttctcttccttgctgcagcccatcctgagcccttctatcctagaccatctcatcaataatgaccgcaaactgcctccagagtacaaccttccccacacttacgttgaaatgcaggtgagggagccaagccaggcccaggactgaggttttacatccccacccccatcctcccaagatctggagagctgggtgtgggtggtccacttagtttctgcttcagaagagccctggctgccccaagggctataggaagaggacaacactgagagtcaggactggctcaactcctggctctgcccctcaggcaagtcatttcccaccccctcccctttgacgcctcagcatctgcctgtgtaaaatgggggtgataattcccacctttcctgagttagggatggcctgtaagggaagtgccatcacagtgctgggcacacagtagctgcttgaaggctccttgccttgctgcctcctgaactgagtcctgggatcagggactcctgattagtctgggcagaagaggtcctcacctcccttccatcctgcccaccctcagtcactccagattgctgccttccttttcacggtctgccatgtggtgattgttgtccaggactggttcacagacctcagtctctacaggtgaggagctgaggggttggagggtggggaggaggaatgaggcaggagacaaaggcccagagacttgagccactgactcaagggacagcagccagagggatccttttaaaatgtaagttggagcaaatcactcccatctaacctccccctcaaagcactgcgcgcacacacagccctccactgactttacatatctaccagaataaatccaaagtctgcccgtgcatggcttacaaagtcctttgctctctggtcaccttgctgacttctctcactgcctcccctcgctccctttatttttatttatttatttatttatttattgagacggagtctcgctctgtcgcccaggctggagtgcagtggtacaatctcggctcactgcagtctccatcttctgggttcaagtgattctcctgcctcagcctcccgagtagctgggattacaggcacccaccaccatgcccagctaatttttgcatctttagtagagatgggtttcaccatgttggctaggctggttttgaactcctgacctcaggtgatccacctgcctcggccacctaaagtgccggaattataggcgtgagccaccgcacctgccctcactccctttattaaagccacagggcctcatggctgttcttcctgcagcccaggacctctgcactccgcctccctcagtgggaaatacccttcccgcagatctcctcagactctcgccctcgtgccattcgagtcaacttcaggccttccctgaccatctaacatagcatcccctgttactctccctcacttctgtgttttccttcattgcatttacctctccttaataggatactgtagctttccttatgatctttctcccccattcgaatgtaagccctaggagggcaaggtccccagcacctcacacagtgcctggcacacagtaaatatttactacaaatttgctgaataaggagcatgaggagctggcttgtctgatccgtggagttttgctgttcatctccttcaggctcgtgtgccctcctgttggtactcagggaggcaggacctggcaggagtcctgcctgaagcagccacagattgcagaaatgcctccagaagagactggctcagaacctatggccacaagggctcttcctggcttcaggccccaggagaccgctgggaggtgttggggggaacagctttgggcacacggaccaggcagaaggaagggacaggagcttatagggaggggagaaatggaattaggaagcagatgccttcagagctaggtagtgcctttgaatcctagctcttactgggcatgtgtctgtttcctcctcagttcctcatcagcagcattatgttgtgtagattcagtgagttaaggaatttaaagcattcagcttagtccctgttacatagtaagcagttgatggagaaaacttaatgtttgtattagtaaccctggggacagggatgagctgagggtctggccaacagcaaaaaaggcttgctggggagttggttgttctgaccagatctaatgcagctgagctgtgacttcattctgaaacacctattcctaccaccatctgggattcattcacatctaggtgtgccaggcactgttctgggcactagggacacaggtgtgaacaaaacagataaaagagagaaaacagataaaactccttggggagtttacattctggtaggagtattggctcaggccggcacatggcagagccttgtttttaaggtcttgtctacaggtgggcttctcagagtaggggagccccttgagattgtagatgtgtttgtgtgtgtatgaggagaatgtccctgtattttagcaatcccattatcccttaccttagaaaacaggtttatgtactcttaacctattgtaaaaaattattttaaaataacataaactgaaaattccactaaaaaaccacacagatttttttttttttttttttttttttgagacagagtctcactctgttacccaggctggagtgcagtggcacaatctcggctcactgcaacctccgcctcctaggttcaagtgcttctgcctcagcttcccaagtagctgggactacaggtgtgtgccaccatgcccggctattttttgtatttttagtagagacacagtttcgcgatgttggccaggctggtctcgaactcctgacttcaggtgatctgcccgcctcagctccccaaagtgctgagattacaggcgttagccaccgtgctcggccacacagatgtttatagcagctgtatccataattgccaaaacttggaaacaaccaagatgtctttcagtaaatcgaatggataaatcatcagtggcacatctagacaatggaatattattcagcactgaaaagaaatgagctatctcaccataaaaagacatagaggatcattagatgcagatcaagtgaagccaatctgaaaatgctatatacttgtaattccaactatacagacagtctggataaggcagaactacggagacagtaaaaagatcaggggttggagagagggagggatgaatagggacagcacagaggatttttagggcagtgaaactactctgtgatgctataatggcagacacacacctttatacatttgtccaaacctgtaggacgtacagcaccaagagtgatccctgatgtaaactagggattttgggtgataatgatgtgtcagtgcagcttcatggatcttaaatgaaccattcaggttggagatgttgatagtcagggaggctgtgcatgtgcaggggttgtgtgggaacgctacgtgctttctgctcagttttgctgtgaacctaaaactgctctaaaaaatagcctttaaaaaaaaaatacagtaaactcaaagaatttatacagttggtaagtccatgggttggtatctgagaggattatctctgaattctctgaaattgtgagaaacatggtgtgtatatggtatttttctgagcatggctgtagctttcatcagaatctcaaaggaagcccctgtcccaggctgtgggacctggggtgcaagtgcaagagcaacagccactcaccccaaaccccaaggttcctgcagacagcagagatggtgaagccctccaccccatcccccagccacgagtccagcagctcatcgggctccgatgaaggcaccgagtactacccccacctaggtgagaggctttctggggactggaggggtgggcaggaggaaaaatgaggggctgaaagtcaggagcacgctggagaagaggggagagagaggaaggagtggggttctgggtggagcacttttgagagttgtgaggagcaaagtcaaaaaggattagctgctccttccaagttcccactgccctggtccaatcctgacagttgagggcatgacccctgagcctgtgtctggaatgggacaggccccaggtctgcctatttctgggtccctggaatctcccaactcaggaagtgagtattaggttgggttcatctgggtggccccgtccacctgttctccctcctctagcctttgcacatgccgttcctttgcctgtttcatcctttctccgctctactcttcttcaaagacccagttcattttatgatccctcgctagggcctcaaagagactaggggcagaaatcagacctgactcacttctgggtccccagcattgccctacacagagcctggtgctaaagtgaagtgaagttatataaatatttacacagtgatctgaactcaggggtaacaacaggtctttggggtgagaaaggggagtccatgaagccaagcgatgtctgcctgacagggcccgtctcttcccaccctcagtcttcttgcagaacaaagctcgccgagaggacttctgtcctcggaagctgcggcagatgcacctgatgattgaccagctcatggcccactcccacctgcgttacaagggtaagggttcccacatcaccccccaagctagtcagcctcctaattcctgatccaaccccgtgggtcagtctctacccccagactagtctcctgatcctgctttgactgtcaacaattcccactccccaaacccacaacatggtacctgaaggctgaagcgttttctcctccaggaactctgtccatgttacaatgcaatgtcttcccggggcttccacctgacttcctggactctgaggtcaacttattcctggtacccttcatggacagtgaagcagagagtgaaaacccaccaagagcaggtacagttaccctcaacaggttcatggagagacaagtcctatcctgatcagagagagacccagcacccactggtctaggaggcgacatgggttgccctggtttgggagcagtgtggagcctacctggtctgagagaagatcctggtttgttcctggggtgtgtggaccctttattaggagtgtgtttcagagtcatagaagtacaggaagagctcagccggggctgaactctcaggtgctccttgaagcccaggatgctgttaactgggagaaagaccctggcagtctatccctcttaccctccctgccccaactttccaggacctggttccagcccactcttctccctgctgcctgggtatcgtggccaccccagtttccagtccttggtgagcaagctccggagccaagtgatgtccatggcccggccacagctgtcacacacgatcctcaccgagaagaactggtaagagctctttgcagagggggtcaatttgaggcaccccaccctggtgtagagagaagggggcgtcccttagatcggcatgaccttgtgaagcccctcctctccagatcccaggttccttttctggaacagtgatgattgctactgtcttgtaagcatctcacccatgtggcaacatgctgtttcctgtgactttgaatcctcctaatcagccagcatcatgtaggtccttgtcaccagttttcctggtggggaaatttaggctcggggaaaagtgttacatagcaaggccacacatctgtggctaggagtcatttgattgctaggagtaggaccagtgaccagatttagcttaaggaagatttattccagggacctgatcacagaaagcagggccctgcagcagatgggaaccaggaagccatcagggtctcattcttcacacttctgcatttgtcttgtttcctgcctctggctttctctccctgctttcacttggcccggcactagctctgtggcccctactttacattacttctttgtccagagctctcagcatatgagtccaggtcttcctcatcttacttcaaagagaaaaattggaaagataaatagcttaactgggtgcagcctctctaacttggctccctacatctgtttgcagttggctgtgcctggaaggggtcaggagtgcagacaaagcagcaggaagcccctcagggcttgtagggcagagatggggcagagctttgagtcccagctctgctcctgccattggtctaaaccaggacccagaggagagagggagaagattgtgggttgtgcagctgctgttagatgttttctatgtcgtaagactctggagggaggtggaaactgaaccctcacccacaaagccagcactgtgtggagtgggagaagtttaggtggtggagacttgaggtcttagtccaagccctggaaccttcagctttgcataacctgggtgagctaagaaaagttgggccacctcccatcactgttaggatcctccctgtatcccagtcgaggagattgggttccaagaggctcagagtcacatctcaggtcataaaaggggcctcagtttctccacctgtcccgggttggtgctgggctggggggagccccggccaggcagccctgactgttggcctcctcacaggttccactacgctgcccggatctgggatggggtgagaaagtcctctgctctggcagagtacagccgcctgctggcctgaggccaaggagaggaatgtcatgcaggggacctcctgggtccgcagtgtactgcgagggagcacagatgtccatcccccgctggggtggagagcggcagcaggcctgatggatgagggatcgtggcttcccggcccagagacatgaggtgtccagggccaggccccccaccctcagttggggctgttccgggggtgactgtgagcgatcccaccccaaacctgagatggggtagcccgtcctgtgtcctccacagggacaagcagtgggaggagtctgaatggtcaccaggaagcccgggctccatcttgacctcctttttcagggacaggagcaacaggcccctcttccctgactctaagcccttccctgtaaggtgaggcagggtctggagagctctttattggaacagatctggtggttcaaataaacacagtcatgcaagcctg

SEQ ID NO: 11603 - DNA, 14987 bp, Homo sapiens
ccagccctcagcgcatgcgcaggacgagtcgcctgagggaactgatctcagctcgggcccgcgttacatcctcctcctcttcttccttcggcccagctttccttaggggctgcaacccggacgccgaggccggtttcggagtggggagtgcccattttctctccttcccacgttcctggcccccagacgccatttgcaggcgggtggcttgggtcagcctccccgcccccacccgactcccgtcacgggagagcgcacaccgcgccccgagaaccaatcagcagccgcgttaggtaagggggccgcgagcccgcgcgaggctagcgcaccggcggcgggcggggcgctccggcaggccccgcccccgccttggccattgaaaggtcgctgggacgtccggcgggggtgcggcactgagtagggggccggcgaccgtcaattcgatactgggttggcaggaatgggggcgggggacggaaataacgtgtaaatgagaaacttatgctctgcgagatccaagtacagcctgcaaactgcccgtcaagtactggggaggccgccccaataacgtgtaacgagaaacttgagttgggttccccgagggaagctttgtaaagcaatgcctaaatccgggggaggctcccttctagaaccccgtagagagaagtttaaatcctagggagtccttaggaaaatgtgcaaatcgactacagttctgggctggggagtgccccacgaagtgggcttacatactcaggaatcgggagagtctccccaaatatttgcaaatagtgaggttctgggagatccccgaagggagtgtgtgaagcgatgcctaaatactgaggagacactccccaaaaatatgtaaattcgatttgttaattttcgggaagtcaccctagaagtccatcagcagacacttaaatagaccagctttcctaagtttgggggtaatccccaaaggagcccggaaacagcattggaagtccccagcttgcatgtgggtggggttttttttttttttctttgagacaagagtctcgctctgtcgcccaggctggagtgcagtggcacgatctcggctcactgtatcctccacacctggtttaggtgggcttttaagttccaaggaactccccacattcagatactgtggaagctcccagaataaagggcacagggaggccaggtgcggtggcttacccggggaatccgatcactttgggagaccgaggctggcgaatcacttgaggccaggagttcgataccagcctggccaacatggcgaaaccccgtctctactgaaaatgcaaaacttagcccggcctggtggtatgcacctgtaatcccacctacttgggaggctgaggcaggagaattgcctgaacccgggaggcagaggccgcagccagctgagatcgtgccactgcactccagcctgggcaacagagcaagaccgtctcaaaaaaaaaaaaaaaaaaaaaagaaaagcattcacacaggggcgcttactttgcacaggaaagggcatcctcataggccagtaaacagaaacctcagggctgggcagtatcccaattgaggcatgaagacaagtacttaagcactgggtagatttcagaataatgtgtaaagacacttaattgcaagtgagggaggagtctcagattctggggagaatctccatcccagactaagcagtcatttcggtatggaatgagtcattttccctaagcagctgtaaacaggcccttgtcctcctctgtctaggaaagcagtcttcagcctggcttgtggctctgggagaggtcatgtagcacagtaggagaggagctagacaagccacttgtctggctagcaaaattatgactgcatcttgtaaacagacccttccattctggagagtctcggagggacctgtttatgtcattatgaggtggggcaggggaggattcatggagggatttaacagatacttccaagctaagcaagggtcagcaaactgtttttttgagacagggttctgcttttttttttttttagacagggtcttgctttgttacccaggctagagtgcagtggtgcagcatgatcatggcagccttgacctcccaggctcaagtgatcccaccacctcagcctcccaagtagctgggactacaggtgcatgtcaccacgcccagctacttttttcttttttaaatgttatatagagacaggatcttgctatgttgcccaagctggtctcgaactcctgggctgaagcagtcctcctgtctcggcctcccaaagtgtcgggattacaggtgtgagccaccatactcggccattcagtaaaactttctgttaaggccagagaataattattttaggccctgcagactgtattgtctgtctcagctctgccattgcatcaagaaggcagccacagacagtttctaaattgatggatgtggccatgttccgataaaactttctatttacaaaaacagaaagcagaccagatttggcccctaggccacactttgtcaacctgacttctgagcttgagcagatagccccactgagttctacaaacagttaagtagtcaaataccaccctagactgatgtgtgaacagctgggaaaactctctaaggacctgtaaacagatactgaaatggtggagagtgggttgcataggtagccagacattatataacatctcaaatagaataaacactggagacaccttgaaatgaaattcactgtgagggaaggcagaccgtcaggaacggaagacagacagacactgaaatgtagtgggataccaggtgaaaataggcccttgagtgttggaacctcaccatgacatacactagtaagtggctggagccccaccatgacatacactagtaatgactaatcaagagtagctgttggactgaggatcacattgctggtttgtaagcaaatgccttgctgcattttggtaaggagaatatcctatttttatgtgaacttgcccctgtgagtttatttatgttggagcattttaatagttgggaatagttttggctgcaagtaagagatagatgtgtatttgtttttcactgcctctcgaagtaggcaattcaaggttaacgtggaaccccccaaccttgtgtcttgttttattgtaccttccattaaattgccttacagcccaggatagctgcttgagctccaacctccacacccacattcctgtcactgggaggaaggggcagaaggcatgtgccagagtctgtgaagggaagtttctggaagctgccaagccacacttctagtgtcataccatagccagaaagtacttactcacatggccacacctaactgcaaacaaggatgagaagtttgttctggatagccatgtacctagctcagaactgagggttttacttttttggaagaagtcaggagtggatgttgggaaccagcttgcagttgctaccacaggcccagagctctgttgaaaggaagggccttggccgggcatggtggctcacgcctataatcccagccctttgggaggctgaggcaggtggattgcctgaggtcaggagtttgagaccagcctggccaacatggtgaaaccccatctctactaaaaatacaaaaaaaattagtcgggtgtggtggtgggcatctgtaatcccagcttctcaggagactgaggcaggagaattgcttgaatctgtgaggtggaggctgcagtgagccgagattacgccattgcactccagcctcggtgacaagagcgaaactctgtctcaaaaaaaagaagaaaggaagagccttggttgggcacagtggctcacatctgtaatcccagcactttgggaggccaaggtaggtgcatcacctgaggtcaggagttcgagaccagcctggccaacatggtgaaaccccatctctactaaaaatataaaaattagccaggcatggtggtgggtgcctgtaatcccagctacttgggaggctgaggcagaagaattgcttgaactcaggaggcagaggttgcagtgagccaagatcaggccactgtactccagcctgggcgacagagagactccatctccaaaaaaaagaaagaagggacttcgtatagtctaggatatgccaagtagagtaggaagagactctgtcatcctgaaatcccctcattccctccataggtaaccatgtctgagtctggacacagtcagcctggactctatgggatagagcggcggcgacggtggaaggagcctggctctggtggcccccagaatctctctgggcctggtggtcgggagagggactacattgcaccatgggaaagagagagaagggtgagtgtctggacccaggagcagcattcatgtatctatttggttccacgcacctgccatgtgccaggcactaatccagatgccggggatatatttgtaaacaaaacctaccaccctcatggataaagaaggtggagagtgataaaggagactgttctagataacatggtcagagaaggtctctctgaagaggtgactttttagcagagacttgaaggagatgagagaataagccatgccagcatctgagatgaagagcattccagacagaaagaacagcaagcgcagaggccctgaggtggcccatatctggcgtgttcaaggagtagccataggaggccaggatggctgcaattgatgaggaaggagggagagagataggagatgaagtcaagtaactggggccaaatcatgtaggacctggtaggccttggaaagaactttgtatttcactgagtgaaattggcattggagagtttgagctgagaggtgccatagctcatgttttaaagggtcatgtcataataacaacaactgttactctttttactgagcagcctatactgtgcttgcactgtgcaaagtcttttacatcctttgggtcttcctgaacccttacagctaccccatgaggtagattctatgatagatctgattttcactaatgaggaaaatgagccccagaggtgaagggacttttccaaaatcagagtcaataaactttgggtccaggactcagatccaggtccagcttagtctcacatatagcatcgctctgcctgctgtagagagcgccctgggctgggaatcaggagggatcggcttgtgcccaggcccagcctcgctcccctcctgtacctaggtgactcactgccagaacctgccccctgggcttttttctctagggccctgtccacctcagagatgtcaggtagggtggaagtaggtgacaactggggccagcttctgagctataaaactgtacaaacatgaagaatagttttttcacagtgagctgggctcttacttgctccttctcttgggccacagtgtaaatgagaacacgtagtctctcttccttccacataatgccctcctggggaatgttatcccgccacaccttcaggtttaatccttgaacaagcacctcctaaacctcatctttgtctctaaatgtgctactgagccctggcagcctcttgtcacacccatgggcttcttatcctctgtgtcccgtgctgacctcggcatctttctgccatttttcctcttcccatttttttctcccatatcagtgacagcccattgggccttatcctgaatgcctctctcgcctctcccctgcttcctctgtgctagtcaggcaccagtgctttacattctgccgcctggttatatctgtgtgtcttctctctaccctcacagcgttcatcccaggtatagactgaatatccgaagtgctccaaaattccaaatgttttgagcaccaacgtgacatttaagggaaatgtttattggagccttgcaaatggatttggggtgctcaaccagtaaatatgcaaatattccaaagttcaaaaaaatcccaaattcagaacacttctggtcccaggcatctgagataagagatactcagcctgtatcatctcccccttcctagcctcctggaagtccacagcctctcctcctgtagtttttcccttgaaacttcttttcgaagcactttcacttcgtctttttgtttgttcttcaccgtaagccagtgaagtgagcagggtttaagtaagtgtcctcagtatattggtgaaggaacagacacagttaggggtcaagactctcatgaggttactcaaggaaccagagaaagaacgggactcagactcagatttctcccctcttcagcagactgagggtaagttggggaggcatgaagaggtcaaggcttgggatcagcctgccagctttgccagagcaggagggggctgaggcagaggtgatcaggatagcaagtgccaccagcagctctcacatagtgagcacctgccatgtgtcaggtgccatgctagacacttgatgagttctctctcctttcatcctcatcatagtctgtgaggaaggaattcccatacccactcacagatgggaaaatgaggcataagtgaaggtggcgagggtggttccttattcaagttcacacagccaacacgaggcgggatcaggtttgcacccagacctgtctagctcctagttcctttcctcctgggcttgttgcctcgcagaggcagctgagcagaatgcttgaggatttggttctgcagccaggctgcctgggctttgtgactttgggcaatctgcttaacctttctaggcttcattttcttcatctgtaaagtgggggtaataatagtatctatctcacagggctgttggtaggatcaaggtagttaatatatttcggcatttagaatagttcatggtacataaagatctggaatgtccaggagagccattcatgagtaactgccctccctcaccacaggatgccagcgaagagacaagcacttccgtcatgcagaaaacccccatcatcctctcaaaacctccagcagagcgggtgagcagagaaggagggaggagggggagccgttagggaagggattgcccccattgatgggattttttttacctccgtagtcaaaacagccaccacctccaacagcccctgctgccccgcctgctccagcccctctggagaagcccatcgttctcatgaagccacgggaggaggggaaggggcctgtggccgtgacaggtgcctctacccctgagggcaccgccccaccaccccctgcagcccctgcgccacccaagggggagaaggaggggcagagacccacacagcctgtgtaccagatccagaaccggggcatgggcactgccgcaccagcagccatggaccgtgagttggggctgggcagtaccaggttgggaactggcgtctcctcacagatcctcactgcatcctctgtctcctgctttctccaatctccagctgtcgtgggtcaggccaaactactgcccccagagcgcatgaagcacagcatcaagttggtggatgaccagatgaattggtgtgacagtgccatcgaggtaccgaggggtcctgccctgcctgagcttccgcacatcctgcatcctctgatcttccacctctctgtaggcaacaccagactggagggttttgaggcaacttacagcagtgagagggggtggtatcagaacattctcacctaaccagagcggaatttcaactagctcggctgtgcttgctagttggtaaaatacagaactcctttggtaccgattggtaaagaagtactctcactaccaccccaggacccctgggatctcccgtgccatccacagcaggggagtcttttggaccctgctccagtacccttcttatttggttgaaacccttgctggtggctcatgcctgtaatcccagcactttgggaggccaaggtaggagaatcacctaagcccaggagttcaagaccagcctgggcaacataggaatactccatttctaccaaaaatttaaaaattagccaggcatggtggcaggaggcatccaggccactcaggaggctgaggtaagaggatcacttgactccaggaggtcaaggctgcagagagctgtgatcatgacattgcactccaacctcaacaacagagtgagaccctgtctcagtaaaaaaaaaaaaaaaaagaacaagaagcccacgctgtctcagtgtcaactgttttgaatgtcactcccccaaagtgacccccatccatcccaccaccccctgctctagttcagacctcacattcctagatcatcatacataacaccagtctcccagatgttgtgtcccttcttctgctttttctcccctagacctgtcacacccctgctcagattgtcccagaggtgtcacctctcctacccagcagcctggacttattagcacagcctcaagtccatttattgccttgcccctgccacttctgtgtccactctcacattggaattaactggggagctttaaaaaaacaaaaaacagaacaacaacaaaaaaccaaaccctacccttcagcgctattaaggaaaactttctgcagtgatgaagatcatatatatttgaactatccgtccagtatggtagccgctatccccagatgtggctttagagcacttgaaatgtggctagtacaaccaaacagaatttttaatgttgtttaagcttactaatttaaatagccatgtatgatcaatgcctactgattgaacagggcatccatagatattctgctttaatgtgttaaagcacgttaaatcctgattgggcccaggatttgctttatttatttaggagacggtctcgctctgttgcctaggctggagtgcagtggcaccatctcggctcactgcaacctccacctcccgggttcaagcagttctccagcctcagcttcccaggtagctgggaccacaagtgtgcgacatcacgcgcagatagttgtttttttttttgtttttttgtgatggaatttcgctcctgttgcccaggctggagtgcaatggcacgatctcggctcaccgcaacccccgcctcccgggttcaagcaattctcctgcctcagccttccgagtagctgggattacaggcatgtaccaccacacccaactaattttgtatttttagtagagatggggtttctccatgttggtcaggctggtctgtaactcccgacctcaggtgatccgcctgcctcggcctcccaaagtgctgggattaaaggtgtgagccactgcacccagccgggttttgtatttttggtagagacggagtttcaccatgttggccaggctggtcttgaactcctggcctcaagcgatcctcccaccttggcctcctaaagtgctgggattacaggcgtgggccacaacacctggcctataggattcgcttttaaaaaacaaaacaaaacaaaattttaaggtaattctaaggagcagcagccacagttcagaacgtagctgttttccttgaggagtgtctcttacaccccctggtggtgaaagtcagcagagctggtggcccagagttggtctcagttaatttccagaggggctcttaaatcccacagacaacagcatatgaatgtaaaaaaaaacaaaaaaacacacacacagacgaaagcctgggtggctcctgtttgcacaccactccctttcatgtgctttcccaggtttgccaggaatctgtgccagtagccctcagtcgccgagtcctatcttctccaacctgcccttctgttcctgtgactctcactttcacttctccaagatcagacttccctttttcccgctgtgttcagccacactgacttccttttagcttcttgaccatgctaggctcttttctacttcagagttctcacagacactgttgtttgtgtctaaaacatttcacataatcctaccatgacacggaacagaggccctatgcctagttgaaggggttgggactataggagtttctcttcatatatgataaggcaggtgggggagccacaagggtctctggagtccccccctcattccagctccagcagctgacagacttgtcagagtcatttatgtattttcccacagtacctgttggatcagactgatgtgttggtggttggtgtcctgggcctccaggggacaggcaagtccatggtcatgtcattgttgtcagccaacactccagaggaggaccagaggtgaggggctatcagatagggtgcaggagggaggtgggcacccactgggagcaggggcaaggtgggcttgggtgtttcaagtggtgttaccaaaggactttggaaagttgcttttcttctgtagacctcagtgtcttcatgagatgaagatgataatgggctggactaaatctgtgtagctccaaggcatccaatcctgttcctccctccctccctcccttcctgcctggcctcaggaaatggtacaggtcctagacaagaagtgggatgatgtagttgttaaggttttggatttgggcccacctcaggctcagccctgcaacataactggttgaccttgggcaggtcacttcatttcccgtatcccctgtccaggtagatttttggagaataaaataagatcaagaaggcaaaagttaatgagcacctggcatagagcaagtatcacagaatggtagctgatacgatctgagaaatagagtggggaaagagatctggagacagagagtggtttctgtaccagcctcagtcctactgtgtcaccttgggaaaatggctctgcttctccaggctggggaggatcagacatgaggattctctggcctgaacaacattcttgagtaaggatggaatgtgattatgaagataaagcataagggcacaggagcaggttttggggaggggagaacttgagaaacaggtcccgaaactgggggcagagaaggaaagggaaaaatgtaggaatttgggaatgggggagatacacatctcattaagggagaatcaaaatggggaatgagaatggatagtagccactggggtggtgaagaacagagacatgttgaagttacctaaaaatacagggatctgtttttttgtaaagcaggtgatactaccctggcctccatggatgagcgtcaggagtccattaatcccttaacagtatatgcagaattttatttattcatttatttttgagacagtgtcctgttctttcacccaggctcaagtgcaatggcacgatcatagcccactgcatcctctacctcccaggctcaagtgatcttcccacttcagcctcccaagtagctgggactacaggggcatgccaccacaccagctggtttttaacttttttggtagagatggcgtcttcctctgttgcccaggctggtctcaaactcttgggctcaagcaatcctcccgctttggcctctcaaagtgctgggattacaggtgtgagccaccaccgttggccgtatgcagaattttacacacatttgcagtcaggcttttcttctagggaaaaggtccctagtttgcaccagatctcagagtgggctgatggagatctagaaaaggtgaagaccactgttgggcgaatacacatcccataaagctggagctgtgaggttcctctgcctctctccctcctcttctctgctcactcatgactcagtttggttccattttggaatagttccaggtcttagataacattctttccatttcagcttttcaccccaactagcaaattttccccatgggtctcagttcagattcctgaggtagggagaatcctgtcacccagcttgtctttttgagccacgtcagcctgtggtgtggtagacttcagtatcaactcttttcatcaggtctaggttttgcctcctaattctctctctctctttttttttttgagacagtctcgctctgtcacccaggctggagggcggtggcacaatttcagcttaacacaatctccatctcctgggttcaaccgattcttgtgcctcagcctcccgagtagctgggactaccatgcccagcttatttttatatttttagtagggatggggtttcgccatgtttaccaggctggtcttgaactcctgacaggtgatctgcccacctcggcctcccaaagtgtcgggattacaggtgtgagccaccgtgcctggccttcctgctaattctctttctaattcatctgtttcttccctccttcactcccacctccttagtccaagccattattatcttacatgcaggataccaagaggtttctgtctggtctgcctgatttaattcagttttgacaagtactgtattaattgcttactatgcgccaggcactgttctaggtgctggggatacagtggtatacaaaactggaaaaaatctgcccttgtgggacttatattttaatagggaagatagtaaacaaaataaacacactattcggcacgttagaatataacacaatggaaaagggttatagggaggtaatgttgggcctaggttacaggttttaaaaattattactattttttaagagacgagggtcttgctctgtcacccaggctggagtgtagtggcctgatcatggcttcactgcagccttgacctgggcccaagccatcctcccaccttggccatatgagtagctgggaaccacaggtatgcaccaccatgcccaactaattttttaattttttgtagagacaggatctcactgtgttgcccagactgggctcacgtgatcctttgaccccagccttctgagtagctaggactacatttgtgtaccaccatgcctggctaatttatttattttttatttttgagacaattgtcgctttgtcacccagggtggagtgcagtggctccatcttggcttactgcaacctctatctcctaggtttaggcaattctcctgcctcagcctcccgagtagctgggattacaggcgtgcaccaccacatccggctaatttttgtatttttaatagagacagggtttcaccatgttggccaagctggtcttgaactcctgacctcaagtgatcctcccaccttggcctcccaaagctctgggattacaggcatgagcgaccatgcccttaatatttttttttattttttgtagagatgaggtcttgctgtgttgcccagactaggttatagttttaaataggatggtgagggaaggccttgctaaggggaacgtttgagaaaaagcatgctgggaggagcattccagtgaaagggactggcatgggcaatgcgtctgaagtgggagcttgcccatagtgtgtgtagaagaacgtggcagccttagaaggggagtggtaggagataaggccagagaggcagagcgaggcactctggcactgggccttgtaagcctatctccactttttccaccgtacggtcctcaccacatagcagcaaggggacctttcaaaccacagtctgatcctgtcactcctctacttacatctctccagcagcttctccaggctcataggccaaagccttaccatgctccacaagggtctgtgtatcctcttcttgctccctcccctcccacatgcaccatctttctgctcttgccatgctggtctttgagtcctagtacaacaagccacctactttctgccgatgcaaccttcctctgcgtccatcccccacccagtgccaattaactccctctttctctctcaccctcagcattgtcatttccctctccagggcagccctttctggctccaccaactaagcaatctgcacttggagcactgcacgcctcttctttctaacacccacagttactgatttctggtaatttgtaaactagaccagaagcttcacagaagccgacttagtcttttttgttcactgctatatcctggtatctggcaaataggaggttttccgtatagtgtttgtaaagtggaaggatgcctgctttgtgtcagacaacagattatgcatcttgaggggagatagaaattaccccttgagaggtaggtactattaccctgattttacagatttcaaaaggtaaaatcactttgcccaagtcacagagtcaccaagttgaacttagtggtttagggcacggccctgctctgcctgctttgccctcatattcccagcacccagcacacgtagaagtgagggagactcacctgacaggggaagatgctgggaacaagacccaaactctctctcactgtgggagtggagggcactcagtgctctctctccaatgcctgggatctagtaggtttatttgataattaacagctaaaagtatatatcattatatatcaggcaccattctaagggctttacacataccgacctcacagtaatacacagagttttgatcatgtggttatccccgttttatagatgaggaaactgatggaaaaaggttaaggagtgtgcctaaagccacacagccaggaagaggcagagctgggatctgaatcctggcagactggcggagtctctgcccttcaacacctcagtgtactggcttcattaattgaactaatggatctctttatggataggagtgaaattgtgtgcttcaaaacatgcactacccccgcctcccaccccctgacatgggccacagatgaaaagcttagggagcaggcagggcaccacggctcacatgctcagctcacagggtcacacttcggatgcatccaaggctgagaaccagagctctcacacacccctgcctgctcctctccacaggacttatgttttccgggcccagagcgctgaaatgaaggaacgagggggcaaccagaccagtggcatcgacttctttattacccaagaacggattgttttcctggacacacaggtgccagccccgcctgcctttgccccaccctgccacatcctgcattgagcctcttcctggaatgtgattaagccagaaccctgcgtggattccatgtgcttccagtcaagccatggacatactggctgccctggggcaaattgtgtc

SEQ ID NO: 11604 - DNA, 2858 bp, Homo sapiens
  misc_feature (178)..(178): n equals a,t,g, or c
cagagatgtcaggtagggtggaagtaggtgacaattggggccagcttctgagctataaaactgtacaaacatgaagaatagttttttcacagtgagctgggctcttacttgctccttctcttgggccacagtgtaaatgagaacacgtagtctctcttctttccacataatgccctcntggggaatgttatcccgccacaccttcaggtttaatccttgaacaagcacctcctaaatctcatctttgtctctaaatgtgctaatgagccctggcagcctcttgtcacacccatgggcttcttatcctctgtgtcccgtgctgacctcggcatctttctgccatttttcctcttcccatttttttctcccatatcagtgacagcccattgggccttatcatgaatgcctctctcgcctctcccctgcttcctctgtgctagtcaggcaccagtgctttacattctgccgcctggttatatctgtgtgtcttctctctaccctcacagcgttcatcccaggtatagactgaatatccgaagtgctccaaaattccaaatgttttgagcaccaacgtgacatttaagggaaatgtttattggagccttgcaaatgcatttggggtgctcaaccagtaaatatgcaaatattccaaagttcaaaaaaatcccaaattcagaacacttctggtcccaggcatctgagataagagatactcagcctgtatcatctcccccttcctagcctcctggaagtccacagcctctcctcctgtagtttttcccttgaaacttcttttcgaagcactttcacttcgtctttttgtttgttcttcaccgtaagccagtgaagtgagcagggtttaagtaagtgtcctcagtatattggtgaaggaacagacacagttaggggtcaagactctcatgaggttactcaaggaaccagagaaagaacgggactcagactcagatttctcccctcttcagcagactgagggtaagttggggaggcatgaagaggtcaaggcttgggatcagcctgccagctttgccagagcaggatggggctgaggcagaggtgatcaggatagcaagtgccaccagcagctctcacatagtgagcacctgccatgtgtcaggtgccatgctagacacttgatgagttctctctcctttcatcctcatcatagtctgtgaggaaggaattcccatacccactcacagatgggaaaatgaggcataagtgaaggtggcgagggtggttccttattcaagttcacacagccaacacgaggcgggatcaggtttgcacccagacctgtctagctcctagttcctttcctcctgggcttgttgcctcgcagaggcagctgagcagaatgcttgaggatttggttctgcagccaggctgcctgggctttgtgactttgggcaatctgcttaacctttctaggcttcattttcttcatctgtaaagtgggggtaataatagtatctatctcacagggctgttggtaggatcaaggtagttaatatatttcggcatttagaatagttcatggtacataaagatctggaatgtccaggagagccattcatgagtaactgccctccctcaccacaggatgccagcgaagagacaagcacttccgtcatgcagaaaacccccatcatcctctcaaaacctccagcagagcgggtgagcacagaaggagggaggagggggagccattagggaagggattgcccccattgatgggattttttttacctccgtagtcaaaacagccaccacctccaacagcccctgctgccccgcctgctccagcccctctggagaagcccatcgttctcatgaagccacgggaggaggggaaggggcctgtggccgtgacaggtgcctctacccctgagggcaccgcccccaccaccccctgcagcccctgcgccacccaagggggagaaggaggggcagagacccacacagcctgtgtaccagatccagaaccggggcatgggcactgccgcaccagcagccatggaccgtgagttggggctgggcagtaccaggttgggaactggtgtctcctcacagatcctcactgcatcctctgtctcctgctttctccaatctccagctgtcgtgggtcaggccaaactactgcccccagagcgcatgaagcacagcatcaagttggtggatgaccagatgaattggtgtgacagtgccatcgaggtactgaggggtcctgccctgcctgagcttccgcacaccctgcatcctctgatcttccacctctctgtaggcaacaccagactggagggttttgaggcaacttacagcagtgagagggggtggaatcagaacattctcacctaaccagagcggaatttcaactagctcagctgtgcttgctagttggtaaaatacagaactcctttggtaccgattggtaaagaagtactctcactaccaccccaggacccctgggatctcccgtgccatccacagcaggggagtcttttggaccctgctccagtacccttcttatttggttgaaacccttgctggtggctcatgcctgtaatcccagcactttgggaggccaaggtaggagaatcacctaagcccacgagttcaagaccagcctgggcaacatatgaatactccatttctaccaaaaatttaaaaattatccaggcatgggggcaggaggcatccaggccactcatgaggctgaggtgagaggatcacttgactccacgaggtgaaggctgcagagagctgtgatcatgacattgcactccaacctcaacaacagagtgagaccctgtctcagtgaaaaaaaaaaaaaaaagaac

SEQ ID NO: 11605 - DNA, 86 bp, Homo sapiens
aggggttattctgtttcctggggtggcatcaagcctcccctgtgtatgttttggatgggaaaatacactggtgcagctgagtacag

SEQ ID NO: 11606 - DNA, 355 bp, Homo sapiens
gagctggggcacagggcctggccctttagttggcactcatagttggtggaacagagttctggtcactgtggcattgatgacacagagtggaaaatctacaaatgtgatgtgagccttgtgtgccaggccctgtgcaggggccatggagacctggagacaaaccaaaccggctgtggtctgggtcagagacctgtgaagaggaggacggaagttaaacaagacagaatagagcactgctcaatgtttggagtttgagaacgcgagcagttgtgaaagcccctttctaaaagaatttcactgcagtaagaagccagtagactatcaagctaatttaatttagctcttaaagtttttt

SEQ ID NO: 11607 - DNA, 345 bp, Homo sapiens
cactccagcctcggtgacaagagcgaaactctgtctcaaaaaaaagaagaaaggaagagccttggttgggcacagtggctcacgtctgtaatcccagcactttgggaggccaaggtaggtgcatcacctgaggtcaggagttcgagaccagcctggccaacatggtgaaaccccatctctactaaaaatgtaaaaattagccaggcatggtggtgggtgcctgtaatcccagctacttgggaggctgaggcagaagaattgcttgaactcaggaggcagaggttgcagtgagccaagatcaggccactgtactccagcctgggcgacagagagactccatctcca

SEQ ID NO: 11608 - DNA, 4066 bp, Homo sapiens
cagcagcctaggggcctaggcccgggccaccatggcgctgcctccaggcccagccgccctccggcacacactgctgctcctgccagcccttctgagctcaggtacacccctgttcagtcgttgaccaagtccttctgggttccaaagccccctctctcccctgtctgcacttctgtttgggtacccactccaggccccaagccctggagtccctgtccccttcacccacctaccctaggtccaaccagccagtccctggtgagaggactcaggtgccctttcctttggcctgctgctcttctcactgggccaattcctggtcacagcacagtaccaaccgtgcctgagcccttcccagaggcctcctgctgtgttccaggttggggggagttggagccacaaatagatggtcagacctgggctgagcgggcacttcgggagaatgaacgccacgccttcacctgccgggtggcaggggggcctggcacccccagattggcctggtatctggatggacagctgcaggaggccagcacctcaagactgctgagcgtgggaggggaggccttctctggaggcaccagcaccttcactgtcactgcccatcgggcccagcatgagctcaactgctctctgcaggaccccagaagtggccgatcagccaacgcctctgtcatccttaatgtgcaatgtgagtggccctgaggtgggcagggagataggttctttgcccagggacccccagcacccaccaggcaggtggtccgcaggacatttagcagacacttaagcactttgcaaatatgaactcatttgatcctctgagtaaccccatgaggtcattactattgtcgtcaccattttacaaataagaaaactgaggcagaaagaggtaagcaatctgcccagggtgatgatcccgctggtaagaagcagagccaggattcacatctgggcatttggctctagtatttacactcataatcactccgaaatgctgcctctctggcagacccagccatcctgttcctcagcatcccctctgaggagaggcccaggcccctggctcccatctgggtttgggaagaaagggctagaagtatgaggggctgtggtgagagcatattggcctctgctttgtaccagtcaagccagagattgcccaagtcggcgccaagtaccaggaagctcagggcccaggcctcctggttgtcctgtttgccctggtgcgtgccaacccgccggccaatgtcacctggatcgaccaggatgggccagtgactgtcaacacctctgacttcctggtgctggatgcgcagaactacccctggctcaccaaccacacggtgcagctgcagctccgcagcctggcacacaacctctcggtggtggccaccaatgacgtgggtgtcaccagtgcgtcgcttccagccccaggtgagcatggccagcaagcggccctgcaaagcttcaggtgggctcaggggtcccgtccccatacagaaatgggaatacttgttgccctgtggttgggtcttgtggatgaactgtccccagccaccctgggcaaggagggcagagtagtacctatggcatgttggggctggggcactacccacttgggacctgacacagaggacatcctccagggcttctggctacccgggtggaagtgccactgctgggcattgttgtggctgctgggcttgcactgggcaccctcgtggggttcagcaccttggtggcctgcctggtctgcagaaaagagaagaaaaccaaaggtaggccagggacactgggggcagtgtggatgaggtcaggctgagcagcagccaagacagcaagtgcagctgggcagaaccagtcatctctgacggtggcagagcacttccagggggtggccatgggtacggtgacatgcatcccaggtagcagggtcaagcactgggaacccagtctctggccccagggccaggcctgggcatttgagagaccccttgcctgagggtcctgggtctgaaagggtaggacagcccagcgtgggagggcacactgagaattagggacatggtttctttctccacaggcccctcccggcacccatctctgatatcaaggtaactcttccttgggctgggtggacaagcctaaccgaaatgcaggatggggacaggagggagcctgggggtttctggtagaggcagccatgagtgcctgtgccgggactcatatccatcccgaactttgtcctccctgtagtgactccaacaacctaaaactcaacaacgtgcgcctgccacgggagaacatgtccctcccgtccaaccttcagctcaatgacctcactccagattccagaggtatatctagggccctgctctttgcccctgcttaatctccagaagtgcttctgagaaaaagaacttggtgcttgggaggggcgaggcctcatcaggcacactcctcgtcctgaacactgccctctttgtcaaccagcagtgaaaccagcagaccggcagatggctcagaacaacagccggccagagcttctggacccggagcccggcggcctcctcaccagccaaggtactggggaaggggcctgccaccctcctcctctgccccccagccctgtgcttatgccagaggcctccaagtgcccaggaggcagagagagctctccaaattccaaggaacaagcgttactgagtccccgcgggcttctttgatcccgcaggtttcatccgcctcccagtgctgggctatatctatcgagtgtccagcgtgagcagtgatgagatctggctctgagccgagggcgagacaggagtattctcttggcctctggacaccctcccgttcctccaaggcatcctctacctagctaggtcaccaacgtgaagaagttatgccactgccacttttgcttgccctcctggctggggtgccctccatgtcatgcacgtgatgcatttcactgggctgtaacccgcaggggcacaggtatctttggcaaggctaccagttggacgtaagcccctcatgctgactcaggttgggccctgcatgtgatgactgggcccttccagagggagctctttggccaggggtgttcagatgtcatccagcatccaagtgtggcatggcctgctgtataccccaccccagtactccacagcaccttgtacagtaggcatgggggcgtgcctgtgtgggggacagggagggccctgcatggattttcctccttcctatgctatgtagccttgttccctcaggtaaaatttaggaccctgctagctgtgcagaacccaattgccctttgcacagaaaccaacccctgacccagcggtaccggccaagcacaaacgtcctttttgctgcacacgtctctgcccttcacttcttctcttctgtccccacctcctcttgggaattctaggttacacgttggaccttctctactacttcactgggcactagacttttctattggcctgtgccatcgcccagtattagcacaagttagggaggaagaggcaggcgatgagtctagtagcacccaggacggcttgtagctatgcatcattttcctacggcgttagcactttaagcacatcccctaggggagggggtgagtgaggggcccagagccctctttgtggcttccccacgtttggccttctgggattcactgtgagtgtcctgagctctcggggttgatggtttttctctcagcatgtctcctccaccacgggaccccagccctgaccaacccatggttgcctcatcagcaggaaggtgcccttcctggaggatggtcgccacaggcacataattcaacagtgtggaagctttaggggaacatggagaaagaaggagaccacataccccaaagtgacctaagaacactttaaaaagcaacatgtaaatgattggaaattaatatagtacagaatatatttttcccttgttgagatcttcttttgtaatgtttttcatgttactgcctagggcggtgctgagcacacagcaagtttaataaacttgactgaattcatttaca

SEQ ID NO: 11609 - DNA, 4064 bp, Homo sapiens
cagcagcctagggcctatggcccgggccaccatggcgctgcctccaggcccagccgccctccggcacacactgctgctcctgccagcccttctgagctcaggtacacccctgttcagtcgttgaccaagtccttctgggttccaaagccccctctctcccctgtctgcacttctgtttgggtacccactccaggccccaagccctggagtccctgtccccttcacccacctaccctaggtccaaccagccagtccctggtgagaggactcaggtgccctttcctttggcctgctgctcttctcactgggccaattcctggtcacagcacagtaccaaccgtgcctgagcccttcccagaggcctcctgctgtgttccaggttggggggagttggagccacaaatagatggtcagacctgggctgagcgggcacttcgggagaatgaacgccacgccttcacctgccgggtggcaggggggcctggcacccccagattggcctggtatctggatggacagctgcaggaggccagcacctcaagactgctgagcgtgggaggggaggccttctctggaggcaccagcaccttcactgtcactgcccatcgggcccagcatgagctcaactgctctctgcaggaccccagaagtggccgatcagccaacgcctctgtcatccttaatgtgcaatgtgagtggccctgaggtgggcagggagataggttctttgcccagggacccccagcacccaccaggcaggtggtccgcaggacatttagcagacacttaagcactttgcaaatatgaactcatttgatcctctgagtaaccccatgaggtcattactattgtcgtcaccattttacaaataagaaaactgaggcagaaagaggtaagcaatctgcccagggtgatgatcccgctggtaagaagcagagccaggattcacatctgggcatttggctctagtatttacactcataatcactccgaaatgctgcctctctggcagacccagccatcctgttcctcagcatcccctctgaggagaggcccaggcccctggctcccatctgggtttgggaagaaagggctagaagtatgaggggctgtggtgagagcatattggcctctgctttgtaccagtcaagccagagattgcccaagtcggcgccaagtaccaggaagctcagggcccaggcctcctggttgtcctgtttgccctggtgcgtgccaacccgccggccaatgtcacctggatcgaccaggatgggccagtgactgtcaacacctctgacttcctggtgctggatgcgcagaactacccctggctcaccaaccacacggtgcagctgcagctccgcagcctggcacacaacctctcggtggtggccaccaatgacgtgggtgtcaccagtgcgtcgcttccagccccaggtgagcatggccagcaagcggccctgcaaagcttcaggtgggctcaggggtcccgtccccatacagaaatgggaatacttgttgccctgtggttgggtcttgtggatgaactgtccccagccaccctgggcaaggagggcagagtagtacctatggcatgttggggctggggcactacccacttgggacctgacacagaggacatcctccagggcttctggctacccgggtggaagtgccactgctgggcattgttgtggctgctgggcttgcactgggcaccctcgtggggttcagcaccttggtggcctgcctggtctgcagaaaagagaagaaaaccaaaggtaggccagggacactgggggcagtgtggatgaggtcaggctgagcagcagccaagacagcaagtgcagctgggcagaaccagtcatctctgacggtggcagagcacttccagggggtggccatgggtacggtgacatgcatcccaggtagcagggtcaagcactgggaacccagtctctggccccagggccaggcctgggcatttgagagaccccttgcctgagggtcctgggtctgaaagggtaggacagcccagcgtgggagggcacactgagaattagggacatggtttctttctccacaggcccctcccggcacccatctctgatatcaaggtaactcttccttgggctgggtggacaagcctaaccgaaatgcaggatggggacaggagggagcctggggtttctggtagaggcagccatgagtgcctgtgccgggactcatatccatcccgaactttgtcctccctgtagtgactccaacaacctaaaactcaacaacgtgcgcctgccacgggagaacatgtccctcccgtccaaccttcagctcaatgacctcactccagattccagaggtatatctagggccctgctctttgcccctgcttaatctccagaagtgcttctgagaaaaagaacttggtgcttgggaggggcgaggcctcatcaggcacactcctcgtcctgaacactgccctctttgtcaaccagcagtgaaaccagcagaccggcagatggctcagaacaacagccggccagagcttctggacccggagcccggcggcctcctcaccagccaaggtactggggaaggggcctgccaccctcctcctctgccccccagccctgtgcttatgccagaggcctccaagtgcccaggaggcagagagagctctccaaattccaaggaacaagcgttactgagtccccgcgggcttctttgatcccgcaggtttcatccgcctcccagtgctgggctatatctatcgagtgtccagcgtgagcagtgatgagatctggctctgagccgagggcgagacaggagtattctcttggcctctggacaccctcccgttcctccaaggcatcctctacctagctaggtcaccaacgtgaagaagttatgccactgccacttttgcttgccctcctggctggggtgccctccatgtcatgcacgtgatgcatttcactgggctgtaacccgcaggggcacaggtatctttggcaaggctaccagttggacgtaagcccctcatgctgactcagggtgggccctgcatgtgatgactgggcccttccagagggagctctttggccaggggtgttcagatgtcatccagcatccaagtgtggcatggcctgctgtataccccaccccagtactccacagcaccttgtacagtaggcatgggggcgtgcctgtgtgggggacagggagggccctgcatgattttcctccttcctatgctatgtagccttgttccctcaggtaaaatttaggaccctgctagctgtgcagaacccaattgccctttgcacagaaaccaacccctgacccagcggtaccggccaagcacaaacgtcctttttgctgcacacgtctctgcccttcacttcttctcttctgtccccacctcctcttgggaattctaggttacacgttggaccttctctactacttcactgggcactagacttttctattggcctgtgccatcgcccagtattagcacaagttagggaggaagaggcaggcgatgagtctagtagcacccaggacggcttgtagctatgcatcattttcctacggcgttagcactttaagcacatcccctaggggagggggtgagtgaggggcccagagccctctttgtggcttccccacgtttggccttctgggattcactgtgagtgtcctgagctctcggggttgatggtttttctctcagcatgtctcctccaccacgggaccccagccctgaccaacccatggttgcctcatcagcaggaaggtgcccttcctggaggatggtcgccacaggcacataattcaacagtgtggaagctttaggggaacatggagaaagaaggagaccacataccccaaagtgacctaagaacactttaaaaagcaacatgtaaatgattggaaattaatatagtacagaatatatttttcccttgttgagatcttcttttgtaatgtttttcatgttactgcctagggcggtgctgagcacacagcaagtttaataaacttgactgaattcatttaca

SEQ ID NO: 11610 - DNA, 3907 bp, Homo sapiens
cagcagcctagggcctaggcccgggccaccatggcgctgcctccaggcccagccgccctccggcacacactgctgctcctgccagcccttctgagctcaggtacacccctgttcagtcgttgaccaagtccttctgggttccaaagccccctctctcccctgtctgcacttctgtttgggtacccactccaggccccaagccctggagtccctgtccccttcacccacctaccctaggtccaaccagccagtccctggtgagaggactcaggtgccctttcctttggcctgctgctcttctcactgggccaattcctggtcacagcacagtaccaaccgtgcctgagcccttcccagaggcctcctgctgtgttccaggttggggggagttggagccacaaatagatggtcagacctgggctgagcgggcacttcgggagaatgaacgccacgccttcacctgccgggtggcaggggggcctggcacccccagattggcctggtatctggatggacagctgcaggaggccagcacctcaagactgctgagcgtgggaggggaggccttctctggaggcaccagcaccttcactgtcactgcccatcgggcccagcatgagctcaactgctctctgcaggaccccagaagtggccgatcagccaacgcctctgtcatccttaatgtgcaatgtgagtggccctgaggtgggcagggagataggttctttgcccagggacccccagcacccaccaggcaggtggtccgcaggacatttagcagacacttaagcactttgcaaatatgaactcatttgatcctctgagtaaccccatgaggtcattactattgtcgtcaccattttacaaataagaaaactgaggcagaaagaggtaagcaatctgcccagggtgatgatcccgctggtaagaagcagagccaggattcacatctgggcatttggctctagtatttacactcataatcactccgaaatgctgcctctctggcagacccagccatcctgttcctcagcatcccctctgaggagaggcccaggcccctggctcccatctgggtttgggaagaaagggctagaagtatgaggggctgtggtgagagcatattggcctctgctttgtaccagtcaagccagagattgcccaagtcggcgccaagtaccaggaagctcagggcccaggcctcctggttgtcctgtttgccctggtgcgtgccaacccgccggccaatgtcacctggatcgaccaggatgggccagtgactgtcaacacctctgacttcctggtgctggatgcgcagaactacccctggctcaccaaccacacggtgcagctgcagctccgcagcctggcacacaacctctcggtggtggccaccaatgacgtgggtgtcaccagtgcgtcgcttccagccccaggtgagcatgggcagcaagcgggcctgcaaagcttcaggtgggctccggggtcccgtccccatacagaaatgggaatacttgttgcccttgtggttgggtcttgttggatgaactgtccccagacaccctgggcaatgagggcagagtagtacctatggcatgttggggctggggcactacccacttgggacctgacacagaggacatcctccagggcttctggctacccgggtggaagtgccactgctgggcattgttgtggctgctgggcttgcactgggcaccctcgtggggttcagcaccttggtggcctgcctggtctgcagaaaagagaagaaaaccaaaggtaggccagggacactgggggcagtgtggatgaggtcaggctgagcagcagccaagacagcaagtgcagctgggcagaaccagtcatctctgacggtggcagagcacttccagggggtggccatgggtacggtgacatgcatcccaggtagcagggtcaagcactgggaacccagtctctggccccagggccaggcctgggcatttgagagaccccttgcctgagggtcctgggtctgaaagggtaggacagcccagcgtgggagggcacactgagaattagggacatggtttctttctccacaggcccctcccggcacccatctctgatatcaaggtaactcttccttgggctgggtggacaagcctaaccgaaatgcaggatggggacaggagggagcctggggtttctggtagaggcagccatgagtgcctgtgccgggactcatatccatcccgaactttgtcctccctgtagtgactccaacaacctaaaactcaacaacgtgcgcctgccacgggagaacatgtccctcccgtccaaccttcagctcaatgacctcactccagattccagaggtatatctagggccctgctctttgcccctgcttaatctccagaagtgcttctgagaaaaagaacttggtgcttgggaggggcgaggcctcatcaggcacactcctcgtcctgaacactgccctctttgtcaaccagcagtgaaaccagcagaccggcagatggctcagaacaacagccggccagagcttctggacccggagcccggcggcctcctcaccagccaaggtactggggaaggggcctgccaccctcctcctctgccccccagccctgtgcttatgccagaggcctccaagtgcccaggaggcagagagagctctccaaattccaaggaacaagcgttactgagtccccgcgggcttctttgatcccgcaggtttcatccgcctcccagtgctgggctatatctatcgagtgtccagcgtgagcagtgatgagatctggctctgagccgagggcgagacaggagtattctcttggcctctggacaccctcccattcctccaaggcatcctctacctagctaggtcaccaacgtgaagaagttatgccactgccacttttgcttgccctcctggctggggtgccctccatgtcatgcacgtgatgcatttcactgggctgtaacccgcaggggcacaggtatctttggcaaggctaccagttggacgtaagcccctcatgctgactcagggtgggccctgcatgtgatgactgggcccttccagagggagctctttggccaggggtgttcagatgtcatccagcatccaagtgtggcatggcctgctgtataccccaccccagtactccacagcaccttgtacagtaggcatgggggcgtgcctgtgtgggggacagggagggccctgcatggattttcctccttcctatgctatgtagccttgttccctcaggtaaaatttaggaccctgctagctgtgcagaacccaattgccctttgcacagaaaccaacccctgacccagcggtaccggccaagcacaaacgtcctttttgctgcacacgtctctgcccttcacttcttctcttctgtccccacctcctcttgggaattctaggttacacgttggaccttctctactacttcactgggcactagacttttctattggcctgtgccatcgcccagtattagcacaagttagggaggaagaggcaggcgatgagtctagtagcacccaggacggcttgtagctatgcatcattttcctacggcgttagcactttaagcacatcccctaggggagggggtgagtgaggggcccagagccctctttgtggcttccccacgtttggccttctgggattcactgtgagtgtcctgagctctcggggttgatggtttttctctcagcatgtctcctccaccacgggaccccagccctgaccaacccatggttgcctcatcagcaggaaggtgcccttcctggaggatggtcgccacaggcacataattcaacagtgtggaagctttaggggaacatggagaaagaagagaccacatccccaaagtgacctaagaa

SEQ ID NO: 11611 - DNA, 242 bp, Homo sapiens
ttttttttttttgagacagagttttgctcatgttgcccaggctggagtgcaatggcgtgatctcggctcaccgcaacctctgcctcctgggttcaagtgattctcctgcctcagccttccaagtagctgggattacaggcatgcaccaccatgcccagctaattttgtatttttagtagagatggggtttctccatgttggtcaggctggtcttgaactcccgacctcaggtgatccacccg

SEQ ID NO: 11612 - DNA, 127 bp, Homo sapiens
cttccaagtagctgggattacaggcatgcaccaccatgcccagctaattttgtatttttagtagagatggggtttctccatgttggtcaggctggtcttgaactcccgacctcaggtgatccacccg

SEQ ID NO: 11613 - DNA, 2711 bp, Homo sapiens
catataactaaaaatgaaacctgagattgacccaagcacctatctgagattggtatataatatttctataatgatatattttatagtagatattacaatagcatctgactttgagtcacacaaaccttaaactgaggagacaatagttcagaacctttttaagagccattctaaaagtgaccagcaggagggatctagtagtgaataatatcttaatagcaattttaggagaaaatgactctttcgtccagaagagctctgcagaaccagggctcccgtttatcttgtgctatctctgtagtattttcatttgagagaggaggctgagtttccagagctttgctttcatttatttttatacacattgtctctctatatctgcttgtggatattgttattttgaagagaaatggtttgtggttgtccagtggtatacaactgacaggcatttcattaagcacatagaccagactttgtgaatggttcagatattttttcattaaaaaacaaggtatggcagatggacttttccatgggtcaaattttttgtgtgagagatagaggtacatgtcttctgatgatgtgctgtggaatgcaatgtgggaaacctacatctggctagtgcttacatttgctcaaaaagcatgttgtatgaagctgactgccaccatgctaaagcagattcatattaagaagtgtcggtcgatccagtggctcttaagagtgaatagctttatggaatcaagtatgtccctgagtagcaagattaggcctcaccaaagaagaaattaacctgcactttcaaaaagtaccatgtataggaatgaaacattgaggtcccactttattctgtctttagtacatggttttacttattttggggatggatagaaatatatttttgctagttctaggcttgaatcatgggctccttggctttcctagcatcccaaagcagtcaacagtgatttcttaagcaatttgatctgtacctttacttgtgaaaggtatgctatataattcagcaagtaccaacttgtgtagctgcagaataaccaagtggctatccagtcaagtaaatacagtttgcttacatacttcaacagtttcataaaacgattcccctgagtgacacaagaacataaaatgttaatatcactaatatagcctgttaaatcttttgtggagacaggtgcaaatcagaagattgacaaggaagaacttgagcttgctaaataagacttcctaaatttaaaagctctagttttgcttagtgtgaattctggcactttaaaaagattaagcaagtgaaattctgctgccctccaccatttatttttacagtgctttgtaatttttttcatcagttccttaaatgttatttggaggaaactaagttcttgacctcagtaattttatttttgtttttccctaaatgtttccctactagtctttttggaaaacatgtttgttttaatttcatcttccctcactttatttaggtagaatttttcccccttcatttctgaaattttttgctcaccgccatgtttaaatggggttgaatcatagcgagccatttgctcttgccaaagtgagatagatgtactgaggagataattgaaaagtcagactctgtactgtggggctttaatcggagcactgctggaaatgattgcagagaatgtagtgcttcatatatccatgaccaagattgacatgttgctcacaacatgtcacaatttagtgaggagctacatgtatttccaagaattccagcatagattataatttaaataatcgaatttggtatttaggtacattgtttatatagccaagtgtatatgctttactacctaacaattattctagcctaggtgaatccctaattgaaacacctggctaacactttagacacataaattaagtgggatacagttttctcatttgtattatctccagcttcaacctcatttatcctttttcctagtataatacattgttttcaaccagaaattaaagtagatatccaacattattttcagtgcttgtacttcatgagaaataatctgattttcaagacacctcttaagtgcatttgcattttattttggtaatggcagagacctcatgtggccagtttgattgattgaagaatgtatcactcttattcaagcaaaggaattcagacttaaatgcctacctctgtgctgaagctgacagacagtattaactcttatcaaggccatcttttagacctgattttcatttatatgaaaacagacctgtccatgtctaataagtaaaaactgatagaatacattaaaaagtcactggtttatcatagaaaagtttgatgggtttagagctcagtgatttaagcttgtaaaactgcattcttgggcaaaatatttatattgtatataaatggttggcagcttattccagttgatctcttcacatctgccttaaaagtgctatgtagagatacattaacagagttataataaaacagtgttttaaaatctagcctataaacaaaaactagtttgaggcacccaagcatttagtgagagattgagaatgatgcttaatggatcaaaaaagcaattaggagtatgttcctgattttattctctaaattatactcaatttcatggtaattacatgaagaagttacctgcaattattcttaacactacatggaattc

SEQ ID NO: 11614 - DNA, 4398 bp, Homo sapiens
catagaactaaaaatgaaacctgagattgacccaagcacctatctgagattggtatataatatttctataatgatatattttatagtagatattacaatagcatctgactttgagtcacagaaaccttaaactgaggagacaatagttcagaacctttttaagagccattctaaaagtgaccagcaggagggatctagtagtgaataatatcttaatagcaattttaggagaaaatgactctttcgtccagaagagctctgcagaaccagggctcccgtttatcttgtgctatctctgtagtattttcatttgagagaggaggctgagtttccagagctttgctttcatttatttttatacacattgtctctctatatctgcttgtggatattgttattttgaagagaaatggtttgtggttgtccagtggtatacaactgacaggcatttcattaagcacatagaccagactttgtgaatggttcagatattttttcattaaaaaacaaggtatggcagatggacttttccatgggtcaaattttttgtgtgagagatagaggtacatgtcttctgatgatgtgctgtggaatgcaatgtgggaaacctacatctggctagtgcttacatttgctcaaaaagcatgttgtatgaagctgactgccaccatgctaaagcagattcatattaagaagtgtcggtcgatccagtggctcttaagagtgaatagctttatggaatcaagtatgtccctgagtagcaagattaggcctcaccaaagaagaaattaacctgcactttcaaaaagtaccatgtataggaatgaaacattgaggtcccactttattctgtctttagtacatggttttacttattttggggatggatagaaatatatttttgctagttctaggcttgaatcatgggctccttggctttcctagcatcccaaagcagtcaacagtgatttcttaagcaatttgatctgtacctttacttgtgaaaggtatgctatataattcagcaagtaccaacttgtgtagctgcagaataaccaagtggctatccagtcaagtaaatacagtttgcttacatacttcaacagtttcataaaacgattcccctgagtgacacaagaacataaaatgttaatatcactaatatagcctgttaaatcttttgtggagacaggtgcaaatcagaagattgacaaggaagaacttgagcttgctaaataagacttcctaaatttaaaagctctagttttgcttagtgtgaattctggcactttaaaaagattaagcaagtgaaattctgctgccctccaccatttatttttacagtgctttgtaatttttttcatcagttccttaaatgttatttggaggaaactaagttcttgacctcagtaattttatttttgtttttccctaaatgtttccctactagtctttttggaaaacatgtttgttttaatttcatcttccctcactttatttaggtagaatttttcccccttcatttctgaaattttttgctcaccgccatgtttaaatggggttgaatcatagcgagccatttgctcttgccaaagtgagatagatgtactgaggagataattgaaaagtcagactctgtactgtggggctttaatcggagcactgctggaaatgattgcagagaatgtagtgcttcatatatccatgaccaagattgacatgttgctcacaacatgtcacaatttagtgaggagctacatgtatttccaagaattccagcatagattataatttaaataatcgaatttggtatttaggtacattgtttatatagccaagtgtatatgctttactacctaacaattattctagcctaggtgaatccctaattgaaacacctggctaacactttagacacataaattaagtgggatacagttttctcatttgtattatctccagcttcaacctcatttatcctttttcctagtataatacattgttttcaaccagaaattaaagtagatatccaacattattttcagtgcttgtacttcatgagaaataatctgattttcaagacacctcttaagtgcatttgcattttattttggtaatggcagagacctcatgtggccagtttgattgattgaagaatgtatcactcttattcaagcaaaggaattcagacttaaatgcctacctctgtgctgaagctgacagacagtattaactcttatcaaggccatcttttagacctgattttcatttatatgaaaacagacctgtccatgtctaataagtaaaaactgatagaatacattaaaaagtcactggtttatcatagaaaagtttgatgggtttagagctcagtgatttaagcttgtaaaactgcattcttgggcaaaatatttatattgtatataaatggttggcagcttattccagttgatctcttcacatctgccttaaaagtgctatgtagagatacattaacagagttataataaaacagtgttttaaaatctagcctataaacaaaaactagtttgaggcacccaagcatttagtgagagattgagaatgatgcttaatggatcaaaaaagcaattaggagtatgttcctgattttattctctaaattatactcaatttcatggtaattacatgaagaagttacctgcaattattcttaacactacatggaattcactgggtaattgtgggtcatttatttcctgaaagtcacgtgaaatccttagctggttgaatgttgcacagtatttgagaattacggtttgaagtgatttctgtgggagggaatcattgcaatgtatattctaaataaagtcatctaactattaaaaaaaaaacacccttcctaacccttcttttcttaaaattccacattcatccacaatctcatccctttgtagaaattcttgcctgaattctcaccaagttttgaattcctaaggtagccccgatctaggatgtgaaggctgcccagaaaaagtttatggctggaggagtatcatacagtgtctacatatgatagtacttacagattaggtctttggatgctttaacacaaaagatttttgttatccttattagtcaaataacgctattcttttgtggttctagaccctggcttctatctccctgtgatttgttttaatgctgaaatgacttggctatccaaagcttctagtctagaggtctgttggttgaaggcagacatttccaagtttgttgaaataatacgaagctgactagcttacgtgaatgatgttgccctcatttgttttgggtgaggactcattactgcagtatattgatctcttcaccaaatgctttttctttttctgaataaatgctgtattagaggttctatttatatatgatttttaaaactttggtttccttctatccaccaaatactgtgaattgtttttccatttatttttcttagctaatgtaactttattcttcacttttttttagccctagacttcctagattttctgtggcattctgtaggacattgtattgcttggaaaaaaaaagatcaaaatcattctggggcaaatgctctattatccttatttatgacaagagaataatgaaattcataagaaattaataacattcagatattgctataaatgtacttgagtcattttcatttggggatagtaataatggctgtggcagctttaatggagaaacctgtgttggcctctttttctggcattaggatctcttgtcatagaactattggtaaagtacaggtttgatagcagagttcctgaattcagcatatcatcagaatttccatttaccttttgtcttttctttttattgtattttttaacctttttgtttctattcctacctcccatgagtaacattgatttctgctgaagttagaatttgtgttaagaattgactttaaacttctgaaatagttgaatattagaagtggcttcagttgccatgaaatgattgcttttctttttctttttttttccttaaataaaaataatgcagccttatatatgtctcttcccctcaagaatgtgaatttaggctgggcatagtgactcacgcctgtaatcccagacctttgggaggctgacacgggaagattgcttgagcccaggaatttcagaccagcctgggcaacacaggaagactccatctctacttaaaatatttttgttttttagccaggtgtggtggtatgtgcctgtagtcccagctacttgggaggctgaggtgggaggatcacttgaacccaggagtttggggtgcagtgagctatgattgcgacactgcactccagcctgggcaacagagcaagaccctgtctcaaaaaaaaaaaaaaaaaaagaa

SEQ ID NO: 11615 - DNA, 862 bp, Homo sapiens
gaagcattaacaagtcagaaaagacaagtggaatttcctcagtggaccagcagagaaaagacctaataaggaaaaaaagagagatcagtattatttgtaactaaagtgccagtccttctgctagacgcttttcatgtaactacatttaatctgcacaataactgtatgaagtaaacaggattatcacatacttacagctgaggaagcaaagtctgaaagccagaaagtctgactaatttatctaagatcacaccacagccaggtagtagaactggggtcagatcagtagtgtctgcctggttttgaagcctgatttgatttctccattataaaatacattgctgctggtctcaactagtttttctgttacatgttttaaacacaatggatgtttctttgtatcttcttcaccaggcttttctgatgtggatcacacctatgctcaaagaactcagctctttgacaccttagtaaatttctttcctgacagcatgactcctcctaaaggcaacctggtagacctcatcacactgtaactgaagagtcactggacacagaaatggaaaacaggagtcgattttccgtcttttggattgcagctccactgactgacagtaaagctgcagtgattgaggactgcaccacagttctgaagggatcttaaccatcacaagtttttaccctcttccttcatgcctgacctcaaccccgctctcctcatcctattcctaaattaggctaataaagtgaaattggtatactctccagttaaatatatatatatatatattttttcttactctatcttttaagaattaatgagtataaaagaaaaattaggcagtttacccttttcagattt

SEQ ID NO: 11616 - DNA, 3878 bp, Homo sapiens
atttagctccaattccaaatgactaactcttaggccagtcatagccaatgaaatcatctgacggtagcttctgtagcccttaacctaaggagtcattagaggttatagtaaattagtttctctagtggtgcagagagaaatgccatcggggaaattatcactgtctttttggctaaagttttatattgtgaactggatcccacttaacagcttaaaaacacaaaaatgaaagggtagtcctagtttatcttcttaattagaatcattatttggaaataagatttgcaatgtgctgtctatccccaaacactgctgagcttgctggaaaacagaatttaacatgaatgttgtctgaaagctgtaggatcaatggcaaaaaaggggaaatgtttggtagggaattggaccagttctaaggtatcacttttaattataaaataatgtcttcctttttatctgcttttcagacagcctcagtgaactattaaacatttgtgtgcaaagtcctattttgcttatctaaggcattttgacttggaagtattaaacttcaggaacgagctagagaagacaatgagggtatgttagagaaggaaaaataggagctttttgcttatggattttagaggtccacaaatcgaaaggaaaaataaatttcttcatttctaaccctaaaataattttgttaatgagatgctgggaagaagactaccaaaaggcctcaaagctcatgcttctagaatattcagtaattctgaatagtctttgggaagtagcatttcttgggaagtagcatttcccttcttccaaataactgtttgagatcttaaaacagaaaatccagtgttaatgggctctagatcttaaactaggtgagcagcttcttacatacaaccagttccttgttaaggatccagcaggaaaaccagccataaaacatttcaacatgcagtttgggggctcccttgcttattcactgagtttaagctcttgctgcaacatagctctgtaccatctgggatgctagcagtcacagcagttagctcagatatctgagctgtctgccacacaaagcctgaggagatcatcattcttcagtttcattcattacttaatgaatgccaaattaattggcaggaagaagaaacactgtgtgatatactgaacaagcctgtgtgcatgaataaggagccactcaaaaagccaattttgagctttatttctccgttgttaacaaatctcaagaaagcctttgttacagtttagctcatgtcatttggttggttttattttctagccctttaacataggaggaaaattgtcatttcatgtataacttgtaacacagaattgaactgatactagtttccttgccttaaattaattatatgtcatcccaagggtctctgttaattctgctttgccaagcaataatgagatctgggtttggcattagaagtatttcataattttggttttttatttaggtttcctccacatctgtaaagtgattgattaaattagaggaggcgtgtagaataaatcccaatcccattgcaactggcagagctttataaatctttataaattcagttacaacaaaggagaggatcctacaccattagagccatgccatcaggtgtttgcaagtgacagctgtagtgtgttgcctcaaataataccaagttataaataataccaagtaattatcaactcactcccaaatttaataagatatcaaagtccaaaaggttacttaggagtagtcttccgtgggggaagataaatttattaaagagtcatgtactgatctttttcttgggattttttttcctttcccagaaaaaaaaattattttggtgactgatcaattgtaaacaattttcttccttacttacaaatcatccgttcagaaaaataaaagtggacttcctttcctaagcattacaattagcctgggcaagaggtgttatgattgtcttattctttaagccggcttactttttggatttgtgtgaaatgtcttttgaaaagaaagtagatagtatagtattaattaactactttgtatagtcttctgcataatttagagttgaaaataatgtaacattttcctgtgaacagattcctttatgcgtacatactttataaatatacatacatacacatacacatacatttttaaaatgctctttttaaagagattcttatcttgctcccactccaaaagctatgtacagttgagttattagcctcagaggaagagtacaggaaagcgaagatgaggacctccttttcttgtgttggtcttgggaacaaacagtattccgtctttcaaatatggcatatttctaaacagtttgggaaagatgttagaattttttaaaagtcagctcttttataaattggaagtactcagtagtcagaaattaagatcccctctgatagagatagattctcaaaaccaaaattggactgaaaattagattgagaagaaagatacaacttcctccatagccaataaaatctgtctttccaagtctgcttattaatgctgtgaatcgctccttctgtttgtgaaaacatctcctggactggaaatgtggtgctgtaaccagctgagccgaaagttggagaatgttaaatatcttatatgggacttacgataaaatgtattgatgttagtgattgtcaaaataggtttatcatttaaaaaactaggaaattactaagtataaagaagaaaaaccagtattaattaagtgatgagacctgttcattttgttttccctgacttatttccattaccaaacatagtaaaggccagaaaagattaaaaaaaaaattaacacagccattccattgttttttaccacatggagaaaggaccaggctggaagcatatgtccccccacccttatttatattcctttgagcattgccgttttctagacagacaatccgaaaataattgtgttgataggtctgtttaagcctgaactctgggtgtaaaatgttatccagaagctatagggagctgccttgctcaggtcattggaaatttcaaccctaagactcattggaatttctaagtccgttatgcaccattatgggcatatggagcatattcataccatgaggaggagtctttgtttatgatggactttttaatatggccataattaaactcacactcaaaaaggatgagctattgtcaaaagccaaaagaaaaacagacaaaatgaacatgaagcaaggagtccataaaacaagagttctttaccacgtttaagcaaatgtctctcaaaaaaaattgtatttctgtgcacattagctgagattcacacattttgcacctcagtagtatttcagatgagactcaatgtgtggagaaaaccgctaacttgtttggttctactcttaccccctcttctgtggcaatgtggggtcagggccgtatcctaaagtatccacatggtcttaaatggaaatcatgggactctggaaagctggcatgagctggttggagcttttaaacagaagtgctttatgggtatcagatctcttctgacatcaattgtttcaaatcattgttgggctctgtcgtgttctgcaatcttccccattcccctcatgatctctggcttatcttttatccaatctgtatggactttttaggattttttttttcttatagtacaaataattttcagatcccagctttggtaaatgtgttaattctactttgtgaataaataaatgagtgatctgctaaaaatggcaattgtagaattatgttgtatgtaatgtacatatggagaaagaatgtattttgttcattttcttaataaaatgttatatatggatgctacaagata

SEQ ID NO: 11617 - DNA, 862 bp, Homo sapiens
gaagcattaacaagtcagaaaagacaagtggaatttcctcagtggaccagcagagaaaagacctaataaggaaaaaaagagagatcagtattatttgtaactaaagtgccagtccttctgctagacgcttttcatgtaactacatttaatctgcacaataactgtatgaagtaaacaggattatcacatacttacagctgaggaagcaaagtctgaaagccagaaagtctgactaatttatctaagatcacaccacagccaggtagtagaactggggtcagatcagtagtgtctgcctggttttgaagcctgatttgatttctccattataaaatacattgctgctggtctcaactagtttttctgttacatgttttaaacacaatggatgtttctttgtatcttcttcaccaggcttttctgatgtggatcacacctatgctcaaagaactcagctctttgacaccttagtaaatttctttcctgacagcatgactcctcctaaaggcaacctggtagacctcatcacactgtaactgaagagtcactggacacagaaatggaaaacaggagtcgattttccgtcttttggattgcagctccactgactgacagtaaagctgcagtgattgaggactgcaccagagttctgaagggatcttaaccatcacaagtttttaccctcttccttcatgcctgacctcaaccccgctctcctcatcctattcctaaattaggctaataaagtgaaattggtatactttccagttaaatatatatatatatatattttttcttactttatcttttaagaattaatgagtataaaagaaaaattaggcagtttacccttttcagattt

SEQ ID NO: 11618 - DNA, 1185 bp, Homo sapiens
gctgcaacaagtcgtgtgggacgaacccggatggcatcatcttcgtgtccgagggcagcaccgtgaacctgaggctgtacggctacagcctgggcaacatctccagcaacctgatctccttcaccgaggtggacgatgccgagaccctccacaagtccaccagctgcctcgagctcaccaaggacctggtcgtccagcagctggtcaacgtgagccgcgggaacacgtccggcgtgctggtggtgctcaccaagttcctccggaggagcgagagcatgaagctgtatgcactgtgcacccgggcccagcccgacgggccctggctgaagtggacggacaaggactcactgctcttcatggtggaggagcctgggaggttcctgcctctctggctgcacattctcctaattacggtgctgctggtgctgtcgggcatattttctggcctcaacctcgggcttatggccctggaccccatggagctgcgcatcgtgcagaactgtggcaccgagaaggagaggcgctatgcccgcaagattgagcccatccggcgcaagggcaactaccttctctgctcgttgctcctagggaacgtgctggtcaacacctccctcacaatccttctagacaacctcatcgggtccggcctcatggcggtggcctcctccaccattggcattgtcatctttggggagatcctacctcaggccctgtgctcccgacatgggctggctgtgggtgccaacaccatccttctcaccaaattctttatgctactcaccttccccctcagttttcccattagcaagctcctggacttttttctgggccaggagattcgcactgtttacaaccgggagaagctgatggagatgttgaaggtgacggagccctataatgacctcgtgaaagaggagctcaatatgatccagggtgccctggaactacggaccaaaactgtagaggatatcatgacccagctccaggactgcttcatgatccgcagcgatgccatcctggacttcaacaccatgtcggagataatggaaagcggctatactcgcatcccggtgttcgaagacgagcagtccaatattgtagatattctctacgtcaaagacttggcctttgtggaccccgatgactgcacccccctcaagactatcactcgcttctataaccacc

SEQ ID NO: 11619 - DNA, 636 bp, Homo sapiens
  misc_feature (42)..(42): n equals a,t,g, or c
ggtcgtccagcagctggtcaacgtgagccgcgggaacacgtnccggcgtgctggtggtgctcaccaagttcctccggaggagcgagagcatgaagctgtatgcactgtgcacccgggcccagcccgacgggccctggctgaagtggacggacaaggactcactgctcttcatggtggaggagcctgggaggttcctgcctctctggctgcacattctcctaattacggtgctgctggtgctgtcgggcatattttctggcctcaacctcgggcttatggccctggaccccatggagctgcgcatcgtgcagaactgtggcaccgagaaggagaggcgctatgcccgcaagattgagcccatccggcgcaagggcaactaccttctctgctcgttgctcctagggaacgtgctggtcaacacctccctcacaatccttctagacaacctcatcgggtccggcctcatggcggtggcctcctccaccattggcattgtcatctttggggagatcctacctcaggccctgtgctcccgacatgggctggctgtgggtgccaacaccatccttctcaccaaattctttatgctactcaccttccccctcagttttcccattagcaagctcctggactttt

SEQ ID NO: 11620 - DNA, 29119 bp, Homo sapiens
actgccctatgagaggctgctcagggagccagggctgctggccgtgcaggggctgcccgaaggcctggccttccgaaggccagccgagtatgaccccaaggccctcatggccatcctggaacacagccaccgcatccgcttcaagctcaagaggtgagtgaggtagccggcccggggctgggctggggctgggccagggccgggtcagggccgggggctggaggccacttagccagaggggaagggacttgagatgcccgtgggggaccctggtggtgaaagctcccagtctgatggtggaggtgaagtgaaagcgaagtcatagaacaggatctgagccaggtcattaagccttgaagtcttcccagggaagttgcattgcagagagacttgaagagacatgacttgggacaaaatagcaccaaagtggtcgggtacagtagctcatgcctgtaatctcagcactttgggaggctgaggtgggaggatcacttgaggccaggagttcaagaccagcctgggcaacataccaagaccctgtctctgccaaaaaataaaaataaaaaaaattacccaggtgtggtggtgcacacctgtcatctcagctgttcaggaggctgaggcaggaggcttgcttgagcccaggagtttgaggatgcagtgagctgtgattgcgtcactgcactccagcatgggcaacagagcaagaccccatctcttaaaaaaaaaatatggcattttaggtgtcagaaacgggagaaccatgtcctgtgcttgctcaggttgtaaatctggggttaattagggatccaggggagattaggttgttgaggctggtctgaggcagtaccagttgtcaggagagccaagaaggcagcctgagggcttaaggttgaacccatctctgctaagtgccccaggcaatgcagaggcaggaaggggaggggtgcagcaggagacaggaggcaatcaaccgcacctggcgggatctgaacagtggattggagcagaggggcagggcccaggtcctccggtggcctagctctgtggccctgggcacaccattcccacctccgagcctgcatccccacttgtgaagtggaagagcagctcctgtcctgccctcctcatggggctgttatgttctgcagagggcagggatgcggggttttcgggggaagagctgcaatgtgtgaaacagatgtacaaagctgtccatgtgtcctctcctttactcaggccacttgaggatggcgggcgggactcgaaggccctggtggagctgaacggtgtctccctgattcccaaggggtcacgggactgtggcctgcatggccaggcccccaaggtgccaccccaggacctgcccccaaccgccacctcctcctccatggccagcttcctgtacagcacggcgctccccaaccacgccatccgagagctcaagcaggaagcaccttcctgcccccttgcccccagcgacctgggcctgagtcggcccatgccagagcccaaggccaccggtgcccaagacttctccgactgttgtggtaacattgctgctgggatctccaagtctagggggtgggacagaggtcactcatgcaggggacagcctcccagggcaggtcaggatgcctgggccctcttaggttggaaggagccatgtctgggcatgggagtgggactggacagatggtgtcctggctgagacccccttggaccttgggtctctgctcagccatctgtgaatgatgtccttggccttggactaagaggacgcctgcgaggactccctgggtcccagctactcgggaggctgaggcaggaggatcacctgagcccaggagtttgaggctgcattgagctatgattgcacacctctgcactccagcctgggtgacagcacagctctgtctcaaaaaaaaaaaaaaaaaaaaaaaaaaaaaagcaccagcgatatttcaggtgtcaaaggtgggagatccacatcacgtgctataaaggaagtaagcatactagtcatcctcatgcattccatgaggacccattccaactgaatgagcacccactgcatacccagcctgattaagggcactgggggaagtaggtcctggaagtaggtcctggggtgaacaggacaaaaggaacaactgcaggtgaggagcacctggattcatatcctggctcctctacttagtggctaggcatcctggggcaaatctctactctctgagcctcagtttcttcctctataaaatggggatgctagtggtacctgcttcccagaagtgttatcatgattaaatgacagatcggtggcagtagcatctcctgagagagggttagaaatgcatattctcaggcaccactgcagtcttgctgaatctgaagctttggggatgggacccggtagtctttttggataactctgccaagtggttccaatgtgctcaagtttgagagttgctgaattaaagcgctgggtcttgccaggcatacctgtaattccagctctttgggaggctgaggtggaaggattgcttgagcccaggagttcgagaccagcctgggtaacatagcaagatcctatctctaccaaaaaaaaaaaaaaaaaaaaagcgtttgggtctaatgcttggcctgtagtaggtgcttgtaagttatatatactattattattattattattattattattattattattattattataagggggaaaaaagcccaaatatgtgggctgaccagggcttcgaacttatacatgtaaaacaagtgttcttacctggaaaaggtaacctccgacatccctttcttgttaacctggctttcggctagcagattctggtgcagaatgtcttagacctctggtcaggggccttgccttgagtttgtgatcacaggaatcagttattggatgtccctggcagatgaggctgttaccccagagccagggcctgtgcactggggccagatctggggaaccctcttgggtcccacctggaaccttcttccttctctcccttgtccaggacagaagcccactgggcctggtgggcctctcatccagaacgtccatgcctccaagcgcattctcttctccatcgtccatgacaagtcaggtaggacagcgcccacgaagcaccccggcctgagtgggaatctgaggttggaggtggtgcttattgaaatggaagtgtatctcctgggtctttgtgaaagaaaggaggaacagctctgctcaaggggctgcaagtaaactggggtgtaatagttatctattgctgtgtgataaactaccccaaactaggcatggtgtctcatgcctgtaatcccagcactttgggaggctgaggcaggagggttgcttgaaaccaggagtttgagaccagcctgggcaatgtagcgaaatgctgtctctacaaaaaataagaaaaattagtggatgtggtggtgcctacccgtagtcccagctacttgggagactgtggtgggaggatcacttgagcccaggagttggaggctgcagtgagctgtgatcgcaccactgcactccagcccgggcaacagttagaccctatctctaaaaaaagttgtaacaaaaaataaaataaataaccccaaaatggagcttaaaacatcaagtgtttattacctcacagtttctgggggttgggaattcgggactggccgagttgggcagtgctcggtcagggtctttcatgaggatgcagtcaaaatgttggctggggctgctgtcatccaagagctcaactggggcgggaggagacgcttctgagctcattcacacggctgttcgtaggaggcctcagtcccccaccatgtgggctagccttgacggggctgcttgagcatcctcacaacatggccactggtttcctccagagttattgatccaaaagagaggaacgaggaagccacgtggcttttatgacccatccttagaaattgctgtcatattctatctgttagaagccagaaacatgatccagccttccctctgtgggagaggaattaaactccaccttttaaaggcagtgatatatttaaaaaaaaaaaaaagtggacagatttttaaagtatcacacagaaggcctgagtgtaggaaagtttgggattcagttataccaagaaggaatgcagtaggacttgccagcagttttgctttgagggcctcagcctcacctccaggaaaaggttctgtaagaaaacccagtcctaggccaggtgcggtgactcacacctgtaatcccagtgctttgggaggctaaggtgggaggatggcttgaggccagaagttctagaccagcctgggcaacttagtgagaccccatctctacaaaattttaagaaagaaagaaaacccagtcccctgggatcagaatggaggaccctcccccccaacaacaacccaacctgtcactgccccaaacaaggtccagccctggcagggaggagatgtgaatgtccagatggaacagtatcatgacaggcccatgggccagggacacaagctgggatagaatctcactgggttatcacaagcaagatactcagtttctttgagcctcagttttcctatctgcaaaatgggactaatatctctgtttaaaacttgtcataaggaattaaataggatattattatatatataaagtacttagcacagataagcacttaacaagttaaagttgttacttttactgattataaatgaaccaatgatcacttgttattattcaatcaagacagaggttttgagagagagaccagcagagctgagagtttgggggaagccaacaaggccagtgctgagtgagacctcagatgtaggaggtacaagggttagattctcaagatcaagactcagcccttagccagacatggtggtaggcacctgtagtcgcagccactcaggaggctgaaatgggaggatcgtttgagtccaagagttggaggctgctgtgagctatgatcacaccacagcactccagcctgggcaacagagtgagaccctgtctgtaaaaaagaaaaaaggaaaaaacacagccaggagtgttggctcatacctgtcatcccagctgcctggggggccgaggcagagggatcacgtgagcccaggagttcaaggctacagtgagctatgattgcaccactgcagtccagcctgggcaacagagtgagaccctgtctctatttttttaaaaaaatttaaattaaaaaataaaatactcgacctcaggccggacttggtggctcacacctgtaatcccagcactttgggaggccaaggcgggtggatcacctgaggtcaggagttcgacaccagcctggccaacatggtgaaaccccatctctactaaaaatacaaaaataagccaggtgtggtggcaggtgccctgtaatcccagctacttgggaggctgaggcaggagaatcgcttgaacctgggaggcagaggttgcagtgagctgagaccacgccactgcactccagcctgggtgacagagtgagtcaccatctaaaggaaaaaaaaaaacataagactcgacctctttttctgctgaagggactgctcttccagcctcctgtatgtctggggcaggatgggctcgggatggacaggctgagcctgttctgacaccacacccgtgggagaggccagagacaaatgttagggcaggaacgggcagacgggggaccatcagagcaccctgaattcgtgtatggtccgaggtgggagagggtggaaggactgggggctggggccggcctcgggggctctgggggtgaaagcccggtggtcatggccggtggagggcgtgtgaccgtcccgtggggccctgctcacttgtgcctcctgtgttttgatagagaagtgggacgccttcataaaggaaaccgaggacatcaacacgctccgggagtgtgtgcagatcctgtttaacagcagatatggtgagtgggcggcgcggcccgccgtgtggccccagcagccgtgttgagcatctcattacgtggcaatcactcgtgttccccaacacggcagcgggagccatatgctggctcccgcgcgccggcaccgctaatgtcatccgtcgcgggctcctcctgtctgggtagggggtggttgtgtcaatatttcccttccagattcttcagggggcggaactgatggcaaagccccagacctgggctcagtggcggggagcgggacaggttgggggcagagattacccatctgggggccgggcgcagtggctcatgcctgtcatcccagcactttgggaggccacggtgggaggatcacctgaggccgggagttcaagaccagcctgaccaacacagtgagacctcccatctctacaaaaacaaattttttaactaggctgggtgcagtggctcatgcctgtaatcccagcactttgggaggcagaggcaggcggatcacctgaggtcaggagttcaaggccagcctggccaacatgccagaaccctgtctctactaaaaatacaaaaattaactgggtgtggtaatacacgcctgtaatcccagttactcagatcctgaggcaccagaatcactggaacctaggaggtgcaggttgcagtgagtcgagatcgtggcattgcacttcagcctggtgacacagtgagactctgtctcaaaaaatataaataaatacaaattaaaaattaaaaaattaaccacacacctgtggtcttagctacttgcaggctgaggtgggaggattgcttgagtccagaaggttgaggctacagtgagctacgattgtacccctgcactccagcctgggtgacagagcgagaccctatctctacaaaaaaacaaacaaaacagattgcccatcaggggaactatccataaggcccagaaaaatctctgttggcctcatgtgcaagtcccccacagtaacacaccatttcccacctcccagctttacctgtgctgtgccctctgtctggcacagtcttttcacattttagggacaaattcctaattgttctttgagactcgtcttgggagtcacctcctctaggaagcctttgggtccccagcctgggccaggtaggcctgggtaccctgatggttccctctctgtgacacattgggaacttgacgccccctgcctgccgctgtctccctgagggccaggactgcacccaacccctctctttgtccctagcacccaggacagagtcaggctcatagcagatgtcagcccaccgcactctggaaagaaaacacaagtggtaggcgctgtggctcatgcctgtcatcccagcactttgggaggccgaggcaggtgaatcacttgagctcgagagttcgagaccagcctggccaacatggtgaaaccccgtctctacaaaaatacaaaaattaactgggcgtggcatggtggcatgcacctgtaatcttagctactttgggaggctgaggcagaagaatcacttgaacccgggaggcagaggttgcagtgggccgagatcacgccactgcactccagcctgggtgacagagtgagactttctctcaaaaaaagaaaagaaaatcattaaggaaagaatttaaaaagaaaaaaaaaagaagggaggataattccaaggaagaaacagtctcaataggctgggaagtcaggggtggcttcatggacgaggtgtcttgtgaccacgtctggggcagcctctgcgtgtgggctggaccttccacattgacatggggctgaacaagactctggaggccttagtgaggagcctgggatagccagctacctttgatgtggccaccctggcccagccacgcctcctcactcctcagagctgcaaagggctgtctgcacctgcccctgagtctctccccgccccaggcaggtgtgagccaggcggaggttgggggaggggaaccagggaggagccggctctgcctgccttgggagggttctgcccaggccagtgttctggcctgtcccacgctctggactttccaaaatgccaagccttttccaaatgtcagttcctgagtcacatccaaagagtgttgggtgtggagtggtcaagatcttgttccccataaagccggagctccctctggggagctgcgtgggggagaaggcagctgcccagtactggggaccccacgggtggtggggacggggtctggcagcccaaggcattccactggtcgtgggtgagcaaaccctgctcccagctctaccagccaccaaatctgggtgaattgggccagtgacagtgtgggtggtacaaaggaggaagaaacagaaaaattagaattgggggaaacattaggcttcaggaagtctcgaggacatgtcctctgggatgatgctgggaccaggtgaggggccgaggagggtgcatggtggcactgcatgaaggcagccccttcccaaggggcaacagcagggttcgggggttggccctctgtccactgaatctccccagtgctgaaaagacaagccccaataaaccagatgaaccagacggagacaaattcacaggcactcaaaggaccaattgctcaagggctggggctgggggtggctgctgatgtgggaggtgggggggaagtggggagagatgctttgccagctgttgagatttcgaaggtttcatttgacaacgagctaagtgtgacatctcagtgggatctggatgccaaagccgccaacgcagacctgggccgctgcatcaacaggaaaacagtgtcagaggcacccaagggagggcccaagcagggctggagggaggtccagctctgggctggcacttacaggaacacagacaaagcatagtgtggccagagaagcagggctaggacagggaggggcctgaggaacagccaggagatatgggagcctggagggaggacagtgtatcgaggccccgtccatggtcatacggggaggcaagagtgaagtggatactcaggtcaggggaagggtgacccatgaaagtacttgcttaaggccaggagcggtggctcatgcctgtaatcttagcactttgggaagctgaggcaagaggatcacttgagcccaggagttcaagatcagtctgggcaacatagcaagaccccgtctcttcaaaaaataaaaaagtaaatagctgggcatggtaacacatgcctgtagtcctagctactcaaaaggctgaggtaggaggatgactttagccagaagtcgaggctgcagtgagcaatgattatgccactgcacttcagcctgggctgttagcaagaccctgtctctgaaaaagaaagaaagaaagtaccagcttgtattaggaacatagtaggtgcttaaaaagtatttggtgtggggccggggactgtggttcactcctttaatcccagcactttgggaggccaaggcaggcggatcacctgaggtcaggagttcaaaaccagcctggccaacatggtgaaaccctgactctactaaaaatacaaaaattagctgggcgtggtggcacacgcctgtaatcccagctactcgggaggctgaggcaggagaattgcttgaacccagtcagggagtttgcagtgagccaagattgtgccgctgcactccagcctgggcaacagagcaagactccatcagggaaaaaaaaaaagtatttgatgaatgaattaatgaaaacgtgtagctggggtcgaagtgaatgactgaaatggcacaagtctgggaaaacagagcaagtagcctgggcatgagcctggattctgtctgcttggctgttggcagagccgtcagcttctggggtgtgttttgtttatggcgctggtgaatgaagggcgtgccaagctcctccctggaagaaggcacacacctgtgctcacctgtgcaactactcgcctgccaggagctaatctcaagcttgggcacttcctttagccatttgtatattcactatgcagaaagcacttagtgtgtgcccagccccattgaggtcgcagtggcaaggcagaaaacaaaacccctactctttttcagacagtctcgctctgtcacccaggctggagtgtagtggtgcaatcacagctcactgcatcttcgaactcctggactcaagcgatcctccagcatcagcctgccaagtagctgggactacaggcccaagcccggctaattttttgtatttttatagagatggcttcttactgtgttgcccaggctggtcttgaactcctgggctcaagcatttcccaacaactgtagccttccaaagtgctgggatgacaggcatgagccactgcacctggccaaaacccctgttcttatgcagcttcctttctagacagtacacatagagatgagtgtggatgtagtgtcaggtgatgaccagtggatgacagacacagcaggggagggaatgagggatggaggaggctgtgttaggctgccaaagtgctatttgagcaaacacctgaaaggagggagggagggagggagggaaggaaagatgggtggatggatggatggatggatggatggatggatggatggatggatggatgaatggatggatgggcagatggatatacagccgggtgggtgggtgggtggatggatggatggatggatggatggatggatggatggatgaaaggatggatggatgaatgggcagatggatggatggatggatggatggatggatggatggatggatggatggatggacggacaaccgggtggatgggtggatggatggatggatggatggatggatggatggatggatggatagacggatggatggatggatggatagacggactgatggatggatgtttatggatttctaggagaaagggatctgagcagacagaagagcaggtacaaaggcattgaaccgagtgtatgctcctggcctgtaggggaagcaccaagggggcggcaggggtagggggagcacacagaggcatgaagggggcagatgaggccagaggtgatgaagtcacatacgtaggactttggctgtcaccaaatgagatgggagccactggacattttttatttttattttttgagacagggtctcactctgttgcccaggctggagtgcagtggcatgatcttggctcactgcagcttcgaactcctaggctcaagtgattctcccacctcagcctcccgagtagctgggaccacaggcgtgcaccaccacacctagctttttgtattttactttctgcagagatggggtcttgctgtgttgtccaggctggtcttgaactcctgggctcaagccatctgtccacctcagcctcccggagtgctggaattacaggcatgagtcaccgcacccagcccagccaatttcctaacagaaaagtgatatgattttgacatttctgcaggatccctctggccgctacatggccagagtggagtggggacggtgggaggtgatggggaccgcagctcccgggtcctgtgtgtccagcagcctgtctaacactcagccttgctgtttggttgtctttccagcggaagccctgggcctggaccacatggtccccgtgccctaccggaagattgcctgtgacccggaggctgtggagatcgtgggcatcccggacaagatccccttcaagcgcccctgcacttatggagtccccaagctgaagcggatcctggaggagcgccatagtatccacttcatcattaagaggtgcgggtggggctgggcgcagtggctcatgcctgtaatcccagcactttgggaggccaaggcaggcagatcgcttgaggccaggagttcgagaccagcctggtcaacatggcaaaaccccgtctctattaacaatacaaaaattagccaggtgtggtggtgggtgcctgtaatcccagctacttgggacgctgaggcaggagaatctcttgaacccgggaggcagaggttgcaatgagccaagatcatgccactgcactccagcctgggtgacaaagtgagactctgtctcaaaaaagagaggtgcgggtgggcgtaggggtctggccttctgctccgggcttggcttgggctccgggttttggggcatgtgggctaagcaggggcctggggaggcaatgatggggcaggggcagaatgaatgggttctctaacttaacacagagaataagacgagtctgagagagaattctgttatagctccttgtgtagctgtgtggcctattccttctgggccttttgaggattgaatggaaaatgcaggcacggtgtctggcctaatcaggcactttgtaatttttttttttttttttttttgaatagagatgggatcttgctatattgcccaggcctgcatagcctgagtgtcagagcaaggccctgtttcttaaaaaaaaaaaaaaaaaaaaaaaggcggcaggggtggggggaagggacaatgatggcccccccgacccaagttttcctaacataaaatgaaaaagtggatgaaacacacctgacatgtagcagatgtttaataagcatgaggtgttttttcattgtccttatttcccttgtgaattaaaacatcattaagtgcatcggtgcacctgaagacatttccgacctgggcgtccttgggcaagttacttaaccactctgtgcctcatttacataaaccaggcctgataccagcccaggcaacatggcgagaccccatctctgcaaaatatttaaaaagttagccaggcatggtggcaggtacctgtagtcccagctacttggaggctgagatgggaggatcacttgaccacaggagttcgagactgcagtgagctatgatcgtgccactgcactccagcctgggtgacagagtgacaccccatctcaaaaaataaaaaataggccaggcatggtggcctggattacgcctgtaatcccagcactttgggaggccaggatgagtggatcacctgaggtcaagagtttgagaccagcccggccaacatggtgaaactccgtctctactaaacatacaaaaattagccaggtgtggtggcgcacgcctgtagtcccagctactcgggaggctgaggcatgagaatggcttgaattcgggcgacagagattgcagtgagccaagatggcacaactgcactccagcctgggtgacagcgagaatccatctctaaataaataaattaaacatagaataaccaggcctgataattgtccatgcctcatagtgttgatcggagagtaaattaccagatgtggatgaaatgcttagaacagtggctacagcttcagagcctccaagtacacttttttctattacacaccccagcctcatcatttaaccatctgagatcatgctggcaaaagtgagtcaggagaggagggcttaaaaaggagccaggggctgagcacagtggcttacggcctgtaatcccagcactttaggaggccaaggtaggcggatcacttgagcctaggagttcaagaccagcctggccaacgtagcaagaccccatctccaaaaagaaaaaaaaaaagtggggggagccaggaggtagagtctctgccctggcccaggtatctgcagggtatgcaccatctgggagtcagaagtgctttctacaaggcctgagggtcttgttattggtggtacagctctctgccccccacctctgccccaaccccaactcatgccaagttctggcctcctacttctcatgtctgtattcctactgggatacaatagaatcccccagggctgtgggttcacacctcaggggcagatatattggttctagctaagccagaacttaggaggagaaagtatctggagaagatttctagaactcagaactgtgcttagaggctggccagcgaccccttggtcagtgcctatcatgtgggccttccagtccgggcagcccgtgagggcatctgaccgctccctgacatctgcctccacccccaatgcccccccagggaatggtgtaagtccctgatgctgtctcgaacccacatctccccgaccctgttctccctgataaataaataaaactgtaaataataaaactgcaggctgggcacagtggcttacacttgtaatcctagcacttggaaaggctgagacaggaggatcacttgaggccaggagtttgagaccaacctgggcaatatagtgagaccctatttctacaaaaaataaaataaatagccaggcctggtggtatgcacctgtagtcctagctactgaggaggctgacggaggaggatcacttgagcccaggaattggaggctgcagtgagctatgatcacgccactgcactccagcctgggcgacagagccagaccctatctctgaaaacaataataaaacgacaaccaatgctgactgtgtctccatcactgggtggggctgaggaagcaggcctcagaaaggaagccagttttcccccaaaattattccctgaggctgcctctgggcctgtggatccagatgtgtgggggccttcaggagtggcaggggagtggggcctccagcgtgaaaacagaagtcaccgtcagccttgcacccccggctctgcctcccaggactggtgtttttgcctctgttttaatttcctgctgggtcctcccttggacattgtcaggtatgcaggctgggacatcccttctttcctcctacattccccctagagcccaaggctctgtccgtggtccagccactccatggcagggaagctgtacctccataatcagctgcctgagggcccctgacccaccaccaggcaccaccctggtggggctgaggttagaagggaaagaatgccagaactccagtcctggaggcaggagagtgtgtgagcccagccccgccctctcagactctcagacctttatttcatcctcattttcctggctagaggttccatgcatcatttttttttttttttttttcagatggagtctcactctattgcccaggctggagtgcagtggtgctatgtcggctcactgaaacctccgcctctcaggttcaagcaattctcctgcctccgcctcccaagtagctgggattacaggcatgcaccaccacacctggctagtttttgtatttttagtagagacggggtttcaccatgttggccaggctggtctcaaactcctgacctcaggtgatccacctgcctgggcttcccaaagtactgggattataggcttgagccaccacgcccggctggttccatgcatcttacctggatgacttgggtccctaaatgggcccctgggtgcccagcctcccctcctccaatacattctctgataatctgaccttgtcatgaccattggggcacctgttgcccacagggtagaggccaggtgcctgaggacagcactgaaggccgtgcacctccacctccagcctccagtcacctcacctagctcactgctctctctcctgcaaagtctctcctgcttccctccctaagggaagggctggccgctcactgcttgggcccccttgatttctaagacacctgtgaagggtcccacaaggccaggcacagtggctcttgtctgtaatcccagcgctctgggaggctgaggcaggaggatcacttgaggtcaggagttcaatgtggacaacacagtaagaccctgtctctacaaaaaaatttaaaacttagctggcattggtggcgcatgcctatagtcccagctacttgggaggttgaggtaggaggatcgcttgaacccaggagttcaagtctgcagtgagctatgattgcaccactgcactccagcctgggtgatagagcaagaccccaactcaaaaaaaaaaaaaaggatcccacggttcaccttgtgctgccacgatcggttggcagctctgctctgtgccgtcctgtgcctgtcactgagtaagatgcaggagaagttgggcaaaagccctcaggataaacgaataagtcattcagagtaggtgctggtgggaaatgggcttgagtcactcacctggggccagaagaggcccccagggagttgtgagcagattagaccctccaagaccgccccaggggttggcccatgctttccctaactgtgcaaaaatggtttgggataggctgggtgccgtgggtcacgcctgtaatcccagcactttgggaggctgaggcaggtggatcacctcaagtcaggagttcgagaccagcctggccaacatggtgaaaccccatctctactaaaaatacagaaattagctgggtgtggttgcacacgcctgtaatcccagctactcaggaggctgagggaggagaatcccttgaacccgggaggcggaggttcatggggaacccagcaggaaattagaatagaaccaaaaacgccagtcatgggaggcagagctgggggagcgaggctgacaatgactcctgttttcacgctgagagaccccactcccctgctgagatcgcgccactgcactccagcctgggcgacagagcaagactccatctcaaaaaaaaagttaattaattaattagattaaagtacaacaattagcagggcatggtggtgcacgtctgtagtcccagctactcaggaggctgaggcagaagaatcgcttgaaccctggaggcggaggttgccgtgagccaagatcgcaccactgcactccagcctgggcgacaaagtgagactctgtctccaaaaataaaaataaaaataaacggtttgggatgttctgaggttccagacatgccctctcctgcctgcatgtctgccggatgcccaggtctgtagctgtgcatgtgtcactcagtgaccatcaccaaaggggactggaggcatctccccgagccctgggagagtcctccagcctgcactgttctcatgcctgtctctcttctctccccaggatgtttgatgagcgaattttcacaggtatgtggggaccatctagtccattctgaagtttccggattggttccccaacagaacccgagctgccaccaccctggacttggtcctcctgagcgcctcccctcaggcagggagggaggctgggctgtggtttctgtgtcctgggacagaaatgggtcccaggcttctaggtgctgacagactgtcaggacaacccctcccagcttcaaatgccctggacagagagtactaaagctggacgctaaccggtgccaggttggtgaacctgagcctgtgccaggctctctttgaagctgccagcatattttattttaatctgattccaacaatcctatgaaggtggctccactccactactctcacgtgcagacagaggaacggaagcccagctggtgagcacgggtccctgctgcatgcccagcagtgtgactccagagcccatgcagtggcccgtgggccagcacacctgtcccaggaggaagatgcgggctcttcccggggtagcaaaagcatcacggttcttggggtgatcctggcaccccagttccggtcccgcctcccaccagctgtgtgactttgggcaaggtcttgtgggcttcagtgtccacgtctgtgagatgaggataagggcgccttcctctgggctcctggcacgatgacatgagagcctggtcttgtgatgcagccatggggaagccccggcccttttctgagggctcagcccccatagtgtgttggagggcaggagaaccatctctggttgctgcctcccattcctcctgccccttgctctcccaaatctctggccacctctggcactagggctgctgttcctccttctggcgtcagagtctctccccaggacccgttcctggctgttggctggacgtggcgcccacaaggacaggcagaggccaggccctatccccgggattcccccagcttcacacacagacctttacccaggggctctgcagcaagaggaggccagagggccttcaccctgacctccctgactctccccacagggaacaagtttaccaaagacaccacgaagctggagccagccagcccgccagaggacacctctgcagaggtctctagggccaccgtccttgaccttgctgggaatgctcggtgaggccccgcccctggccccggaggcccgcggccagccctgctctgggctgaggcagtgttacctgcaagggggtacccagggcggctcccaccacaccaccacccctcgaaggtgcaaagggagggcaagggaaaacagactccacctacttccctctgcctagagaactctcacatagagaactctcccgcccccaacatctagccagatgtcacctctctcagaagcctctaaatgcccacactaggccaggtgcggtggctcacacctgtaatcccagcactttgggaggccgaggcgggcggatctcttgaggtcaggagttcgagaccagcctgggcaacatggtgaaactcccatctctactaaaaacaaaattagccgggtgtggtggtgcgcatgtgtaatcccagctactcgggaggctgaggcaagagaatggcttgaacctgggagggagaggttgcagtgagctgagattgcactactgtactccagtctgggtgacagagcaagactctatctcaaaataaatacatgcccacaccaggccggacttggtggctcactcctgtaatcccagcgctttgggaggctgaggtgggtggatctcttgatcccaggagtttgagaccagcttgggcaacatagtgagacccttgtctctacaaaaaataaaaagttagctgggcgtggtggctggtacctgtggtcccagctacttgggaggctgagatgggaggattgcttgagcctgggaggtaaaggctgcagtgagctatgatcgcaccactgcactccagcctgggcaacagagtaaagaccttgtttcaaaaatacaaacatgcagctgggcatgatggctcacgcctgtaatcccagcactttgcgaggctgagccaggcagatcacctgaggtcaggagttcgaaaccaacctggccaacatggcaaaaccccgtctctactaaaaatacaaaaaaaattagccaggcgcagcggcgcatgcctgtagtcccagccactcgggaggttgaggcaggagaatcgcttgaaccctggaagcggaggttgcagtgagccaagattgtgccactgcactccagcctgggcaacagaacaagactccgtctcaaaaaaaaaaaacaaaaaaaacatggatgcatgtatacatacctactacatgcatacatacctactacatgcatacacacctacctacatgcatacatacataccaacaccaggtctgatgcctgtcctgagtgcccaccagaccctgcccccagcactcagcttggctaccatccaccaacaccccccaagcacattctgacctcttaggggcaggggtgggccgtttatcccagaatccccacatcatatcaggcctctccctgcagttccctgggagggagggaattaaccaaatcatctgtcccagggttcctgccaccttcattccccagccccttccccagatttttaaccctttccaggccctgcaggtctcagtcccccacaagcagtgatcaaacccccagtgtgccaagcctaggatccccagagctcccagatggtgaagaagggggatccccagatggttcaccccaggagagtgagcaggtgcctggctcggccacccctggagattgtggtccctggagacaagacacggggaatctgtcttcctggtggaggtggggagcaccatcctggagggccaggggccgatggggacagggatgccttctgcagtggcgcccgcggtgggccctgactgcctggaggggcaaggctggggcagggtggccctggacttggctgacaggtgtcatttcctgcttcccttcacaggtcagacaagggcagcatgtctgaagactgtgggccaggtgagaaggaacagggcccgctgtgtgtgtggtgggccgggagggcaaccaccagccctacccggcagccttggggaggagctcaactcagcccatgagcctggagtgctaacgagcctcctctgcccacctgcctccactaggcctcgcagagctgaggtgcaaggcatgctgggagcttactggggtcagggacatggagagctgggtgctggcatcaccactgcctcctgtcgatgcccagacccaggctgcaggttcttggaccagcagcctcccctctggggggcctcagtcaccgggtctgtaaatcggagcccctaagcctggcctgagggctcccctgacctccaattccagtttgggcggagccagggggctgacatgacttgtcctaggtagggcctcactaacaagttacagacaccagaatgttctggaaagagtcactctgcccagtcgggatcatgccagacttgacaggattcttcctttcctccttgcaggaacctccggggagctgggcgggctgaggccgatcaaaattgagccagaggatctggacatcattcaggtcaccgtcccaggtaagggacgggcatctgaccaccccctgcagaaatcagggccggaccgttagcctcctgagggtctgccctggtgaagaagtggcctccaggccgctgtttctctctgtggattctgagagccatcggggtactgtgaatgctttttctggccacatctgtcccctgcgttgtgaatcagtgttctcagctctgaccttccagaaggtcccctcaaaacttcacctccctggcttggcttccctgggatttgtgaggctggacagaagaaaaagccatgggtgtgagaggctctgagtttgaccctaccccctgccaagcctcattttccacatcttcagaggagaggatagatttgggcgctggagcctcagtacggggtgactgttagaagccaagagggtgctgggcacagtggctcatgcttgtaatcctggcattttgggtggctgacacgggaggatggcttgaggccaggagttcaagaccagcctgggcagcatagcaacacccacatctccacaaaaaatacaaaacattagccagatgtggtggtgtgtgcctgtcggtgtagcttctcaggaggctagggcaggaggatcacttgagcccaagagttggaggctgcagtgagcagtcatcccaccactgcactccagcctgggcaacagagcgagaccctatctcaaaaaaaaagaaatgactgggcgcagtggctcacgcctataatcccagcactttgggaggccgaggcgggcacatcacctgaggtcaggagttagagaccagcctggccaacatagtgaaaccccatctctactaaaaatacaaaaataagccaggcatggtggctcacgcctgtagtcccagctactcaggaggctgaggcaggagaatcgcttgaacccgggaggcggaggttacagtgagccaagatggcgccactgcactcctgcctggacgacagagtgagactccatctcaaaccaaaaaaaaaaaagagacagaaagaaaaggacccttgtctgtggggagactgggctgggtgggccctgagggactgtgacaggagtatgacaggcagaagatacccgtgtcattcggagttttgtcttcagacccctcgccaacctctgaggaaatgacagactcgatgcctgggcacctgccatcggaggattctggttatgggatggagatgctgacaggtaagaaatggacctgggctggtggtgcttgggactcagctctccagggagcaaagggaaaggggtgggccaggccgtccccaggtgtttcttggtgtcagccgtctgtagtagaggaaacccaatatatgcctgaccctaatccaaggctgggttccttttggaaacctcaagtaggctctatttatttatttagagacggagtttcactcttgttgcccaggctggagtgcagtggcacgatctcggctcaccgcaacctctgcctcccaggttcaagtgattctcctgcctcagcctcctgagtagctggaattacaggcatgtgccaccatgcctagctaattttgtatttttagtagaggcgggctttcgctatgttggtcaggctggtcttgaactcccgacctcaggtgatccacctgcctcagcctcccaaagtgctgggattacaggcgtgagccaccgtgcctggccataggctccatttataacaaggcccagcgtccttcccaggagccacctgttggaattaatttgtccatttatccaacaactatttattgagcatctgttgtgtaccaggtcctgtgtaaggggctggagacaaagcagtgaaccaagcagaagtccccacctcctggggtgcacatcctcatgtgaagagatagatggatagtacgcaaataagtaaaataggcagggtaaggtggctcgtgcctgtaatcccagcactttgggaacccaaggtgaggggattacttgaggctgggagttcaagatcagcctgggcaacatagagagacccatctcttaaattttttgagatggagcctcactctgtcacccagactggagtgcagtggcgcgatctcagctcactgcaacctccacctcccggcttcaagcagttctcctgagtagctgggattacaggcgcccgccaccacgcctggttaatttttttgtatttttagtagagacggggtttcaccatgatggtcaggcaggtctcgaactcctgacctcaaatgatcctcctgcctcagcctcccaaagtgctgggattacaggcgtgagccaccacaccttgcctcaacaaatatttattgagcacctgctatgtactaggtcctgcgtaaggggctggggaaaaagcagtggaccaaacaggtgtccccacctgctggggtacacatcctcgtgcggagagataaacagtaagcaaataagtaaaataggcagggtgaggtggctcacgcctgtaattccagcactttgggaggccaaggcgagggtactgcttgaggccaggagttcgagaccagcctgggcaacatagcaagactccatctctaaaagatttttttttaattgactgacacagtgtctcacagctataatctcaacactttgggaggccaaggcaggaggattgcctcagcccaggagcttgagaccagcctgggcaacatggtgaaaccctatctctacaaaaaatacagaaattagttgggtgtggtggtgcgtgcctgtagttccagctacttgggaggctgaggtaggaggattgattgagcccaggaggttgaggctgtggtgagccgtgatggtgccactgagtaagaccctatcttaaaataaataaataggtcaggtgcattggcttacaactgtaattcaccattttgggaggctgaggcgggcagatcacttgaggtcagagttcaaaaccagcctggccagcatgatgaaacccccttctctactaaaaatacaaaaattagctgggcatggtggcgcatgcctgtagtcccagctactcaggaggctgaagcaggagaatcacttgaacccaggaggcagaggttgcagtgagccaagattttgccattgcactccagcctggacaacagagcgaagctctgcctcaaaataactaaatagatagatagatagatagatagatagataaaaattagacaggaacggtaggacctatgtgtagtcccatctactcaggaggctgaggcaggaggatcctttgagcccaggagttggagcctgcagtgggctatgatggtgccactgcactccagtctgggtgccacagcaagacaccatctcaaaaaaaaaaaacaaaaataggctgggcatgaagaattgcgtaatcctagcactttgggaggccgaggcaggcagatcacctgaggccaggagttcaagatcagcctggccaacctagtgaaaccccatctctgctaaaaagaccaaaaaaaaattagctgggcatggtggcaggcacctgcagtcccagctacttgggacactgaggcaggaaaaccgcttgaaccttgggaggcggagtttgcagccgagatcacgccactgcactccagcctgggcaacagagtgaaattctatctcaaaaacaagcaaacaaaaataggcaacaaggcaggatgcttaggatgtaacactaagcaaaagaggaaaaattgattgtgctttgcttacaactgtgttgcaaacgtaatcactggggacaaacaagggtagagcaaaacagtagcagtgttaggcaaaatgatttgcgttttttattttctaaatcagttatgatgcacttctaatactttggtaatgaagaaaaaaatatgatttgtccagcacaaactgggcatgaccagacttgacagcagtctgtggcgtagctatccagagagtttggttgacgccaagctcaggctgagatgacagcatggcgtggcgcctaaggaattggcacggtgcccagctgggtttgcagtggccttagaaaacaccatagaagcctccatgcagcactcacagccagaggctgggtggcactgcaggggttgggggccttggatgagcacagcatcattgctgtttgtttcacagagcagaacacaggctcagcaaggctcatccacctccccaaggtcacacagccttgggctggaaaacatgtttcccatgcagggttccttcccaggcaccccagtcaaacctgatgaattaagaaaattctggctgggtgtggtggctcacacttataatcccagcactttgggaggccgaggcgggatcacctgagatcaggagttcgagaccagcctgcccaacatggcgaaactccgtctccactaaaaatacaaaattagctgggcatggtggtgcgcacctgttatcccagctatttgggaggctgaagcaggagaatcacttgaacccaggaggcagaggttgcagtgagccaagatcgcaccattgcacttcagcctgggtgacaagagcgaaactctgtctagaaaaagaaaaaaaaagaaaaagaaaattctgatggtagtcacatctgtaatcccagctactcaggaggctgaggcaggagaatcgcttgaacccaggaggtggaggttgcagtgagctgagactgcaccactgcactccagcctgggtgacagagcgagactctgtctcaaaaagcacaaaacaacaacaaaaaaagaaaattctgagatgtccaggaccaccatggattagaggattttgcatttgtgtgctttttctgtttacacatatttgatatgaaacagttaaatgatacagaactgtgtaatacattgagcaggtgcagtggctcatgtctgtaatcctagcactttgggaggccaaggtgggaggatcgcttgagcccaggagttcgagaccagcttggacaacatggcgaaaccctgtctctacaaaaaattttaaaaagtagccagccgtggtggtacatgcctctagttccagctattgaggagactgaggcgggtggatcgtttgatcccaggagtttacaaccagcctggggagcatagcaagaccccatctctacaaaaaaaaaaaaaaaaaaaaaaaacaattagctggatgtggtggtacctacctgtagtcccagctattcaggtggccaaggagggaggatagcttgagcccaagaggttgaggctgtagtgagctgtgattgctccactgcactccatcctgggcaacagagcaagacccaggaaaaagctccagtcacatcctcctcaggcaaccactagtattcctagcatcttccttttgtatgtttttatctatgtgctaattcatgtgatgactattttaaacaaattgtcccttgtattctcacctggaagtttttttgtttgtttgtttgtttgtttttgagacggagtctcactctgttgcccaggctggagtgcaatagcatgacctcgctgcaacctccgcctcctaggttcaggcgattctcctgcctcagcctcccgagtagctgggattacaggcatgcgccaccatgcccagccaatttttgtatttttagtagagacagcatttccccatgttggccaagctggtctcaaactcctggcctcaagtaatccacccatctcagcctcccaaagtgctgggattacaggtgtgagccaccgtgcccagccgaggactttgtcttgttcccacgtgtcctcagtgtctagaacagactagcttgggaggtgcatgcaaaatgatctcagcctgctttcgtgtgaaggccagggtaggcacctgtatggaatcggggtccctgatcccattggagtgggtgccatgcttcagagttggggccccctggcctgccattccccagctatctggcctgacgtcggcagtgcatggcttaggagatgatgaatgtggcttcccggcatcctctgttctcttttagacaaaggtctgagtgaggacgcgcggcccgaggagaggcccgtggagggtgaggccctgtctacccctgacattttacacccacccccaccccatctctcttcccctgccgcccacctccccttggcctctgggtctcttcgttctctccacctcatctctctccagcaccctggtgtgggggtgggaatcctgtgggctgcctgatatgggaggagatttaaggatttgtcttctagaaccaggaagttcctggtcaaaggtgagagcagttcccactgctaaggaaaattgcaagcctttgtttttattacacaccctgctgctttgcgcaaaggttttaagactgggaactgagcctcctctatctgagcaagtagattagaggcctgaaagcacaaaatttgctttgtgtccagcagacacgcccattctcaggaacgtgagaattccctccctgctgagaatggaagtaggacagagagagagggaggccagggtgagggtgggtctgtttcatctctgtagtatcctggaatggaatgagtgagtgtcagaggagagaattgtcacttccccaaacccagcctggcaggaggaaccatgaagtcttaacacagttccgctgccacctggtggcagcctgctcaatttgcaggcttagtgggtacccactagttctatcacatgctacactcagtcacatacctagaaagacccatggtcactcctagtccacagaaccttccaaatcttcattcaggctggcggtgccctagatttgatttcgcaaacaagaatgtgagcccaggaattgtggacctgtctgcgtgtgccatttctgaggaaataagttacccaccgccccagccccagccttcccccattccaagatcccaccacagggccaatgttggtaccagcagagcaggaacatcagccgagaagctgccaccaaccagcctcaacagactgccttttgccttccagacagccacggtgacgtgatccggcccctgcggaagcaggtggagctgctcttcaacacacgatacggtgagcaagaagtgggacagggtctgggggcatcccggcccccctccagccgccctgtttgcagaagggctttggtcgcatccccttgcctgttcccatcccagctgttctctgggcagggacaagggagagagggaagggaggagctgggacccatcatgaggatggggacactagagaggctgtcactcaggctccctggctcactcactcacactctgcctcagtcgcaggttggagaggccactccctcccctgtaatgtcgccagccctcagccctccgccctcaccctcatccctccgccctcaccctcatccagggtcctcaagaagactcataataagaataagataagataacctcagtggtgtgccgggcatgaggctaggtgattccccatgtttttctttttttttttttttttttttgaggcggagtctcactctgttgcccaggctggggtgtggtggcgcaatatcagctcactgcaacctgcgcttcctgggttcaagaaattctcctgcctcaccctcccgagtagctgggattacaggcacctgccaccatacccggctaatttttgtagttttaatagagacagggcttcaccatgttggccaggctggtcttgaactcctgaccttaagcgatctacccaccttggcctcccaaagtgcagggattataggcttgagccactgcacccggccccctgtgttcttgtatcccatctcacaaaatccccgtgtcctaagacccactttacagatgaggagaactgaggcctggtaaaggggtgtgactcgtccaaggccccacaccactcagtggcagagatcgggttcgttccaaggcgtggtgttgtgccacagcagcgtgtggggttgcttatggtggcaggagggacactcggggggccttactggaagggcgaggcccagtggactcggggaagcaatgccgaatctcagcagccattagtggtggcttctgtactgcctgggcatgagggcatggacccagcgtgggccttggggtaaccctgggttgagttcctatcccctggctctgctgttcagtggctctgtgacctcagacaagtcacgtcccctctgaactccaggttcctttcctgcaggctggggggccactctttccacatcccaggaaagctggcaggccctcaaaagggctctggcagctttgccccccgacacaggcacgggacacaggggttgaggctcctggccctgtggcaccgggtggccctacagcagccatgtctctgcagccaaggccattggcatctcggagcccgtcaaggtgccgtactccaagtttctgatgcacccggaggagctgtttgtggtgggactgcctgaaggcatctccctccgcaggcccaactgcttcgggatcgccaagctccggaagattctggaggccagcaacagcatccagtttgtcatcaagaggt

SEQ ID NO: 11621 - DNA, 206 bp, Homo sapiens
ccgggcgcggtggctcacgcctgtaatcccagcactttgggaggctgaggcgggtggatcacgaggtcaggagatcgagaccatcctggctaacacggtgaaaccccgtctctactaaaaaaaaaatacagaaaattagtcaggcatggtggtgggtgcctgtagttccagctactcaggaggctgaggcaggagaatggcatgaa

SEQ ID NO: 11622 - DNA, 145 bp, Homo sapiens
tcaagcaattctcctgcctcagcctcctgagtagctgggattacaggcacctgccaccacacctggataatttttatatttttagtagagacggggtttcaccatgttggccaggctggtctcaaactcctgacctcaagtgatc

SEQ ID NO: 11623 - DNA, 6209 bp, Homo sapiens
gaacaagaatgggatgaattttatcttactcatttcctggaggaattttgacaaagcagagacgaaggcgagtcctcattcctaattcaccaggaggctgttagcccagcaattgggcgtgactgttcctgcccagtgtgctgggtgacagctgtgtcccaggagccccacatccccagagctccaggtatattgtggcttcatttatatttttattttttgtaaattttttctttttttcttttttttttttttttttgagacggagtcttgctctgtcatccaggctggaggctggagtggcacaatcttggcttactgcaacctccacctcctgggttcaagtgattctcctgcctcagcctctggagtacctgggattcaggtccccaccaccatgcctggataatttttgtatttttagtagagacaggagttgaactgtctctacctgcatgttggccaggctggtcttgaactcctgaccccaggtgatccacctgcctcggcctcccaaagtgccgggattacaggcgcccaccaccatgcctggataatttttgtatttttagtagagacaggagttgaactgtctctacctgcatgttggccaggctggtctcgaactcctgaccccaggtgatccgcctgcctcggcctcccaaagtgccgagattacaggcatgagccaccacgcccagccaattttttgtaaatatttttctaaggtactttcgttgtagcatatcatggcttcaggcctcctggcactgggattgtggagtgagctgccattttcttcctcttcctctccggggcacagagactgtctggatcggggaggaagagaggggagaggagaaacacgtgggactttggaggtctttgaaaagagtttgacacaggttggggcaattgaaaccccagatctcagtcgctggagctgttcttttcctttctttcttttttagagacagggtcttgctctgttgaccaggctagagtgcagtgggttgatcagagctcactgcagcattgagctcctgacctcaagcaatcctcctgcctcagtctcccaaagcactgggttataggtgtaagccactgcccagcccaggcctgttcttctctgtttacactcactttctaggttctctctctagtgtcatggtttaaatactaactgtttgccaatgcccagtgatagggtttggctctgtgttgccacccaaatctcaccttgaactgtaataatccgcacgtgtcaaaggctggaccaggtggagataatggaatcattgggccggtttttcccatgctgttctcgtgagagtgagttctcacgagacctgacggtgtttttttttttttttttttttttttttcggaatcttgctctgttgccaggctggagtgcagtggcgcgatctcggctcactgcaacctccgcctcctgagttcaagtgattctcctaccttaacctcctgagtagctgggattacaggtgcacgccacgacgcccagctaatttttgtatttttagtagagacagggtttcactatgttggccaggatggtctcgatctcttgaccttgtgatccgcctgccttggccttccaaagtgctaggattacaggcgtgagctgctgcacctggcctgacctgatggttttataagggtcttcctcctctggtcagcgctcattctctcacctgccgccgccctgtgaagaggtgccttctgccatggttgcaagtttcccgagacctccccagctacgcagaactgtaagtcaattaaactgcttttctttataaattacccaatctcagatatgtctttattagcagcatgagaacagactaatacacccagtgtggtagactgaataattacctcctcaaaatgtccatgtcctaatccccagaacctgtgaatatgttaccttatatggcataaaggactctgcagatatgattaagttaagaattttgcagggggagattatgctggtgggtttgatgtaatcccaagggtccttatacgagggagacaagacataagtgtcagtagtagtagatgtgatgaggaaattgagaggttggggtgatgccaggaaggggtcgtaaaccaagcaatgtgggtgattgctctgagccccgccaggctggaatcaaggtgacagctgggctgccttcctttctggaggctctggggagaatccgcttccagactcactcttgtgggtagaattctgttccatgtggttgcagggcggagggccctgtctccatgctagatgttggctggggctgttcttagcttctggagggtgccatgtttcctgatccatggctcctttcatcttcaaaccagtgacagcagctcaggtttgtctcctgcctcttctccagtgaatctctctaccttcagctgggaaagggtctctgtttctaaggactcatgtgattagtaggtttgtgcaaaagtaattacagtttttgccattgctttcaattaggatatggacatctttggggggctattcctctgctctcctgtaccccttcttgcctcccatgggtttagtggcattttctctcctgctgtcagaaggaattgagcttcaagttcatagtggtcaccggctggccaccccattcttccattatcctagccatcatcctggccaaatcctcctttcaaacggagtctcactctataaccccaggctggagtgcagtggcgccatcttggctcactgcaacctctgcctcccgggttcaagcaattcttgtgcctcagcctcccaggtagctggcattacaggaatgccactatgcctgactaatttttttttgtatttttagtagagacggggtttcaccatgttgcccaggctggtcttgaactcctggcctcaggtgatccacccgcctaagcctcccaaagtgctgggattacaggcatgagccactgtgcctttttttgtttttctgaatagcaaatagtttattggtaagtacatggttttaatgggagtaataaatgaataggagacaataatcaagtcaaaagaataaatgcttaccaatcatcagaaaatctgtggccattagagctggcacgtaaaaactcaaaatcactcagaggccaaatcttaaagaagattcgtcctcttattagtcgatatggaataggtccatagtacctggaatctgtagaattctgtagattatcaccttctaaccaaacatgacccactggcacataactacggcttttaaagaaatctgatggactagtggcgaggattttgtctccttccaattacttttttacaaatatttgattttggatcacttgggctttttgcaatcacaatgtcacctctttgaataccgtacaaatgtacaccaagattttctgcaaagacagtatctgaattttgaatggtaggctccgttggtggtccagaacacataacaacaccaccaatgtattcaaaagcacaatatagccatactgaatagcatagccaacaagtcgaaagcctttccccagaacatcacaaagcatagttctaggtagactctgccaccttcggccttgggccctaaagaaccctgaagaccctcaaccaggacacaggtatgccaaggcctttttatcttgctctttcaactttgggatcttttcccttctggccagggcttcagttaagccctttgtgagcctttttctcctggctgagccttggcaaaggatcttattttgtaaccacccctgccccaaagctgagcttttccccttttcctgccaataactccctgccctgccaattggagccccacatcctcattccctcaggaacatgacgagtttccctctgcaattcctagcctggccctacaaccaagggacgctggcttggatacggcacctctttgaggaactccatccaagatgagcatgtgggacactgttgcttggatgggaccctcctggttgggctgagttgctgggatcctcatatcctgctctccttaccagattcttccctccaggtctacacaacactccagtgcacccagcccaactcacatagggcagtaccaggcaaaggagagcttccttcctcacctttcccctgtctgaggtttatcccaggcactggtgccagtgaatggaaccgaggagtgatagcatcttacctgctgcaatctgaccaagctcagctggaggagcctcgggtcagagcagccgaagccctccagcatgcaggctccttttatccacaacctctccccactggtgaccttgttcgtggtcggtcactcaaactcttcctaaactgccccctgggccattggccactcaccatgagcgttcctgcgtctaatcattgcttccttcctttgatgtaagtggggatcttgttgctagggtaaccggggtcgaactataggtctggggtcttgaccttgaactctgcttaactggattcttcttaggttcttggctcgtttcccttttgtggttaggagaatgcacacccttccacatttctgtcctggtttctccatattttgttctctttctttgaagtctgtctggcctatacattttctctggaatttgctaactcaattgttttgtttctcgtagccaatgttggtgtcaaatttaaaaaattgatttggcaagaacacataatggattgtgctgtgtgctctgtactgtctcatgcctggaggcacaccatgtttggctgtcccttctgctaacactgagattaaactgtggatttggtaccaggaatggtggctcatgcctgtaataccagcactttgggaggctgaggtgagaggattgcatgagatcaggagtttgagaccagtctggcaacatggtgaaaccccgtttctactaacaaattttaataattagctaggcgtcgtggtgtgctgttgtggtcccagctacataggaggctgaggtgggaggatcatttgagtctgggagattgaggctgcattgagctgtgattgtgccactgtactccagcctgggtaacagagtgagaccctgtctcaaaattaaaaataaaaaaataaaaataaaccctgtggatttgggaggtgacatccccccaccccattatagccttccccatcatttcatctaatggtttcacccattgataatctctgcctaaatcatttattttattgtaggttgcaaaattaaagccatcctcatagggttaacgtgaattctggacagaaatattgttgtaattaagcattaatcatgctgcactttggtccacttccttgtaactgaatggcaggagcactagatactgaccatttacatccccattgttcctataggatctctgacattagaatcataaggcttttggccaggcacggtggctcacacctgtaattctagcactttgggaagccgatgcaggcagatcacctgagctcaggagttcaagaccagcctgagtaacatggtgaaacccagtctctacaaaaaaatacaaaaattaggtgggtgtggtggtgtgtgcttgtagtcccagcaactcaggaggctgaggtaggaggatcagttgagcctgggagatggagtttgcagtgagccgagatcacactgctgcactccagcctgggtgacacagctagacccctgcctcaaaaaaacaaacaaacaaacaaacaaaaaaaaacataaggcttctgtttaagaattgcttaagatgttcttctgatcctgagttccagcagaacagctgatggcaaccagtttgaagaccccaacagaggcactgagtcggcagtactatgagaacacagtttcttcctctccctgtcccatgacttcacgctgcactcttcaaccaatcaacgatctccacactttggcccactcccaaacccttaaaaaccctagcccccaactcttcagggaggcagatttgaggtttcctcctatctctgcatttggcagccctacaatgaaacctctttgtctgctgcaacctggtgtctcagcctattgacttgctgtgtgcatagggcaagaaacctattacggttacaaaatgatgatgtttctaatttgtcatcttttaaacatttattaaatggaattcttccgtaaaaaaaataataaaatttcctcgtcagtta

SEQ ID NO: 11624 - DNA, 14208 bp, Homo sapiens
tgctctacttacaatcaccattttattataaagaatacaaatgaagagccagacaaagagtatgtagggtggcaagcactggaagggcccagagctcaggagcctttgtccctgtggaatcaagatgcgctaccttcctagtacattggaatgtctgccaatcaggaagctccccaagcctcactgtccagagtttttattggggtttctttacataggcagcattgcttaaatcactggccatgttaaaattgaactcaatttccagccccatcacctccttggagattgggggtgggatggggctgaaaattccaatgctttaaccacatgcttggtctttctggcttggccaactccttccttgaaactaagggcccaccatgggtaaccttgttagcataaacccaggcatgggtgaaaagggcttgttatgaatacaaaagacactcctatcaggaaactctagaatttttgaagctgtgtgctaggaactaggcacaaaatccagatacattctttattgtatcacaactggtatatgcaacagtgataaaagtttaagtgagggtatgtgaggttaaagcacctagaccttcaagtatctttaaggctaaagcccaaggaaaaagtcttttgatttggcaagaggatactcctgggtgggggggagaaaggcaggctcagaaggaaaagacaacagcctcatataaatatgacaacagttataatctgagcctttggagagcttgaagttctaatgaaagggttggctggctgctggcatagaggatgtctgtgtcagcaggggcagaaagggttttgtatacagaggaaacagacaggacgtggatgagttggaagcaccgagagcaagatcacagagttatgagaaccaaggggaaagtaaagagctttgctttgaagacacagaggattccttttttagactggaaggaaaaaggaggagctaattggaaaaatacaagaaaaaaaatacaagttgacagaaataagatgcacataaagtggatgacagcaactatttttaaaggcaggctgcctgcagagagggagttcagcaaggcaagactttatgaaagggtttgcagtcttgattgatttcaagaagtccaagaagcaagggaaggaggaatagggaccatcaagggaagaatggatgtgagtgactctttctcacggtgagccgagtctttaaaagcgattgccagatgatctctagaagtttcttttagaattattattcaggattctatggcttctggatgagaacatctcattgacaataggatggatcctagctccacaacttcctggtgtctgcattgtctaaaaagaaaaacatacgtgggagagcaatgtctcctaatagttacaatcattgcttaaaagagttaggggaaaaaaggggggacctgtatctgggaaggtaactattgccagagacaattttttggtatttatttataatgcatatcttaataattagagctaaccccacggttggcttggccacctcttccctacattccccccagggttggggtgtagggttcctctagtgcaagggttctcacctagggcagaagacacatgataaagtctcaagacacttttaattgtcacaactgggtggcatctactgggtacaggccagagatgctgctcaacatcctacaatgcacaagagagcctccaaacaaagaactgtctagccccaaatgtgagtaagtatcaaagttgagaaatcctgctttaaagaaagaacctggtggagagaaccaagtatatctggagggaggatatcctggtggaatatatcaggtatatcttggtaggtagggagggctttggagaggtgtggcagacatccttgggtggccagtgcaacccacgtccacagtcatctttgtagccaccttcaagttacaggtagccacatgacatttctgagcaatgaaatggaagaaaatttgcggatgaaacttctaataaaatcactgtgttcttgacctttgggtatcttttccttcttcctgcttggattgcaaacctgccatctggaggcaccgtggccgctttcagggccataagtactcaaattaacagctaaagagggtggagccaaaagccaaaggcagaaagatctgtgaacccaggggaacgtttgacaatgtctgaagacttttggttgtcactgggagaggagggctagtggcatctactgggtagagactagggatgctgcgcagcaccctacagtgcatgaatctggggttacctgcctgaggatcacttgtagtgggggcttagggggctgaccagctgtttaagctcctgtgagctgggtttcctttatttgtgtctgagttaatttcaggttgctacagtaggagaagttctttgattcaagcctgttacagggctatttccagacaacgcctcctttagatgacttttaccggcactttccaaggtggtattgggtttccagtcccatccttgaagcagggagaggataaccattcctttgcttcttttgccagaagatgccaacaccaacggtcccctccacccacgtcacctgtgggttcggctgggtccaagatcacaggcctgaatgagaggttagaaggcattaggagattccaaatcccagtgacttcagaatttggggtccatcctataatactttcagcaataagacaatgtgttcttacagcttagatgtcagcaactcaaatttactagtagggttcaaagtaactttctagaggccgcgtgcagtggctcatgcctgtaatcccagcactttgggaggctgaagtgggaggatcacttgagggccaggagttcgagaacatcctggccaacatgcagaaaccccatctctactaaaaatacaaaaattagctgggcgtggtggtgcgcacctgtagtcccagctacttcggaggctgaggcaggagaaccagcttgaacccgggaggcagaggttgcagtgagctgagattgtgccactgcactccagcctgggtgacagagtgaggctctgtctcaaaaacaaaaacaaaagccaaaaccaaagcaacttcctagaattaaattgtatttgccaaaagcgttttgaaagctgttaattgctatactcatgaaggcataatgaaggcatagtctaaatatctcctccttgctatgtcagctaaaatatgatacataatttaatcaaatacaatgttgccaagaacccagggtaggcaacccaccgggggtctccttctctcttacttctcctctattctttttcaacgctcctttattttctctctttcctttcctctggtttccattgtttttgtcccttgctggtggccctaagcagatggatatgatttcttactattcttgaaggtctgaaagagtagataaaccctaacccaataaaaaccctgcaggataaatcggcccgtgaatgatagcgttaattcttagggacacacttccaactctaacacctcttagatgaaagcagctcagggacgtggtatcttgaaccttccttctctattttttctgaacagcattttctcctgcccctgctaggttttatccctggagactgtgacaggttctgttggctagcactttcccccgtcatgcaaggaatgaatcgtgaccccagcagaggaaaatccaggttgctgagacagtgttcaagggaatcaggttaagaaaagtacggggctagggtgaaggcacctggttttctgcaactggctcagtagaaacttcctcacggtctcatcttcaaagttgtaattgaccttccagaagatgcagagctgctgatattgtgtgaccagctccaggactgtccggaaaccttctgcagtgtcaaaatccggcactccactcccctgctcccaggcatagatggtgagcagctccaaggcatactttgggggcaaagacccctttggcttcagtttcctttcacactaggtaagagtgggaacatcagacgaactggttagcctaggagctcagtgagagccgcacagggaccacagcaaggcaactgagtcacagtgtcgtgctggtgtgctcacactctgcagcttggatgtctaaattgtacagcctacaggagtccacctggcagcagcacatttgagtttctttgttgtgcttttgaccatatatgccttcctaggacaataacatagctacagtttactagaaacccactgcatgccagctatgggcccaggcatttacccacatcattcctaatcttccccacaatgcaggcagcatgacctgcattttagatgaagactttgaagctgcgggaagtggagtgactcactcaaggtcacgccacagccccaagtcttctgacacgccatgccagctctctgattttctgggatgaaaactacagagtttggtcttggtttcacatttcagggagctggacacagaaaggaggcatctcaggaagagctgatatcgtgcttgatgtttactgtcatgaggatgttcagaagctactttgtgtgcaagtgaggggaaactgggtagagactagggatgctgctcagcaccctacagtgcatgaatctggggttacctgcctgaggatcacttgtagtaggggctcaggggctgaccagttgttcaagctcctgtgagctgggtgtatagaaaatgcagccccggttccacctacagcttcaacctgccttctgagagagagcatgtgcgccgggaagcagaaaagtcctattggcaatgtgtgggcatgtgaatcccagcttccacccaccctctgtaggcaaggtcacttggattcctgcagaattctttggccagtgtgagggcaaagtaaaccacatgtagcagctttgatgggcagaagccatcaacgcctgacccaaatgaatagggttagtgatgggaacgtcgtaaagatatccagtgggcagattctccaaagtggctcagccctcagcatgggagattgtgggcaacagggcttaatgttcatggcttactggtaaaaataataaccccatggtcagaacaaagactgtccttacctctttgtaccagtgcttcaccaggcgaattaaatcctttagtttggtgggccgggagcgaatgaagtttcgctgcaggactgtgaaacaggtagaaaactctcctcccgggaggtccgaggatttatacagatcaatgagccctgcataaacctcggggctgggtgtggagccagaactcagctgacctggcatgagggagagattgacatcctgctttaatacacatagtaagtaacagattccaaaacatttttgacaaatatgatttaattcttggaaattactgtgaatagtattagcatatttaaaagactgatgtctaagacacagggagcatctccagaataatgagatatgtaaaaattatgtggtctacacaggtgcagctggtattattaaagtattatctagacttaaactaacagagcagccaccagcaatgtggccatttgcactcacattcattaaagggaatgaaaattaaaaatttagttcctcagttgctgtagccacatgtcaagctctcagtagttgtagaacccagacatagaacattttcatgatcacagaaagatctctgggacgacactgatctggactttgtgaactaccgccccctgggctaaatctggtgcgctgcttcttgtttttttttttttttttttttttttttttttttgttgttgttgttgttttttgcttttttgagacagagttttgctctgttgccccagactggagtgcagtggcatgatcacagctcactgcagcctccatctcctgggctcaagcaatcctcccacctcagcctcctgggtatctgggactacaggcgtgtgccaccatgcctggctaactttgtttattatttatttatttatttatttatttatttttgggatgaagtctcactatgttgcccaggctggtctcgaactcctggatcaagcaatcttcccgcctcggcctcccaagatactgggattacaggtgtgagcctctatgcccagcccaactgcttgttttgtttgtgtgtttgtttgtttgttttcagacggagtctcactctgttacccaggctggagtgcagtggcacgatctcgcactgcaacctccacctcccgggttcaagcaattctcctgcctcagtctccctgattactgggattataggcacacagccccatgcttggaaaagagaaatgggaccaaaattgtctacaagtgtgaagtattactgccatgactaatgccacttgctggggccagggacccatgagtggcacatgttttcagagcccgtaatcaagtcacgtggctctccctccaccttctgtccaccatcacttccaagctaaggtctggggagccttacccagtgcattaaaggcaggaagcacatcaaagctgacactttcgttgaggactttggatttcagagagaagctcagcaccctgggagccttccacttgggaggctcaaagctgacttcaagctcctcctccttctccctccaaaaggctttcagctgttcatggatttccttgacgattttgtgccgctcgtttttttgggaggtgtagcttttaagtgagttatggaacacgacgagatcggcatcagagccagtcttcagagctgtgcctttggcggttgatcctccctaaggaagaaaggaaggttgagatccagaatttccttaaccgaggagtcccgtgcccccgtgggctggcaccagttgggctaactgacactgtttccaaggccaagttctgcgttagggttcagtgagggctgagtccaaagcaaagggttttcttttacaaactaatagataatgcagttattaaacaatacagttcccaaggcaattattctcctgccttttatacatgaacaactgatgggctagttacaagttacctgcttctcaggtcaatttcctaaagattttcctaaagacatatttagctttatttggattcctgtaaccaaataaatcgagcggaatgcaataattatggtgaaggtgctcatctgttctttgatgtgtgttttctcctgcaggtctggcgatcattgggtgaatatccataattgaggtacagggttggtaaactttctgcaaaagggccagatagtaggtattttaggctttgtgggctatttatgtctctgccattaaggcttctcccttccctccctcctcctcttcctcctctttctcctccatttagtttctgtagagaaaaatgttttattttatccatgggtattaaatgcctgattacatgggttaaggaggtgaggaaagggtatgttctatttcctgtatgcagatcctcaattcatccctgttccagcccccttcattcatgcaggccacctttgtctttaagaggtgggcttcggcggctcctctcagactgtagccccttccttacaatctctaggtgtcaccttcctctggcctaagcagagaaaccttcaaccaacttcaggaagatggaaagcaatgtcttatctgccgatggctctcttttcttctttgatgtgtcatataccttttatttttcactgactatcatgtgaatggggtttcaggaaggagaggagaaagcacatgctttgacaattctaacactgatcagaaactcagtcctgttttcactccagtgaccttcaatgagacagttcactcattgccctggggctattggtgccatttcccaggcccctcttctctagttgcacagatttgttctggcatcaacgcagaaatttacgcgtacataataacattttcctccttcccttcttgtgaccacggggacacgtttatctggtcgtgtgaccagtaaacagagagaaacatgtcagccccgtggcctttgagccacggacaagaatgacaaaagcctctaaatctctagctcagctgatggggcaagccgggctccagtcactcaaaggagaaggagattctaagctccttagaatctgcagtgggttcaatggtggacccctaaaaatacatgctctgggggcctgtggatgtgcccttatttggaaaaagggtcttcgcagatgtaactgagttaaggacctggagatgagatcattctggatcaggctgggccctaaatcctatgacaagtgttcttagaaaagaagagaagggggaggacacagaagaaaaggtgatgacagaggcagagacgggagtgatgtgtctccaggcccaagagccccaaggacggccaacagctccaagaaaaacaatacagaatcaaagttgtgttgttaatgacctaggcagtctatccacaacccccctgaaaactagtgtcctagttcccttaactcctggcttcccttcctcaagtttctgaaggtagatggatcctggagagctacaatgcccacttacctcccttccaggaatgcccaatattacatcattccaacaagacatgagaaaggccagtgctcacccggacaatctggatcttggctgttgattgtcggaagcagttttctttaaggaatgtacggatgatgttaacagcactgtcaatctgctctaggaagcatttgttgggctggagaaactccttgatgaacttatccagaaggtggcctggggtcgtgaagagtggtgcaggctggggaaggaaggaagaccccaagtgtgagtggcacctgtaagcccacccaaggcttcttttcctgcctgtactgggccccctaccctgcctctcccaactgccctcctgctcgtgggctggcatcttttccgtcttttgtcattgcacaaatacatcccaagaacacacctgagagtttggagtggcacacaagaccccccacagacacaaaaactgtcctagttgcccctccttccccctaggagagatctggatccttgtccagacagatctgtcgtgttcctaactccaaactccttttccatgcccagttggagcatcacttcctaatgacctgtggctttttgctttacctacacctctggtccttccctgtcttcccatttgctgtaggtattggagattgctgatgaccacatccattcctttcttaaggttgtatcagcctgcgttaaacacgccatgtgcgggtgtgttggtttccaaaggctgccataacaagtgaccacaactaggtggcttaaaacaacagaagtttattctctcccagttctggaggccaacagttcaaagtccaggttttggcacagctgtgctccctctgaagcacacgtggttaagtctctagagatgggaggattattctgcattacctggtttggcctgatgttatcacaggggtctttttcctcttaattttaatttttaattgaattaattaatacatttttctccacttttactttaggttcaaggaggtacatgtgtggggttttacatgggtaaattgcatgtcgctgaggcttggtgtatgaatgatcccatcacctaggtagtgagcatagaacccaacaggtagccttccaacccatgattctaacccatgttttttcagaaatagtgtctcgctctgtcacccaagctggggggcagtggtgccattatagctcactgcagtctccaattcctgggctcaagggatcctccagcctcagtctcctgagtagctgggactacaggtttgtgccaccacgcctagctttttttttttttttttttttttttgtagagatgggagtctcactaggttccccaggctggtctcaaactcttggtcttaagcaatcctcccacctcagcctctcaaagtgctgtaattacaggcgtgagccactgtgcttataaggacaagggtacttataagatggaggcaggagggttagagttggagtgtggtggtgttggagttagagttaggtggtgtgatgttggaagtagagagagaggctggaagatgctatgctattggctttgaagatggaggaaggggccatgagccaagaaatttggacaacctcaaggagcttgaaaaggtgaggaagcatatatatgtatatatatatatgtgtatatatatatgtgtatagatgtgtatatatatgtgtatatatgtgtatatatgtatatatgtgtatatatgtatatatgtgtatatatatgtgcatatatgtgtatatatgtatatatgtgtatatatatgtgtatatgtgtgtgtgtatatatatgtatatatatattttttggttggtgcaaaagtaattttgagacagggtcttgttctgtcacccaggctgaatgcagtggcacaatcatggctcactgcaaccttgatctcccttgctcaagtgatcgtcctgcctcagcctcccaactagctgggactacagctaatttatttatttatttttgtagagacggggtattgttatgttgctcaggctggtctcaaactcctgttctcaagtgatcctcccgcctcagcctcccaaagtgttgggattacaggtgtgagccactgtgcctggctcaaattcatgtgttttaagccactaagtttagggcatttttttaaaacagcagtaagaggcaagtaattactgttctatacaaatattgtacttttgctggcaacacagacaagatgggctagctcacctggaggtggggaagggcactcagcttgaaagttgaaggccaaccttggttgttctcagatgttgtaagttggccttatagttgctgaggacggtgcctattgaaggaatattcattgccaacactgccccttccacagggcagaatatttgtggtgtgtgagtgcatatgtgtgcgtggtatgagtgcatgtgtgtgcatgtgtgtgagtgcatgtgtgtgcatggtgtgcatgcatgtgtgtgcatgagtgcatgtgtgcatgtgtgtgagtgcatgtgtgtgcatggtgtgagtacgtgtgtgcatgtgtgtgagtgcatgtatgcatgtgtgtatgcatgtatgtgtgtgcgtgtgtgcgtgtgtgcatggtgtgagtacatgtgtgtgcatgtgtgagtgtgtgtgtgcatgtttgtgtatgcatgtacgtgtgtgtgtgtgtgtgtatgtgtgcatgagcccccaatgtttggaccgccttatgcagtggttcctgggcctaaattttcttcaacaactgcagagacagggatggtctcacagttctcaaaatagaagttgatgggatagcagaacaaaaacagccacagtgagtatcaaaagatggtttaggagatgtttggaactaaatgccacatgtgcttctgggttggaaaagaatgtcctataaaggcccttcttggaatgactgtcgaaatcatcccaatgggctgtattgggacaataatatatgactcctagtctcctgaatttgatcatggcatggaggttattgaagagaatattcttgttctcagagatccctatgaaagcatttaagggtaaagagatgtctggcagtctactctcaaagggctcagtataaacaacaactataacaatgggccaggtgaggtggctcacgcttgtaatcccagagctttgggaggccaggtgggaggatcacttgagcccaggagtttgagaccagcctggccaatgtagcgagttatagccccatctcttaaaaaaagattaaaaacaactgtaacaacaacaataataacgtgtgcacacacaaactgtaacatagcaaatgttgcacatgggtactgcatctatgtgaggggatcataggagtttactgaatcatttttctaactttttaaatgtttcaaagcttcagaataagatgtcaggtcggggggataattttttgaaaaaatctgtctgaagaagccgggaaaattggggtcagagagcaaagaccaggggtccagtgaaagtaggggttagggtgggcacaggggtgactgctcagagcgtcctgatccttctgggtccagttagggaagttccccattcatagactccccaacctctgtgaagtttgctaaactcatttacatcttcatttacatgccagattggtactcagttagccttcaaacttctgtgcaaacggggtatagattccgcctcccataacttgaatataaattaatctgtctgtgaactgtggaatttgattggcctctttggcctcaattaatacagttgtctccagtgcggttcccaggaaagctgagagggctcagtggtctaacctgggaaggttcttcttggatggcttttctctaataagcactgagcatgcaggggagtttgtgttgacagatttacttctccttttggggatgggagggggaaggccagtgcacctgtttcacagctggtgccttaattggttctcttgtttcggccgcacttctgactgttgcccccggcacctgcctgaacggagctcagagcctgtcctggcatccacaggcctgactgccacccccttctctgagcaatgctccgtttcatgtctccacctgctcaccagctttctctcttgcaaaaattaattgagatctcgcatctttgggtacccccctttctctttgttccattttgcacttcacagtcattgccctgatggtgtgtgatgggttgaactgtgtctccctaaaagatgctggggttccaacctacagtatcgatgaatgtgtgttacttggaaatagtgtcttttcaaatgggatctagtgaagattaggtcattatgttgggccctaattcagtatgactgttgttcttagaagaagaggagatgataagacagacatgcacagagggaaggtgatgtgaagacatgtagggagaagggcatgtgacctcagggacagaggctggagtgatgcagccacaagccaaggactgctggcaaccaccagaagctgcaggaagcctggaataattcttccctagggcctgcagagagcttggctctgccaacaccctgattttgaacttgtaatagccagaatggtaagagaataaatttctgtggctttaagccatctgtgttgtggaactttgtaacagcaatacaggaaacgaatatagagtactctcagataagacctagcctgggtgtcaggaagaccttcctgcagcatgaaacaccctgtatttggaaaaccctcttaccagaacattccaagatggtgcaggtaactcattatccaggttgggagaagtcaaccaggtttgagcttcttttttcagccattgccagcatattttatctccactcacattattggttgggtcaactggatccaagattactggcctgtgtattccattagattaaaaaaagtcagttgagctgcttgtgggaggcaaaatctgttttggggaaagaggcctggagtgggaatccggcaacttgaatttggattcctgcagctcctccaagctgctgagggattttgtctacgacatcaagcccctctggccctgggtttgctgctttacagagacattctattaataaaataacaaagtggtctcctcttcctgccccccatcccctttctctcttagctccttccttctataaggggaagtgtctctccagtgtttgtttaggggacaaaatgtgactatggtttggaatgtgaaaagcactggctggacctcccctctttcagacagacccatctgcctccccacccatggtggctgccattcttctggtccagcactggcttgatagggcaaggctgagatctcattccaaagaggtatgcctggcatgcggatgatgaggtacagggatagggtgtgagaagcttggcacctcgctgattggagctggtgcagcaggatgttcctgatggtctcatcttcaaagttgtagttgaccatccaatagatacacagcttctcctggcatttgatcagctccagtacggttctgacgccttcagcaatgtcaaagttgtcttttctgcacccctgttcccaggcatacaccgtaagcagctccagggcatacggagacagcgagggtaaatccttgatttttttctggcactgt

SEQ ID NO: 11625 - DNA, 84 bp, Homo sapiens
gtgagccgagatcgcgccactgcactccagcctgggcaacagagcgagactccgtctcaaaaaaaaaaaaaatagaaaagaaaa

SEQ ID NO: 11626 - DNA, 132 bp, Homo sapiens
gaggctgaggcaggagaatggtgtgaacccaggaggtggagtttgcagtgagctgaaatcgtgccactgcactccagcctgggcgacagagtgagattctctctcaaaaaaaaaaaaaaaaaaaaaaaaaaa

SEQ ID NO: 11627 - DNA, 147 bp, Homo sapiens
ggtcccagctactcgggaggcttaggcaggagaatggcgtgaacccaggaggtggagcttgcagtgagccgagatcgcgccactgcactccagcctgggcgacagagcgagactccatctcaaaaaaaaaaaaaaaaaaaaattgtg

SEQ ID NO: 11628 - DNA, 131 bp, Homo sapiens
ggaggctgaggcaggagaatggcgtgaacccaggaggcggagcttgcagtgagctgagattgcgccactgcactccagcctgggcaacagagcgagactccgtctgaaaaaaaaaaaaacaaaaactggtg

SEQ ID NO: 11629 - DNA, 143 bp, Homo sapiens
gtagtcccagctactggggaggctgaggcaggagaatggcgtgaacctgggaggcggagcttgcagtgagccgagatcgcgccactgcactccagcctgggcgacagagcgagactccgtctcaaaaaaaaaaaaaagaaatg

SEQ ID NO: 11630 - DNA, 98 bp, Homo sapiens
cggagcttgcagtgagccgagatcgcgccactgcactccagcctgggcgacagagcgagactccgtctcaaaaaaaaaaaaaagaaaaccaagttaga

SEQ ID NO: 11631 - DNA, 135 bp, Homo sapiens
agactgagcaggagaatggcgtgaacccgggaggcggagcttgcagtgagcagagattgtgccactgcactccagcctgggtgacagagggagattctgtctcaaaaaaaaaaaaaaaaaaaaaaaaaaagaatc

SEQ ID NO: 11632 - DNA, 141 bp, Homo sapiens
cagctactcgggaggctgaggcaggagaatggcgtgaacctgggaggcagagcttgcagtgagccgagacagcgccactgcactccagcctgggtgaaagagcgagactccgtctcaaaaaaaaaaaaaaaaaaaaaattt

SEQ ID NO: 11633 - DNA, 125 bp, Homo sapiens
ctgaggcaggagaatggcgtgaacccgggaggcggagcttgcagtgagccgagatggcgccactgcagtccagcctgggcgatagagcgagactctgtctcaaaaaaaaaaaaaaaaaaaaaatt

SEQ ID NO: 11634 - DNA, 105 bp, Homo sapiens
ctggaacctgggaggcagagtttgcagtgagccgagatcaggccactgcactccagcctgggcaacagagcaagactctgtctcaaaaaaaaaaaaaaaaaaaag

SEQ ID NO: 11635 - DNA, 175 bp, Homo sapiens
cgggcgtagtggcgggcgcctgtagtcccagctacttgggaggctgaggcaggagaatggcgtgaacccgggaggcggagcttgcagtgagccgagattgcgccactgcactccagcctgggcgacagagcgagactccgtctcaaaaaaaaaaaaaaaaaaaaaaaaaaatcac

SEQ ID NO: 11636 - DNA, 101 bp, Homo sapiens
cagagcttgcagtgagccgagatcgcgccactgcactccagcctgggcgatagagcgagactctgtctcaaaaaaaaaaaaaaaaaaaaaaaaaaaagagt

SEQ ID NO: 11637 - DNA, 159 bp, Homo sapiens
ctgtggtcccagctactcgggaggctgagggaggagaatggcgtgaacccaggaggcagagcttgcagtgagccgagatcgcgccactgcactccagcctgggtgacagagcgagactccgtctcaaaaaaaaaaaaaaagaaaagaaaaagaaaaata

SEQ ID NO: 11638 - DNA, 176 bp, Homo sapiens
cgggtgtggtggagggcacctgtagtcccagctactcgggaggctgaggcaggagaatggcgtgaacccaggaggcggagcttgcagtgagctgagatcgtgccactacactccagcctgggcaacagagcgaaactccgtctcaaaaaaaaaaaaaaaaaaaaaaaaaaagtcca

SEQ ID NO: 11639 - DNA, 189 bp, Homo sapiens
caaaaaaattagcggggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaagaaatgaca

SEQ ID NO: 11640 - DNA, 116 bp, Homo sapiens
agaatggtgtgaacccaggaggcggagcttgcagtgagctgagatcgcgccactgcactccagcctgggcgacagagtgagactctgtctcaaaaagaaaaaaaaaaaaaaaagaa

SEQ ID NO: 11641 - DNA, 162 bp, Homo sapiens
agctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaaaaagaacaaa

SEQ ID NO: 11642 - DNA, 129 bp, Homo sapiens
gaatggcgtaaccgggaggcggagcttgcagtgagccgagatcgcgccactgcactccagcctgggcgacagagcgagactccgtctcaaaaaaaaaaaaaaaaaaaaaaaaaaaaaaaaaaacaaaga

SEQ ID NO: 11643 - DNA, 193 bp, Homo sapiens
aaaaattagccgggcgtggtggcgggcgcctgtagtcccagctactcgagaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaagatcagaaaaaaata

SEQ ID NO: 11644 - DNA, 140 bp, Homo sapiens
ggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaaaagaggggaaaa

SEQ ID NO: 11645 - DNA, 187 bp, Homo sapiens
aaaaatacaaaaaattagccgggcgtcgtggcgggcgcctgtggtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaagggg

SEQ ID NO: 11646 - DNA, 114 bp, Homo sapiens
gaggcaggagaatggcgtgaaccctggaggcagagcttgcagtgagccgagatcgcgccactgcactccagcctgggcgacagagcaagattccgtctcaaaaaaaaaaaaacg

SEQ ID NO: 11647 - DNA, 39 bp, Homo sapiens
gactctgtctcaaacaaaaaaaaaaaaaaaaaaaaggaa

SEQ ID NO: 11648 - DNA, 114 bp, Homo sapiens
cagtagaatggcatgaacccaggaggcagagcttgcagtgagctgaggtcacgccactgcactccagcctgggcaacagagcaagactccgtctcaaaaaaaaaaaaaaaaaaa

SEQ ID NO: 11649 - DNA, 153 bp, Homo sapiens
cccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaagaaagcagtggggcc

SEQ ID NO: 11650 - DNA, 202 bp, Homo sapiens
tactaaaaatacaaaaaattagccgggcgtagtggcgggcgcctgtagtcccagctactcgggaggcttaggcaggagaatggcgtgaacccgggaggcggagcttgcagtgagccgagatcccgccactgcactccagcctgggcgacagagcgagactccatctcaaaaaaaaaaaaaaaaaaaaaaaaaaaaaaagaaa

SEQ ID NO: 11651 - DNA, 275 bp, Homo sapiens
gcctgtaatcccagcactttgggaggctgaggcgggtggatcacgaggtcaggagatcgagatcatcctggctaacatggtgaaaccccgtctctactaaaaatacaaaaaattagctgggcatggtggcgggcacctgtagtcccagctactcgggaggctgaggcaggagaatggtgtgaagctgggaggcggagcttgcagtgagcccagattgtgccactgcactccagcctgggtgacagagcaagactctgactcaaaaaaaaaaaaaa

SEQ ID NO: 11652 - DNA, 111 bp, Homo sapiens
cttgaacccaggaggcagaacctgcagtgagctgagatcgtgccactgcactccagcctgggcaacagagtaagactctgtctttaaaaaaaaaaaaaaaaaaaaaaaaaa

SEQ ID NO: 11653 - DNA, 158 bp, Homo sapiens
gcctgtagtcccagctactcgggaggctgaggcaggagaatggcatgaacccaggaggcggagcttgcagtgagcagagatcgcgccactgcactccagcctgggcaacagagcgagactctgtctcagaaaaaaaaagaaaaaagaaaaaagaaaat

SEQ ID NO: 11654 - DNA, 193 bp, Homo sapiens
cgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaaattgactcctaatcaaaaa

SEQ ID NO: 11655 - DNA, 164 bp, Homo sapiens
gctgggcgtggtggcaagcgcctgtagtcccagctactcaggaggctgaggcaggagaatggcgtgaacccaggaggcggagcttgcagtgagccaagatagtgccattgcactccggcctgggcaacagagtgagactctgtctcaaaaaaaaaaaaaaaaaa

SEQ ID NO: 11656 - DNA, 93 bp, Homo sapiens
gagctggcagtgagccgagatcccgccactgcactccagcctgggcgacagagcgagactccgtctcaaaaaaaaaaaaaaaaaaaaagaaaa

SEQ ID NO: 11657 - DNA, 136 bp, Homo sapiens
ggcaggagaatggcgtgaacccgggaggcggagcttgcagtgagccgagattgtgccactgcactccagcctgggcgacagagtgagactccgtctcaaaaaaaaaaaaaaaaaaaaaaaaaaaaaaaaaaaaaaa

SEQ ID NO: 11658 - DNA, 279 bp, Homo sapiens
cactttgggaggccgaggcgggcggatcacgaggtcaggagatcgagaccattctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaaga

SEQ ID NO: 11659 - DNA, 138 bp, Homo sapiens
cgggaggctgaagcaggagaatggcgtgaacccaggaagcggagcttgcagtgagccgagattgcgccactgcactccagcctgggtgacagagccagactcggtctcaaaaaaaaaaaaaaaaaaaaaaaaaagaaa

SEQ ID NO: 11660 - DNA, 202 bp, Homo sapiens
ctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgagtgacagagcgagactccgtctcaaaaaaaaaaaaaaaaaaaaaggttaatatgtaa

SEQ ID NO: 11661 - DNA, 300 bp, Homo sapiens
gctcacgcctgtaatcccagcactttgggaggccgaggcgggcggatcacgaggtcaggagatcgagaccatcctggctaacacggtgaaaccccatctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaattaa

SEQ ID NO: 11662 - DNA, 150 bp, Homo sapiens
ggcgcctgtagtcccagctactcgggaggctgaggcaggagaatggcgtgaacccgggaggcggagcttgcagtgagctgagatcgcgccactgcactccagcctgggcgacagagcgagactctgtctcaaaaaaaaaaaagaattggc

SEQ ID NO: 11663 - DNA, 322 bp, Homo sapiens
cggccgggcgcggtggctgacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagctttcagtgagccgagatcgcgccactgcactccagcctgggcgacagagcgagactccgtctcaaaaaaaaaaaaaaaaaaaaaaaaaaaaaaaaaaaaattc

SEQ ID NO: 11664 - DNA, 142 bp, Homo sapiens
cccagctactcaggaggctgaggcaggagaatggcgtgaacccgggaggcggagcttgcagtgagccgagatcccgccactgcactccagcctgggcgacagagcgagactccgtctcaaaaaaaaaaaaaaaaaaaatgga

SEQ ID NO: 11665 - DNA, 122 bp, Homo sapiens
cgggaggctgaggcaggagaatggcgtgaacccaggaggcggagcttgcagtgagccgagatcgcgccactgctctccagcctgggcgacagagcaagactctgtctcaaaaaaaaaaaaga

SEQ ID NO: 11666 - DNA, 123 bp, Homo sapiens; identical to SEQ ID NO: 11276

SEQ ID NO: 11667 - DNA, 214 bp, Homo sapiens
ccccgcctctactaaaaatacaaaaaattagccgggcgtggtggcgggcgcctgtggtcccggctactcgggaggctgaggcaggagaatggcgtgaacccgggaggcggagcttgcagtgagccgaggtcgcgccactgcactccagcctgggcgacagagcgagactccgtctcaaaaaaaaaaaaaaaaaaaaaaaaaagattacacaata

SEQ ID NO: 11668 - DNA, 154 bp, Homo sapiens
tgtagtcccagctactcggtaggctgaggcaggagaatggcgtgaacccaggaggccgaggttgcagtgagctgagatagcaccactgcactccagcctgggcgacagagcgagactccgtctcaaaaaaaaaaaaaaaaaaaaaaagggccgc

SEQ ID NO: 11669 - DNA, 1632 bp, Homo sapiens
caataattggaatttttaaaatcaagatgatctgcttatccagtgattgccattagcaatgaagaaagaaatggttttgttgacaactacttatttctctctccatgtgaaagtgtttttttgtttgtttgtttgtttttcaattctgtcatcatcgagacgtggatcccttgctaacaacagttcctggtgactatagaaattaagactccttagaagaaaaatgttattattacaattcaaaaaagaaacaaatgtgctcacctgttggtgggaggacaactgaaatttgcatgtcaactgtaaacatctgaaagataaataagagaggaaagaaagtttatgatacagataacagattgctagtacagagctgctttttcagaacctctcctttattaccagtatttttcccccctttttaaaaaaaaatctaaacaattagatgtcagcattgggtgaaaaacacataacaaaagattctggcttttgctcatcattctgatctccctgctctgcatactgaagccccacttccttttgttgtcctcccagtggaatttcagccactcagaccagtcaggggtgtgttggcagctatcctctttgaatggtagagagtacatttattctttgcacagaaggaacatgaaaatttggtttgaaacctagtaactctcaggctgcatggtctggagacaatagaagtatttcatcccttgaaaccagacgaatcttgagtaatcaggtgaacctgccttgctggctggtggtgcttcactgaagggttggaccagggtgtagaaaggactttggtggttcagatttccactggaaaactgtgacatcctgccatctcagagaagaaagttgcaggagatagccacacgtataggtgattcctgcttatctggctaataatattcttgctaatatttttgaaaagaaattagttttgggccttcacggaagctaacatttaatctcatagggcataaacacgagcgtagggtggaataacagcctaatgttttgaaccccatgaatttgctaatccataggaagttccattaagaaactccctagttcatcattcatagtatttcacctgtagctctaatccccaggcccatgactgcccttctctcttctgagttgtgtgtcagtcttcaacctacggtccttcccgactatggactcatgtacaactctgaatgaaactagcatctttcaaagaagagtctagttttcttcctggtcctgtacccctctgtgtttcgttgtactagagaaatttcttatttattaagaaccttttcggcctggcgcggtggctcatgcctgtgatcccagcacttgggaggccgaggcgggaggatcacgaggtcaggaaatcgagaccatcctggctaatatggtgaaacccgtctccactaaaaatacaaaaaattagcggggcatggtggcaggcacctgtagccccagctactcgggaggctgaggcaggagaatggtgtgaacccaggaggcagagcttgcagtgagccgagatcgtgccactgcactccagcctgggcaacagagcgagactctgtctcaaaaaaaaaaaaaaaaaaaaaaaaagaacctttt

SEQ ID NO: 11670 - DNA, 4802 bp, Homo sapiens
tttaatttcaaacgttaatatattttctattttatattggacatatgcatctgtaacccctcatttgcagcaactatcacatcctcataaaaggggcaaaatttgtaagatgcctcttaaaataaatattcttttttataaaataataaaacttcaaataaatattctttacactaaacaatatgttgaaaaaattagaaaataaaggttgaattttactgtaactgtacaatatacatgaagtccaaagggaaatcagagtcttacaataaaggctttctgtaaggcaaaatacaatctaaaaacatactgattgattcacattcttccgaatgtacaacatattagtataatattttgtgtctgtgccatgtagtatggcacaacttgtttttcacagttgcaaatattattgtatatacaaaaatatagcacattctctctggagaaaacaatggaaaaaagtcatctgctaatttacaagttttgcaagtactattcacaaacaaaaactttgcctaggagtgtctgtgttgctttagcttatgcaatacatgggtcaccaagttctgtatctcatactttgagctccattagctgagttctaacaagcatatcagttaaaacggcacatggacaaaaagcatttcaccgcaaacagcaaagactatcccaactttctattaacagtgccaagattataactgtttagttggttgcatatgtgtattaaaaaaagacagaaaaaatcctcattactgtaatattcctgattaatgatgctatgttggtttttcaaagttcctaggggggacagtgggaactttgcagcaaactgtgtttgagtttttacagcggcaaccaggcctgttaacccggtcataacacccctggcacaatttaaggcaacccttggctggaaggtaacaccataaacaaggcaaaaagagggacatgacacccatggctgaccatcgtgtacaacagtgagactggctgcaagaacatgggttgtcagcacagttgtcctcatcatcattagaacagtgatagaagagacctttcacacagcatacacaagtcccatagtcaatcacgttctgggccgagcaaaggcactgcttgtcgcagatccagtctgatggcagaggccttgggtaggtgcactccttacatttgcacttgccacagtcctcacacctgtaggcgtgcaggcccaaatcttccttgctcagtggcttaagctcacctggcttgagctcagatttgggttgcacccggattatgccatcagcaacaggcccggaggagaaggatgatcctagcagtctctgttcagaggagctgctgctggtacttgtcctcgtactgctccgcgaccctgagctgaccgtgcttatggatctggacagagaggctcgtgcagaagaatggacctgcgagtgctggagcctaggaggctggcggtgctcaggcagaccgtggagtctctcgtgtttgtgctgagtggaggggcgaggagcaggcttgagcccaggtcttgggacgacagtaggcccctctgtgtactcattggtgtttcggatggctctgatctgatccagagacaagacatgtacctgctgggtgagggcgtctctggggtcgggctccccacgctgtctgccaccgtcacggggcgtctgcagcaagggctgcgacccgttgccactctgagctctggcctccatcaggtcttggaagtgtggtcactccagcaggcttagaacacatctgaactcctgaggaagccaagaggaaagaacggttgatactctaagatacttcccactctccacccacctgaattgactcctcacttcccactttccctagagaaacaggatttgaaatggaatggcagtagggaggtattagccatatgatcaacaacgcatgtacccaaaagtaaaaattacggcgggctactgacaattctgtaatcctgtgacgtacaacaatacaaaactgatctttgagtcacttaagtaagaattccttattcaaagaaacatacaatttgtaaggttcaggttcaacgtaaaaatcgcaaggaagtattgctggaatataacactgctaccaatgttttcaaaagttgaaaatcctttcaaaatttgaaataggtttccatttgtcatagtcatttttgccttaagcgttaataatgcaacctagaagattctttcttggttcttaatttttacttttacatcaaacactttaactgtgacgtatacggcattctgtaactttttcaaaccaggtagaatgaatatggcatgcaaaaaagtaaatacccaaattctacaacaatcatgccattttttattaattgtatagtagcacaaagttatagaactaaaagcaaatcaaatcctattaggtgccagaaacacattaaagcaaacttaacaagaagaagacatgaatttattttcaacttctcaacaacttaagaattaactattttacagtctgatagcctagaacaccaccttagattctgcagctaaaaggttgttctccctgctaattgagaacacaaacgaagtgataataaccagaaaagcgttttaaaaattcaaatgtcacatttcgtatctagcattctgtcaaggaattccttaaactgcagtccttcttcaatttcaaaacgatcaccccctttcccaagcctatatgacaataaaaagtataaaacaggcaaaagtggacctttatccgatctccgctctttagaatagaggccacagcgaacaaggcaggtgacaaacgtctcccaattcggagcaaggcagtgctggaaaccggatctcctcacctccaaaagaatggcagaagacaacgctgctctttgctttcacttagtttatcgcctctctgtgccccaacaccgtccccagcaggtgggacacagccgatccccaggggagtttctccaggcggactgacgctgtccatgggccaggctgcccccctgcttacgatccccagactcagacaggcgggggccgcgggcgcctccgaagggtacgtgtcacgaaatgcaggagcacacttcccccgcctccctctccccagctaagatctcccccaactcaagagaactgccttccagccccaaggagccactccgcccccaggcagaggtcacgccgcccactgccaggctttctgcaaagcccctcggacatccggcacaggtttcccaccccgacactgcgagcacgaaagccctgcctgagacacgcagccaggacgcacaagtccaacccacgcacacacagcgactccacgctgcactgaccgaagggggcattgcctgtaatctgcacacgcctatctccttttgggtcgagagaaaaaaaaaagatatcatatttcttaaagtgaaagaaaaatggctttttaaaaaaagggcattttccagggtcccactgctcactccgggcgcgcaggacccagctcccggagctgtaaactttcggtgcagatttgcttgcagtcaaagtagcatctttgaaataaaagggggcttttttgtttttattttttaagtgatttctgccgatccgatccctggcctccttcttcaaagctggactccctacctccgcccctcttctctttcccagtcccccctcccctttgaaagtgctttgaaacccccattaagaacagtgtgtgatcagactgaggattaggggaaaagaacttcagctctagggtggggcaaacggacacagaaactgctttgtaaaaaacacacaagaatccaaattaaaacacagcaacaacaacaacaaaaggaaataaaaaattgcctattttgccacctactttcaggtaatggaaaatgatcgcgaccgcttgatgactttcttcctgcgctgggtcagcccgagcttccaaaaataaaataagtgtgacccaggctgaccacgaagaacggaagagagagagctgcacttccgaaccgcagagacccggcgccaggcagggcgacgctcccacccgctccgggctagactgtccacacggagcagaggcgggcactccctccacccggcaccctgcctttttctcaccctggaagtctcctgcccccgaggcgggcaacctgtgtcccccagccccaccagcgccccgcctagggacagcctctccctggactttgccttccaccaagaggaagaacaggttagaaatgcgggcgcctgcaaaggcaacctggaaaatacaaagtgtttttctctccctctcccgctctcagcgccgaattcgcggccagtgcacggctgggagcagacttcaggctagctgtcctccgtcccaaccccctagagcgcgggcgcgcggggtcgcctgtcggggacactgcacggggtgcatacagaagtccccgcagaggcaggccgagcccaagccccgggcgaggcaggtccgcggggagcgccccggatcctcgcgaagaccctgcgggatttgagaaagggaggctcggggagagacggacccaactcctggtccggctgcacctactccatgttgcccacaacgcgccggccgcggcgccaggaggggaagagccaaacgtgcctcaccgtgatcgcggctttgcaccaacccctctcccttggattctcttctttctgcgatgtgcaaataaatccagtctcgatgcaaacttttttcctttctttccaacctctgctttagaccaacttccgagcaatcggcgggagaaaaaaagagaattc

SEQ ID NO: 11671 - DNA, 160 bp, Homo sapiens
gcctgcctgcctctgtagactccacctctgggggcagggcatagccaaacaaaaggcagcagaaacctctgcagacttaaatgtccctgtctgacagctttgaagagagtagtggttctcccagcatgcagctggagatttgagaacggacagactgcct

SEQ ID NO: 11672 - DNA, 2705 bp, Homo sapiens
ttttcctccaaacagatttattgaatacagcaaaattctatatacaaagtgacctggacctgctgcttcaaaacatgatcctttcttactaatatcttgatagtcggtccatagagcattagaaagcaattgactcttaaataaacagaaaagtgcctaatgcacattaaatgaatggcctaactactggaactttagtagttctataaggtaattaacataggtaggatccagttcctatgacaggctgctgaagaacagatatgagcatcaagaggccattttgtgcactgccaccgtgatgccatcgtgtttctggatcataatgttcctgaaatgcaggaagaaaatattcagtaaaacgtaatcagtgggacttcactgcaagattaaagatgttgtttgctttaggatacaatatttaaaataatgtaattgtttctacgtataaaagcaatatttaaacataacaaaacatttgggaaatacataaacatatagcatgtgaacacgaaatgaatccttaatcctactacacacagacaaccactgttaatatttccctggttctttgtttcggttttttaggcactgtcttgctatgttgcccaagctggcctcaaactcctgggctcaagcaatcctgcttcagccacctcagtagctggaactacaaaaaaaaggctttactggtctttgttttctttgcatgtatatgatacagtcatgtgctgcataacaatgcttcagtcaacagtggaccctacatatgatggtggtcccgtaagattataatggaactgaaaaattcctattgcctagtgaccttttaaccgtcccagcatcacatagcacaacacactactcacatgtttgtggtaatgctggtgtaaacaaattgtgctgccagtcataaaaagtatagcacatacaattatgtacagtacgtaacgcttgataataataaatgactatgctatggtttatgtatttactatactttttttcttttttttgagacggagtcttgctctgttgcccaggctggagggcagtggcgtgatctcagctcactgcaacctctgcctcccgggttcaagcaattctcctgcctcagcctcctgagtagctaggattacaggtgcctgccaccatgcctaatttttgtatttttagtagagacagggtttcaccatgttggttaggctgtctcacactccttacctcaagtgatctgcccgccttggcctcccaaagtgctgggattacaagtgtgagccaccatgccgggcctactttttatcattattttagagtatactactcctacttattaagacaaggttaactataaaacagcctcagacaggtcctttaggaggtattccagaaggtatcatcattacaggagatgacaactccatgcatgttactgccctggatgaccttccagtgggagaagatgtggagatagaagccagtgatattgatgatcctgaccctgtgcaggcctaggctaatgtgtgtttcttctttgcttttaacaaaaaagtctaaaaagtaaaaaagtttaaaaaaagaatttttgtacagctgtacaactgttttaagtgttattataaagtcaaaaagttttattgactcactcagagcaacttccagtgttgtaagctccattatggtaagtgccctattcagatataccttttaaaaaatttccctataccatacttttactgtatcttctctacgtttagatacataaataccactgttataactgcctacattatttaggctacaaatctttgtagtctaagagcaatacagcctaggtgtgtaatagggtgtaccacctaggtttaagtacactctatgatgttcatacaacaaaactgcctgacacatttctcagaacatatccccattgttaagcaatgcatgactgtatgttttttctttttacaaggctgtgatagtagcagttgtatatatatactttttttcacatattattctgaggaccatcacttggaatatctttagtaattttattgctttagaagtaatttttggctgggtgcagtgactcattcctgtaatcccagcactttgggaggctgaggcgggcaaattactggagcccaggagttcgagaccagcctgggaaacatggtgaaacctcatctctacaaaaaaatacaaaaattagctgggtgtggtagtgtacacctgtagtctcagctacaactcgggaggctgagttgggtgaatcgcttgagcccggtggggttgaagtcacagtgacccatgatcacaccactgtactccagcctggtgccagagcaacaccctgcctcaaaaagaaaaaaaaaaaaagtaatttttattctctgattagttttcctttgtgctatttgttactttctttttgttggtaaactgatagcttctgccaattcttattcttcatttaaatagcattgtggcctgagagcacattagctttagggatcaacttgtctgttcctgtgattcaaaagattaagaacttttcccaaagtagtctgaataaggaatcactgatgaacacagggccggcccccgccaattttaccaggaatttttctgaacaaaaaggaaaggatctgctgaaatctactcacccattatctgattctagacacaccacaggaatatcagtg

SEQ ID NO: 11673 - DNA, 368 bp, Homo sapiens
ggcatgggcaaggacttcatgtctaaaacgccaaaagcaatggcaacaaaagacaaaattgacaaatgggatctaattaaactaaagagcttctgcacagcaaaagagtctaccatcagagtgaacaggcaacctatacaatgggagaaaaattttgcaatctactcatctgacaaagggctaatatccagaatctacagtgaactcaaacaaatttacaagaaaaaaacaaacaaccccatcaaaaagtgggcaaagtatatgaacagacacttctcaaaagaagacatttatgcagctaaaagacacatgaaaaaatgcccatcatcactggccatcagagaaatgcaaatcaaaaccacaatgag

SEQ ID NO: 11674 - DNA, 2925 bp, Homo sapiens
ctcccgagtagctgggactacaggcgcccgccaccacgcctggctaattttttgtatttttagtagagacggggtttcaccgcgttagccaggatggtcttgatctcctgacctcgtgatccgcccgtctcggcctcccaaagtcctgggattacaggcgtgagccaccgcgcccggctgagatgggtattattaagaaattaagatgtggattaccagggtaagtcatatttcaatgtgcaacctctgcaagtccacagggtgtgatatggacattaaggagatctatggacgaatagcgtatgataccttgacaagttgacaaaatgtaaaatagttgaatggccatagaaaaaaaccagctttttagccccataggccgagggattcaggagggctggctacgggcattttggaatggaagatgttgtaccaacaaatcaagcttaggttcctggcaatttgcccacatataatatgtgaaagttcagatgtgaaataaatctgcggctaatagtaagaacctagccacaggagttaaaacttacggttctgggaccagatggactgccttctaatcttagtcttactacattttagcggtaaaaccttcagcaagttatttagcctccagcatctcagttttctcatctgtaaaatggtgataatgctactcttacattgggttgtagtaggataaaaggagaaaacgtatgtaaaggatttagtagaaacttattaaaattaagcaattattatttctcaattctaagattctaacctgcaaaaggcataaggcagctgctgagaacagggtgagaagatagggattcggtcaggaaaagtcttgtttccctgttgctgttggtggttttgtttgctcatttgtgtgttttttttattaatcattttcacttgtgtttattgacaagcttaatcaataatgccattgacatttagtaaaagtaaatttccttaagtgatctcccaggtagcaatgtttattcattatgtgtggagtagagataggaattattttattgctgcaaatattttattattggtttttcaagttttaaaagtaattttaattttttaatttttgtgagtatatagtaagtgcacatatttatggggtacatgagatattttgatacaggcatatgatgtgtaataatcacatcagggtaaacagggtaagcatcacctcaagcatttgtccttttttgtattacaaagaatctaattatactcttttagttatttttaaatgtacaataaattattgttgactatagttttgccactgcaaacaatagaaggcttcctgatacagcctcctagtcattggagttctatggcagaattcctaaagtttttaagtttcatgagatggctaaattttggtaaatatgatactttctttgaacagatgctacagaggccaatataaaggagtgtaacagagtgacacctgtgatcagtatctctccaactacaaagagtgtcccttaaatttcttctgtgtggttcctctttttttttttttttttttttgagacgaagtctcgctctgtcgcccaggctggagtgcagtggcgcgaacttggctcgctgcaagctccgcctcccgggttcactccattctcctgcctcaccctctcaagtagctgggactacaggtgcctgccaccactcccggctaatttttttttgcatttttagtgagagatggggtttcactgtgttagccaggatggtctccatctcctgacctcatgatccagccgccttggcctcccaaagtgctcggattacaggcgtgagccaccgcgctcggcctgtgtggctcctcttaagtaatactctgcttcgtccatataagcagaggtcagaactggctaagaatttctttatgtgtgtttatcctgatgttttcctactgtcacttttcttttcttatggattagcattgagggaatggtcagatggtgcctgcgtgagtctgattgaaacattttagcggcggggtgcgggggttgatggcatgtgcaatagtttaggatatttgagttagtggcagaatgtagacatgagggtgagtagagagtgcgtagcagagcaagcaattcaggaatctatgttggttaattacttttgttttgtggacattttattctacctgaaaagattatctaggaactacagaaattaatgacgtgtagtggaaactttgcacagtgtaagtgttatccatttacttctcttagtttccaatacaatgactctcctggtagctgtcatacatgataaatataatttcgttaataaaattatattttatataattgcgtactttaaacaagtgatcaatataactcagttataaatgtacagtaacaaagatcaatggataataaatacttctgcgttcattttcatggatacattctatttttgtttgtctcacaagcagtaatcagactatgaatcatgatatagctccataaacacttactttatagcaattcactgatatatgctccaccaaaaaaaattaagagacggatacaagcaatttaaagcttctgtgtgtgtgtgcatgcaaccgatgtgtatggcttttttttttttttttttttttgacacagagtgtcgctctgtcgcccaggctggagtgcagtggcgtgatctccgctcactgcaagctccgcctgcctggttcacgccattctcctgccttagcctcccaagtagctgggacttcaggcgcctgacaccacgcctggctaattttttgtatttttagtagagacggggtttcaccgtgttatccaggatggtctccatctcctgacctcgtgatccacctgcctccgcctcccaaagtgctgggattacaggcttgagcctcctcgcccggcc

SEQ ID NO: 11675 - DNA, 212 bp, Homo sapiens
tatagagaaagaaataagggggcccaggggaccagcgttcagcatatggaggatcctgccagcctctgagttcccttagtatttattgatcatttttgggtgtttctcagagagggggatgtggcagggtcataggataatagtggagagaaggtcagcagataaacacgtgaacaaaggtctctgcatcatagacaaggtaaagaattaag

SEQ ID NO: 11676 - DNA, 4704 bp, Homo sapiens
tattattatactttaagtttcagggtacatgtgcacaatgtgcaggtttgttacacatgtatacatgtgccatgttggtgtgctgcacccatcaactcgtcatttagcattagatatatctcctaatgctatccctccccactccccctaccccacaacagtccccggtgtgtgatgttccccttcctgtgtccatgtgttctcattgttcaattctcatctatgagtgagaacatgtgctgtttggttttttgtccttgcaatagtttgctgagaatgatggtttccagcttcatccatgtccctacaaaggacatgaactcatccttttttatggctgcatagtattccatggtgtatatgtgccacattttcttaatccagtctatcattgttggacatttcggttggttccaagtctctgctattgtgaatagtgccgcaataaacatacatgtgcatgtgtctttatagcagcatgatttacaatcctttgggtatatacccagtaatgggatggctgggtcaaatggtatttctagttctagatccctgaggaatcgccacaccgacttccacaatggttgaactagtttacagtcccaccaacagtgtaaaagtgttcctatttctccacatcctctcagcacctgttgtttcctgactttttaatgatctccattctaactgttgtgagatggtatctcattgtggttttgatttgcatttctgatgatggccagtgatgatgagcattttttcatgtgttttttggctgcataaatgtcttcttctgagaagtatctgttcatatcctttgcccactttttgatggggttgtttgtttttttcttgtaaatttgtttgagttcattgtagattctggatattagccctttgtcagatgagtaggttgcaaaaactttctcccattctgtaggttgcctgttcactctgatggtggtttcttttgctgtgcagaagctcttcagtttaattagatcccatttgtcaattttggcttttgttgccattgcttttggtgttttagacatgaagttcttacccatgcctatgtcctgaatggtattgcctaggttttcttctagggtttttatggttttaggtctaacatgtaagtctttaatccatcttgaattaatttttgtataaggtgtaaggaagggatccagtttcagctttctacatatggctagcaggttttcccagcaccatttattaaatagggaatcctttccccattgcttgtttttgtcaggtttgtcaaagatcagatagttgtagatatgtgacattatttctgagggctctgttctgttccattggtctatatctctgttttggtaccagtaccatgctgttttggttaccatagccttgtagtatagtttgaagtcaggtagtgtgatgcctccagctttgttcttttggcttaggattgacttggcaatgtgggctcttttttggttccatatgaactttaaagtagttttttccaattctgtgaagaaagtcattggtagcttgatgggaatggcactgaatctttaaatgaccttgggcagtatggccattttcacgatattgattcttcctacccatgagcatggaatgttcttccatttgtttgtatccccttttatttcattgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgagatgatggggttttctagatatacaatcatgtcatctgcaaacagggacaatttgacttcttcttttcgtaattgaatgccctttatttccttctcctgcttgattgccctggccagaacttccacactatgttgaataggagtggtgagagagggcatccctgtcttgtgccagttttcaaagggaatgcttccagtttttgcccattcagtatgatattggctgtgggtttgtcatagctagctcttattattttgagatacatcacatcaatacctaatttattgagagtttttagcatgaagcattgttgaattttgtcaaaggctttttctgcatccattgagataatcatgtggtttttgtctttggttctgtttatatgctggattacgtttattgattttcgtatgttgaaccagccttgcatcccagggaggaagcccactagatcatggtggataaactttttgatgtgctgctgtatttggtttgccagtattttattgaggatttttgcatcaatgttcatcaaggatattggtctaaaattctcttttttggttgtgtctctgccaggctttggtatcaggatgattctggccacataaaatgagttagggaggattccctctttttctattgattggaatagtttcagaaggaatggtaccagctcctccttgtacctctggtagaattcggctgtgaatccatctgttcctggactttttttggttggtaagctattgattatttcctcaatttcagtgcctgttattggtatattcagagattcaacttcttcctggtttagtcttgggaggatgtatgtgtcaaggaatttatccatttcttctagattttgtagtttatttgcatagaggtgtttatagtattctctgatggtagtttgtatttctgtgggatcggtggtgatatcccctttatcattttttattgcgtctatttgattcttctctcttttcttctttattagtcttgctgtctatcaattttgttgatcttttcaaaaaaccagctcctgaattcattaattttttgaagggttttttgtgtctctatttccttcagttcttctctgatcttagttatttcttgccttctgctagcttttgaatgtgtttgctcttgcttctctagttcttttaattgtgatgttagggtgtcaattttagatctttcctgctttctcttttgggcatttagtgctataaatttccctctacacactgctttgaatgtgtcccagagattctggtatgttgtctttgttctcattggtttcaaagaacacctttatttctgccttcatttcgttatgtacccagcagtcattcaggagcaggttgttcagtttccatgtagttgagtggttttgagtgagtttcttaatcctgagttctagtttgattgcactgtggtctgagagacagtttgttataatttctgttctttgacatttgctgaggagtgctttacttccaactatgtcaattttggaataggtgtggtgtggtgctgaaaagaatgtatattctgttgatttggggtggagagttctgtagatgtctattagttccgcttggtttagagctgagttcaattcctgggtatccttgttaactttctgtcttgttgatctgtctaatgttgacagtggggtgttaaagtctctgattattattgtgtaggagtctaagtctctttgtagttcactaaggacttgctttatgaatctgggtgctcctgtattgggtgcatatatatttaggacagtttgcttttcttgttgaattgatccctttaccattatgtaatggccttctttgtctcttttgatctttgttggtttaaagtctgttttatcagagactaggattgcaatccctgcctttttctgttttccatttgcttggtagatcttcctccatccctttattttgagcctatgtgtgtgtctgcacgtgagatgggtttcctgaatacagcacactgatgggtcttgactctttatccaatttgccagtctgtgtcttttaattggagcatttagcctatttacattcaaagttagtattgttatatgtgaatttgatcctgtcattattatgtcagttggttattttgctcattagttgatgcagtttcttcctagcctcgatggtctttacaatttggcatgtttttgcagtggctggtactggttgttcctttccatgtttagtgcttcttccttcaggagctcttttaggacaggcctggtggtgacaaaatctctcagcatttgcttgtctgtaaagtattttatttctccttcacttatgaagcttagtttggctggatatgaaattctgggttgaaaattcttttctttaagaatgttgaatattgccccccactctcttctggcttgtagagtttctgccaagagatcagctgttagtctgatgtgcttccctttgtgggtaacccgacctttctctctggctgcccttaacattttttccttcatttcaactttggtgaatctggcaattatgtgtcttggagttgctcttctcgaggattatctctgtggtgttctctgtatttcctgaatttgaatgttggcctgccttgctagattggggaagttctcctggataatatcctgcagagtgttttccaacttggttccattctccccgtcactttcaggtacaccaaacagacgtaggtttggtcttttcacatagtcccatatttcttggaggctttgtttctttttattcttttttctct

SEQ ID NO: 11677 - DNA, 1090 bp, Homo sapiens
gaatgtaatttattttttttaattatactttaagttttagagtacatgtgcacaacgtgcaggtttgttacatatgtatacatgtgccatgttggtgtgctgcacccattaactcgtcatttagcattaggtatatctcctaatgctatctgtgccccctcccccaaccgcacaacaggccccggtgtgtgatgttccccttcctgtgtccatgtgttctcattgttcaattcccacctatgagtgagaacatgtggtgtttggttttttgtccttgtgatagtttgctgagaatgatggtttccagcttcatccatgtccctacaaaggacatgaactcatcattttttatggctgcatagtattccatggtgtatatgtgccacattttcttaatccagtctatcattgttggacatttgggttggttctaagtctttgctattgtgaatagtgccacaataaacatacgtgtgcatgtgtctttatagcagcatgatttatagtcctttgggtatatacccagtaatgggatggctgggtcaagtggtatttctagttctagatccctgaggaatcgccacactgacttccacaatggttgaactagtttacagtcccaccaacagtgtaaaagtgttcccatttctccatatcctctccagcacctgttgtttcctgactttttagtgattgccattctaactggtgtgagatggtatctcattgtggttttgatttgcatttctctgatggccagtgatgatgagcattttttcacgtgtcttttggctgcataaatgtcttcttttgagaagtgtctgttcatatcctttgcccactttttgatggggttgtttgtttttttcttgtaaatttgtttgagttcattttagattgtggatattagccttttgtcagatgagtagattgcaaaaattttctcccattctgtaggttgcctgttcactctgatggtagtttcttttgctgtgcagaagctctttagattaattagatcccatttgtcaattttggcttctgttgcccttgcttttggtgttttagacatgaagtccttgcccgtgcc

SEQ ID NO: 11678 - DNA, 654 bp, Homo sapiens
gctttatgccagtgctacccttctccagtaaaacaactaattgatggttgagatgattgttttatttgatgaaaaatgatacttttatatcaaaaagattcttactagttttttatagaaaccccttaaaacatcaaagttttatagtgtacataaaagatgtgtttgtccacatactaacctcgcaaataaatgtataaagtaaaacaacaaagtagttttattagatgtgcctttgtcatcatgcaacaagttagttcagttggttgtttatttaattacattgtgctcaggttctatttgtgtgtgtgtgtgtgtgtgtgcgcgtgtgttacctttattggtctttaggactgctgtgtgtcagcattatcccattttacaggttatgccacggaggcagaaacaagctctcatcagtttgattgtgagttattggcttgaggattattatgactcatgatattttagtgtcctcagtaacaataactttttaaattgctcagaattttatttaccacatgttgaaatagcatgatttttaaaagtactcagtccttctatttgacagaatagaataatttcatcagtaatttgatgatcaaacacccttttaaggatttcatttcctcatcacttcaaggaaagaaaaaa

SEQ ID NO: 11679 - DNA, 19776 bp, Homo sapiens
gtgagggatattcgccctggagctgcctttgagcccacatatatttacagactcctgacagttaacaagtcaagcctgtctgaaaaggtttgagacttctctgttgtcactagtatcaagtgttgccttttgttccagtgtttgtgtggtaactgttgcttattgatatttgccctctgtctccagcgctataagtagatgtaggtttataagagtccattgcttggatgatatggtgcaccaagcactgctctcagtactttacatatattaacttagttgactctgaataaagtatgattatggtctccttgttacggttaagagaagtgaagccactgtctgaggtcaggtagctaatgtacatggcagaacccagctttcaagtcagttctcttaaccactgcactatatgccactggggtagaatggagtgcactgggcctggaatgatggcagtattcagaagagcttatgtcttcatcatacttacaggctttagtagctatttgatgtacttgattcctttacctaatttttttttaatcacatactttgttactaaaggcatgagaccaaggggccagggagcccttataaaaggccctggggctgttgagagtgacttgggccgcccttagcaccgttaactggagcatttctttcctcccagattgagtttgtgatgaatcagtacaagcagttgaaatgatgcttagggaaatgtattcagagagaaaaatagttgagaaaatgccatttaagtcaagtttacttgaagcttcattgctttgaagaagagtgaatgtcgagggcatcgttgcaggataccaccaggggtagcatagggtcttaagctttttaaatgcttataatgcagcttttggtattggcttggaatttgcacttcccaagtaatgggaacatggtgttagggatgcagaaatggaatgaagtgcgccctctgccctcagtgagggaatgagttaatgaatagtcaacaagagaagcacaaagatacagagatgccttagaacccagaggggcccacctagcacaggtggaggcaaaataaagtgggtgctcaggaacccctcttggatcgtgcacagagataatgctatgaacaaaagcatcttctaaaggttacattaataggggatgtgttgggctccccaagaccaccctgaggttgggtgattcactggaagaactcagaaaatgcagaagctggtatacccgtggctatggttgctgacagcaaaagcatgcggagcagagtcaggaagggaaaggacaggtgaggcagggcctaaaggaaacttccagactcctctcccagtggggccacaaggctacgcgtaactactccagcaccagactgtgaccacacgtgaaatgctgccaaccagggaaggtcattacagactccgtgtccagagtttttactgagggctggtcccataggtaccatctgcctggcttgaaccaaaagtccaaactcccaaaacaaaagcaaagtgttcagcagaaagcacattgcttgcgcaaacggtttaggcagaatcccgtatcagttattggaccgatgggaacctttctgaaatccaaattcccagacaccagccaaggggcaaccttgcaagcaggcctttccaaggagagccacccaggcctgctatgaaaagtcttcagcacactttggctgtgccagtttttgcccttttctgcacacgtgcagagcatgcactcacgtgaacagctgctgtccacgtctactatctggagagggcaagtaaactttgcagtttacctagatgcttcaaacagaacaatttgcagggccttggaataggcagttgtgctgtgaagaatgaaatatgaactgatgataagtaacagaatcaaacactcgtgatgtgggattattaaactcttgggtgactcgtctgtgaatgattttgctgatgtatgtgtaacacagctaacgctctaaatcagtggagtttttccacatgtagtttgagttctttcccatgtagttgtccatcatcaaagacagacagaagcagacatagggctgcttagctcattgctcgagtggtgacccttgcagttgaacagtgaactggccctagacatctagttcttcgtcttctattttgtttacccaagacagaaacttttttttaaataacttttttgtgataaaggtaatgtggccaggtgtggtggctcatgcctgtaatcccagcactttgggaagccaaggcaggcaggtcacctgaggtcaggagtttgagaccagcctggccgacatggtgaaaccccgtctctactaaaaatacaaagattagccaggcatggtggcacacacctggagtcccagctactcgggaggctgaggcaggagaatcgcttgaacccgggagctggaggttgcactgagctgagattgcaccactgcactccagcctgggtgacggaatgagactttgtctcaaaaaaaaaaaaaagtatatttattgaagaaaatttcaaaaatacagaaagtataaataataaaaatccccattagtccacccatttagagatatgtgtttagtcagtttctccttttcctcctactcttgggatttcagctatgcaagggaaacccatgtcatcatgtcattgtttggaaatactttacatcttccatttcagaggaggcatggttggactttgcaagtactgcatgtcctgcaggcctttgacagtgatcagttcacagtaacgtgattatatttgaccttttcagggtcgacaagaagatgctgaggaatacttaggcttcattctaaatggacttcatgaggaaatgttgaacctaaagaagcttctctcaccaagtaatgaaagtaggttatggtccacttgccgcagagttgtgcaagagttcgctgtaaacaggtgttgcatactcatatgttatgttgcttccctgcccctcagtcgttttcctttcaaatagcatttattccctacgataacttacaccatcgagaaggttatatttaggtaaattacagtttatcccgaacctctgccattttcctttaacttttaattaggaaaatgatcaagcctataaaaaagctgaaagaatcgtttgatgaatacctttataattgccgagtgtacagttttaaacatattttctgatgctatacacacactgtgtatatatatatatgtcttatctgtccatccatatatacatacatacgcatacattttccctgaatgattcaaagttaagttgcagctaacagtttagttcatctcaggtgctaaagcatctcctgcgtaaccacagtcccttatctaactgagaaaaacaactgtaatgacacggtaataccgactttgcagagcatcttcaaatttcgccagttgtcccagggatgtcatttctaggagtttatgtaaacaaggatccagtggtggtgcacctgttgcgattggttgccgtggatcaagtggcattgcaatgggttgcagtggatccagtggcattgcgcctgttgtgattggttgccgtggatccagtgacgttgcacctgttgcgattggttgccgtggatccagtgacgttgtgcctgttgggattggttgccatggatccagtgacgttgcacctgttgcgattggttgccgtggatccagtgacattgtgcctgttgcgattggccgtggatccagtgacgttgctcctgttgcgattggttgccgtggctcctaatgtagaccacaccctgatttcatttttaaaactgcaatcgacagatctgtgccttttttttttttgctgttcttgtcgtaaatagtagtgtaagcagatgctctccttttcagaacttacgatttccaacggccccaaaaaccactcggtcaatgaagaagagcaggaagaacaaggtgaaggaagcgaggatgaatgggaacaagtgggcccccggaacaagacttccgtcacccgccaggcggattttgttcagactccaatcaccggcatttttggtggacacatcaggtttgtgcttttctggaataacttaatatttgccttttctagggttttgccatgttggtgaagggggaaggtgtgaggcttgttttgagacttcttggacgtaatggtttgcatcttgctcccctgcctgctcttctcttgcacttcctgatgcttcccttgtcagcccccgtggcttattctctccctgctggcgcatgtctgcaggggacagggagctcctcccttctactctgtcaagttcagctgctcactgctagggagtaagagaaaagccagctaattggccatacgcggtggttcatgcctgtaatcccaggactttgggaggccaaggcgggtggatcacctgaggttagaagttcgagatcaacctgatcaacatggtgaaaccccgtctctactaaaaatacaaaaatcaaccaggtgtggtgacaggcacctgtaatcccagctattagggaggctgaggcaggagaatcgcttgaacccaggaggcagaggttgcagtggcccagatagcgccattgcactccagcatgggtgacagagtgagactctgtctcaagaaaaaaaaaagaaaaagatacaggagaatgtcatcatgacttaggggtaggcaaaggtttcataagataggtcataaacaataaccacgagagagagagaaaaaaaaatatatatatatatattagacttcatctgcatttaaaacttgcaacataaaaccacctccgggaggcagaggttgcagtgagccaagattacaccactgcactccagcctgggtgacagagcaagactgtcttcaaaaaaaaaaaccagctaaccaaaccatgtgttttggtaagagaagacagtgtatctggaggaattttatttatgttaataaattgtgtatatttaaagtatacacagatgttatgaaatagagatagtaaaatagttgctacagtgaagcagataaacatattccccatcacagttacccttgtgtgtgtgtgtgtgcacatggcaagagcagctgcagttttactcatttcacaaaagtcccaaatacagtgcactatgagtagctcttgtccgatgttccacatcagatctctagacctgttcgcctgtgtggctgcccttggtgtccttcgaccgacatcttccattcccactcgccacccctaggaaccactcttttccctatctctgtagtttcgtcttttttttttttttaataaagattccatgtataagtgagaccatgcaatatttttctttctgtgtctgacttctttaacttagtataatgttccccaggttcattcctgttgtggcaaatggcagggtctttattacagctgaatagtgttcccttgtctatatatacacaccacagtttctttatccattggcccatccacagacagttgtttccctgtcttggctgttgtgaactgattggaagcaggtgaggtagaaagtgaagagagtgtgaagggaggtcttttttacacagacagacccgtgactgggctggagtccctgggcacctggctgtgtgccagttcccttaagcagctttttgctcattcacaaagtccttcggaaaggtttttctttatttacctgagagcttttcagtaccactgtgatgtggaattcagcaaaacttgtaccatctccaagaaggtttacccatcgaaagtactgaagaggcctcattggagcctaatttcctttctgaggccttgcggcataacccccaggctggtatttcagtgacactcttagtctgttgttgtcccaaatgctgcgtacctgaaagaaagagcaccccttttgaggcatcaagacttgattcagtctcagttctgagactgaatcaacaactttcaacaggtgaataataagaacctcagaaacctgcgctgacgccctcagaagctggtttcccgtcctctgtggaagtggatttagaagccagttgagcagccatgtgaccttgaacaagtcacttctgtgttctgcactgtgagctctattccactggcccctttctattctggtgctctgtggagtgtccacggcagctgggtggtcagttgtcacctgggaaacacccagccctgaccactgtctgtggttccttgggacacgtcgtgttgggagggagacgctgaggtccaggttggcgcgcagcagcgagggaaggctgtgccctttgctccttcagcccagcagcctggtttaggattgtgagaacaccccctcgggatgggagagaaagatgaatggacagctcaaatggaggcatcgggaacatggtttttgtgcagaggccgggtatcagaatttcaaggccacagagggtcagcatactcaaagatcccaaatttgtctaagagtaaccagtggaaaataccagcgtccatttggaggacttgctggctcagattgaacagctctgtcacagctgctagccacatcctctgaggggtctctgtgttgaaattggttgttgatgtttctttttgaaaaacggtaaagcaaagatagggaattcttacaacgtaggaacttcttttcagccattgttaagcatgattctttattcacaccaattgaaagatttacttctaaaactcagcctcttcagatgtttttcagtttccccaggaagacttccccgcctttcttccccggtgccacctttgctaaaacacaggaccactgaatcaagagggcttcttgattctccaccagctctcatgagcggtttccccactactgtatccctctccagaaccaggggaactgttgtcactgaagtcttcaaactgtaaaggagcatggagatgcgtaattaaaccctggacagaaaagcttttagcgagctcttcaccgcatctgttctggaaagcctgagtacctgtccacacccattttattccgttgagaaactaggtcaccgagactgcagaaatagaagcccttgttgaacccctggaatgtttccttgctgaggctaaatgagagatgggccgaacacacaatttttactcagaaaaacttagaaaaaggaaaaaaaaaatgaaatgaaaaaccagctaagaaaacaaggtcaaattggcgcccttcttggaagggtggcagccttttttcctggaatgttaacttgttttttattctacacaccctactccccttcttctttttgtaagacatctttataggaggaaaatgccattaaaaatcctctatttaccttgggatttcctctattttattagaacaggctatgatacttggagaaaatggaaagcagcagcgttttgaggccatggcagggtggctgcctttatgaaccggtgcagtaaataacagtgtggagaggaagtgaaagaatttggaaaatgaaatatgttttcttccagagcactggcgttgggaacatttatcaactggtagatttagttgttagaaatactaaggaggtgctattcagcagaattattatttttttttttaattttttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagatcagggattggtgatgactcttaacgagcatgctgccttcaagcatctgtttaacaaagcacatcttcagcagaattatttttaaattcagtatatttttggcttttctctgtggtcttttgaaagtgatattgaataatcttattttcagtgtttattcccttggttaatcttaagggaaagtagcaaggagtggtctcttaatttttttgtttttgctttcaattcttaggtctgtggtttaccagcagagttcaaaagaatctgccactttgcagccatttttcacgttgcagttggatatccagtcagacaagatacgcacagtccaggatgcactggagagcttggtggcaagagaatctgtccaaggttataccacaaaaaccaaacaagaggtatgttcacacttgattttgaacctttctactaaggtgctctggtttggtggaaagaacacaaaattaggaatgaggggaaatgggtttgagttatgcctcttaaatcagttgcttaaccattttgtactgaaagtttttatggttttacaatgaaatggttgaaacgtgatcccaagggcctcttttagctctaaatcatattacacaaggtaatgatctccttttggattgtttatcttgagctacatttaattttctggcaatctaatgatgatatcacaacatcaatactacctctgacagaggccaaatagcttatttatgttcatgataccgtagggtacaactgtcattagattagttaggatgtcagagagattccagacacatctgttttgcatttgattgtagatcttccaggtcattgtaaatataatatagtcattgtaaatataatatagtcattgttctgatgcttgttactctttgatttgatctggaaaaggtaagattcttgagtctttcagtcttcatgaatttaagagtatcacattatagcttggtggagtccttgtcaactcagttgggcgagacggatagcattctgccctgtgagagcttattagttcctggctgtccagatgtgccagcttatggctattttgtactctgcagcagagagtgtcttctctgttatatatcttaggttgtggcagtgaattcctaaaaatgcactggggagatgaatgcaggctgataattatggacggtccatagcattcctgcaaagcgatatttgaataatgggcagtggatggcagctacaaggtaaaataaggtgccccaacgtagaagacctgtcatcacattgcatgactgggatggatctatccttggcttatcttgtgtgctctgagtcaaaaagagcaaagtaggacatagggacccttagcaccttcggggtgtcctgctgtggactggttcacccaggctctggggggatcagtagaagttatgcctaatcttctaccgtatttgcagacttgcatctcatgggtgattttgtttaaaaaatagaagcagtaggagccagaggcagaaacttggtagttgacttcagtgaatgagctaagaagagtctggcggtggacctcgtggaagagagagagggaaaaagtggtatttgtgttggggaggttggttgggtggttcagttgtgcattggctgtgggtgactgtcggcttggctcacttctgtggcagctgcaactccagagatagctccctggccctggctgctggtgcactctgcttatgctgtttcttgagccagctatgggagtctttggccacccatgctgttggggaggtggtcagcctttccatgggctgcctagggaagacccttttgtgatgtgtctgtttttctcttttgcttctgctgcaattacagtttgactttgctggggtgggctggtaggggtggcggtgtgggggcaggggttgaggcgcaggtagttgttagcctgttgttagacggtagtgaagaaagaatggtttatcctaaatagcaggtttggatgaaggcttccagaaagaaggcgggccaggtgtggtggctcacgcccttagtcccagcactttgggaggctgaggcaggaggattgcctgagcccaacagttggaggctgcagtgagctatgatcacgccactgcactccagcctgtgcgatagtgaaaccgtgtctctaaaacataagaagaaataaaaataaaggaaagctggcattttggtggactccggaagataaaaaggatgctgccagccgttctgggtgcgtggttgtggtggtgtgttaccagatgaggccaggaccactttcaacagcagatgtttcaggaagatttgggacagcttgtatggaagtatctataaggagcaaattacatattttcttgaatgtgtttttttttaagtttttaaaatgccacctttaactttattatgttttagatcagaagtatttttctgtgggaacatgtgaaggttttggggaaaataggattatatgaaatatttgctatatagaaaatgtctgcctttgttgagtgattagaaattaagcctcagttggctgggcgaggtggctcacacctgtaatcccagcactttgggaggccaaggcgggtggatcacgaggtcaggagatcgagaccatcctggctaacacggtgaaaccccgtctctactaaaaatacaaaaagttagccgggcatggtggcaggcgcctgtaatcccagctactcaggaggctgaggcaggagaatggcgtgaacctgggaggcggagcttgcagtgagccgagatagcgccactgcagtccggcctgggcgacagagcgagactccgtcccaaaaaaaaaaaaaaaaaatctccagtggctcatgcctgtaatcccagcattttcggaggctgaggcaggcggatcacaaagtcaagagatcgagaccatcctggccaacatgttgaaaccccatctctactaaaaatacaaaaattaactgggcatggtggtgtgcacatgtagtcccagcctctcaggaggctgaatcacttgaaccctggaggtggaggttgcagtgagctgagatcgcaccactgcactccagcctcgatgacagagcgagactgtctcaaaaaaaaaaaaaaaagtgttatccaaatgaatatgggaagcatcaaagactttgtaagtacagagaatgataaagggattgttatttgtaaagatgcatcttagtgacaaaaaacctggctttatttaaaagcagcattcatcagacctgtgaaagtacttcaggaacagattacattgataaaactcatgattagaataaatagctttaaaggttatttaaaacatctaattggcctggaatcccagcacggtgggagactgaggcgagcaggttgcttaagtctaggagttcaagaccagctgggctcatggctgtagtcccagctacttgggaggctgaggtgggagaatcacctgagcccaggaagtcaaggctgcagtgagtcctcatcatgccactgcactccagcatgggcaaccagagtgagatcctgtcttaaaaaaacaaacaaacaaaaaaacccacctaatcctactggtatcagttttatcaatactatcagagttattttaaaatgggtcaatactaggcctagcgtggtggctcacgcctgtaatctcagcactttgggaggctgaggcaggtggatcacctgaggtcaggagttcaagaccagcctggccaacatggtgaaaccccttctttactaaaaatacaaaattagccagatgtggtggtgggagcctgtaatcccagctactcaggaggctgaggcaggagaatcgtttgaacccgggagacggatgttgcagtgagcgcagatcgtaccactgtactccagcctgggcgacagagtgagaactccctccccccaaaaaaggcgggggagtcagtacataaataaggtggtactaagttagctttttaatttttatgctaatttgtcagtaatgccacagagtaaagttcttaactttgagtttacgactggacttcagggacccaagaggctctctgcagttgtgcttatgggaacgtatgcatttttcttcttcttttttctttttttctgagacaagatctcgctgtgttgcccaggctggggtacagtggcgcgaacttagctcactgcaacgtctacctcctgggttcaagggattctcttgcctctgccacccaagtagctggggttacaggcgcccaccaccacgcctggctaattttgtatttttagtagagacgggatttcaccatgttggccaggctggtctcaaactcttgacctcaggtgatccgcctgtctcagcctcccaaagtgctgggattaatgggcatgagccactgcatctgggtatgtgcattttcttaagaggagcattggtagatctcagagcttctgtggggcaggaaaagccatgaagtcctgccacaggactcttgggcctcacctctcagaggacgtctttgagcggaaggtggatgtggtgttagctgttgcaagtaagacagggacggtgtgtcctggtgtgctttgtgtcttaggttgagataagtcgaagagtgactctggaaaaactccctcctgtcctcgtgctgcacctgaaacgattcgtttatgagaagactggtgggtgccagaagcttatcaaaaatattgaatatcctgtggacttggaaattagtaaaggtaatgcatacataaggtcgggagtgttcgtggtgacacactcctgcacatcagaagctcaaccctgtagcatttctttatgatgtcaagagtgaggacattctcttgctggacgtggacttgttttaagtttcttgacttgtaatagaccttaatactaaaattctcatgaaaatggcctgttgaaaatagaggcaaaaataactaaactctataatcttactagattagaaaaatagcagcttttgtctatcaaaaagaacatcacttttctgtgaatatttcagggatgaatggtgcagtttgccttccaccgagtattaacagctgtgttgactagcccagttaagtggtttttagtgaagtaagaatgatttctcataggcagtgagagtcccttctaacctctagttgtggtggcgcacaaataagacgtggcacttaccagcctcaagtctctgtcaggtcacgggctcggcactttttgaaagcaattttaaagagccccaggttaaaggcatcttgctaaaagcacagcttcaagaagacttttcttgaaagctttagaatttgtgaaaacgtatagtacaacactgaggcttgattgggactgtgattagctagagaggattctcagaatatcgaggtgtttgggaagcagaaaaggggacactgggcctcactcctgggtcctgcagaggaacaaacctgaaccgagagtcctcttctctccgtcccctggcacagcaaccccacctcatacctccttccatatagatgacccaggaactgtgggcatggctggcttctagccggctccctgtctaccctaggggcgccctataccttcccgtgaagactcagacactgtctctcccaggcctgcacacaagagctgtgctttctgctgacgggcttggctgctgtgccgggtttagtgtccgttgctcctctcacacttctagctgctttatcactcatcagccgattgctttttaatcccatttgaggaccagcaagaggaagaaagatgccagtgagaatcatgtaacagatcctcctccccattttattctatccatcgggaaacctggaatgccggctaagtcaaagaaggcatcctcggcctctgctcctgcatcttcactcgcctccagatcagctgtctgagctgacttggatgttttgctacagtgattttatttttatatcttttcttgcttgctgtatttttatatcagctgccacctccaatacattatcaaaatatgacataaatgggggctgggcgcagtggctcacacctgtaatcccagcactttgggaggccgaggcaggcagatcacctgaggtcaggagttcgagaccagcctgaccaacgtggtgaaaccccaactcttctaaaaacacaaaaattagcctagcatggtggtgggtgcctgtaatcctagctacttgggaggctgaggcaggagaatcgcttgaacctgggaagcagaggttgctgagatcatgccactgcactccagcctgggcaacagagcaagactccatctcaaaaaaataaataaataacataaatgggggacaagaggacctcacttgggtcatgggtcagaagtacagatggctgcctcgaacagcatgcctccgacggactcttgtgtcggtgtaagtggtacttctgcgcacagtaagagcagggagttcccgcctcgtagcagctggtagactggttcctatttggagaaatcatgttactgttctgtaactgaagttttgttttgttttttttttgtttgtttgtttttttcttcgagacagagtcttgctctgtcacccaggctggagtgcagtggcgcgatctcggctcgctgcaacctctgcctcccgggttcaagtgattctcctgcctcagcctcccgagtagctgagactacagccgcgtgccaccacgcccgggtaattttttgtatttttaatagagacgtggtttcactgtattagccaggatggtctcgatctcctgacctcgtgatcgcccgtctcagcctcccaaagtgctgggattacaggcgtgagccaccgtgcctggcctgtaattgaagttttatgatctgacgcatatgtaaaattttaattcttgccttggatttttcacaactgtttttgtttttaagtcagcagcttttttcttttccattttgtagagcacctgtttttaaggggcctcccacaggagcatcacagcctcggccgttgctcctgtttctttagtgagctggctgcacattttgtgtcctattacgtcacatggctcatttccttcatgagtcaatttttgtgcaactgaagggatagagtgttgttttgttcctggtctgacaggcagtttacttgctggggagaatgttgttagccattttctgctgctgttaccctgaacctttctaaaagtgcttcaagccattgatattttgttttccagaactgctttctccaggggttaaaaataagaattttaaatgccaccgaacctatcggctgtttgcaggtgagtaaatttgtacgacattacttcttcattaaaacactgatgaaggggtttacagctgggcacagatttgctgcaacttagcatagcgaccagatgctgtactcaggtatccctgtggccttgtgagtcggggagtcacgtgagagtttcacctgaaactctgcgtagatgacggattatcatcttggccctgaggacagataacagaagaccttgctcaaagcgaacatttctgtctttgagtcagaggagggagtttcaggctcccaggctggctgtttgagaatgtgacctctcccggctgtgcttgtggcacctgtgggtgacagtgctgtggagtttccacgacacctggtcacccagccaggttgggtgagcgcgcccccagccggtgatccctgcgtcctcccccacaggtattgttagggctgcttgagagggtgggcccgattacacaagctcctcggctgccaggccctcagtcagtcatgagaaatctcccaacagggtgaatggcaccccctgttccctcatgggtggaccttgagacctcttctgtctcctggcttaggctccctgcagtatcattttttctgccacatcatcttccctttcctttctgccttcccttttatccttctttctcttttatagcgtcatcttttatgcctgagtctttacctctttggattgttgctgtttgccgcacttttgtttgcttcccaggctgtttttactacatgtttctagcttctgtgtcttccctcctctggtgtggcctttggtgaacctgtttgtatcgtaacataacactgccatttattgaccttcacacatgtattgaacctcttcccaagatattctttcatttccttacatgtgtcctaggagatgggaggtgggatccctgttttataaaagaataaaccagaactcaaggaagaaaactcaccactctggcctgcagtggcagagcagggcttcaagctcctgtccacctcagctcacgcccgatgttttaggaagtttggcgagtgggtgagggcccagggatgggggcccaggggtgagggcctagcggtgggggcccaggggtgagggcccagggtgagggcccagtgggtgaggcccagagccacactgcaaggtgccaggcttccctctcttcctctcactattcattgttccttttgactctcttctccccccgatcacaattcctcctcaacttgctgggcctcacatgggacggccatgggcaccacgcgcttgtgggtgtctccagccctgtctggaatggaaggtctgagtcctcagactctgcagccagccattatcctgcctggctccttggagtgtggcacccaggtcccagtgggtggccagcagtttctctgccttctccctgcacctcttcccctggaggctcttgcgggggacatcactgggcaggggcaggggctagggattgctcctctcctggtcagggccccagtgtgagcacacacacccctccccgactctgcaacctgcctcgccccgggacctgggcctgggttgctctcccctgccctcctgaatcctcatcccctaacccattatttttttgagatagagttttgctctgtcgcccaggctggagtgcagtggcacagtctccattcactgcaacctctgcctcccaggttcaagtgattcttgtgcctcagccccccgagtagctgggattacagctgtgcaccaccacatccagctaatttttgtattttgaatagagacgaggtttcgcccttttggccaggctggaagcctattctgatcttggaaatgaggtcaccggactggttagaattacctgtaaagtgagcaaaggaacactttttaagaactgctgtgattgtggggcctgggagaagcaatctcgcgcacaagcttttcaggcggttctcagcgctcctgtcaggggggcttgcaggtgtgagtgacacacggctcagcccagggtagttaactgggctgctgcttatgaaactagaatggtgacatgcagtcccccttgacattttagaatggagatgtcttgtgggaaagacaagttagtaaaacccccaggccctgcaaattctactgatggtcgctttgaagcaaaactcttagcccagtcagttaggtctgtgaggtgaagatctaggacagaagtctcaaagtgaacttgggatccaggggacatgctgctgtcatgggtgcttcctgccctttcacaagatggctgtgacttgtgcagcacaggatgaagctatgcccttggattggctgtgtccctggctctccgaagtacgggccccacagtcttgctgtccctatgctgttcagtctcctccggggtccctgcacagaggatttctttgtgcagagcccaggagtctgactggtggcctcagtcataagcactgtcctctagccagccaaggtccctggcccagagaggactgaggcctcctgctgtcatttagcccctccacgtgacaactgcgactagaacctggtgatgtttggtcttgttttagtgctgaaattccctaccagccaagtcttgcatctctcctggttccttttcttttgtgccactgatggtgggcgcagcttagcaggctgccctgtcattccccgcggaatgctgccggacagccgccttcccgaggctggtgtctgctgctggccaggcagacctgtgcccctctgctccatagaagtggaggatgtgttctgtggctctcttaatgttttcatgacatcttctacagattttttgttttaggcctttgactaaggcttcttggttataggattttttttttaagtaaataactgtgtgtgtgtgtgtgtgtgtgtgtgtgtgtgtgtgtgtgtgtgtgttttgttctgttaaaacatagaaaaatgggtaattttttttaaaggcaaatgcgtaactaccagcaccatctccgcagtgccccaccacagctccacgctcaagcaaccgtggttagcagtcccagggtccctcctgccatgtgggccggcaccgggagattgtgtcccgtgtctttaggatagatgggccacagaaggcctaaggaccttgttttctcatttaatataccataagcatattcccgcatcaccattcttaatctattccacgaaaaaataaattgtgttattttaatataatttactcatcagtcatttcttctagtggctattgaggttttccgttttttcactgttataaatgacatcataatctctgtccaagattcagataatctcttcaggacagtctagaagtagagtcagccacatccaagggcatgagccaggtctgtaggcctgtacagctgatggctgtgtaggagtgtctgtgtgaggcgtgggacattttaaatatgtggttaatatgcgtacatgcacacatgtacctatctgacttacccttaccttgcagttatagaaaagtttttattatggattgcttgcgtgtttgagttgaaatagcattggtttgtgtgatgacatctctctgtcccacctgctttggagaggggttttacacataggatgcatccctggagggaagtcggcggagacctgtaatgattcgtgtgcagtgctgttctcactctgctgcctgctgggctctcttccagtggtctaccatcacggcaacagtgcgacgggcggccattacactacagacgtcttccagatcggtctgaatggctggctgcgcatcgatgaccagacagtcaaggtgatcaaccagtaccaggtggtgaaaccaactgctgaacgcacagcctacctcctgtattaccgccgagtggacctgctgtaaaccctgtgtgcgctgtgtgtgcgcccagtgcccgcttcgtaggacaccacctcacactcacttcccgcctctctttagtggctctttagagagaaactctttctccctttgcaaaaatgggctagaatgaaaaggagatgccttggggttcgtgcacaacacagcttctgttgactctaacttccaaatcaaaatcatttggttgaaacagactgttgcttgattttagaaaatacacaaaaacccatatttctgaaataatgctgattcctgagataagaaagtggatttgatccccagtctcattgcttagtagaataaatcctgcaccagcaacaacacttgtaaatttgtgaaaatgaattttatctttccttaaaaaagaaattttttaatccatcacacttttcttccctaccctttagtttttgataaatgataaaaatgagccagttatcaaagaagaactagttcttacttcaaaagaaaaataaacataaaaaataagttgctggttcctaacaggaaaaattttaataattgtactgagagaaactgcttacgtacacattgcagatcaaatatttggagttaaaatgttagtctacatagatgggtgattgtaactttattgccattaaaagatttcaaattgcattcatgcttctgtgtacacataatgaaaaatgggcaaataatgaagatctctccttcagtctgctctgtttaattctgctgtctgctcttctctaatgctgcgtccctaattgtacacagtttagtgatatctaggagtataaagttgtcgcccatcaataaaaatcacaaagttggtttaaa

SEQ ID NO: 11680 - DNA, 642 bp, Homo sapiens
aggaaatgtggtgtgtctgttcatttcctttacgcttccttactgccactacatagacactgcaggcattggttgcttgcccgccgatgtaccacctgatgaagttcattcctctgtattccaaagtgcaaaggccttgtacgtcaacacccatgatagacagcttgtaagtaaggtggtgaaagatgtgttaagtggtggggtttttcccgtctgataattagaattgaaatagtttagtaaagctcttgatttcctgcaaatgagtcctataattctgtctttttttaaaaatagactgttggcgattttatatggaagttaaccagaaatggaattggagcattgatgatctgtgttctttagattcagtagaaaatattttagcgtttaccagcatatatcacttgaaatagaccaaaaatgcatatagaagagacttgagttcactagctgttacagcattggttacctaaaatctactatactcgtatagctgatattctacttagccatcaaagctctttagtaaaagtatatattgtttaaaactgcactatttaacattttttccccatgtttagtgttcggctaatgaatgagttcactaatatgccagtacctccaaaaccccgacaaggt

SEQ ID NO: 11681 - DNA, 5493 bp, Homo sapiens
cctggagagggaggtaaacagccctgcaggcctcggggcaccgttgctgggcggcgccggcggcatgtgcgagggcccgtcccgcatctcggggcccatccccccagacccgacgctctgtcctgacaactacaggcggccgacctcgggtgagtccgggggcttggcggtggtgcgaggctcaggggtcggccctggctccacctctgagccccggactccgcccggctccgccccacagctcaagggcgcctcgagggaaacgcgctgaagctggacttgctgacttccgaccgggccctggacaccaccgctccccgtggcccctgcatcggtcccggtgccggagagatcctggagcgcggccagcgcggcgtcggggacgtgctgttgcaactcgaggggatctccctaggtcctggggcctctctcaagagtaagtcccaggaatggaagaagggacagagaggcagtgcggggtggaaagagatcaaaagcagctgctctttccaccctgacgtgggcccaggctttgcatctcttgagtctcagtttccccaactataaaagggggagaaatatgctaccttctcgaaggaggtgaactgaatgaggtagttcccacgaagccctagctctgctttatgcatttgttacccattaaatttgtttgttgagtgcctactgtgtgccaggccatatagatgctagaacacagggctgaagataagcatgagccatcactgagtcaaggtgggatacaaagatcaagagatgaatgtcatatatgagatgatctatggtgtacttcaatggtgtacttcactataataatggaggaaatcacctgggcgcagtggctcactcctggaatcccagcactttgggaggcccaggcgggcagatcacttgagtccaggagttgaagaccagcctggccaacatggtgaaaccccatctctacaaaaaatacaaaaatcaggctggcatggtggagtgtgtctgtaatcccagctactcggcaggctgaggtagccggggaggttgaggctacagtgagctatgatcatgccactgtactccagcctgggtgacagagtgagaccctgtctcaaataataataataataataataatggagaaaatcatcctgtgatacttactacatgaggaagggaacacggtgatgagggagagtgtgtgtagggtctaaggtagttggagaggtcagggagctctttctgtaggaggcagggggcaggcctgtgtgtgaactagtggaagttggactgtgtgggccccatgtagggcagaacctgggggcatcttttctccagggaaggaccctaaggaccatgagaaggagaacctgaggcggatcagggagattcagaagcgcttcagagaacaggagcgcagccgggagcagggccagcccaggcccctgaaagctctgtggcgctcacccaagtacgacaaggtggagtcccgggtcaaggcccagctccaggtacctgcttcagggagccagaagtattatccattttgttggccaacaggcaactgtaccctgatctgagttctggggtgggagggaagtcacagaggtaacagaggactaagagaccctggctctgctgcagggcgaggctggggggcttctcagaagtagtgatggtggggctgatcctgagggcaagtagcaattagtcaaagggacagcagaagagaacattcccaaaagatggaacctcacagaccacagggcacgcagcagtggagatgctaggtacagttcactgtgaggaaagaagggcgtgaagttaggccaagaagtcagctggacccacgtcaggggccacaaaagccacttttcagcccttatttctgaggacagtgggaagggcaggggtatggtggggggctctgtctcagggactcagtaggaggagcaggagtgagaggaaaggcaaggtcacacaaatgtgttgtagctgaagcatctgtggggttcccagggggtgggagtgtgtccaggaagcagatggaaattcaggcctggatctcaggagtgagacctaggagttattgacgatcaggttgaggacaacgagaccaaggaattgaccgcctggatttgaggacttggaggccagctgttaggagccttgcagggctagagccaggaagcttggctaggaaggaggaaagagagtggtagctgggccagtactgaggtggaaggagagatggtttgttgttttcttaaaaatctgacatactcacacatttgtgtgctgatgaggacaagtgtcccttgaagagggaagagggcccgagggacatggatgcaaaggtcagaagggccaagatggccaggtcttgcagcttgagccccagacctcagcctgcctgctctctctgctgtgccctgccctccaggagcctggccctgcctctgggacagagtctgcccacttcctgcgggcgcactcccgctgcggccctggcctcccaccaccccatgtatctagtccccagccaaccccaccaggtcccgaagctaaggtgagaggatgtatgggggctagatggtggttgggcagggctcctggtgtggggggggtgttcagggacacaacataatgctgtctgcccccacccacgcttgctgtgtcctgcaggagccaggcctgggggtggacttcattcgtcacaatgcacgagctgccaagagagccccccggaggcattcctgctcactgcaggtcctggcacaagtgctagagcagcagcggcaggcccaggagcactacaatgccacgcagaagggccatgtgccacattagtaggtctcactgcccgacactcagggtgaaggacacctgtggagggtgggaaccaacctctgccctcgggtcatcaactctgagcctgtgtacccacagcttgttggagcgcagggacctgtggcggcgggaggccgaggcccgcaagcagagccagccggaccctgccatgcccccaggccacacgcgcatgcctgagaaccagcggctggaaacactgaccaagctgctccagagtgagtacctgggcagggaggctggaggggggccccactggggaccgggcacccctgcccaacactcactgttctcactgttcccgggccccctgtaggccagagccagctgctgcgtgagctggtactgctgcctgctggggcagactcactgagagcccagagccaccgtgctgagctggaccggaagctggtgcaggtagaggaggccatcaagatcttttctcggcccaaagtcttcgtgaagatggacgactgagcccctttgggggacagtggcaaggagctccatgctgaggatcgccacatggctgcaaaggacagggttggacccaatcccagagcagaggtctgaagacaggagcaggggggtggccagtgtccctagagcactcttcccagtcaccagtggctgcagaagggccaccctagccttttaactgctttgtcaaaattaaacattttgtacacaggatttgtttccataagagcttttcttaccctaaaaatgccaagcctggtggccctcctgctgcttgattgcaggaagttctccccaatgtcactcctgccttagtccagagcagaaggcaagctggtgagaccagggaggaggctggaactgggacacacaaggaccatgactgtatttgtagaaaacctttaatgttccccaggctgagggagccctgtgagccagctaaaaacccccactgtgaagtccctgccatgtcccagcagtgtggagtggcatggggcttcatcctgactgtcagaggctgaagccactaccatctcctcgaatgcgactcccccagccagaactggcctgctcctggtcatccagggagggcagagagctgcgggtaccaggatgtcggcagccagggtgcaggtcccagcacgggggcccctgagacagcccattggaactgggaggctggcggttctcaatgaccaggtcactgctgtcatcgtcactatcaggctcagcaggcccaggccctgcagagggaggacctgtcaaacgcccagatgcccctcgcaccacgttattgcgctggttggcgggcttgacagtgacaatgaggttatggctgttggcaaccatcatgtccgtcacttggtccaaggtcttcccggctacttcaatgccattgacctcgaggatctcatcactgaccgccagcagccctgtactctcagccagacccccacgtaccaggcgggagatgaagattcctggaacccgctccaggccctggggagccacacgcacgctcatgccatctcggatgtagaagcccagggggcggtctgaaccatgcttgtgcagccgcacccgtcggtgggtctcaggcagtaggtccacgtctatgactgaggaaacctggcggaaatcttggggcaggctgattagcaagggtggccgggtgcgcaggggtgccactggccgcagcaagagccctttcttgcgccgctgcagagagttggaggcaaaagccaggccgctggagtcagcttctgctgcagaagaggggggatgttgagatcagagacctgctccccgacttgggctgtttacagggggcactgtagctatttcctaccacttagaggtcaagccaagggcagggactgcagagggtgacgcttgggtaccctgggcatggactaacccttgtagacctgccccacagacaccttaccccacagaggctgcccactgtacccctcctcaccccgcttctgcaccagtaggcgcagtggcgggggcccgctggccagggcccggtgcaggctgtcgtcgttggtgaggggcagcaggtcgccatgagcatccgtatagccaagtagcacgtccaggcccgggatctggtgcaccgcccgcagcaaccgcgagaactcctggaagccgctcaccgaagcgcgaggcagcgcgaagcgtcggaactcggcgtcaaactggaagtcggggttgggggagaggaggagtcaggacagcctgcgcccctttctcaccgcaggctggcaggaatgggaaagatgcggctgccgcttttgcggcagccttaagcccagacctcagctccagtaccagggacgctgtccaaggtcttcttaccgccctccaggtactcaggccacagagagctggagaccagcagtggaggaaggaagacggatgggggaaggcgagcagaaaagcagaatgggacttggaggatagagggaagaggtggcggggaccaaggagctgggaaggggagaaagagggaattgggagcgcctagggccgaggccggaggagcccttactttgctcttcacctcgacgatgctatcgggactgcgcgccggagtcctctgcggccgggccatggcggggccgggcgggccggggacgg

SEQ ID NO: 11682 - DNA, 5717 bp, Homo sapiens
gtcgggtggcagcggctggcggcaaaacctctcgagtgagcccctgcccgagtgccgcgggggagaggccgcgagcgggaccgagaagtgggctgggagcagaggtcgcggaggtggcgagcgaggccggggcccaggcggggaccggcaggggcccgggagtggcgggcacgccagggtcagggtgccgggcgagggagggggcccggggttggggaagggggcccggggagggaggtaaacagccctgcaggcctcggggcaccgttgctgggcggcgccggcggcatgtgcgagggcccgtcccgcatctcggggcccatccccccagacccgacgctctgtcctgacaactacaggcggccgacctcgggtgagtccgggggcttggcggtggtgcgaggctcaggggtcggccctggctccacctctgagccccggactccgcccggctccgccccacagctcaagggcgcctcgagggaaacgcgctgaagctggacttgctgacttccgaccgggcctggacaccaccgctccccgtggcccctgcatcggtcccggtgccggagagatcctggagcgcggccagcgcggcgtcggggacgtgctgttgcaactcgaggggatctccctaggtcctggggcctctctcaagagtaagtcccaggaatggaagaagggacagagaggcagtgcggggtggaaagagatcaaaagcagctgctctttccaccctgacgtgggcccaggctttgcatctcttgagtctcagtttccccaactataaaagggggagaaatatgctaccttctcgaaggaggtgaactgaatgaggtagttcccacgaagccctagctctgctttatgcatttgttacccattaaatttgtttgttgagtgcctactgtgtgccaggccatatagatgctagaacacagggctgaagataagcatgagccatcactgagtcaaggtgggatacaaagatcaagagatgaatgtcatatatgagatgatctatggtgtacttcaatggtgtacttcactataataatggaggaaatcacctgggcgcagtggctcactcctggaatcccagcactttgggaggcccaggcgggcagatcacttgagtccaggagttgaagaccagcctggccaacatggtgaaaccccatctctacaaaaaatacaaaaatcaggctggcatggtggagtgtgtctgtaatcccagctactcggcaggctgaggtagccggggaggttgaggctacagtgagctatgatcatgccactgtactccagcctgggtgacagagtgagaccctgtctcaaataataataataataataataatggagaaaatcatcctgtgatacttactacatgaggaagggaacacggtgatgagggagagtgtgtgtagggtctaaggtagttggagaggtcagggagctctttctgtaggaggcagggggcaggcctgtgtgtgaactagtggaagttggactgtgtgggccccatgtagggcagaacctgggggcatcttttctccagggaaggaccctaaggaccatgagaaggagaacctgaggcggatcagggagattcagaagcgcttcagagaacaggagcgcagccgggagcagggccagcccaggcccctgaaagctctgtggcgctcacccaagtacgacaaggtggagtcccgggtcaaggcccagctccaggtacctgcttcagggagccagaagtattatccattttgttggccaacaggcaactgtaccctgatctgagttctggggtgggagggaagtcacagaggtaacagaggactaagagaccctggctctgctgcagggcgaggctggggggcttctcagaagtagtgatggtggggctgatcctgagggcaagtagcaattagtcaaagggacagcagaagagaacattcccaaaagatggaacctcacagaccacagggcacgcagcagtggagatgctaggtacagttcactgtgaggaaagaagggcgtgaagttaggccaagaagtcagctggacccacgtcaggggccacaaaagccacttttcagcccttatttctgaggacagtgggaagggcaggggtatggtggggggctctgtctcagggactcagtaggaggagcaggagtgagaggaaaggcaaggtcacacaaatgtgttgtagctgaagcatctgtggggttcccagggggtgggagtgtgtccaggaagcagatggaaattcaggcctggatctcaggagtgagacctaggagttattgacgatcaggttgaggacaacgagaccaaggaattgaccgcctggatttgaggacttggaggccagctgttaggagccttgcagggctagagccaggaagcttggctaggaaggaggaaagagagtggtagctgggccagtactgaggtggaaggagagatggtttgttgttttcttaaaaatctgacatactcacacatttgtgtgctgatgaggacaagtgtcccttgaagagggaagagggcccgagggacatggatgcaaaggtcagaagggccaagatggccagggtcttgcagcttgagccccagacctcagcctgcctgctctctctgctgtgccctgccctccaggagcctggccctgcctctgggacagagtctgcccacttcctgcgggcgcactcccgctgcggccctggcctcccaccaccccatgtatctagtccccagccaaccccaccaggtcccgaagctaaggtgagaggatgtatgggggctagatggtggttgggcagggctcctggtgtggggggggtgttcagggacacaacataatgctgtctgcccccacccacgcttgctgtgtcctgcaggagccaggcctgggggtggacttcattcgtcacaatgcacgagctgccaagagagccccccggaggcattcctgctcactgcaggtcctggcacaagtgctagagcagcagcggcaggcccaggagcactacaatgccacgcagaagggccatgtgccacattagtaggtctcactgcccgacactcagggtgaaggacacctgtggagggtgggaaccaacctctgccctcgggtcatcaactctgagcctgtgtacccacagcttgttggagcgcagggacctgtggcggcgggaggccgaggcccgcaagcagagccagccggaccctgccatgcccccaggccacacgcgcatgcctgagaaccagcggctggaaacactgaccaagctgctccagagtgagtacctgggcagggaggctggaggggggccccactggggaccgggcacccctgcccaacactcactgttctcactgttcccgggccccctgtaggccagagccagctgctgcgtgagctggtactgctgcctgctggggcagactcactgagagcccagagccaccgtgctgagctggaccggaagctggtgcaggtagaggaggccatcaagatcttttctcggcccaaagtcttcgtgaagatggacgactgagcccctttgggggacagtggcaaggagctccatgctgaggatcgccacatggctgcaaaggacagggttggacccaatcccagagcagaggtctgaagacaggagcaggggggtggccagtgtccctagagcactcttcccagtcaccagtggctgcagaagggccaccctagccttttaactgctttgtcaaaattaaacattttgtacacaggatttgtttccataagagcttttcttaccctaaaaatgccaagcctggtggccctcctgctgcttgattgcaggaagttctccccaatgtcactcctgccttagtccagagcagaaggcaagctggtgagaccagggaggaggctggaactgggacacacaaggaccatgactgtatttgtagaaaacctttaatgttccccaggctgagggagccctgtgagccagctaaaaacccccactgtgaagtccctgccatgtcccagcagtgtggagtggcatggggcttcatcctgactgtcagaggctgaagccactaccatctcctcgaatgcgactcccccagccagaactggcctgctcctggtcatccagggagggcagagagctgcgggtaccaggatgtcggcagccagggtgcaggtcccagcacgggggcccctgagacagcccattggaactgggaggctggcggttctcaatgaccaggtcactgctgtcatcgtcactatcaggctcagcaggcccaggccctgcagagggaggacctgtcaaacgcccagatgcccctcgcaccacgttattgcgctggttggcgggcttgacagtgacaatgaggttatggctgttggcaaccatcatgtccgtcacttggtccaaggtcttcccggctacttcaatgccattgacctcgaggatctcatcactgaccgccagcagccctgtactctcagccagacccccacgtaccaggcgggagatgaagattcctggaacccgctccaggccctggggagccacacgcacgctcatgccatctcggatgtagaagcccagggggcggtctgaaccatgcttgtgcagccgcacccgtcggtgggtctcaggcagtaggtccacgtctatgactgaggaaacctggcggaaatcttggggcaggctgattagcaagggtggccgggtgcgcaggggtgccactggccgcagcaagagccctttcttgcgccgctgcagagagttggaggcaaaagccaggccgctggagtcagcttctgctgcagaagaggggggatgttgagatcagagacctgctccccgacttgggctgtttacagggggcactgtagctatttcctaccacttagaggtcaagccaagggcagggactgcagagggtgacgcttgggtaccctgggcatggactaacccttgtagacctgccccacagacaccttaccccacagaggctgcccactgtacccctcctcaccccgcttctgcaccagtaggcgcagtggcgggggcccgctggccagggcccggtgcaggctgtcgtcgttggtgaggggcagcaggtcgccatgagcatccgtatagccaagtagcacgtccaggcccgggatctggtgcaccgcccgcagcaaccgcgagaactcctggaagccgctcaccgaagcgcgaggcagcgcgaagcgtcggaactcggcgtcaaactggaagtcggggttgggggagaggaggagtcaggacagcctgcgcccctttctcaccgcaggctggcaggaatgggaaagatgcggctgccgcttttgcggcagccttaagcccagacctcagctccagtaccagggacgctgtccaaggtcttcttaccgccctccaggtactcaggccacagagagctggagaccagcagtggaggaaggaagacggatgggggaaggcgagcagaaaagcagaatgggacttggaggatagagggaagaggtggcggggaccaaggagctgggaaggggagaaagagggaattgggagcgcctagggccgaggccggaggagcccttactttgctcttcacctcgacgatgctatcgggactgcgcgccggagtcctctgcggccgggccatggcggggccgggcgggccggggacgg

SEQ ID NO: 11683 - DNA, 6668 bp, Homo sapiens
atcacgctgaggtccgcgcgcccccggagtctggggagcagggctccgccaatccgaggggagggcgaaggaagtaccatttatttagcgctgtgtgtgtgctcttatttccactggccttacaagaccgtgcactgtgtagatgaggaaactgagtcataataaatatgtgctgaaccgttcgggggtcacacggtgctgaaatggtttcgagtcaactcgctcggacggcactcggcctcagcctccggccctggaaccctctccagggacgggaccagcccttgttctgttccctaccggtaccacaggaatcttgacgaacggcccaaatgcctggccgctgtcagagtgacgccgcgatgagagtaaacgggccagcatcccgtgcaccagcggggtggaccagcgggagtctgcacacaggcccccgagcaggacgccctcgtgcgcaggcgcggggtgtacgtgggcggggcctcctcctccggccccgcccagcgaaggagcttcctcttccgaggaaaggcggggcctgggcgcccgcgggaaacccgggcccgttgcatccgctgggtgtagccgtggggatggcaggttcggggaggctggtcctacggccctggattcgggagctgattctggggtcagagacaccctccagtccacgagccgggcagctgcttgaggtgagcccccattcagggcccggagaccgaggcggaggcccggggtggtgggattgacgccgctcgccgccgtcaggtactacaggacgccgaggccgcggtcgcgggcccatcccacgcccctgatacgtccgacgtcggggccacgctgcttgtgtctgacgggacccacagtgtccgatgcctggtgacgcgggaggccctggacacctcggactggtgagaggccccgcgcggctctggaggtcggagtccggcaggagagcgcgaggtgggcgggccttgtgttcaggtgggcccggcagtgaggatcctgcttgttgcagggaggagaaggagttcggcttccgcgggacagagggccggctgctgctgctgcaggactgcggggttcatgtccaggtcgctgagggcggcgcggtgagtggtgagactgccttgggcgggttaccgggcatgactcttcgtgacgattctgagacccccccttccccccgaactcctccagcccgcagagttctatctccaggtggaccgcttcagcctgctgcccacggagcagccccggctacgggtgcctggttggtaagtgatgcctccgccctccagcagctctccccaccccagcctggccggcgctggcagacgcctatggggtaggagggcttgggcccccattaactacccttctctttttcttagcaaccaagacttagatgttcagaaaaagctctatgactgccttgagtgagtctggggttgggctcgggggccacgtgttgtttggtgaggggatggtgtatctaggtagacaggcctcagcatggttcctgagtcctggccactctcttcctgtagggagcacctttcagagtccacctcgtccaatgcaggtactgtagagcttgaccagtgatcctaacacgctgtgcagtgatctctccagccttaaccttatgcttcctcaataagctgtcttccccctcaccctcctggtcctcccctttaagccttgactcatcccatggtcccctgtccccaggcctatcactgtcccagcttctggatgaaatgcgggaggaccaggagcatcagggggcactcgtgtgcctggctgaaagctgcctgacactggagggcccttgcacagcaccccctgtcacccactgggctgcctcacgatgcaaggccacggtcagtctggggatttgcttgggagatgtcagggtgaggagttgggcaagggtcatatcccacaggacatgagagtaaacgggcctgtcctacagagttcatgtcccacagggagaagctgtgtacactgtccccagctcaatgctgtgcatctctgagaatgaccagctaattctgagctctctaggcccctgtcagaggacacagggtaagggggactggagaggttggggggatacctggggcccaggtccacagtgctgataagacttcctgaaccccccaggccctgagctgcccccaccagacccggctctgcaggacctatctctgaccctcatagcctctcctccttcctcacccagttcctcaggtgaggtgatgcacaggtcacaggcactcactgccgcctgtcagtcaggttcccgggctgcgcaggatgctgtgaaaggtgcacggtgggtgggggatgaacacggtccctgcagtcctgtctgagctcgcaggccactcagctgccctgagcggagagggctgtgcctacaataagtcccctcctcctcaggaaccccggccttacccggccacatgtcatccgaggaaagtggtaccagcatcagccttctgcctgccctgtccttggctgctccagacccagggcagagaagcagctcccagccctcaccagccatctgctcagcccctgccaccctgacccccaggtccccacacgccagccgtacccccagctccccactccagagctgcactcccagtctctcaccccgtagccatgtccccagtccacaccaggctcttgtgaccaggccccagaaacctagcctggagttcaaggagtttgtagggttgccctgcaagaatcggccgccttttcccaggaccggagctaccaggggagcccaggagccctgctctgtctgggtgagcatagcccctctgcagctggagggtagaacaaggaaggcctgaggtagagctgggagggagcatgggtagccttggatggggttggggtccttgttagctcttccccagacaccatacccctttcaggaacccccaaagaggcatcgtgatggttctgccttccagtatgagtatgagccaccctgcacgtccctctgtgctcgggtccaagctgtcaggtgagtgcctgggtctgccccaactcttggtcactagtcccaggctccattgacctgcagcggtggtttctttccaggcttcctccccagctcatggcctgggccttgcactttctgatggatgcacagccagggtctgagccaactccgatgtgagacgtcacgcaggacagataccgctccacactctgcttcctttgagttttttaataaaataatctcatgcggcaggagaggagaggatcagggattggggccgccgcctctttggtctgtggctggggagggtgggctccgctcagggctggagggctctgtgggctgtgggggcagaggctcggttccaaggccagatcctgtgaggggagggagggagagagaggaagggtcagggctgggctaagcagtcctgccaccctcccagctggcctggaccccctcttacctaggcttggggatggaggtgcctcgagttttggcctgcgtttgaggacgggggagcgctgcagcctcaggggccgttctaagggacacagaaaggcttggggtgggttgctaaggcttggggtctgtccatcccctgcccctctcttccacctccagtgcacataagcatgcactcacacacactgctgccttcagagcatcccccgtccctgcgtcctcacccctggcagaggctgctcttcgggaagtggagccagtgctagttggaagggcttgctgtcaaacccttgcacctggtcttctggctccctgatttcttgagacctcacacactggtggctccctccaaggaccaaagctatgaagggagccccagaagcccaccctcccacatctcctgcattcaagcacacgtggaggtgtctcccctcaccagcaggggcctggagctggtcctcatgcacagacactgctcgccgccctgccgagagaggcctcggcctcagctggccatctgagggaggccagggaatcaggggtattccaacagctgcccccactccagcccttgcctcccaccctcagggtccttagaggagctgagttcccagcaggaactcctccagccccgaggccaggattggggtggggaatcaggtgcctgcctaccttcatttctggggcccaagcaagggtcctctgggaggcccaggctgtctggggaggggctggttctgcagggacttgggctttgaccaggggagggagggcctggaccatcctgttggccccaaccacggctcctgagctccgcattcaactgctgccccagtgtcttccaggtggcagactcaggcccctggctccctgggccaggtctgcaggaagggtctgtagggagaaaggtgtcagccaagacctggtcaggcattggcgataggtctgaacaacagtctgacccaactcctgcctgtccctgctcccactaccaacacacacagtggccctcactcaccagcagacacagagtgggtgcgggacttgatcgagatgggaggggcctccgtggaactgtccataatgtcacctgcaaggcggagctggggactcaggtaccagaccttggaggtgaggggaagaaaaacctggcctctccccttcctccccaaggagagcaagtgccttgggggctgtctataaggacacctcctggcaaatgtactgccacaccccagggtcccacttaccatctgagccagctttcttgatctcgccatctttgctctgcaggaaacagggcaatcagattccagccctgcccgctccccacaccctagccttttgttcgttcttgttcttataatcctgccactgaatgcccaccatgggctggacaagaacatggcaaacccagtacagccctcttagaactctttgcacacttgaatatttctaaattcaggccgacttcatgttttttgtttgtttttgttttttgttttttaagatattgaatggatggtatggagggctggggttctttgggactctaatgagagagacattagcagggtggcccacagaggagagtcagggaagaaccatgggcactgcagggatggctgaggagggacctggcgtaacccacaattagagactggaagcgaggcagggaggacatccagaccacccagggacgtgtgtggaggctctgatttgcaccaggggaggaaagcagtgaggttttaaggtggccagggccaagaccccacagggctctgaagcaggttgtggagtctgaacagtgtcttgagaggaagcccctggaggacttgctatttcaagcacaagtgacaaggtcagatttttttctttttctttttttgagatgagtctcactcttgttgtccaggctagtgtgtagtggcacgatctaggctcactgcaacctgtctcccaggttcaagcaattctcgtgcctcaccctcccaagtagctgggactacaagtgcccaccgccacacccggctaatttttgtatttttagtagagacagggtttcaccatgttggccaggttggtctcttaactcctgacctcaggtaatccacctgcctcagcctcccaaagtgtcgggattacaggcgtgagccatggcgcctggcccaggcctcagatttctattagacctgcagagaaaagactttctcaggtccaaagaggagatgctggtggcctgtgcctgggtcaaagccaagagggaagaaaggtcgaatctgtaaccatttcgaggagaatggagtagaactgacaattagacctatctgtcatgagtctcctccatcttggtcacttatgtcacccacagcatgccatctgccctctcacttcatgctcaggtcccctcaactcacttgcttcctcttgccttcggcacccccgctgcctcggctgacgcctatcctctgcagcattacttgtacccgctgttcaaaggatggagccagttctgtttctccccgctccaggggccgccgctagggacagagatgctcgagttggagacagtccgcgccctgggtcccagaagcgccttcaccaccccccatcagcaagcctcaccttgtcgggtctggcacccagcgttgcctcctcctcggcaggcagcagtatcatcgagtaggccttgctatctcttgtgtagcgaggtcggctcctgccggcagggtcagggctgctggtgtccccctcagccccaccaagctcctcaccacggctgggacgggttggcggccgcagtaggtcgccaaatgtagtttttcgggttcggggagctgccccagggctggtctctagatcagtccgtggaccccgcgttgaacgaggcttcttgaaggcaaagagggtgcccagcttctttcgcagtgtacgggggacaggagtggcgcccccctcagtggccgggtcctcctcgggggcccagctgtggggacacccagcagtgagcgagaaagcccatcaggcatcccaccctctcccacccccagcagatgcccctcactcacaggcgatcctgctggatcagccttttggagaagaattcctccacgccctcgtccacgcgggcactgagcccattcccttcctgcggcaaggctgggggtacctgggg

SEQ ID NO: 11684 - DNA, 6670 bp, Homo sapiens
atcacgctgaggtccgcgcgcccccggagtctggggagcagggctccgccaatccgaggggagggcgaaggaagtaccatttatttagcgctgtgtgtgtgctcttatttccactggccttacaagaccgtgcactgtgtagatgaggaaactgagtcataataaatatgtgctgaaccgttcgggggtcacacggtgctgaaatggtttcgagtcaactcgctcggacggcactcggcctcagcctccggccctggaaccctctccagggacgggaccagcccttgttctgttccctaccggtaccacaggaatcttgacgaacggcccaaatgcctggccgctgtcagagtgacgccgcgatgagagtaaacgggccagcatcccgtgcaccagcggggtggaccagcgggagtctgcacacaggcccccgagcaggacgccctcgtgcgcaggcgcggggtgtacgtgggcggggcctcctcctccggccccgcccagcgaaggagcttcctcttccgaggaaaggcggggcctgggcgcccgcgggaaacccgggcccgttgcatccgctgggtgtagccgtggggatggcaggttcggggaggctggtcctacggccctggattcgggagctgattctggggtcagagacaccctccagtccacgagccgggcagctgcttgaggtgagcccccattcagggcccggagaccgaggcggaggcccggggtggtgggattgacgccgctcgccgccgtcaggtactacaggacgccgaggccgcggtcgcgggcccatcccacgcccctgatacgtccgacgtcggggccacgctgcttgtgtctgacgggacccacagtgtccgatgcctggtgacgcgggaggccctggacacctcggactggtgagaggccccgcgcggctctggaggtcggagtccggcaggagagcgcgaggtgggcgggccttgtgttcaggtgggcccggcagtgaggatcctgcttgttgcagggaggagaaggagttcggcttccgcgggacagagggccggctgctgctgctgcaggactgcggggttcatgtccaggtcgctgagggcggcgcggtgagtggtgagactgccttgggcgggttaccgggcatgactcttcgtgacgattctgagacccccccttccccccgaactcctccagcccgcagagttctatctccaggtggaccgcttcagcctgctgcccacggagcagccccggctacgggtgcctggttggtaagtgatgcctccgccctccagcagctctccccaccccagcctggccggcgctggcagacgcctatggggtaggagggcttgggcccccattaactacccttctcgttttgtacttagcaaccaagacttagatgttcagaaaaagctctatgactgccttgagtgagtctggggttgggctcgggggccacgtgttgtttggtgaggggatggtgtatctaggtagacaggcctcagcatggttcctgagtcctggccactctcttcctgtagggagcacctttcagagtccacctcgtccaatgcaggtactgtagagcttgaccagtgatcctaacacgctgtgcagtgatctctccagccttaaccttatgcttcctcaataagctgtcttccccctcaccctcctggtcctcccctttaagccttgactcatcccatggtcccctgtccccaggcctatcactgtcccagcttctggatgaaatgcgggaggaccaggagcatcagggggcactcgtgtgcctggctgaaagctgcctgacactggagggcccttgcacagcaccccctgtcacccactgggctgcctcacgatgcaaggccacggtcagtctggggatttgcttgggagatgtcagggtgaggagttgggcaagggtcatatcccacaggacatgagagtaaacgggcctgtcctacagagttcatgtcccacagggagaagctgtgtacactgtccccagctcaatgctgtgcatctctgagaatgaccagctaattctgagctctctaggcccctgtcagaggacacagggtaagggggactggagaggttggggggatacctggggcccaggtccacagtgctgataagacttcctgaaccccccaggccctgagctgcccccaccagacccggctctgcaggacctatctctgaccctcatagcctctcctccttcctcacccagttcctcaggtgaggtgatgcacaggtcacaggcactcactgccgcctgtcagtcaggttcccgggctgcgcaggatgctgtgaaaggtgcacggtgggtgggggatgaacacggtccctgcagtcctgtctgagctcgcaggccactcagctgccctgagcggagagggctgtgcctacaataagtcccctcctcctcaggaaccccggccttacccggccacatgtcatccgaggaaagtggtaccagcatcagccttctgcctgccctgtccttggctgctccagacccagggcagagaagcagctcccagccctcaccagccatctgctcagcccctgccaccctgacccccaggtccccacacgccagccgtacccccagctccccactccagagctgcactcccagtctctcaccccgtagccatgtccccagtccacaccaggctcttgtgaccaggccccagaaacctagcctggagttcaaggagtttgtagggttgccctgcaagaatcggccgccttttcccaggaccggagctaccaggggagcccaggagccctgctctgtctgggtgagcatagcccctctgcagctggagggtagaacaaggaaggcctgaggtagagctgggagggagcatgggtagccttggatggggttggggtccttgttagctcttccccagacaccatacccctttcaggaacccccaaagaggcatcgtgatggttctgccttccagtatgagtatgagccaccctgcacgtccctctgtgctcgggtccaagctgtcaggtgagtgcctgggtctgccccaactcttggtcactagtcccaggctccattgacctgcagcggtggtttctttccaggcttcctccccagctcatggcctgggccttgcactttctgatggatgcacagccagggtctgagccaactccgatgtgagacgtcacgcaggacagataccgctccacactctgcttcctttgagttttttaataaaataatctcatgcggcaggagaggagaggatcaggattggggccgccgcctctttggtctgtggctggggagggtgggctccgctcagggctggagggctctgtgggctgtgggggcagaggctcggttccaaggccagatcctgtgaggggagggagggagagagaggaagggtcagggctgggctaagcagtcctgccaccctcccagctggcctggaccccctcttacctaggcttggggatggaggtgcctcgagttttggcctgcgtttgaggacgggggagcgctgcagcctcaggggccgttctaagggacacagaaaggcttggggtgggttgctaaggcttggggtctgtccatcccctgcccctctcttccacctccagtgcacataagcatgcactcacacacactgctgccttcagagcatcccccgtccctgcgtcctcacccctggcagaggctgctcttcgggaagtggagccagtgctagttggaagggcttgctgtcaaacccttgcacctggtcttctggctccctgatttcttgagacctcacacactggtggctccctccaaggaccaaagctatgaagggagccccagaagcccaccctcccacatctcctgcattcaagcacacgtggaggtgtctcccctcaccagcaggggcctggagctggtcctcatgcacagacactgctcgccgccctgccgagagaggcctcggcctcagctggccatctgagggaggccagggaatcaggggtattccaacagctgcccccactccagcccttgcctcccaccctcagggtccttagaggagctgagttcccagcaggaactcctccagccccgaggccaggattggggtggggaatcaggtgcctgcctaccttcatttctggggcccaagcaagggtcctctgggaggcccaggctgtctggggaggggctggttctgcagggacttgggctttgaccaggggagggagggcctggaccatcctgttggccccaaccacggctcctgagctccgcattcaactgctgccccagtgtcttccaggtggcagactcaggcccctggctccctgggccaggtctgcaggaagggtctgtagggagaaaggtgtcagccaagacctggtcaggcattggcgataggtctgaacaacagtctgacccaactcctgcctgtccctgctcccactaccaacacacacagtggccctcactcaccagcagacacagagtgggtgcgggacttgatcgagatgggaggggcctccgtggaactgtccataatgtcacctgcaaggcggagctggggactcaggtaccagaccttggaggtgaggggaagaaaaacctggcctctccccttcctccccaaggagagcaagtgccttgggggctgtctataaggacacctcctggcaaatgtactgccacaccccagggtcccacttaccatctgagccagctttcttgatctcgccatctttgctctgcaggaaacagggcaatcagattccagccctgcccgctccccacaccctagccttttgttcgttcttgttcttataatcctgccactgaatgcccaccatgggctggacaagaacatggcaaacccagtacagccctcttagaactctttgcacacttgaatatttctaaattcaggccgacttcatgttttttgtttgtttttgttttttgttttttaagatattgaatggatggtatggagggctggggttctttgggactctaatgagagagacattagcagggtggcccacagaggagagtcagggaagaaccatgggcactgcagggatggctgaggagggacctggcgtaacccacaattagagactggaagcgaggcagggaggacatccagaccacccagggacgtgtgtggaggctctgatttgcaccaggggaggaaagcagtgaggttttaaggtggccagggccaagaccccacagggctctgaagcaggttgtggagtctgaacagtgtcttgagaggaagcccctggaggacttgctatttcaagcacaagtgacaaggtcagatttttttctttttctttttttgagatgagtctcactcttgttgtccaggctagtgtgtagtggcacgatctaggctcactgcaacctgtctcccaggttcaagcaattctcgtgcctcaccctcccaagtagctgggactacaagtgcccaccgccacacccggctaatttttgtatttttagtagagacagggtttcaccatgttggccaggttggtctcttaactcctgacctcaggtaatccacctgcctcagcctcccaaagtgtcgggattacaggcgtgagccatggcgcctggcccaggcctcagatttctattagacctgcagagaaaagactttctcaggtccaaagaggagatgctggtggcctgtgcctgggtcaaagccaagagggaagaaaggtcgaatctgtaaccatttcgaggagaatggagtagaactgacaattagacctatctgtcatgagtctcctccatcttggtcacttatgtcacccacagcatgccatctgccctctcacttcatgctcaggtcccctcaactcacttgcttcctcttgccttcggcacccccgctgcctcggctgacgcctatcctctgcagcattacttgtacccgctgttcaaaggatggagccagttctgtttctccccgctccaggggccgccgctagggacagagatgctcgagttggagacagtccgcgccctgggtcccagaagcgccttcaccaccccccatcagcaagcctcaccttgtcgggtctggcacccagcgttgcctcctcctcggcaggcagcagtatcatcgagtaggccttgctatctcttgtgtagcgaggtcggctcctgccggcagggtcagggctgctggtgtccccctcagccccaccaagctcctcaccacggctgggacgggttggcggccgcagtaggtcgccaaatgtagtttttcgggttcggggagctgccccagggctggtctctagatcagtccgtggaccccgcgttgaacgaggcttcttgaaggcaaagagggtgcccagcttctttcgcagtgtacgggggacaggagtggcgcccccctcagtggccgggtcctcctcgggggcccagctgtggggacacccagcagtgagcgagaaagcccatcaggcatcccaccctctcccacccccagcagatgcccctcactcacaggcgatcctgctggatcagccttttggagaagaattcctccacgccctcgtccacgcgggcactgagcccattcccttcctgcggcaaggctgggggtacctgggg

SEQ ID NO: 11685 - DNA, 13327 bp, Homo sapiens
gagggggagaggctgaaagcgcggcctggaaggcaaactgcgcgtgcgcacaacgctctcaacgaaccctcggtccgctgcggccgcacggggccaactttcgcgagggagcggctgacactctccgggcgacgttatcgctccctccgcctgcgcctggccgctctagaaaggggtgccagccatcgctggggtgccttgattctgttccaccttggtccggtttatttcagtttaatggttatgtaacaacggtccgtctctcctaccaaccggtaccccgcccacgccagcagccacgggtcgccagcgccacgcagcggaggcgggcggcatggctggcccaaggtgcgcaggcgcactagccctgggggtgcttccgtgtctgcgccctgagacatttttggcgccggccccagcctgagcggggacggcggccgggagggcgcggcccgggttcccgttccccgcggagccatgcggtacaacgagaaggagctgcaggctctgtcccggcagccggccgagatggcggccgagctgggcatgaggggccccaagaagggcagcggtgagcgggacccgggagaccgagacagtgccaggggcgggaggccggggccggggtctgggcgggggtgccggaggccggagtccgggtcggggcgccggggacgggaggccggggtccgggcgggggctgcctgcgcccctgagtgcgcgctgtgcccgcagtgctgaagcggcggctggtgaagctggtggtgaatttcctcttctactttcggacagacgaggccgaggtaggggcgtcccgggcgcgcgggcgggtcccaggctgggcccctcggaggccgggtgctcactgccccgtcccggcgcccgtgtctcctccagcccgtcggagccctgctgctggagcgctgcagagtcgtccgggaagagcccggcaccttctccatcagtgagtggggctagggaagccagcggcgcttcccgcagcccggggcacccgcagcgccgcactttcccctccccgggcgcccaaggtctcctctgtgtccccagcctggcgccaccctcctcaaacacaagagtgcattgtccacgggcagctcaaggtcaagttctcctggcgggcaccacccttcccacctgccgagtccacttaagcttgggtccctcccagactctgctctttgttccctgtgggcccaggctgtacttacagggcaggtgggccagccccacccaaagcgtttccccagctgccaagagtagcatgggtctagcattgttatatggccccgggctggaaatcccaggtgggggtaggaggagtgagaggggggtgttctcctgggtcttaagagattcccttctgcggggaaagatggagtccctgctagtttgcccagagtggctgtcaaaattccacaggccaggtggcttaaatatcagaaacattctctacagttctggaggccagaaatcctagatgaaggtgtgggtggggccgaatccttctgaggccgaggggaatctcccagttcctagtggtggccagtatcctccaggttccttggcttgtggaagcgtcaccttgtcctccttgcatcacgtctgtgcccacatttccccttctacacagacgccaagcagaatttagggcccaccctgacaacccctttttacttcactttattattttatttgcttattttttgagacagggtcttggtatgtcgcccaggctggagtgcagtggtgcaatctcggctccctgtaacttccccctctcgggttcaagtgattctcctgcctcagcctcccgagtagctggtactacaggcacgcgccaccatgcccagctaatttttgtatttttagtagagacggggtttcgccatattggccaggctgctctcgaactcctgacctcaggtgatcctcccacctcggcctcccaaagtgctgggattacggtcttgagccaccgtacccggccctctttatttttgagacaggatcttttgtttccgaggctggagtgcagtggcgtgatcacagctcactgcagcctcaacccccttggctcaagcagtcctcccacttctgactccggagtggctgggcctacaaggccccaccaccacacctggctaatttttgtttttgtagagatggggattttgccatgtcacccaggctggtctcgaactcctgagctcaagcaatcctcccaccttggcctctcaaagcgctgggattataggcatgagccaccgcacctggcgacaacctcattttgactagtttatatgcaaagaccctgtttatatacagggccatactcatgggttctggggggtcaggacatgaacacatctttgtgggggccagagaagggacagtttatgggcaatggcaagaggaagctgcttgtggctgtgggtaggaccgaccacaggtgttccatccccaggcttcattgaggaccctgagaggaagtatcactttgagtgcagcagcgaggagcagtgtcaggagtggatggaggctctgcgtcgggccaggtggggccaggcggtggtgggcactgctggggtgggcacagcagccatgcagagcgggcatttgaccccgtgccacccttttccccagctacgagttcatgcggagaagcctcatcttctacaggaacgaaatccggaaggtgacgggcaaggtgtgtgcagggctgcagagggccggggtggggctgcaggtggcagaggcagtcctccagccctggctcatggccacccgtcctccccacaggaccccctggaacagttcggcatatccgaggaggccaggttccagctgagtggcttgcaggcgtgagcgcagggcacggtggtcagcgtgcagcgggacgggactggccctgcccagccatgaatcgcttggccatgcctggatctgttttgttttggtttttggtttttgggtcagggtttcactgtgttgcccaggctagagtgcagtggtgccacagctcactgtgaccttgaccttctggactcaagtgatcctcctgcctcagcttcccaagtagcggggatcacaggcatgagccgccacacccggccatcacacctggattttcagtgggaggtttttggtttggagacatccaaagcctgaagccaggtgggtgtgggcaggggctgcattttatgaaactgcccagcaagctgcgctccctggggccccaggatccacctaactggcctggcacctggtgccacgtgctgctgccgccaggatatgcgccttcccacaggtgccctgcctgagttgtgtgcatccaggggcctggtgagcccccaggctggtggcatggcccccctgccccgtgctgaatgaatgtacagagccagacaaagctgtgaatggcctaggggctgagtcccacaccagctgtgaattctcctgcagacaggagggccctggctgtgcacctggggaagtggttgccctggggccagggtgcttgttctgttcaaataaaggtacctcttttccacactggatggcggtgaagtgaaggagaggggaggggcagccagggagcccccacccaagggaagtaaggctcagggtcctgagaggcagtggctgggcctcctgcactgaggggagagctagaacccccagccaggacaggtggaggctgggacccaggcctggggagaacagagctgctgtgtggtatcaggaatcctgtggtgacctggggtcctgcctctggcattcacgggccctcccggagtgtggctggggcctgggcgggctttggtccatctgatgtgaaaaggactttgccgatgtcattggggtcgcagatctggttttccgttcatcaaaaggcactttgcctgtggcctggtgccctcataagcctccccttgcctgtggcctggtgccctcataagcctccccaaggccagggtgtcctggtgtcagcccccggagcttctgctaggagcacccctaggccctccactccccgtttcggcgatgacacactagccggggcctctcactggccgccaggagacgcctcatgccacctggaagaaaggctgccattcacaccaggtccgagtgaaaacagtctgtttattacagcgtctagaggtggggatgcagaatgcaggggtgcccagaggaaggggcgcctgcagcccaggggcggaccgtgacaatgcgcgcaatccaaatacagttcacccggaagacacggcagagcctcccacgttacaaaggctgacacagaccagcagcgtgttgtgttgggaggggggtctgaccacgatggcgagggcagtcggcggggggtggggggcctgctgaccactgaacagactgacgcatcctgggggcagataaattaagggggaagtcttaaataagtcactgtgcgtgcctcatgggccgaggagggggtatcctagtttttagggttcctatcaattcctgagcaagagccactcccaggcgccgcccgcccacccacagtcagcagcagcagcacaggtccccgccagctgcccacggaaactcaggccaggtgccagcaccaggctccagatccccagtctccacagccaccctgccacccgccacacaccacccctcagtctgggagtgtctgagaagaacacaggcccagggctcagaacaggagggtgtccgcaggcagccaccacactagttcacgtgtggtgacacgcatatgacccagtgggctcaaggagacttctgcctgggccagtggctctgagacccagtgcgtgtcctgaacatacggtggcctgcgtgggcaggagccctgcatggccatctgcaggacccgtgatggcacccggactgccactgtcacctagagggaggcagaagtaatacagtgtttaaagaatgtgtcttgttctagaccagggactcggccgtctctgccatcaaccctgtggcgtatccggcccgtggcgacacagagcaggctgcctgtcctgaaggccaggctcggggcttggggctcaggcagaggcacagcaccttctagctgagagcaccaacgtggggtggggagggcactgggcaccacttaagaggacaggtccggagcaccatcttcagaactcagctatgttggagggtgggggtctgagaggttgttgggggctgggggaggcagcacccccctcaccaggcacaagcaggggtcttcaggccctcccacacaggactcccccacctagcaaccacagaagcctttcctccgtggctccctttggaggccacgtggtagggatgtgacgtgtgtccatcctgcccttgggaaccagaacacagggctggcagctccctggagggtggatctgtggcaccttggggaaggggctccccgatgccatctcacaggagcaagcacttgagaaggtgggctcagcaagtgccacacagcccagggccagatgcggggagctcagactcccagatcccatcctccagggagggcacagagccaccactgctcagacaacccaggccctgactgctcagggctccagaagcactggagtggccctgcctgcctgctacaccccggcctcagctcctctccttccacacccagtcccaggcacccgccaaggctgcagagtggggggccgacgtcaccctggggcctagggccagagaggccaggtttcagcagtgcaccctggccccagcacacccacagcagctgggagaaccagcacaggctccaagggatgggtgccaggcgtggccctgacaggaagggatgtggggcaggcaggggcgccggcagctctgtctgggctgctgggagctgcaactgaggggtctagggtcggggctgacgctggggccattttgtgcactgtttgaataaataaggttttttcccctcgcttttctttcctcttcactgtgcattataccatctaaaaataaaagctgtcaaatctatgaaatttataaattctcatcacatctctataaaatactgccactcattagtgtgactctctcctgtacagaaacaccaagggacccacgacaggcctgccccgcatcgcagggcatgctgcgagccatggacagccgagaaatacaaaagtaaatgcacttgttcaacgtgcccgcgccgtcctcacagcaccatcgcgcagcacatggccagctgcgtcaccgcgcaggccccttcacatgcaagggcgcaacccacgccccggagggtgaacagtctgggggttcacagtgccggggtaaaggtgaagagctcagggcaggcgccagggcgctcaggaaggggctcaggccgcggggaggcctccgaggaatgtggtggcgacgggcctgcctttggtacgggagcagcgcgtcgggggagccggccgggcggcgtttccgagaacggggttcggcgttgtcagcgtctagtcagcaccaagcgggtggaggcaggcgcgggcctggggacgagatagcaccggggcaggctgtggcgaatccgctggcgggcccgccctgcagacacgtgtctttatatagagctctcatatatagatatttatatttctcaataagttgccttttaccacttagatggaataaaataagtcagaattgtttatactttttaaaaaatgataaatactttatctaaaactatcgacagtacaaactggaccagtcccagcctcctgcggcgcgtgccgccgattcacagtggagctcccgtccgtccttgcctctgccgtccaggggtgggagcccggcaggccggcgggcaccatgccgcgggcgcgagttggtccacaccgtccttgcataggtctcgcggttgaggtagaaatcctagttacctgcagaagggcacagcgggaagagcggcctgaggttaccatcgcgcctgggggagcccaacactcacccaggctggggaccgaggcctcccacgagcacacacgccacctggggccagcaccatgacaggcatagtgccagctcctctaaccacaacagacgacgggcgtgccccgtgacagaccagggagcctgacacctggacacgccggccaagctccagccttcctccaaaggagacacacagccgagtccagctaaagccaccctacctgcagctcatctcctaagagacccagcatagcttgtccagcccgcaggtgcccgcattgacccgccaggctgaccagccctggccacagcctccgccttggctcctggctcccagtcctcctctccttgcccggtgggctttggactcgcccaggaaggcctgtgtcccaggggcccctgaggcagaaggccaggggcaagcagagggcacctttgcactacgccgccaggcacgccatgtccctggagggcacgggtggccaactgccctcaggggtcagcggccacagtctccacagcctcttgggggaggagtgaacaggacattccctgaaggcctcacatcatcaaaatcactcctgcttccaacttccttctggtctcaaaggtgggcaccgtctacactaacctgcccagcttggtgctgacatctgagcagctgaaagcccctcggctgtgggccatgaccacagggcagtgtggccatcagccgtgtccagcaagggggcctcaacacgcagggcacagagcttgcctctcgaccccgccgggaacccatcagcccccaggcaggcagggcacttggggcttcactggctccctatgagggcatccgaggctactggccagacagccccgaccagaggcatccagccagccaccctggctctccaggacctctgcagccggcaccgtgcctgctacatgctgggcgcctggggaacagcaccaagccacgccacccgtcatgagtgacctgggcctggtgcggatggagccctggagactgctctaggagctagagctcccagccccctggcctggcaccccgtgagcctcgcccacaggggctggcacagctgcccccagggctggcctcagtcctgcggcgtcaccgcaggaacccagctgcgggcagctggaacccaacacactcaggccactccatggctggtgcccgtcctgtagtccctcctctcgcgaccatctccctggtctccctggctctctccctcttccctcctcaggacccccggaacttctgccgagccctgtggccgtcttctctgccaaaggaaggacagttcagtgtctggagtgagccaccgcgcagggctctggccttaccttacacaatacgcactgctagctaagcaaggtctttatcgcggcttaacccccgaaaggtgcgcggcatagggaggcggcatgccgagggacacccacaccgcggacggccccgtggcgctggcctgtgggatcccgggcgcggcctgggccagggccagccggggcaggggctggtggtgcaccgtgaaggaggggcgggcgcccttgtgcgggagggaggtgagcttgatagacaaagaggcgttagcaggcggcagagaggcagcagaggtggggggcaagaaagcttggttaggcgggagggacgcgaggctctgcagaagcgcgggctcagggttagaggccagcagcgttgggggaggaggcaaggcggcgttaggtggagggggggcgtggaggacgggcggccccgcgggggaccggcccaggtgcgcaggcgggggcagcgggggaggcggaggcggaggcggagggggcggccgggtctcaaccgaggccggggcctgaaaggaagaggccgaggcgctggccgccgcctgcagcgggctcgggcccagtgtggcgctgccacatgcagccccgcggccgacacgggctccaaacggatgagcagaggcggagggcaccgcgtggttaaagacacctgcaaataggagagaaaaacgcagcttcaacaagcggcagcatccaggcaagcgcagagcagcagccgcaggctcacaaaaagggaagcgaaacggcgccgccaggcgtgtgcgggcaccaagcacaagcagcggctcggccaggctcgtggtggcccgccctccgccctccggccccccgccccgcagcagccccagggccaggccgctccccccggcggctcctctccgccctgtctgggcaggcactgcggggactcgctcttacccaacaccagctcccagagccttgccagagcccgggcggccacacctagcaggtgacctccacgggagaaagtaatgctctggtggccctgcgcacggtggccttctgaaaacaagagggacgcggttacaaccagagaacccaagacacacggactcagcgtgagccctctccccacaggactggagttcgccaccgtgcacggatggcgggggccggccggcaccaggggacctgcagctcagctcctgctgcaagagagtgcggaagggaacctgcaaaggaaggggcctccggcgggggccggggcggggggcggacggacggccgccctgcctacctccaactgtgccgcctgccaccccggaaaagctgcccatggcgtgcgagttggtcagtctggtggcagcggacgacacgtgcaccaggcctgcggcggccggcacagagctgaacagcgactgcagcacggaggagccggccacggagccgaggttggcctgcagggacatggggccgagcgcgaactgcggtcccggcgggaaggggcccaggaaggaccggtgcgtctgggcggaggacgccgcgccgcctgcggaggacgccgccggggccaggccggggccgctgaggaggcttccgggaggcacggccgccgcagagatgaagaggttgtggccattcttgaggtcgacctcgcggtcccgggccttggcggccttgccgctcagcagtggggtcttgtccgtgggcccgcacagcggtaggccgccctcccctgcctccttgccgcggctgccctcgcccttcagcccagccaggccgtccagctgcctcttgctcaggaaagggttggcgtccgagccctccttgccgcgctgcgaggggaagctcagcggggagctcaggccggccgcctcggggcccttgtggggaagagaagcaccatcactgaagctgtgtaaactcaggtccgcggccaggcccccgccgaaggtgcagccgttggcagggttggtgcccgggctgagtccgtcagcccccgacagggagccgggaaagcctttcctggggtgagcggccagcttggcatcggcagagggctcctccagggcgggccggaacgtgaacagggagttctggctgagggcggagctggcctgcagcgggctgtccgccgacttggccaggccgatgtcggagatgggcgagaaggtggacttccacttgctgctattgactggctcgccggcgggcgcgggcttccttcccgccaagccaccacctggcaaagaggaaaggcagaagccgtgagcccagagcacctgcccgggctacccatgaggctaaccggggctgctgccacggcccgggcaactctgcaggcagggctggtcacagacactcaagatgccaagcgggacaggatgggagaggacaggagggaaggggacgggaggggacaagatgggatgggacaggaggactacagcacaggatgagatggcaggggacgggactggatgggacaggagggcggaagacaggacagaggcagctgaagcgggtctcagaggccatgcgggatgagctctggggaaaatgctgaggtcagcagcctgcgggagggaaggtggggctgccccagagcaggtcagggtcctcactgaggacgcaggcaccactcggggggaaggccagggtgcaaagcaaacaggggacccaaggtgacgatccccgcaggtcagccacccactgtgagagcatggcgtgtgcgcggaggccctgggctgcagtgagggcctcccagaggcagttctggaagcccagcgcccccagtgtcggcgcccacgcaggacacgacgcagcaggccagcaccacgcaggacacgacgcagcgggccagcaccatgcgggacacgatgcagcgggccagcaggtgggtcagcagcactgactgggcaccacggccacacggacaggcctggccacgccgcaaaacacttgttactcaccattttccaaggttttcgggggagatttgctttctaaggagattgttgcaatttttctctcaattctgttaagaaaaaaaggtcattaatgcttgaaacccagctgcatactaagaatgacacaaatgctgacagccaacagcccagggagctccggaggtggtgaacgagaagcactcggcccagacaggggacccgtgcagccaccctgggccaggcctggactgggtggctgggccctgggatccacccctgttgtgccacaagggtactgtcctggcagggactccagggcctctgctgggacaagcagccaagagatcaggcacagcagctgaatgggagaagcaatttcccagcacacagaagtgtgagaatcccagacagagctctcttcctacctccctctcccggcccctctcagacctcggtgcctcaggtggcaaacaatgccacagcattgcaggccagcacgtgaagacatgcccaaccacacactgcatggggtcgctttgatccaatgtcccaagaacacaccagggacacacaaattcctaaagatcctggaaaccactaagctgagcaatcccaatgcaaaacagagcatccaggtgctacaatgtttctcgtgtaacacgtgcacgcacacgtgggcaaggagcagaacgaactaacacagaacaccaccaaaagcacacttagggccggctgtgatggcgcacgctgggaggcactgggaggcagaaggcttgaggccaggagtttgagaccagcctgggcaacatggcaaaacccgatctctataaaacaaaaaaacgaacgaggcacggtggtagcgtgtgcctgtagacacaactactcaggaggctgaggcaggagaatcacttgaacccaggaggcggagggtcagtgagccgagatcgcgccaccgcactccagcctgggccacagaccaaaactctgtgtctcaggaaaaaaaaaaaaaaaaaagcaaaaaaccctaccatgttatatcacttcacgacgactcggatggctagaatcaaaacaagaaattcagtgtgttgaggatgtggggactgaggacctcagaccctcgtgcacccatggtggcagggtggaatggtgtggctgctggagagcccagggggccgggccacccagcacctccgcccaggcaccaggaaacgggaaacttgctcccaaacacaaacacgcacacccatggccacagcagtgctgctcacaaccgcccagggtaagcaagcctagcacggagggcggatggatggtggagcaccacccagccacgacagggaccgaggatgcaccttgaggacgtcacgctcagtgagagatgccagacacaaaaggccacatcctgtgtgactccgctcctaggaggtccctagagccctcagattcagagacagaaagtaggatgggggcggggggtgccaggggctcttgggaggagaaggggagtgagtgtttcaaggggatgatgagattttctcaggacatgatggaaggttctggatttaggcagtggtaatgtggatataccaaagacctctgaattgcacactttaaatggagaatacgatatgtgaattttatctaataaagctactgtaatacactcggcaagacgtgtggatgagacctccaacgcctcactgctgaagcttctctcctgctgcgctcagctcctcctcagcttgcctcttctaaccgatggccctgctcgtgtcccaccccgaatggcccgggaggccggccctgcccggaacggggcccaggacctgtggggaggcccctcacaaaacagacgccttcctcccatccagggcaccccctaagagcctgccggtcctccccacccacccacccacacacacacagtgagcaggcacctcctgcccctgctgccaggccccgcccccctccgggcccctggactcgccgagcactgctgggctcgtcctcagagcctggctcctcgtctgaggtgagtggggagtagtgtgccccattggtctggctcagaggcc

SEQ ID NO: 11686 - DNA, 128 bp, Homo sapiens
ttttgtatttttggtagagacggggtttcaccgtgttagccaggatggtcttgatgtcctgatcttgtgatccacccgcctcggcctcccaaaatgctgggattacaggcgtgagccaccgcgcccgg

SEQ ID NO: 11687 - DNA, 388 bp, Homo sapiens
ttgcagtgatggggtctcgctatgttgcccaggctggagtgcagtggtgggatcatggctcactgcagcctcgacattccgagctcaagcgatcctctcgagtagctgggcctacaggtacaaccaccactcctggctaattttttaaaattttttgtagagatgggggtctcggtgtgttgtccaggctggtctcgaactcctggcctcaagcgatcctcccgccaaggcctccctgagcagtgagattacaggcgtgaggccccgcgcgcggcctcccaacaggagtttggaaatagagttcctggcgggcccgaccctccaggcccgcccagcgcggggcctcaggatgcacaaggccggacgctcacgggaggagggaggggag

SEQ ID NO: 11688 - DNA, 30527 bp, Homo sapiens
  misc_feature (14736)..(14736): n equals a,t,g, or c
  misc_feature (15869)..(15869): n equals a,t,g, or c
ccgcccagccgctcgcaggcgccgcacggagttgcgtcccggggacttggggccgcagggaggtgagcgcggggcgacgagcggggcaggactcacggccgcccagccgcaggcgccggaagggtcccgaggttgtgcccgagcctgccctggagcggtggtgcgcggccaggaagggtgcccagtgcccggtgcccgccctgcggagcgcctgggtcccacgtgggctcggctggaggcccgggctggctcagacggcgccggcggggccgctggacccggtctgctggcccctagggctcggctcggacaggacgcctaaggggtccctgggcgacggggcgccagatgtaggggcaagacgattgggcagagatttaaacctccggaggaagagaggagactgcgcagggcagtcccgcctgcgtcccagaagtgcctgcagttcagacccttctctcccctccactttctcccgggtgagcaccgggcggaccggggccgaagtttgttggttgagccagccaaggtggaaacaggtgcgggggtggggatgagggactcacacagcagggctggaccggagctcagaaattggacccaggagtcctgacttctggatggaggggctggggaaggttggccctgggcttgccttttacctgtttggcccctcggatgttcccccagggcattgggatagagacggataagttccctagggtacagaccccgccccactcccacgccagggcgcaaaggaagcctaggttttggccctgccccattccatgaaagattaacggagggggctctagggttggagctactgagagggtggcagcgggtgtgtctgaggagcagaaggcggtggggagctgaccccacttggggagaggctgctgttgcctgggcggctggcatcaggcccccagtgtgtgccatttgctggtaatataatgagaccagcatctgccttattcgaccctcactgtccgtagggcaggcagtggaaagggaggcgtgttttagagctgtggttctcaaccaggggcgactttgcctgccatgggatatttggcaatgttggagtcattttgggtgtcacacacttgggaggggaagtgagtgttgttgttactggcaggtagtgggtagaggccagggacgctaccagacatcttcagggcacggaacagcccacataacgaggaattatccagcccaaggtgttgggctgtgctgaggctgagaaaccctgcgcagcagctggtccatcaggttccttctcaatgatgctccctcactggggaaactacctcagttttccagagtggttaggggaggaacttggaataaacctgaatgagatgaggggtaaggcagtgtgagggcacttattcccctcacaagagtcttcctttggtgccatgagacaccgcctttcccaatctccactggccctgcaggaagctggtctaggtgctgtgggggagaggttgggaacagaggacccccttgcagcccaggcctggggtgcttaaccccagggcaatctcccaggaaggctgggctgaggcagcccttgagctcaaatatccctgggctgggagggtgggcagagggcgagctctcttcccatagattttcccaaagctggattgctgaagctggcatggttgcctgataccatgtgacctgctggaattttcccttctgaactcacacctaactcctccaattatgtacaccttttgaaagtgacatccaaggagtatcagggctcctaattcctggggggtccccaggctgcttttgtcctgcaataaagagggcaccctgggttagctgacgagccctggagtgggcccagctgctgatggggtggaggcacccctgcccatggtgttagctgagcagaggtgagagatgggagacatcaaagcacaggccaggtggccccccagtagggatgactcagagttgtttgtattgggctggaggaatgtacttccagttttctggcaacaaggaggggtggctggcacggtgggagaggatcggatgaagcagccacgtccatgcccaggagctggggccacctcgctgccctccctccctgttttcttgcagtagccattatacccatcctgttcacttctggacccagccttcttgcctgggaaccctggtggaggtttcgagcttgggttctttttgttggtgttggtggcttttgttttttttgttttgttttgtttttgtttttgtttttttggtctcttgactgtaaaaggctgaagtgaaactcccaccttttcatttgcacaaaaaacaaaagtggcctccattgctgtgagcctctcaagggacagggctgagcacccaggcttgtacaaagttgttcaggaagtcggcagtggagctcgggtgtgaacccagttgcccaccctcaggccccacccaagagccccacgaacaaaccctcagtgactcctacctgtctgtacctggtgtaaccacacacacacacagacacacacaaacagacacacagagacacacacaaacacacagacacacacagactcacacacacacacacacacacacacacacacacactctctttctctccagcccaggagggggacttttgttcctataagaggaggaataaatcacactacaaatgctttgggtgacgcacttggggcccgagtcctgctctggggtcagtggtgctgtttttcctgtggcctcagctctggatactgtggtggcctctccaccaaggtttctgtccttgctgtgtaaactctgccccagacaaggtgacagatgacagcagaagtcaaggagctgtgcacgcctgcccgtgagtgtgcgagtggcatggctcagctggctggtgcttccctttgggcctggcccccgcctgccgctggcacagcacagggaagacgtgtgccctcctggctgcctctccccctccacactctcctcagatctctgtgcctcgcactctggagcaggcctcggcgctgccccatctgccccaggggatttccagagtgagctcaggcatctgcaccggctgtggaagcgctggctgtcggaagcggctcccagtttcctatccagctgagccaggctgggggaggagtggcggggacgtctgcgcctgcccaagtacaggctgacctcggcggtggtggtggctaggcagggacagctctcagggcacgggcggcttcacagggaaaccaagcctgcccggaacgtcgttttgcctcccaggagacctaggatgggtgtaaggaaaaacacatcttccgggaagtacaaagcgccaccgtgtccacggcccctccttcagcaaatgtatccgggcgcccagctgggagttgtttgtggtccaaaagctactggaaggcagttccagccccagtgcccggctcctgcaggaaagtggtttcagccaagtgggcagtgcaggaggtgggccagagacactgtttggagtgtgaggggaaccttgtgaccagcagaaaaggatggaggaggattccaaacttcaggagctgggccaaggtccaggggctgctgggcacagtcgtccatgtgtgtgctcagtaggatgagttcacttaattagtctgtgcctcagtttccccagctgcacagtgggctcactaacagtaatctacctggagggttgtgtgaggtgaggactcccgtggtaaaggtgtgcagcctgcagtgcagtgcccggccatggcaggagcagtgcggggagccatcgtgataatggtgttagggtggcttcaggtaggggcgtggctgccggtccatggcacagacttgggagatggccgaggccctgcctcgtgggctgtcaaggactagatgggaacacgcatatggagcagtggcactgttgttattgttattctgtaggagtggctgtgtctggggtagggggacctcagtgccttgctggccaagggaagtgagggtgggtttccatctgggcatgaactgctgacctctgcccaggggttttcctggcctgccagtgtgtgtgtgtcactgacagtggggtggggggcagctcatggagttggtgcccctcagctgtgctttccctggcgtaggttcctggggctgggagcagggtaaagctgcctcaagtcttggttttctcctctgcctcccccgtgtggccgccaaccctgtgccagcaggtggtgcagggatggcttcctgccccggtctctggcaagaaacccttttccctctcccagtgggtctccccaggttgtcagctccatttagtcataagaagatctggggccaggcgcggtggctcacgcctgtaatcccagcactttgggaggctgaagcaggcagtcacaaggtcaggagatcgggaccatcctggctaatacggtgaaaccccgtctctactaaaaatacaaaaaaattagccaggtgtggtggcatgcacctgtagtcccagctactcaggaggctgaggcaggagaatcgcttgaacccagaaggcagagcttacagtgagccgagatcaccctactgcactccagcctgggcagcagagcgagactccgtctcaaaaaataaaagaaaaaaaaaagagatctggaagaggagggttgaggatctgctgtggggtttggagtgggaacaggactttgaaccctggcctaagccccttttgaccttgccagcccgtgaggatgatgacagccgcctctcacccttagcctcaactaaatgagatcatgtctgtaaaagtcctttgcaagctgagcagtgctgcccaggcagttaggtgctgtcccttcttcatgaatcaaaggcctttgcatgcaggactcactccagcaccccaaacactcagagtcctcacccgttctttttctcctgcccctcaccagttccagggtggcaagaggctgcagagtgtggaggttaagagcgcgggaccctggctggggttgtagccccaccacctccctaactgtgggaccttggacaggtgacttcatctctctgagcctcagtttccccacctgtcgaatagagatctgtcccctgtggggctcgtggctcagatagagactaagtgagcgatggtggcagagctcagccaggaataaaagaaacttccaactgggcgttgggtgtgtgccaggcactgtacattcatatctgctgtcatcttccctggctccctccgtggtggggcatcaacccatctcacagcagaggaggcaggctctgcagcacccacttgcccaaagtctcccagcaggtaggtggcccaggcaggtttgagtcccatctctggccccttattcctcctcattcctcagcaagagagctccacgctgccccgaagcaaggtgtgggccataagcacgtggctttgcaggcctgcttgggacaagcaacctggtgtccccgtgtcctgaaaccctggcagtcactggggctagggccagcctcttccctgggaagcagggagccccagggcaacgttctgggaaatcaggtttattagttccttaatgaccgtttacaagctcagaagtgtctgcctggcattttccctccctgctgaggggctccatgcagccggaggcagaactgggcctccagaagcgctctgagtgtgtcgaggtgagggcccagggatgccgtcggctccctgggctctgcatgctcacacccagccagtccaggcctatttctggctgggtggcactgggcaaggtgcttacctctctgtacaataggtgagaccttgtacctcagctgagctgttcctggggtgagccctcgttcatggtgacaaagtcacatagatcttagaccctgggaggatactagcatcttatgcatacacaaactgaggctcagagatgttaagtggcttgcccaagatcgcacagtggttagagatgggcctgtgaccctgtcttctgccatcgggacagattttcactgtctggaggcaggtggaaaccgggtgggctcctactttgtaagcacaggacagtgccctgtctgtgtacatgggacagtcacaaacggaaatggcctggtcacaccttagtgtcaaggagcctccagcaggagtgaaacggacctctcacacagaccccaggctgcatctcatcctgccccaaccgctgggcttgtgctggaccaccactgcttccaaggacccgtgaaaacccggctgccgggatgcagagaggcagactttcatgaacgtttgcagcaaagggcagttcccaccgagcctgtgttgctgtggcactgtgtggtgcacaccccaccccggaaaccctccagtgtcctggtgtctgaccccaaatggacagggccttttggcccccaggggccacttctgactcctccccttcacaacgatgctgagggagcaggagaactggggcccggctgctgtgcgtgcccccttcccttcattgccccaaagcctgcagtccagccccaggctcgggagctgctgcctcttccctgggatgtggaaggcacctgcatccccgcccagctgctgccacttgcctgcctccatcagcagctttgttttattttgtctgtgtgttttttgagatggagtcttgctctgtcgcccaggctggagtgcagtggcgtgatctcggctcacttcaacctccgcctcccaggttcaagcgattcttctgcctcagcctcctcagtagctgggattacaggcacccgccaccatgcctggctaatttttgtatttttagtagagatggggtttcaccatgttggccaggctagtctagaactcctgacctcaggtgatctgcccacctcagcctcccaaagtgctgggattacaggtgtgagccactgtgcccagcctccaccagcagcttttgaaatccagaaatttccaggggagggcactgtggtgggtggggcccagcgctgtgtccagctcgaggcctggctgcactgccacctcctttggtgcccacccctgtgtcttgccagcagctgctgcacattgggcttcggggatgcaggactccagcacccccagctcagcctgcttcctggaccaggaaccccagccgaggagggggcatttgtatctctgccatccctgctggcaactggtcctgagaaagcccagatggttggtgcagagggggcgtcaggggctgcaccaccctaagaacatgacatgtcaccccccagccccccgcaacacacacacacaggttcacacctcacacccctgatcttggcggctccctggagcacagcacccgcttcccgtgtctgtggttggcttatgacgccccagccactctaaccgggttaaggggagcccagagcctggggccggataggaaaaagcccagagaagtcaggggatggtcagtcccctgaagctgcccctgggggttcttgatcttctgaactgagttcgaggcaagccctggaggggcgaggaggagaaagaaacagctctctgggccaggacccgctgttcgtgggatgtctggggagctgtgtgaacccacaggccgttttgtttctctccatcagcagctgtgggctgaagcgtgtaccggcggagtgggttgagatcgtgtctgcgcccacttgccaccagctccggcctctggggaggtggtgctgagagggagggagagtggctcctgtttggctcctggagacagacagctgggtgtcccaccctcagagtccccagccccctctcccctctgctaactctgccggtggagctcacgccgcagctcatgccaaccctgcccttctgttttgcctctcatgactctccccaaattctgcccccaggcccccagccagccttcttgccactttcctgccctttactcttgccccttctacctcttgccagggcagcgtcactggctacgtgaggcccagcttggggatgcatggggaggtgtaagaacagctgtgccatgagctgtccttccgggcctctggggctggagaaaccccggggtcagcagtaccacgggttttgctggggattgcacagtgggtgaggctcagcttcctctttgcagctttctaaaaatgccctggttcccagcagggccacaggcagggaaaatgagtttcagtttctgtggcaagggagctggggagagaagcagtttccttgtccccagccctcaccctagcatcctgtgattcagccgcgaagacgtggccccaagcctcccaccgccctccttctgtcctgactgcccactcccagggacaccaggtgacgcctcgcccacccgcggctccggagccaggctggaagcagcttcccgcccagggggtggtttccccacatcctgtcttcagatggcttgagccccctaaacttcctggtcatatccagtggataataatggtctccctctttcctgtctggaggggagggggctgcttacttcttatccaagggcctgtcccgtcccacccctgtgtccccatttctggccacacgcaggctcagcccttgcatcaagcctctgcctgtttccctctgggctgcacctgtcacgctctccctgccctgccccataaagcccatagagcccagggcttgtggggactgcacccttcattagcaagactcagagcttctagaaacccacttgtgtgggggtggggagtgcagggagattggtggcaccaggtggagagagggaactgcacctgggggagttgggaggggcagtgggctgggcccgcgtggaggagtgtggcttgtacagtccgcatggcggggggacccttgtaccctgcctggactggctggtagagctgttggggacctccctgggggtggccttgcttacccagctgtgcggaacaggcttggttgggagtgcctggcctcaccctttgtggggaaaccagattctctgggcagcagtggtaaatggtgtctgagtctgtgtttcgttggatgtgtctgaggtccgctgctgccagctgggttatgctgtctccaaagctatctgcagtgggggaggccctgagcctgggcaggggagggtacagaggcctcaacccatgggacctgggggtgatctgaactctgcacttcactttttttcaggatttcccccgccccaccctaaaggaggaggaaatagagtctgtcccaccctaagccccagtccctctccccaggtctctttggcatctcccagctgggctggggctgaaggcccttctctggggttggccacagtgaggccaggatctggctgggcaggtggcagtgttccgcctgtgggctgggtgcggaggcgggcctgggggtcttagagagagagcggcggatgtgactgcgggccaggaggaagcctggtcccaggatgtcaccatttcccctgcagtgagcaagcatctctagggctcggagataagtgctgggtggggtagctccagctctccagcgcttttttctgtctggttcctgccatctggacttgagccatgaggaaggccagagtgggtctgacagtccccactcctttccccgctgagccccaaggaaggggctgggcctttgcacccccaccccaacttctgcacgagttggaggcagttgatctcaatggtggaaagtggctggtgcaaagtcatgcttccatactccatgtttaggcttcatgggtgtcaaagctgggccgtgaccttgtcccattccctcagagaagggaactgaggccagagggtggagctgctctcaggccgctgcccaggcctcttgtgctctgcggttcagatggcactcccgatgccaggctcctgcccaggaagacatgcccacccgccctggccctgtctctgctgtctggtgtcaggccacctctcttcgggacccccccccaactgattgccctggggctgaccaggctctcctctccctcagtgttgggttttgggagcctctctcatcaggaggttggcacagatgccagccatgcagcggatcctgggcaggggtctcagctgggatggcctggccttgggacagggaggctggctgggcagaaccctagaaccaaaagcggtgcctgtggtgggctagggagctaggtggggagtctagtggggagtctagtggggaggtccactagacactcgttctggcacagcatgcagcgtcctccatcctggccctgctgtgggtacggagccagcagggcaggagctctcagtggagccctccaaagagggctgcttcctggaccagctgcaggatgagggagaccccttctgtccagggctgacataggctgaccaccgccagccccaccctctcactagcttcccattcagttagccattgatgagggctcactgggtgcaggatcctgggctgcccggggttgggtaggggactcctacatgtaggtaaatccgcgagatgctggagagagcaggcaataaagtggttgattctctctggaggtgacattttactttcctagtagggcttggccaggcaggcaaggtggagcctggtgtgccaggcgcagcgcttcagatgagaggaggtgagagcttggggatggcacagggaagtgttttgtctggtgagggtgtggcagggagggcaggcctgaagggacctccagggaggtgtgatcagatctgggttccagaaagatcctacctgcttggcgaccttaactgagctggagtctggaggccccacccttgcacccagctgcttccactgcttgcctcccatcccccagtgccagttccccagggcagtgccctccccatgccctcttggtgtaccctggtcccaaaggaggccaagctatgaacttttcttgcagaggtcccaggtgaggctgttgtcctggagctgtccccagagcaggcttaggatgaggggacctagccacagcttcaaccgagtggggtcccggtgtggctgccagggctccttggcaccaacccagcccagtgggttgatctctgaggacctcgtcatactcagccgggcagtctgccctggggggtggggtcaggactccccagcacttcgggatggaaggaggcgaagccagcgctgctggactagccttaaagaagcgggagacatcctagctccgcctcaagatttctcctctgcacccagcattctgctccccaaatgtcccaaatatgcagggggtcaaggaacattgctcagtggaatcaatggggagcgtgggctactccccagcctctggtttgccccatagcagccccttgggcaccgctggggacccccaggcctctgaggagcttggtttggaaagcgctggaatgctggaccaagttccctctctggctccctgagagggggtcttctagccccagtcttagggcaagaggagcccgtcccctaggagcctccaggccctggagccagacatcgggcgtcctagctacaccctttcctggctatgtgagcttgggcaagttaccaaacccctctgagcctccattcaccatctacagaatggaagagacgctaatgtcaccctggaaggtgttttgaagggtaatgtgtgtaaagggccaaacaaggccccgcacagttaaggacttaaatcctgcccggccccgggagggcttccggcatcttggggttcccctcaaaggatggcctgggcaggacttcttaaaaacaaacaggcggctgggcgcggtggctcacgcctgtaatcccagcactttgggaggccgaggcaggcggatcacgaggtcaggggatcgagaccatcctggctaacatggtgaaaccccgtctctactaaaagtataaaaaattagccgggtgtggtggcgggcgtctgtagtcccagctcctccggaggctgaggcaggagaatggcgtgaacccgggaggcggtgcttgaagggagctgagatcatgccactgcactccagcctgggctacagagcgagactccatctcaaaaaaaaaaaaaaaacaggaatgcccctgggtttcgtgctttaaaatggttgattttatgttgtgtgacttttaagttcaataaattaccaatcaaagcaacaaaacacttccagatcatttgaactttgccttaagtatcagaaggcagttagtaattcctggactttgaatgttaaatatgtggggttcttttgttttgttttgttttgtttcgagacggagtcttgctctgtcacccaggctggagtgcagtggcgcgatctcggctcactgcaacctccatctcccgggttcaagtaactctcctgcctcagcctcccgagtagctgggattacaggcccaccacacccagctaattattttgttgtttttggttttggttttggttgtgagacagagtctcacactgtcatctgggctggagtacaatggcgcgatcttggctcactgcaacctccgcctcccatgtttaagtgattctcctgcctcagcctcctgagtagctgggattacaggcgcccgccaccacacccggctacttttttgtatttttagtagagatggggtttcactatgttggccagactggtctcgaactcctgacctcgtgatccaccctcctcagcctcccaaagtgctgggattacaggcgtgagccactgcacccagccccggctaatttttgtattcttagtagagacagggtttcaccatgttggccaggctggtctcgaactcttgacctcatgattcccccaccttggcctcccaaagtgctgggattacaggtgtgagcgcctgcaccctgcccaaaaatatgtggttttgtttgttttttgaggcagagtctccctctgtcgcccaggctggagtgtaatggcacaatctcggctcactgcaacctccgcctcccaggttcaagcaattctcctgcctcaacctcccgagtagctgggactaaaggtgtgcaccaccatacccagctaacttttgtatttttagtagagatgggtttttaccatgttggccaggccgatctcgaactcctgacctcaggtgatccacctgcctcagcctcccaaaatgctgggattacaggtgtgagctactgcccctggccgaaagttaaatgtttctgttctgttcaagtaatattgagaaaaataacaggggccatcttgactctaatgttctgctccaatcaggttcccagaccagaggactgttgttaggtgattggctgtgaacaccctgaggccagtgcccctcgctgcttggcactcggagatgcctgattagcacctttaatcccttaccagtgaggcaggtggaattggccccattttacagatggggagactgaggtgaggaaggttaaagcactcagtggtgggcatgccccctggagccggccctcctttcttccagctgtgagtacccaggaagctgcaccgtgtggcctggagctgtctatctgtccttccagccacctgtctgtccagccacccttccacagactgaggcttgacaccggagcatctgtacagagcaaggagaagacaagaacatgctctaaagcccttcacagcaagacccaggaagccgcgggcaaactcagactcgaaggtaggaagctgggcggccgggtggctggacccagggcgctggctgctgtgcccacgtccagatacctcctgcggggcccacgctctctgtctgaacagcggtggacagtgaatgaagaaagtcaattcagggagcgagagggaggaataagggcagggaagggacgggcgcggtggctcacgcctgtaatcccagcattttgggaggccgaggtgagtggatcacctgaggtcaggagttcgagactggcctggccaacatggcaaaaccccatctctactaaaaatacaaaaaatttagctgggcgtggtggtgcgcgcctgtagtcccagctacttgggaggctgaggcaggagaatcgctcgaacctgggaggcagaggttgcagtgagccaagatcatgccactgcactccagcctgggctgcagagtgagactacatctcaaaaaaaaaaaaaatttgccaggcatgctggctcacgcctgtaatccaagcactttgggaggccaaggcgggtggaggccaggagtttgagaccagcctgaccaacatggagaaacccagtctctactaaaaaatacaaaattagctgggcatggcggtgcatgcctgtaatcccaactactcgggaggctgaggcaggagaattgcttgaacccaggaggcggaggctgcagtgagctcagatcgtgccactgcactccagcctgggcaacaagaatgaaactcagtctcaaaaaaaaaaaaaaaaaaaaaaaggcaggaagcgaggtgggaccggcactgctcaaggtggggcaggagggcacttgaactgcaaccaggaggctgagaagagccagcccctcctctgtgtgatggtctgggacagagtgactggctcggacagaggcccaacattatggagcacctgcttcattgagagagaattcacacaccagtcgattcacccatttaaagtgtaccatcagtgtttttatttatttatttatattttgagacagggtctcactctgttacccaggctggagntacagtggcgcgatcacggttcactgcagcctcgaccttcctagctcaagccatccttctgcctcagcctcctgagtagctgggactatatgcacgcaccaccatatctggctaattttttaatttttttatacagatgggatctcactatgttgctcaggctggtcttgaactcctgggctcaagtgatcttcctgcctcagtctctcaaattgctgggattacaggcatgaaccaccgctcccaaccttcagtgattttgatatattcacagaggctgggcacagtggctcacacctgtaatctcagcactttctgagaggccgaagcaaacttgaggtaaggagttcgagactagcctggccaacatggtgaaaccccatctctactaaagatacaaacattacccaggcatggtggcttgcgcctgtagtcccagctactcgggagactgaggcaggagaatcgcttgaacctgggaagtggaggttggcagtgagccaaaatcgcaccactgcgctctagcctgggtgacagagcaagactctgtctcaaaaactatatgtgtgtgtgtgtgtgtgtgtgtgtgtgtgtgtgtgtgtacatatatatacatattcacagaattgtgccaccatcaccacagtttcagattgctttcatcaccccctaaagaaagcctgcaccctttagctgtcaccccctgcccagtccccaccttcccagtcctaagaaccactaccctgcttctgtctatagatttccctcttctattccgagctttcatatgaatggactcatgcagaggtggccatcgtgactggctcctgtccctggacacaatgttctcaaagctcgtccacgttgtagctttgttaggacttccttccttttgtggctgaaggatgctccattgtgtggctcaaccacattttatatttgtgccttcatctgctgacgggcgcttgtgctgttttcctgctccggctctgcagagccgtgctgccgggcacttcctgtccaggtttctgtgtggacacagtgcttcagtgtgtgaagccatctgctcattttttgttgttgtttgagacggagtctcactctgtcgcccaggctggaggcctggagtgcangtggcgagatctcggctcactgtaaccacaccccccgtcctgggttcaagtgattctcctgcctcagtctcccgaatagctgggactacagttgcccaccaccacacccagctcttttttttttttttttttttttgagacagagttttgctgttgttgcccaggctggagtgcaatggcgagatttcggctcaccgctaactccaccttccaggttcaagcgattctcctgcctcagcctcccgagtagctgggattacagggatgcaccaccatgcctggctaatgttttttgtatttttagtagagataggctttctccatgttggtcaggctggtctcgaactcccgacctcaggtgatccgcccgcctcggcctcccaaaatgctgggattacaggcatgagccaccgcgcccagcctaatttttgtatttttagtagagatggggtttcaccatgttggccaggctggtcttgaactcctggccttaggtgatccgcccacctcagcctcccaaaatgctgagattacaggcgtgagccactgtgcccggtgacatcatccactcatttgctcctccagacgcttctctggggaggaaccgttactctcccccttgtgcaggtcaggacttgggtgatgagttgtcaggtgactaacccgacagcaaatgcaagaccattggcccagtatgcgctgccggctccattgcttttgatcatgaaccccacccccagcagagcttggccagtttgagacaatgaggggcccaggaaagctgggtcaggggtaagcaagggcacaggaagagacgaagagaggtcctggaagtcccagtgagacgtttggactttgggtgagaacaggaaatcctgggagagagttgagcagggaagcaacaggtgtgatctatgcttttgggaggtgaccccagctgcggtgcggagaatgatcagtctcagggggcttgaggcagcaggtagaggaattgagagagtggagtgagcctccaggtgaggagatggtggaggtgaggtggagatggtggaggtgaggtagagatggaggaggaggacaggttcagatggctgctgtctcgccgacccgtgcatgccacgcctcagcccacacacgcccttggctgaagggctcccagggagatgggtatggagtccctggcttcgtacaaggagaggaaaaacaaaacttgcccaggaaccttgggatgtgaaggagaggaaacagctgggggggtttatttttatttttatttttatttttgagacgaagtttcgctcttgttgcccaggctggagtgcaatggtgcaatctcggctcactgcaacctctgcctcccgggttcaagcaattctcctacctcagcctcccgagtagctgagattacaggcatgcgccaccacacccagctaattttttgtatttttagtagagacggggtttctccatgttggtcatgctggtctcgaactcccgacctcaggtgatctgcccaccttggcctcccaaagtgctgggagtacaggcatgagccaccgcgcccggccacagctgggggttttaacaagaagacggtcatggggcagagcaagagacgaaacgaagagaatgaaacaggcagagggtgttaattctggtggagtcagaggggaactggggactggtggcacacgcacaggaaagccccagatggggtactgggcaacagccactgaaatttgggatgtacttactcttcaacccagccattctgcttccagaacttggtcttgtaatagttaaacaagcacacgcggtgtatgcaagggtgttagttgcaacatcagacccatgtctcaaattccggaaacatcctaaataaccagcagtctggacttaagtaaatcttggtgcattccacttatgaaatctttgcattcatcaaaaaagacaagaggcctagggccgggtgtggtggctgaaacctgtaatcccagcactttgggaggccgaggcaggtggatcacctgaggtcaggagttcgagaccagcctgaccaacatggagaaaccccatctctactaaaaatacaaaattagctgggcgtggtggcgcatgcccgtaatccaagcttcttgggaggctgagacaggagaatcacttgaacctgggaggtggaggttgccgtgagccgagatcgcgccactgcactccaatctgggtgacagaatgagaaccccatcacaaaaaaaaagaaaaaagaaaaaaagtaggtctgtccgtatgtgttcacagggaaagatgtctacaatgcaggtaaaatgatagagtgtgggctgggcttggtggctcacgcccataaccccggctacttgggaggctgaggcaagagaagcgcttgaacctgggaggtggagggtgcaatgagattggctcacagcaatctcttcctctcgggttcaagtgattctcctgcctcagcctcccgagtagctggaactacaggaatgaggcactatgcctggctaatttttgtattttagtagagatggtgtttcactgtgttggccaggctagtctcgaactcctgaccttaagtgatccatccaccttggtctcccaaagtgttgggattgtacgtgtaagccaccacacacagctgtgtgattttttttttttttcaatgagcatatgccacttttattgttaaacagtgttctcactatgggggagaaaagtgccagacaggtggcagtttcagttatcttttttttttgagacattttctcactctgtcgcccaggctggagtgcagtggcatgatcttggctcactgcaacctctgcctcctgggttcaagcaattctcgtgcctcagcctcccaagtagctgggattataggcatgcgccaccacacctggctaattttgtatttttagtagagacagggttttaccatgttggccaggctggtctcaaactcctgacctcaggtgatccacctacctcggcctcccaaagtgctgggattacaggcatgagccacgcacccagccagttttagttatctttgaaaaatgaactggggctgggcacagtgagcttgcacctgtaatcccagcacttgggaggccaaggcaggcagatggcttaagcccaggagttccagaccagcctggctaacatggagagacccccacctctacagaaaaaagacaagaaaaataaactgggtggccttgggggacagggaccagcacagtaggtttctcatctctcggcccacctcggcctccccaagtgctggtattacaggtgtgagccaccgtccctggcctgcatcttcatgctcttttcagggtttggttcttgcctcaagcggagagatcagaaattgaatgaggtagtaagttgaggacctcccagacccatatggtccgggatgcaaatgatggtcagaaatagacctcactccaaccactgggcctgaggttcagcctggttcaggctgggtttagtccccagggatggtttgtttttggttttgtgtgtgtgtgtgtgtgtgtgtgtgtgtgtgtgtgtgtgtgtgtgtgtgttttcagacagagtcttgctctgtcgccaggctggagtgcagtggcgcgatctcggcttactataaccgctgcctcctgggttcaagccatcctgcctcagcctcccgagtagctgggattacaggcacgtgccaccacgcctagctaattttttgtatttttagtagagacggggtttcaccatgttggccaggatggtctcgatctcctgacctcgtgatccccccacctcggcctcccaaagtgctgggattacaggcgtgagccaccgcgcccagccgcccagagatgtttgaaccaactttaggcaagttggttcttggtctgggctgcgtgccctggcgtcagggtcctgacactgcgccaccccgcaccgcccaccgctgctctcccggtctccattccagccctcccgcctcctgcccacaatggcctctgctgacaagaatggcgggagcgtgtcctctgtgtccagcagccgcctgcagagccggaagccacccaacctctccatcaccatcccgccacccgagaaagagacccaggcccctggcgagcaggacagcatgctgcctgaggtaagggggctggcctgggggctcactgttctgccgtaggtaacagatgtacccacgtgacactttctggtcagtttcacttcccagaggggctccttcctgagccacagctgctgtctgtgcagcccttgactcgggccctaccccctccttcctgggcccgaaatatcacagggagtaaagccaggaaccgggctcactctcatcgtggtcaggggcacacaggaagggccagccccaagaaagtgcttgctggtaaccctggggccctggctgttctcatttcaccccctaggcctggactctcagtctctcttctgagggctgggggctttctttgacatgggtgagcaggggacagtgtctccctggcatcagcagcccgcctaggcagtgtccgcttcctttgggaggacgagaacagatcagtgtttctgacagtctggtctagtgccccataaagagctcattgaaaaccggcttgtggcagcgtgggcttcctgcacagtctggagtataaagggaagcgatgttaacgccccccgttcacccgagagctctgcagaagacacagcagcaggcaggagcgtcatggtgcagaggggagggactggatgaggagttaggaaaacacacgctggccttgacggagaaaagttagacaatggcgattttaaattcagaatgaggctgggcgaggtcgcctcatgcctgtaatctcatcactttgggaggctgaggcagccagatcacttgagcccaggagttcgagaccagactagacaacatagcaagactctgtctctgcaaaaaaaattaaaaaagagctgggtgtggtggcacatgcctgtaatcccagctacttaggacactgaggtagaaggcttgcttgagcctgggaggtcgaggctccagtgagctatgatggtgccactgccctccaacctgggcaacagagcaagactctgtcccaaaaaatatatatataggccgggcatggtagctcatgcctgtaatcccagcactttgggaggccgaggcggccagatcacttgaggtcaggcaggagttcgagaccagcctggccaacatggtgaaaccccgtctctactaaaaatacaaaaattagccgggtgtggtggcacatgcctatagtcccagctactcaggaggctgaggcagaagaatcgcttgaacctgggaggcggaggtgtcagtgagtcgagaccacaccactgcactccagcctggacaatacagtgagattccatctccaaaaaaaaaaaaaaaaaaaaaaaaaaaatatatatatatatatatatacatatacaaacacacacacacacacacacacacacacacacacattatatatatatatttccaaatgaaagcaaattggggcataaatcagggttgaagtttgttctcagggttttcagaataggaggctaaagaaaagccagcccaggacctgggctgcacacaccaccgcctgccctccctccttcctccccaagaggaagaacccagcctacttgaagagcgtcagcctccaggagccacgcagccgatggcaggagagttcagagaagcgccctggcttccgccgccaggcctcactgtcccagagcatccgcaagtgagcccccctacacccaagcccagcaccccccacccagcaacctgtggattctcggggcctggacatgattgggcctggtccctgcgtcccctctctggaaggaggaggccggcattaatgagcaatgtctccctgtggcctattatcatggtatagatggggaaatgggtatgtgctttgcggaatatcacggtgtggaggctggggggcttcgaggagctgggtggatcagtgtgggggtgcctggggccctagcctggctcctcacgctcccgtcatcccctgcttctgctcatctggtcactgggctccagccaggggcctcacaggcagatccgccccccacctccctgtaggcacgcgggcacacacgtgccatcaccccttccacacactcaggtgcacaggcgtagacaagcgtatgcccacctgtcccttgtctgcttccgcaggggcgcagcccagtggtttggagtcagcggcgactgggaggggcagcggcagcagtggcagcgccgcagcctgcaccactgcagcatgcgctacggccgcctgaaggcctcgtgccagcgtgacctggagctccccagccaggaggcaccgtccttccagggcactgagtccccaaagccctgcaagatgcccaaggtgggatccatggggaaaggaggcaggggtggggaccctaatggctctgcttaccgcccccctcccttccagattgtggatccgctggcccggggccgggccttccgccacccggaggagatggacaggccccacgccccgcacccaccgctgacccccggagtcctgtccctcacctccttcaccagtgtccgttctggctactcccacctgccacgccgcaagagaatgtctgtggcccacatgagcttgcaagctgccgctgccctcctcaaggtgcggggctccctcctgcagggcccccacctctgcccggcctcccttccttgcccctcccttccactcctcatagtagcatcccctaaagctcacctgggcatctgcctacggtgccaaggacagtggatgtgctgggatccctgggcaaagagggaccccgaagcccagcacccaggcgtccatccttctgtcttaaatctcgtgtgaccccctgccaagttttggaacctggtctctgcactgactcttaagctggggaagtgggaagtgagatgcatacttgctcctcatccacccgggttttccaagtccctgttacgtgctgggcaccgcgtgcagagccatcgccatcctggctgagctcgcagcccagggtgagggtcaccattcagggtggtcagtttaggagagcggctgttatcagggaagacattgagttaagcccagaagacacaaggagacgttcactagggaaggaagggaacagcattctcagcagagggaatggcctatgcaagggccaggagcccagaggaagtacagtgctttgagggggcagcaggcggtttgatgtggttttagtgaagggtggttataggagctgtggcaggagatggggtcagaaaggtgggcagggacctggtattccgtgccaagaaacagggacagggagacatggcccaagcctcgggagtgagggtatagaatgtgggttgctttgagtgttagggtaccagcagcccaaggcagaggggcagcagggaccaagggaaaggtgactccaaactgtgccaagagtggtgtgccaacggaagctggtgtctcatttcctggccttccagtctcaggagctcctcttgcccgttcagcttgcagaatctccacgctttgggcaggatccctcctcccaaggcgctgcctgcaggcggatgggcttgatgattccttcggtgttggggctgggggcctaggtggccaggctgtggtcctgatggctgtgcctctgcccgtgcacaggggcgctcggtgctggatgccaccggacagcggtgccgggtggtcaagcgcagctttgccttcccgagcttcctggaggaggatgtggtcgatggggcagacacgtttgactcctccttttttagtaaggcaagcatggggtgtgggacagcaggagttgggtggggtggcctgggagctgggtgaggtgaccttggcattgatcatattcaggaacccctgagggacccagaggcccactgctgggatgtggcatggtcctatgtggagctgctgggcccccatctttctgttgggtagggtgaagacctgcggtggggcacagtgccacccgggaaagtcaccattggggctgacgggcatgtggcttcccaattcattgtgaagagcccgtctgttcagctgtgtcctgcccttgaattgaggttccggggggcagtgtttgggacagactccttacactgtattttcttgtcccccaccccaggaagaaatgagctccatgcctgatgatgtctttgagtcccccccactctctgccagctacttccgagggatcccacactcagcctcccctgtctcccccgatggggtgcaaatccctctgtgagtgctggggcagagtccctcctccaggccagccaccagcctgggggcatccccagacctcaccctggcccccaagccccttctgagcaccctggtggggtctgggagtattttggtgggggattcaggctgaaagccaccatccccaccaggaaggagtatggccgagccccagtccccgggccccggcgcggcaagcgcatcgcctccaaggtgaagcactttgcctttgatcggaagaagcggcactacggcctcggcgtggtgggcaactggctgaaccgcagctaccgccgcagcatcagcagcactgtgcagcggcagctggagagcttcgacagccaccggtgaggtgtcgccctggagcccccaggagagcctggaaggttccaaattcctctgggccctcctgaagcgcccccttactcattcagcaagtgtttcatgagcatcttctgcggatcaggagtgtagtgacaagctcgaaggcgcaccctgtcccaagggttgtgcacatgacctgggaagggccaggggtgcttgctgcctctcttccaccccatgctttctgagcctggtccccagccttgctcccagacagcagtcagtcaacaaatgttcattgagtgtcactgcctgcaggccctaaaatggaacccccagagggtggagcagggagggcagggtcggtcagaggacagttagaagctggggccagggctgggcgccgtggctcacacttgtaattatagcactttgggaggctgagtcagaaggattgcttgagcctaggagtttgagaccagcctgggcaacatagtgagaccctacctctactttaaaagaagaagctggggctgggagggaggggactctgggagaggctatgcagagcccttggggaagaacagggcatctgatttgcagcagcccaataaacactgggcccaaattagaaaataacaagcaggcagggcgcggtggctcacgcctgtaattccagcactttctgaggccgaggcaggcggatcacctgaggtcaggagttcaagaccagcctggccaacatggtgaaaccccatctctactaaaaatacaaaaaattagccgggcgtggtggtgcatgcctgtaatcccagctactcgggaggcttgaggcaggagaatcacttgaacctgggaggcagaggttgcagtgagccaggatcgcaccattgtactccagcctgggcaacaagagcgaaattccatctcaaaaaaaaaagaaagaaaagaaaaagaaaataacaagcaatggccaggcccggtggctcacacctgtaatcccagcacttcgggaggcctaggtgggcagatcacctgaggtcaggagttcgagaccagcctggccaacacagtgaaaactggtctctactaaaaagacaaacaaaattaggcaggtatggtgggtgcttgtaatcccagctacgagggaggctgaggcaggagaatcgcttgaacctgggggcgaaggttgcagtgagctgagatcgcacaactgcattccagcctaggtgacagagcgagactctgtctcaaaaaaaaaaaaagaaaagaaaagaacaagcaatgataggtgtggtgggtgtcccggaggaggatagagagggagagtgaacagctggtggggaggggtgcagtcaggacaaactgtgatgtcatgtgcaaaggccctggggctggaagggcaaagtacatcccaggaaatgcaggcaaagaggccagagaggtggtcggtcaggcaaagctttgcagccagcaagagggggtgattctggaatttgtcccaaggccagtggaaagctatcaaaaggttttaagctaggagagagatgcttggaggctcgtcttaaaagttcctctggtttgagatgagttgacggggcagaacagggagcccaggcgagccatgtgaccaggccagggtggccctgtggccgggactgggggttgggataggagctcggctcagctgacccgaggtgtctctgcacaggccctacttcacctactggctgaccttcgtccatgtcatcatcacgctgctggtgatttgcacgtatggcatcgcacccgtgggctttgcccagcacgtcaccacccagctggtgagtcgggtcaggctccatgctgggggtcccagcctctcctaggaggcctcagtgtcgtgggtacctaatccctcccaccgcaacaatctggccccagcagggtggtgctcaccatagcctggccccttcctggaggctctatcctggggacagctgccccagctccccatgcccagggcccacactgttctgacgccctcctctgtgctacctccacgataggtgctgcggaacaaaggtgtgtacgagagcgtgaagtacatccagcaggagaacttctgggttggccccagctcggtgagggcccaggctgggggacatcatctgagccaggagtccctgtgccctgtcactcccagctgggcaggtgggctcctcacccacccgcaggcccctcatcaggggagactctgcggggcagaggtggagtgatggacccctcccaggtctggggctcaaactcactctctcccctccctttcccttccccagattgacctgatccacctgggggccaagttctcaccctgcatccggaaggacgggcagatcgagcagctggtgctgcgcgagcgagacctggagcgggactcaggctgctgtgtccagaatgaccactccggatgcatccagacccagcggaaggactgctcggtgggggcaggccctccctcctacccctgccagaccctggtcccggactagctccacttgccctgtccttcaagggcagtgaccacgttccctcctccccgccccacctttcccagacccccatagatgagactgagccctggggagatgggaaaagcctctgtccttgcccactccagtgggggtgacctggccccgacatgacccaccagccttcttctgccctccaggagactttggccacttttgtcaagtggcaggatgacactgggccccccatggacaagtctgatctgggccagaagcggacttcgggggctgtctgccaccaggaccccaggtagggcctggagcctctgctgggcctcagggtcaggcatagccatgccatctgagccacccacagggacgtgggtaggtggacgtggcacgctgggtgtgccacagcccaatctgaaccctgtctccaggacctgcgaggagccagcctccagcggtgcccacatctggcccgatgacatcactaagtggccggtgagtgtccctggcggggagtggtctgggaaggtcagggatgggggacctgcctgctgcacagcccacttccctgccggtgccccctcctggcagatctgcacagagcaggccaggagcaaccacacaggcttcctgcacatggactgcgagatcaagggccgcccctgctgcatcggcaccaagggcaggtgagcgacctgggccctggcctcagccatcccactgcccccccgagctgcggcttcctgtgggccctctgctcctccaccgtcaccacccacagccgctgggccgatgccctccaataactgtcctttgctcccctgctctggggctacccatggtgcgagctggaggaaggaagcttgctccagagtcgaaggttctggatgcggcatcccccttcctgccagcgatgcctcctgtagccaggtgctgggctctgggcaaaggtgggcagtggttattcggcgccctgatgtcccctcttgcctcaccacccccttagctgtgagatcaccacccgggaatactgtgagttcatgcacggctatttccatgaggaagcaacactctgctcccaggtgaggcgaggcaggcctggagtagtggaggagaggacgctgggcatggcagcctgctggggccggggctcacgcactccctcccatgtcggagcctcagactcagcctgcttctggggcgctgagcaccatatgcccactcccaggtgcactgcttggacaaggtgtgtgggctgctgcccttcctcaaccctgaggtcccagatcagttctacaggctctggctgtctctcttcctacatgctgggtaagaggctcctcactgcccccgaacccgacccctgtgatggccacccagccggacccctggggaaaggttcctgggccagggcatggccggcccaacctgccgaagcctactgctcctgaagtgcctggctgaaggccgctgcctggtgtgtccctcccccagcgtggtgcactgcctcgtgtctgtggtctttcaaatgaccatcctgagggacctggagaagctggccggctggcaccgtatcgccatcatcttcatcctcagtggcatcacaggcaacctcgccagtgccatctttctcccataccgggcagaggtaaggatgtggaggatgggaccccttccgcacatagggggccagccctgctgctcctattccacccacctgggatctgccagagggacacggtgcccctcctgtactgggctccacagcggagggacagctaatctgggggcttactggctggtctcttaatcccagtgagagggaacagtgatgctcttgagtcaccctgtccctccaccgcctcatttatcttcctaaccgtgcccactgcctgacagtatgctaggtatctgcaggtcgagcggtaggaaatggcctccgtgcgccgtcggcagtctgatcagttccacctgactgatctagtttgttcagtgtccgtcctctccccaccgtgtgcggcctggaacaggcttgtctgtcttgcttattgctacggacccacaccaggcacgtacacagtaggcgctcagtgtttgctgaaagaatgggcggagcaggcccagctttggtccagcagctccagccgaccccctgcccctcagcctcaggggtccccatgcctgccagggaggagctgatcgatgggatgacccagggtgcaggcccggcccaggccacccacctgatgcctgaagccacgtctcccctgccccgccccaggtgggcccggccggctcacagttcggcctcctcgcctgcctcttcgtggagctcttccagagctggccgctgctggagaggccctggaaggccttcctcaacctctcggccatcgtgctcttcctgttcatctgtggcctcctgccctggatcgacaacatcgcccacatcttcggcttcctcagtggcctgctgctggccttcgccttcctgccctacatcaccttcggcaccagcgacaagtaccgcaagcgggcactcatcctggtgtcactgctggcctttgccggcctcttcgccgccctcgtgctgtggctgtacatctaccccattaactggccctggatcgagcacctcacctgcttccccttcaccagccgcttctgcgagaagtatgagctggaccaggtgctgcactgaccgctgggccacacggctgcccctcagccctgctggaacagggtctgcctgcgagggctgccctctgcagagcgctctctgtgtgccagagagccagagacccaagacagggcccgggctctggacctgggtgcccccctgccaggcgaggctgactccgcgtgagatggttggttaaggcggggtttttctggggcgtgaggcctgtgagatcctgacccaagctcaggcacacccaaggcacctgcctctctgagtcttgggtctcagttcctaatatcccgctccttgctgagaccatctcctggggcagggtccttttcttcccaggtcctcagcgctgcctctgctggtgccttctcccccactactactggagcgtgcccttgctggggacgtggctgtgccctcagttgcccccagggctgggtgcccaccatgccccttcctctttctcctcctacctctgccctgtgagcccatccataaggctctcagatgggacattgtgggaaaggctttggccatggtctgggggcagagaacaaggggggagacacaagtagacctcaggtagaacgacactgggcggagccaccccagggcctgctcccagggagtgctcgaggcgcatcaggcccgttttttaccagtttatatcacggtcttcatttttaaaagtaacgctaactttgtacggacgatgtctcatggattaaataatattctttatggcagtaca

SEQ ID NO: 11689 - DNA, 6347 bp, Homo sapiens
ccgagggatcccacactcagcctcccctgtctcccccgatggggtgcaaatccctctgtgagtgctggggcagagtccctcctccaggccagccaccagcctgggggcatccccagacctcaccctggcccccaagccccttctgagcaccctggtggggtctgggagtattttggtgggggattcaggctgaaagccaccatccccaccaggaaggagtatggccgagccccagtccccgggccccggcgcggcaagcgcatcgcctccaaggtgaagcactttgcctttgatcggaagaagcggcactacggcctcggcgtggtgggcaactggctgaaccgcagctaccgccgcagcatcagcagcactgtgcagcggcagctggagagcttcgacagccaccggtgaggtgtcgccctggagcccccaggagagcctggaaggttccaaattcctctgggccctcctgaagcgcccccttactcattcagcaagtgtttcatgagcatcttctgcggatcaggagtgtagtgacaagctcgaaggcgcaccctgtcccaagggttgtgcacatgacctgggaagggccaggggtgcttgctgcctctcttccaccccatgctttctgagcctggtccccagccttgctcccagacagcagtcagtcaacaaatgttcattgagtgtcactgcctgcaggccctaaaatggaacccccagagggtggagcagggagggcagggtcggtcagaggacagttagaagctggggccagggctgggcgccgtggctcacacttgtaattatagcactttgggaggctgagtcagaaggattgcttgagcctaggagtttgagaccagcctgggcaacatagtgagaccctacctctactttaaaagaagaagctggggctgggagggaggggactctgggagaggctatgcagagcccttggggaagaacagggcatctgatttgcagcagcccaataaacactgggcccaaattagaaaataacaagcaggcagggcgcggtggctcacgcctgtaattccagcactttctgaggccgaggcaggcggatcaccctgaggtcaggagttcaagaccagcctggccaacatggtgaaaccccatctctactaaaaatacaaaaaattagccgggcgtggtggtgcatgcctgtaatcccagctactcgggaggcttgaggcaggagaatcacttgaacctgggaggcagaggttgcagtgagccaggatcgcaccattgtactccagcctgggcaacaagagcgaaattccatctcaaaaaaaaaagaaagaaaagaaaaagaaaataacaagcaatggccaggcccggtggctcacacctgtaatcccagcacttcgggaggcctaggtgggcagatcacctgaggtcaggagttcgagaccagcctggccaacacagtgaaaactggtctctactaaaaagacaaacaaaattaggcaggtatggtgggtgcttgtaatcccagctacgagggaggctgaggcaggagaatcgcttgaacctgggggcgaaggttgcagtgagctgagatcgcacaactgcattccagcctaggtgacagagcgagactctgtctcaaaaaaaaaaaaagaaaagaaaagaacaagcaatgataggtgtggtgggtgtcccggaggaggatagagagggagagtgaacagctggtggggaggggtgcagtcaggacaaactgtgatgtcatgtgcaaaggccctggggctggaagggcaaagtacatcccaggaaatgcaggcaaagaggccagagaggtggtcggtcaggcaaagctttgcagccagcaagagggggtgattctggaatttgtcccaaggccagtggaaagctatcaaaaggttttaagctaggagagagatgcttggaggctcgtcttaaaagttcctctggtttgagatgagttgacggggcagaacagggagcccaggcgagccatgtgaccaggccagggtggccctgtggccgggactgggggttgggataggagctcggctcagctgacccgaggtgtctctgcacaggccctacttcacctactggctgaccttcgtccatgtcatcatcacgctgctggtgatttgcacgtatggcatcgcacccgtgggctttgcccagcacgtcaccacccagctggtgagtcgggtcaggctccatgctgggggtcccagcctctcctaggaggcctcagtgtcgtgggtacctaatccctcccaccgcaacaatctggccccagcagggtggtgctcaccatagcctggccccttcctggaggctctatcctggggacagctgccccagctccccatgcccagggcccacactgttctgacgccctcctctgtgctacctccacgataggtgctgcggaacaaaggtgtgtacgagagcgtgaagtacatccagcaggagaacttctgggttggccccagctcggtgagggcccaggctgggggacatcatctgagccaggagtccctgtgccctgtcactcccagctgggcaggtgggctcctcacccacccgcaggcccctcatcaggggagactctgcggggcagaggtggagtgatggacccctcccaggtctggggctcaaactcactctctcccctccctttcccttccccagattgacctgatccacctgggggccaagttctcaccctgcatccggaaggacgggcagatcgagcagctggtgctgcgcgagcgagacctggagcgggactcaggctgctgtgtccagaatgaccactccggatgcatccagacccagcggaaggactgctcggtgggggcaggccctccctcctacccctgccagaccctggtcccggactagctccacttgccctgtccttcaagggcagtgaccacgttccctcctccccgccccacctttcccagacccccatagatgagactgagccctggggagatgggaaaagcctctgtccttgcccactccagtgggggtgacctggccccgacatgacccaccagccttcttctgccctccaggagactttggccacttttgtcaagtggcaggatgacactgggccccccatggacaagtctgatctgggccagaagcggacttcgggggctgtctgccaccaggaccccaggtagggcctggagcctctgctgggcctcagggtcaggcatagccatgccatctgagccacccacagggacgtgggtaggtggacgtggcacgctgggtgtgccacagcccaatctgaaccctgtctccaggacctgcgaggagccagcctccagcggtgcccacatctggcccgatgacatcactaagtggccggtgagtgtccctggcggggagtggtctgggaaggtcagggatgggggacctgcctgctgcacagcccacttccctgccggtgccccctcctggcagatctgcacagagcaggccaggagcaaccacacaggcttcctgcacatggactgcgagatcaagggccgcccctgctgcatcggcaccaagggcaggtgagcgacctgggccctggcctcagccatcccactgcccccccgagctgcggcttcctgtgggccctctgctcctccaccgtcaccacccacagccgctgggccgatgccctccaataactgtcctttgctcccctgctctggggctacccatggtgcgagctggaggaaggaagcttgctccagagtcgaaggttctggatgcggcatcccccttcctgccagcgatgcctcctgtagccaggtgctgggctctgggcaaaggtgggcagtggttattcggcgccctgatgtcccctcttgcctcaccacccccttagctgtgagatcaccacccgggaatactgtgagttcatgcacggctatttccatgaggaagcaacactctgctcccaggtgaggcgaggcaggcctggagtagtggaggagaggacgctgggcatggcagcctgctggggccggggctcacgcactccctcccatgtcggagcctcagactcagcctgcttctggggcgctgagcaccatatgcccactcccaggtgcactgcttggacaaggtgtgtgggctgctgcccttcctcaaccctgaggtcccagatcagttctacaggctctggctgtctctcttcctacatgctgggtaagaggctcctcactgcccccgaacccgacccctgtgatggccacccagccggacccctggggaaaggttcctgggccagggcatggccggcccaacctgccgaagcctactgctcctgaagtgcctggctgaaggccgctgcctggtgtgtccctcccccagcgtggtgcactgcctcgtgtctgtggtctttcaaatgaccatcctgagggacctggagaagctggccggctggcaccgtatcgccatcatcttcatcctcagtggcatcacaggcaacctcgccagtgccatctttctcccataccgggcagaggtaaggatgtggaggatgggaccccttccgcacatagggggccagccctgctgctcctattccacccacctgggatctgccagagggacacggtgcccctcctgtactgggctccacagcggagggacagctaatctgggggcttactggctggtctcttaatcccagtgagagggaacagtgatgctcttgagtcaccctgtccctccaccgccccatttatcttcctaaccgtgcccactgcctgacagtatgctaggtatctgcaggtcgagcggtaggaaatggcctccgtgcgccgtcggcagtctgatcagttccacctgactgatctagtttgttcagtgtccgtcctctccccaccgtgtgcggcctggaacaggcttgtctgtcttgcttattgctacggacccacaccaggcacgtacacagtaggcgctcagtgtttgctgaaagaatgggcggagcaggcccagctttggtccagcagctccagccgaccccctgcccctcagcctcaggggtccccatgcctgccagggaggagctgatcgatgggatgacccagggtgcaggcccggcccaggccacccacctgatgcctgaagccacgtctcccctgccccgccccaggtgggcccggccggctcacagttcggcctcctcgcctgcctcttcgtggagctcttccagagctggccgctgctggagaggccctggaaggccttcctcaacctctcggccatcgtgctcttcctgttcatctgtggcctcctgccctggatcgacaacatcgcccacatcttcggcttcctcagtggcctgctgctggccttcgccttcctgccctacatcaccttcggcaccagcgacaagtaccgcaagcgggcactcatcctggtgtcactgctggcctttgccggcctcttcgccgccctcgtgctgtggctgtacatctaccccattaactggccctggatcgagcacctcacctgcttccccttcaccagccgcttctgcgagaagtatgagctggaccaggtgctgcactgaccgctgggccacacggctgcccctcagccctgctggaacagggtctgcctgcgagggctgccctctgcagagcgctctctgtgtgccagagagccagagacccaagacagggcccgggctctggacctgggtgcccccctgccaggcgaggctgactccgcgtgagatggttggttaaggcggggtttttctggggcgtgaggcctgtgagatcctgacccaagctcaggcacacccaaggcacctgcctctctgagtcttgggtctcagttcctaatatcccgctccttgctgagaccatctcctggggcagggtccttttcttcccaggtcctcagcgctgcctctgctggtgccttctcccccactactactggagcgtgcccttgctggggacgtggctgtgccctcagttgcccccagggctgggtgcccaccatgccccttcctctttctcctcctacctctgccctgtgagcccatccataaggctctcagatgggacattgtgggaaaggctttggccatggtctgggggcagagaacaaggggggagacacaagtagacctcaggtagaacgacactgggcggagccaccccagggcctgctcccagggagtgctcgaggcgcatcaggcccgttttttaccagtttatatcacggtcttcatttttaaaagtaacgctaactttgtagggacgatgtctcatggattaaataatattctttatggcagtaca

SEQ ID NO: 11690 - DNA, 2565 bp, Homo sapiens
ccgtgagaagccaccttatctcctctttatttagccctgctctctccactctctggaaactgctgtctccatgctcagctgagctaagaggagcccagggcagagacggggatcatgttggcagccaggtgggcagcccagttcagcagccgctgttcctgcgcaggaaggggtggccccgcagggagcagtggagctccatgaaggtgagggagcccacggtgatggcgcaggggcccacggcgtggaagctgaacctctcatagaagggtaccagcgcgtcctcgcacatgagcgcggcccggcgcacggccggctggctgcccaggtggtgcaggtagcgccacagcaggatggggcccctgccctgctgccggaaggcgcggtgcacggccagcacatgcaggtgggctatgtggcccccagacctgtgcagcgtcagtgactcctgggagcgagcaagggatgagatcccaggtcacttctgctgacacgtgctcccccccaaccaccaacccaggcagggagcaggtgtcccctgggtgcctgtggtcagggcacccaccccagcaaaggagggccccaaattgggagccatacccccaaccccatggagaaaacttgaagacccagaaggtcttgctctgggaggggcctgtggcctgtactcatctctccagttctggaggaagaaatcccagcccctgggctcccctccccgccatctggctgacctctgtcttcagaggcctccctggagctgggcgtcgcagccctgtcctcacctgcatgagtctctccttgtcccagagcgagccgatgatgaaggccacaaggcagccctcctcgaaccagcccagggacagctctggacatagggtcaggaagtgccggatctcatccaggtacagggggcagacgcccaagacggagatgaaggctgtggcaggaggctcaggtgggtgactggtagtcgctgtgcctcgcgtccactgtctgctgcaccccgagtgtccactcagatgccccgttccccacaggaaaatgggggttagggctgctgtttcccccactttcttgagcgcacacatggtctgatactctgggacccagcctccaaggacaggagactaagggtctcctccccacaggataactggaccagagtggagcatccctctgaccctgtgcggggccactcaccttcacgctcgatctcaaaggcgctgacagcgtcctccggggtgaggcagcgaaactcactggcagggagtgtgtggcgccgctgacagctcggggactcggggatcccaggtggcagacgtggggcctcaggtttcagggggtgggtgctctgcgtggacattctggccactggtgcctccttggggcgccccagctttggaagtgtcctcctaagccaaggagggcctcccagcacctgttggagaacagcaagggacaggggtctcatcctcatctccagggaggcaggccccagagtatgtatctggcctcttttgtagcaggaactggggtggagacagcccctaaatcaatgggcacattccccaggtacctggtccccgaggctgttaccaggcattgcaaacattggcactgtctccccacctttccctctcagccagaaggatccctggaggtttgccaccttgcagacctgcagacattggtctcagggtgccgtctgggtgcttctgagccccagagatggtggcagggatgagcagggctcagtggagcctggggcaccccaaccctgctgcccacggtgggaggggaggcaggactcgtgaccctccactgaccacgtctaatgcaactgtgcagtgggtgggcgcccggttcccccacaccaccattcatgtggtttatcttacctccccagagggaggcttctggtcctttgggtgcaagatcctgtggcagagagctttttaggtagcctcagcccttggtcctagagagccccttaatcaaagtgggcccttagggagcctctacttctatccagatggcctcagactgggccacacacatgcaggatttgtggtggggggtggggaggttagagggagccgggggctgcagagggcctggggaatggggaggagcaggcaaggagagtgcataggacaccccctgccccacacatccagctcatcagacattcccctctgggcactcttgtctcccaagacaccctgcagatttgcagttcttagaggaggccatccctccctccaccttccaagacacttaataaactccatggcttccatgtttccctccatgtctagaagctccaagtagagaagctcctgttcctaaaggctgagagccaggagtgggggtcccacctacctggactgtggagaggatacccagtgttccctccacaaagccgctagccctgggggcctgtccgcaggcacgggaaccagtaaaatccgggactccgggctgcaaggctgtagtagcagatgttccccgggcagcctgtggtgctgttagaggtttgtaatccccccaccccacctctcg

SEQ ID NO: 11691 - DNA, 2565 bp, Homo sapiens; identical to SEQ ID NO: 11690

SEQ ID NO: 11692 - DNA, 7675 bp, Homo sapiens
ggaggaggtggctccagagatggcagtgagcgagaggagggggctcggccgcgggagccccgcggagtgggggcagcggctacttctggtgctgctgttgggtggctgctccgggcgcatccaccggctggcgctgacggtgaggcccgccgcgcgagggtctggggtcgggggcgcaactttgtctcggagaagccccctggcttggagtggtctcgtccgccctcccccgtccccgagacggtggagtggtccggcgccccccgtttccgggcccggagtggtctcgtcccgggatccccttcggtcctccggatggagttgccgggtccgcctcgctggggtcggccccctcccttcgggggcggggctccatctcttggggactacaccccccttccccccaactgggtcttagtcctttaaattcttggaatcacttttggggcgctagagaccctggagccgcacagcggggtcctggggggctatagagtggggtcctctgggcacttaatgggatttggggggttctgttgaaatattgctgggagctcaactggaatgtaaaagttcttcgggaaggtgaaggtcaggcacgccgaggtgaataactgttctccgggcggtgctcaccccagtggggagacttccaggtgccgcaggatctctgttcctgggttctcagaacagaggtcggagaatgcaggaccacccttcccctgcagggaggaagtccctctcaactttctcttgtcatcctctgggcctgtcctaaatagaggggtaccaggaggcccttctggaggtcctcgtgccagacccctggggctgggcaggcggaaagaggtctgaactgcctctgcctccttggtctccggcagggggagaagcgagcggacatccagctgaacagcttcggtttctacaccaatggctctctggaggtggagttgagcgtcctgcggctgggcctccgggaggcagaagagaagtccctgctggtgagggaccttgaggagtttgctggaggagagcacggtgcaatcccccggttctgggttcccagctctgccgctacccatgtgatcttgtacaagtcccgtcatctctctgagcctgtttcgtcatctgtacctgggagtaatgatgtcttacacaggatgtgctaggcacttttcttaagacttgggggacaggcggggcgcggtggctcaggctttgtagtcctagcactttgggaggccaaggtgggaggattgcctgaggccaggagttcaagaccagcctgggcaacatagaaccccgtctctacaaaaagtttttaaaattagccgggcgtggtgaggtgtgcctgtagtcccagccagtcgggaggccgaggtgagaggatcgtttgaacctgggagttcgaggctgtagtgagctatgatcctgccactgtattccagcttgagaaacagaatgaggtccacccaccaccccaactctaaaaaagaaaaagagcgtgtgggatctagcacatgttaggtgttcagtaaatgtgagtttaggtttctattgctactgaaagggatagctgggaggtctctactgtccctcacaccctcccctttttttttccacccaccaggtggggttcagtctcagccgggttcggtctggcagagttcgctcctattcagtgagtggagggcatggggaagacgggagaaggggctggagggagggggtagggtctgtcctctgcatctgtaacccaagggcccctgttctttgtcagaggcaggagcaggaagatcccgtgggtggacagggagggagacagggtggagctggaccaggagaggagtaaccaagactcactccctcctgcccaccccccagacccgggatttccaggactgccctctccagaaaaacagtagcagtttcctggtcctgttcctcatcaacaccaaggatctgcagtgagttggggaccgggggctcgctcagatccttcgtctgcgtttccctggtgtgatgcccacacgcacctgggctgatcaggtgggatgagaagcagagagagaaagccacttactttttagttttgccttcaagtcttctgattgttggaaggaaggagagagggactccgcgggtgttggtgtctcagggcagaagacccggatacagagggttgttgtgagaatgaataacaattgttcgcacatgttgagtgcttccggtgtcccggagctttaatacattaactcatccattccttatcctgtgatcatctccgctcttcagacaagaaaactgagtcccaggaactgggattctggggccagggtctgacaaaaccatgttgcttttctgtagataaaatgttttctttttaaataatatacttagggccaggcagtggcttacgcctgtaatcccagtatttgggaggccgaggcaaaaggattgcttgggcccaggaattgtagaccagcctgggcaacatggcaaaaccttgtctttactaaaaaaccaaaaaatgtacaggaattagccaggcatggtggtgcacgcctgtagtcccagctactctggaagctgaggtgagaggatctcctgagctggggaggtggaggttgcagtgaaccaagtttgcactgctgcactccagcctggacgacagatcaagagcctgtctcaaaataataataataataatgataataataataataataataataatgtagggctggccatggtggctcatgccattaattccagtgctttgggagactggctgagccaggaggatcacttgaagccaggagttcgagaccagcctgggcaacgtagggagacccctgtctctagaaaatttaaaaattagccaagcatgatggtgtgcgcctgtggttccatctgctcctgtggctgaggtgggaggattgcctgatcccaggaatttgaggctgcagtgagctgtgattgcactacagcgctccagcttgggcgacagagcaagaccctgtctctaaagaaaagagaaaaagagtagattgatgtcatgggaaatgacgaataactgcggatgcaggcagcacaggaaggcggcagcctccttgaccggtgggaaccaaaggctgaaactcagtgataactgactcgactggaccccgcccctcagggaggacacgcagagggtccaaggggccactgagtcctttgccggtgcctgagccaagttcagccccccagcctcatgccccaccccaccctcaccccagggtccaggtgcggaagtatggagagcagaagacgttgtttatctttcccgggctcctcccggaagcaccctccaaaccagggctcccgaagccacaggccacagtcccccgcaaggtggatggcggtgagtcaggctggctgtgcagacgggggtggatgggcaggtctgccctttgcactccccatcccgttttcccactgcccctctatccatccatccatctcttaaaatcactgcccggtctcttacaggagggacctctgcagccagcaagcccaagtcaacacccgcagtgattcaggtttcggggaggtggggcaggagggaagatgcacaccccagggccctgcggggacccagaaccagctgatggaggggctctgtcccttcagggtcctagtgggaaggacaaggacctggtgttgggcctgagccacctcaacaactcctacaacttcagtgtgagtgtttgcagcgcctgcggcccttccgtcaccccagagcacgggacccccaagctgagccctcctgcagccctaccatcgccccagaccatgggacccccaagctgattgtcgccccagaccacgggtcccccaggctgagccctcctctctccccgcccgcccagttccacgtggtgatcggctctcaggcggaagaaggccagtacagcctgaacttccacaactgcaacaattcagtgccaggaaaggagcatccattcgacatcacggtgagcggagtggagggcagcagggccagggagcgccccctgcaggccactgcgggcccagagcgcctcaccccgcttagcttttcccagccctcccgggtgcgaagtaggagctgttatacccatttgagagacggggccaactgaggctcagagtggatgagtggcccagtagaaagtgagagagctggagacccccactcgctgctctcccaggccagcggtcgggctgtgcccctgccgccgcccaccactgccccctccgcaggtgatgatccgggagaagaaccccgatggcttcctgtcggcagcggagatgccccttttcaagctctacatggtcatgtccgcctgcttcctggccgctggcatcttctgggtgtccatcctctgcaggaacacgtaatgcccctgcccctgagggtcccccacgtcccttcaccagacccccatccctatgctctgctgatgccccgcacccccatctctccctgaccctcccaccaggtacagcgtcttcaagatccactggctcatggcggccttggccttcaccaagagcatctctctcctcttccacagcgtgagagccttggaccggggagcagcggggggtgggctgaaaggcccacccgggccatcccccaaatctctgcagaccctgggcctgtgggagggccatccgccagctatccacgtgtccacccattttaccagtgtggccagtcacccatcccctctgtccaccagtcctgcggggcagctctgtccaccactgtcccttggttcagctgtgactgtccgtctctgattgtccaactattcaccccttcagctgtgactgttccctccattttttcagccccgattaccagttttgagtcccacccaccgtcctcattattcaactttctgaccacccatctgatggtgacggtccgtgttcctaatcccccaccaccaccatcagcctcccacccctctgtgcgcctcactgtccgtctgtccatccacccccagatcaactactacttcatcaacagccagggccaccccatcgaaggccttgccgtcatgtactacatcgcacacctgtgagtgtcccccactctgctgggcagctggggggaggcaggcaggggagggttggccccccacctcatcatcacgccctcccctgctccttcaggctgaagggcgccctcctcttcatcaccatcgccctgattggctcaggctgggccttcatcaagtacgtcctgtcggataaggagaagaaggtctttgggatcgtgatccccatgcaggtgcggatggagcagcctccggagcagggcggagagggctgcacagggcagtgggggcaaaggggagcgtgccaggcagtgcccacccacccccgccgcctgcgcaggtcctggccaacgtggcctacatcatcatcgagtcccgcgaggaaggcgccagcgactacgtgctgtggaaggagattttgttcctggtggacctcatctgctgtggtgccatcctgttccccgtagtctggtgaggaccctgcccccgggctgaggctctgccctgtgcacatgggcgatgtccgcgctgaccgtaccctgtgtcctccacttgtcccaggtccatccggcatctccaggatgcgtctggcacagacgggaagggtgaggccctgcgcctgcaggccctctgctcatggccccattcctcctccgggcccttctttctgccccttggatgcccctcctggcctctctgcccagcccccaggcctctgcctccctggatgccccagtctggcctctctttcccccgaatgcctttatctggcctctctgccctgttgggtggcccttccctcctctctgatctcccccttccgcctttctgccccacctaatgtcccctcgagacttgctgctcctggacactccctcagatgttctgtttgtcacctctcccagcccccagccccctcccctccctcccaccctcagtctcccctgaccgccctctctgtgcccaccctcagtggcagtgaacctggccaagctgaagctgttccggcattactatgtcatggtaggagcccgcctcactcacagcgggtttggggggattaccggcctgctgcacgcccaccccagcccctcagctgctgccccatcccgaggcccccatccaggctccccagcccgcagtcctgcagtctagccccatgcctgcccgtgcccctacagtcctggccccacgcctgctcgcgcccctgcaggtcatctgctacgtctacttcacccgcatcatcgccatcctgctgcaggtggctgtgccctttcagtggcagtggctgtaccaggtgagcccgaggcccaggtgggacgggagggcggccacggtgggggtgggggtgctcctgacgcccccactccgccccgtcccccagctcttggtggagggctccaccctggccttcttcgtgctcacgggctacaagttccagcccacaggaaacaacccgtacctgcagctgccccaggaggacgaggaggatgttcagatggagcaagtgtgagctgggcaccatgggcagggccggcggctctgggggtggagtagggggtgggcagctctacgggcagggtgggcaggggggagggactgtagcagccctgggggcagtgttagggcagagcctgctgttgagaagggatggaggggagatggggggcagccagggcagctgtgcaggtggggaccggacagctgtggagtacctaaggccaggctgagctaggggtggggttagggccgctagggagacacccagggccgctctgggggcgggggtgggcggggcctaggtagttcgggtagaacgggtggggcctgggctgctatggcagtaaggtgggcggggcctgagtggttacgggtagagtgggtggggccagggctgctgggggcggggcctaggtggttggagtagaagggtagggcctgcgctgctgtgggagcgaggtgggtgcagcctgggtgagtctggggtagagtgggcaaggccagggctgctgtggttggggggagtggggcggggcctgagtggttccgggtagagtgggtggggcctgctgccctgcaacgctagacgcctcctcgctgtctgcccccagaatgacggactctgggttccgggaaggcctctccaaagtcaacaaaacagccagcgggcgggaactgttatgatcacctccacatctcagaccaaagggtcgtcctcccccagcatttctcactcctgcccttcttccacagcgtatgtggggaggtggagggggtccatgtggaccaggcgcccagctccccgggaccccggttcccggacaagcccatttggaagaagagtcccttcctccccccaaatattgggcagccctgtccttaccccgggaccacccctcccttccagctatgtgtacaataatgaccaatctgtttggctacgccgttgtcttgcctttttgggggttggggtctacacggaggttgtgtttacaatgtagaaacctgttttcgctgtgtgtggcgggggcgcgggcacagggtccgtgtctttgtatattcaataaatattcattcagtaa

SEQ ID NO: 11693 - DNA, 7684 bp, Homo sapiens
ggaggaggtggctccagagatggcagtgagcgagaggagggggctcggccgcgggagccccgcggagtgggggcagcggctacttctggtgctgctgctgggtggctgctccgggcgcatccaccagctggcgctgacggtgaggcccgccgcgcgagggtctggggtcggtggcgcaactttgtctcggagaagccccctggcttggagtggtctcgtccgccctcccccgtccccgaggcggtggagtggtccggcgccccccgtttccgggcccggagtggtctcgtcccgggatccccttcggtcctccggatggagttgccgggtccgcctcgctggggtcggccccctcccttcgggggcgaggctccatctcttggggactacaccccccttccccccaactgggtcttagtcctttaaattcttggaatcacttttggggcgctagagaccctggagccgcacagcggggtcctggggggctatagagtggggtcctctgggcacttaatgggatttggggggttctgttgaaatattgctgggagctcaactggaatgtaaaagttcttcgggaaggtgaaggtcaggcacgccgaggtgaataactgttctccgggcggtgctcaccccagtggggagacttccaggtgccgcaggatctctgttcctgggttctcagaacagaggtcggagaatgcaggaccacccttcccctgcagggaggaagtccctctcaactttctcttgtcatcctctgggcctgtcctaaatagaggggtaccaggaggcccttctggaggtcctcgtgccagacccctggggctgggcaggcggaaagaggtctgaactgcctctgcctccttggtctccggcagggggagaagcgagcggacatccagctgaacagcttcggtttctacaccaatggctctctggaggtggagttgagcgtcctgcggctgggcctccgggaggcagaagagaagtccctgctggtgagggaccttgaggagtttgctggaggagagcacggtgcaatcccccggttctgggttcccagctctgccgctacccatgtgatcttgtacaagtcccgtcatctctctgagcctgtttcgtcatctgtacctgggagtaatgatgtcttacacaggatgtgctaggcacttttcttaagacttgggggacaggcggggcgcggtggctcaggctttgtagtcctagcactttgggaggccaaggtgggaggattgcctgaggccaggagttcaagaccagcctgggcaacatagtgagaaccccgtctctacaaaaagtttttaaaattagccgggcgtggtgaggtgtgcctgtagtcccagccagtcgggaggccgaggtgagaggatcgtttgaacctgggagttcgaggctgtagtgagctatgatcctgccactgtattccagcttgagaaacagaatgaggtccacccaccaccccaactctaaaaaagaaaaagagcgtgtgggatctagcacatgttaggtgttcagtaaatgtgaggttaggtttctattgctactgaaagggatagctgggaggtctctactgtccctcacaccctcccctttttttttccacccaccaggtggggttcagtctcagccgggttcggtctggcagagttcgctcctattcagtgagtggagggcatggggaagacgggagaaggggctggagggagggggtagggtctgtcctctgcatctgtaacccaagggcccctgttctttgtcagaggcaggagcaggaagatcccgtgggtggacagggagggagacagggtggagctggaccaggagaggagtaaccaagactcactccctcctgcccaccccccagacccgggatttccaggactgccctctccagaaaaacagtagcagtttcctggtcctgttcctcatcaacaccaaggatctgcagtgagttggggaccgggggctcgctcagatccttcgtctgcgtttccctggtgtgatgcccacacgcacctgggctgatcaggtgggatgagaagcagagagagaaagccacttactttttagttttgccttcaagtcttctgattgttggaaggaaggagagagggactccgcgggtgttggtgtctcagggcagaagacccggatacagagggttgttgtgagaatgaataacaattgttcgcacatgttgagtgcttccggtgtcccggagctttaatacactaactcacccattccttatcctgtgatcatctccgctcttcagacaagaaaactgagtcccaggaactgggattctggggccagggtctgacaaaaccatgttgcttttctgtagataaaatgttttctttttaaataatatacttagggccaggcagtggcttacgcctgtaatcccagtatttgggaggccgaggcaaaaggattgcttgggcccaggaattgtagaccagcctgggcaacatggcaaaaccttgtctttactaaaaaaccaaaaaatgtacaggaattagccaggcatggtggtgcacgcctgtagtcccagctactctggaagctgaggtgagaggatctcctgagctggggaggtggaggttgcagtgaaccaagtttgcactgctgcactccagcctggacgacagatcaagagcctgtctcaaaataataataataataataataataataataataataataataataatgtagggctggccatggtggctcatgccattaattccagtgctttgggagactggctgagccaggaggatcacttgaagccaggagttcaagaccagcctgggcaacgtagggagacccctgtctctagaaaatttaaaaattagccaagcatgatggtgtgcgcctgtggttccatctgctcctgtggctgaggtgggaggattgcctgatcccaggaatttgaggctgcagtgagctgtgattgcactacagcgctccagcttgggcgacagagcaagaccctgtctctaaagaaaagagaaaaagagtagattgatgtcatgggaaatgacgaataactgcggatgcaggcagcacaggaaggcggcagcctccttgaccggtgggaaccaaaggctgaaactcagtgataactgactcgactggaccccgcccctcagggaggacacgcagagggtccaaggggccactgagtcctttgccggtgcctgagccaagttcagccccccagcctcatgccccaccccaccctcaccccagggtccaggtgcggaagtatggagagcagaagacgttgtttatctttcccgggctcctcccggaagcaccctccaaaccagggctcccgaagccacaggccacagtcccccgcaaggtggatggcggtgagtcaggctggctgtgcagacgggggtggatgggcaggtctgccctttgcactccccatgccgttttcccactgcccctctatccatccatccatctcttaaaatcactgcccggtctcttacaggagggacctctgcagccagcaagcccaagtcaacacccgcagtgattcaggtttcggggaggcggggcaggagggaagatgcacaccccagggccctgcggggacccagaaccagctgatggaggggctctgtcccttcagggtcctagtgggaaggacaaggacctggtgttgggcctgagccacctcaacaactcctacaacttcagtgtgagtgtttgcagcgcctgcggcccttccgtcaccccagagcacgggacccccaagctgagccctcctgcagccctaccatcgccccagaccatgggacccccaagctgattgtcgccccagaccacgggtcccccaggctgagccctcctctctccccgcccgcccagttccacgtggtgatcggctctcaggcggaagaaggccagtacagcctgaacttccacaactgcaacaattcagtgccaggaaaggagcatccattcgacatcacggtgagcggagtggagggcagcagggccagggagcgccccctgcaggccactgcgggcccagagtgcctcaccccgcttagcttttcccagccctcccgggtgcgaagtaggagctgttatacccatttgagagacggggccaactgaggctcagagtggatgagtggcccagtagaaagtgagagagctggagacccccactcgctgctctcccaggccagcggtcgggctgtgcccctgccgccgcccaccactgccccctccgcaggtgatgatccgggagaagaaccccgatggcttcctgtcggcagcggagatgccccttttcaagctctacatggtcatgtccgcctgcttcctggccgctggcatcttctgggtgtccatcctctgcaggaacacgtaatgcccctgcccctgagggtcccccacgtcccttcaccagacccccatccctatgctctgctgatgccccgcacccccatctctccctgaccctcccaccaggtacagcgtcttcaagatccactggctcatggcggccttggccttcaccaagagcatctctctcctcttccacagcgtgagagccttggaccggggagcagcggggggtgggctgaaaggcccacccgggccatcccccaaatctctgcagaccctgggcctgtgggagggccatccgccagctatccacgtgtccacccattttaccagtgtggccagtcacccatcccctctgtccaccagtcctgcggggcagctctgtccaccactgtcccttggttcagctgtgactgtccgtctctgattgtccaactattcaccccttcagctgtgactgttccctccattttttcagccccgattaccagttttgagtcccacccaccgtcctcattattcaactttctgaccacccatctgatggtgacggtccgtgttcctaatcccccaccaccaccatcagcctcccacccctctgtgcgcctcactgtccgtctgtccatccacccccagatcaactactacttcatcaacagccagggccaccccatcgaaggccttgccgtcatgtactacatcgcacacctgtgagtgtcccccactctgctgggcagctggggggaggcaggcaggggagggttggccccccacctcatcatcacgccctcccctgctccttcaggctgaagggcgccctcctcttcatcaccatcgccctgattggctcaggctgggccttcatcaagtacgtcctgtcggataaggagaagaaggtctttgggatcgtgatccccatgcaggtgcggatggagcagcctccggagcagggcggggagggctgcacagggcagtgggggcaaaggggagcgtgccaggcagtgcccacccacccccgccgcctgcgcaggtcctggccaacgtggcctacatcatcatcgagtcccgcgaggaaggcgccagcgactacgtgctgtggaaggagattttgttcctggtggacctcatctgctgtggtgccatcctgttccccgtagtctggtgaggaccctgcccccgggctgaggctctgccctgtgcacatgggcgatgtccgcgctgaccgtaccctgtgtcctccacttgtcccaggtccatccggcatctccaggatgcgtctggcacagacgggaagggtgaggccctgcgcctgcaggccctctgctcatggccccattcctcctccgggcccttctttctgccccttggatgcccctcctggcctctctgcccagcccccaggcctctgcctccctggatgccccagtctggcctctctttcccccgaatgcctttatctggcctctctgccctgttgggtggcccttccctcctctctgatctcccccttccgcctttctgccccacctaatgtcccctcgagacttgctgctcctggacactccctcagatgttctgtttgtcacctctcccagcccccagccccctcccctccctcccaccctcagtctcccctgaccgccctctctgtgcccaccctcagtggcagtgaacctggccaagctgaagctgttccggcattactatgtcatggtaggagcccgcctcactcacagcgggtttggggggattacccggcctgctgcacgcccaccccagcccctcagctgctgccccatcccgaggcccccatccaggctccccagcccgcagtcctgcagtctagccccatgcctgcccgtgcccctacagtcctggccccacgcctgctcgcgcccctgcaggtcatctgctacgtctacttcacccgcatcatcgccatcctgctgcaggtggctgtgccctttcagtggcagtggctgtaccaggtgagcccgaggcccaggtgggacgggagggcggccacggtgggggtgggggtgcgcctgacgcccccactccgccccgtcccccagctcttggtggagggctccaccctggccttcttcgtgctcacgggctacaagttccagcccacaggaaacaacccgtacctgcagctgccccaggaggacgaggaggatgttcagatggagcaagtgtgagctgggcaccatgggcagggccggcggctctgggggtggagtagggggtgggcagctctacgggcagggtgggcaggggggagggactgtagcagccctgggggcagtgttagggcagagcctgctgttgagaagggatggaggggagatggggggcagccagggcagctgtgcaggtggggaccggacagctgtggagtacctaaggccaggctgagctaggggtggggttagggccgctagggagacacccaggggccgctctgggggcgggggtgggcggggcctaggtagttcgggtagaacgggtggggcctgggctgctatggcagtaaggtgggcggggcctgagtggttacgggtagagtgggtggggccagggctgctgggggcggggcctaggtggttggagtagaagggtagggcctgcgctgctgtgggagcgaggtgggtgcagcctgggtgagtctggggtagagtgggcaaggccagggctgctgtggttggggggagtggggcggggcctgagtggttccgggtagagtgggtggggcctgctgccctgcaacgctagacgcctcctcgctgtctgcccccagaatgacggactctgggttccgggaaggcctctccaaagtcaacaaaacagccagcgggcgggaactgttatgatcacctccacatctcagaccaaagggtcgtcctcccccagcatttctcactcctgcccttcttccacagcgtatgtggggaggtggagggggtccatgtggaccaggcgcccagctccccgggaccccggttcccggacaagcccatttggaagaagagtcccttcctccccccaaatattgggcagccctgtccttaccccgggaccacccctcccttccagctatgtgtacaataatgaccaatctgtttggctacgccgttgtcttgcctttttgggggttggggtctacacggaggttgtgtttacaatgtagaaacctgttttcgctgtgtgtggcgggggcgcgggcacagggtccgtgtctttgtatattcaataaatattcattcagtaa

SEQ ID NO: 11694 - DNA, 10876 bp, Homo sapiens; identical to SEQ ID NO: 11296

SEQ ID NO: 11695 - DNA, 742 bp, Homo sapiens; identical to SEQ ID NO: 11297

SEQ ID NO: 11696 - DNA, 6881 bp, Homo sapiens
aggcctcctcgaaagatgttgtcagacagctgtgtcaagaaagcttttccagttcagcccttggcttgaaaaaactcttggatgttacatgttccagcttgtctgtgacccaggaggaggcagaggaagtaagtgtggtcagaaatgatctttggccactggccctcttattagtctctttcttgacttcccagtcattgccatgtccaaggaaaatcccttgaaacatctgttgacactgtagcaaacttttataaatgggacatgaatgggagaactgtacccagaatcagagctcctgaccattttctttcagacctattacctagacaatgtggaacaaaagccaacctttctgtgattttcttttccaacctataacttgctgatgctcataaattgttagctggatagcttagggcagacttttcagggatctttgaacagaaggtttgaggcctgcataagattcaggagtaggcactgctagattccatcaggcttcctgaggggtgctttgtgtatctcactccctcctcacccctctgtcccacagaaggtccccttctcctcagctcacctgatctcagcaggtagccaagagggagattaaggtaacttgtggtaagttattatgtagcagtgacagccttatctttccaaggcaaatatgtttttaaaacagcactttcttcatctaaatgggcctatgtttttggattttttttatttttgagacagggtctcattttgttacgcaggctggagggcagtggcatggacatggctcactgcagcctcgatgccccaggctcaggcagtcctcccacctcagctccacgagtagctgggactgcaagcatatgccacgatgcctggctaatttttgtattttttgtagagacagggttttgccatgttgcccaggctggtcttgaactcctgagctcaagcaatccacccacctcagcctcccaaagtgctgggattacaggcatgagccactgcacctggcctatgttttttgttttaattctggaccttgtttattgaagtgagctgtagaaaaggaaaaggaaaaagcaagattttggaagtgatttggagacttattttgggttcccccccaaagtagattatttgggagatgattctagaaaacacaaagcagtggggaaaatcaaacagggaaggcaagtcaatgaaagaggatgttaagagcaattactgctatggaaaacttgggatcctgtaagaaaccaagtagaacacctctcagaattgttccccgggagaacagagaggcttggccatttatccatgaacacccactctcactggtggaaggttaacttcccttcacttccgggttgtgtcaggtaatctgcagtgatatcagagaaagccctaaagcagagaaacagttacctccagagagcttttttaggttagctaagtattactctattcacaagaccaccataaacccctcttacacttcaaagttacagattcacttagaaggacctaggatgggaacacagcattttagcaggacgggcagacatgcctcttcccaggaggaacccgcacagccggccaggagctgtttgttctctttgcctcctaggcaaccagtgagaggaaggacatgaatcctaccaccctggattcaagaccctcactccacaggagccggtatcttgtgtcacggttcagtaagcacagcttcaggttctcgaaaggagcctgtagccacacataggcaagtccagagctaccggcaccccaggtatttatgcagtcctctcagtccagagccttggaccaatgcagtgttgcttagtaacacagctgactttgcactgctctcaggttaccagggaaacagcaccagaaagttaactgaaggtcagattctcatgcagaaggaaaagggctatattaactctttgtccacaagtggagagtttctgacaagctgtcagcttcctaggtcagggagctgcatctgtcttctaaagcaacaggtgaactccgaggcaggccaaggcatgtggggcatgagcatgtgccacagaggcctctggacttgtgactcagttgaatgaccatagcagtgtgcagccttcggggtgtagagccctgcccctggccctgccttgtgccccctgcctgctgcttctgttacagctacaggtggttccgtttatcttgcagctgctccaggctctgcaccgcctcactaggctggtggcattccgtgacctgtcctctgccgaggcaattctggctctctttccagaaaatttccaccaaaacctcaaaaacctgctgacaaagatcatcctagaacatgtgtaagtgctcatttcttgaaagtcccttctaacttttacatttcttattatttttattctcattctagaagtagtaatatgctcattgttgaaaacttaggaagcccggataagcaaaaagaaaataagacacctgtaattccaccagccagatgttagtggtagtcttttcttaatggaaagccttttaaaacatgttttttttttcctctttacacctctgtaagaggttgatgttttgtttttgtttttacaaaatggatcatgctgttttgtaacttgcttattttctgttaacagtattaacgatagtgaaatttcacgtcaatgtttaccttcaatatcattgtaatggttaaacatatcctgttataggaagaaatgatgtataattttaaaatttcttagtgttggacactgaggctgttggcattttttcatttcagtgaacaatttacaatgaaaactttgctcctgtgcttaattatttttttactgggttaaaggtaatggacattttgagggtttggccttaaatgttcaagttggccattagaaatattgcagtatttttccacagtagtaggatacaagtgtacccctctccctacgccttcactgaggggatttttttcttacatttttcccagttccacaatggcaaatggtacctcatttcagtgtccctatctttgacactagtgatgtcagatatctttttcatatgtttaattgatctttttttttcttttgtgaagtatctgtatattttcttggctgggaagttccttttaaacacgtacattttaagcagaattgattaactattggttagcagaaggcttgaacagacctctctaatagcaataactgataatgcctatttaccaagggttttattgtattttaagaactttctcatacatgatcacattttattatgtttgttgtagcattagtcaggtctgtttggatgtgtttttgcagaagatgcaatatttgtgtatgcagtaggtgctcaataaagagaagataagttgacctttttttctgttttgtctttgaacaaaagcacaaaagaacaatagcacaataagattacaatacattgtattttcttcttttttgtcctgaactatgaaaactgacaacacttagggccttaacatcactgagctttgtaaaacaaataaacaaaagactttcttggagggaggggtttctgtggtcctttcctgttagcaggtgatgacaggtctgaagatcacaggaagggccagttcccctctctatcagaagagtcagtctcatcccctttccattattttttcctcatctttccctcttaaacaggtctacttggagaaccgaagcccaggcaaatcagagtgagtaccaataaatctgcccctcccttcttacttgtctccccagccccagctctcagtctgccaagtgatcagagattttggcagaaaccaaagtgaaccattctagtctcaacccatactctgtgtatggtgggttttttccctaattctactttttaacttttttctgattataaacattattatataggcatgttgttaaaaaacagaaatatccaaagcagaaagtgaagtacttaaaataatggtatttcaattgtgaaaaaaattaacaataatcaaaaatagtttgaaaggctgaatgaaagtccatgtttaataaatggtcattacagtaactctgagccagccacagtgctggagcagttaatctgctcaagtcatttagtcctcccttcagccctgtgagctaggctgatgagcaaacagaagctcagaggttagataagtggtagcacctgtattcaagtcaagtccatttatctctaaaacaagagctcttaccactattgctgaagctacacatttcctaaggctcaggccatgatttcttctctgctttatgtcacttctcattctgccctaacatctggagggctgggtgttcaggtagaagcctggatacgctgccactgtgaattagtaccaagtgcaggcagcacagagcaatgggtaaggcacatgactcgctgtgggtctcgggctttgtttatctgtctttctcagagacttgctgcatagaccaatgcattgcatgtgtgcagtcctcagagccgcctgtcgtacaataaatgcttggtaaacacgggcggcatgagcattgagctgagctgttccttccacagtctctctgccacgcctggtcgatctggactggagagtggatatcaaaacctcctcagacagcatcagccgcatggccgtccccacctgcctgctccagatgaaggtacattcactatcatgccattagaaagaagaggcagcacccctatggccgtctaaaacactagtctccaaggtttgggatctctaacccatatatttttttaaattaccatcccctttatcctcctttgtttagttacaacgtgtatgtgtactactgcagtaacatactatggacatattaaaacaataaaacaaatacaaaacatatttttaaaataatttgctgatacctaaaggtaaccctatactcttagcagtttagctttaacaatagtagtgtgcttccagattttgaatagcctgcccgatcatttcagtgtacttcagcaacttcttgtccagtgattaggctgtcattatttgtaatgtggctgctcaagagtttctactagtcgctgggagcagtggcttacgcctgtaatcccagcactttgggaggccgaggtgggtggatcatgaggtcaagagatcaagaccatccttgccaacatggtgaaaccgcatctctaccaaaaatgcaaaaataagccgggcgtggtggcgggctcctatagtcccagctactcaggaggctgagggaggagaatcgcttgaaccaaggaggtggagattgcagtgagccgagatcacaccactgcactcccacctggtgaaagagtgagactccgtctcaaaaaaaaaaaaaaaagtttctactagcagctggagaagtgtcaggtcttcattttcttgctcacatacctttgcttcattggtgttgtcttcattttatagttattttcaggaatctttttaagctacatatccatattgtagtgtttgtttagttaaaactagaaatgtaatgctgtatctacataaccagacacccagaaagttaccacttgtaagaaaatgaagaagggtgcctctagcaattaagttttaaatattagtgaagcttaacttctttattttttaaaactaaaggttgtaagattgttcctgcatcccaatgcaggattgtctgaagtatccaacagaacctgctccttaaagtaccaatgtaaacacacgtaatgttttcttgcttgaatgctgagagttagggtatcagagaggtgagtgagccttggcttggccttctttgatacctacccaaggcacttgttgcaaatggagactgacccaggcctctgaggtatctcctgtactctcccttactgctaaatgacccaagggctggtactctctagtgcttaggaaagagcctctcttcagaggttcagcagaactgagctcagcctcgcaggttcagggctcacttacagggatatgggaaaagaggcagctttgactttctgggctgtgttctcgtttcagatccaagaagatcccagcctatgcggagacaaaccctccatctcagctgtcaccgtggagctgagcaaagaaacactggacaccatgttagatggcctgggccgcatccgagaccaactctctgccgtggccagtaaatgatccagccagctgccagggccactgccatgacccagctgctcatgagtgataaatgtctccccatatgcaggctgcccttgcagctgcagctgacaacaggcaggatggtggggacagcagggggctactgccatccagaagttacagttggattgggaagaagcagccagatcccccgctgttctcactcatcttctttctctttctgaagctggagagcagaagcccccatctttgaaaagctcctgagtgcaacttaattaccaccatggcagggtgagggaacatttgcatcgtcagctgcctctgcatagctgtttgagaaattcaggcccaaatcatgcagcctatccaataagtaagtttatttccaacattagctctaattagttcatttccaatcccagaacacatggagggaatcggacaggtgatgccagcagttcctgctcctctgtcagggaagccaggcagagcccacagagcatggtccatccagagtgttccctgagccccctccaccatactggaacccctcttcagtgtaggaagtctgaaatgggtgctaattcccttcttcatgaaaccagggccctcttccttcatctaatgcagccactcctaggtgaagaagtgggaataattggaactaaacaacagttctaaaacttccatg

SEQ ID NO: 11697 - DNA, 247 bp, Homo sapiens
ctgtaatcccagcactttgggaggccgaggcaggcagatcatgaggtcaggagatcgagaccatggtgaaaccccatctctactaaaaatacaaaaaattagctgggcgcggtggcgggcatctgtagtcccagctcctcgggaggctgaggcaggagaatggcgtgaacctgggaggcagagcttgcagtgagccgagatcgtgccactgcactccagtctgggtgacagagaaggactcgtctca

SEQ ID NO: 11698 - DNA, 565 bp, Homo sapiens
gaaaaatttctagcctcactagtatcagagaaatgcaaattgaaacaaggtgccatttttggactctagttagtgatggtagtgaaaaccagaatggtcctttctaaaacagcctgtgtgtcaaaaccataaaaatgcttctacctctttttaccctgttaattctacttctgagagtttttcctaaagaaataattcaaaataggaaaaagctaaaagcagaaaaatgttgaacatgacattatttatagctgtggaaagattggaggctgggcacagtggcttatgcttgtaatctcagcactttgtgaggccaagttgggaggattgcttgaacccaagagcttgagaccagcctgggaaacgtagtgagaccccatctcttaaaaaaaaaaaaaaaaattagctgagtgtggtggaacgtgcctgtagtcccagctacttgggaggctgaggtgggaggattgcttgagcccaggaggctgaggttacagccaggatcacaccactgcgctccagcctgggtgacagagtgaggctctgtttaaaaaaaaaaaaaaaagag

SEQ ID NO: 11699 - DNA, 565 bp, Homo sapiens; identical to SEQ ID NO: 11698

SEQ ID NO: 11700 - DNA, 565 bp, Homo sapiens; identical to SEQ ID NO: 11698

SEQ ID NO: 11701 - DNA, 565 bp, Homo sapiens; identical to SEQ ID NO: 11698

SEQ ID NO: 11702 - DNA, 459 bp, Homo sapiens
agatcacgaggtcaggagatcgagaccagcctggccaacatggtgaaaccccgtctttactaaaaatacaaaaattagctgggcgtggtggtgcgtgcctgtaatcccagccacttggaaggctgaggcaggagaatcgtttgaactagggagtcggaggttgcggtgagccaagtgcgccactgcactccagcctggtgacagagcaagattctgtctcaaaaaataaaaaaaaaaggagtacatacactatcattctaaatttggtttgaagaaacgtgtttgtagatatttattcagtatataatatgtggataaaaaagggactggaagaaagcccactgaagtgtcaacagtaacttcaccaggtgatgggaatttgagaaactttttttcttacacatttttctgtattctatatttttcatctagattgtgcactactgttatcagaatttt

SEQ ID NO: 11703 - DNA, 319 bp, Homo sapiens
agctgggcgtggtggctcacgcctgtaatcccagcactttgggaggccgaggcgggctggatcacgaggtcaggagatcgagaccatcctggctaacacggtgaaaccccatctctactgaaaatacaaaaaattagccgggcgtggtggcaggcgcctgtagtcccagctacttgggaggttgaggcaggagaatggcgtgaacccgggaggcggagcttgcagtgagctgcagattgtgccactgcactccatcctgggtgacagagcaagactccgtctcaaaaaaaaaaaaaaaaaaaaaaaaaaaacccagtag

SEQ ID NO: 11704 - DNA, 459 bp, Homo sapiens; identical to SEQ ID NO: 11702

SEQ ID NO: 11705 - DNA, 460 bp, Homo sapiens
agatcacgaggtcaggagatcgagaccagcctggccaacatggtgaaaccccgtctttactaaaaatacaaaaattagctgggcgtggtggtgcgtgcctgtaatcccagccacttggaaggctgaggcaggagaatcgtttgaactagggagtcggaggttgcggtgagccaagtgcgccactgcactccagcctggtgacagagcaagattctgtctcaaaaaataaaaaaaaaaaggagtacatacactatcattctaaatttggtttgaagaaacgtgtttgtagatatttattcagtatataatatgtggataaaaaagggactggaagaaagcccactgaagtgtcaacagtaacttcaccaggtgatgggaatttgagaaactttttttcttacacatttttctgtattctatatttttcatctagattgtgcactactgttatcagaatttt

SEQ ID NO: 11706 - DNA, 776 bp, Homo sapiens
tatgccacattcttttgagaaaagagcttcaatatcatggtgggaaccagaggccaatgatcacccaaaattaaaaggccaaccgcgtattcgcagccgttgtgatgggaggggttaatatttttattgaaagagtttctgtgacaaataatccctcttaaaacccagtagaagctgggcgtggtggctcacgcctgtaatcccagcactttgggaggccgaggcgggtggatcacgaggtcaggagatcgagaccatcctggctaacacggtgaaaccccatctctactgaaaatacaaaaaattagccgggcgtggtggcaggcgcctgtagtcccagctacttgggaggttgaggcaggagaatggcgtgaacccgggaggcggagcttgcagtgagctgagattgtgccactgcactccatcctgggtgacagagcaagactccgtctcaaaaaaaaaaaaaaaaaaaaaaaaaaacccagtagataggctaggtgtggtggctcacatctgtaatcccagcactttgggatgctgaggtgggctgatcacttgaggccaggagttcgagaccagcctggccaacatggtgaaaccccctctctactaaaaatacaaaaagtagccagtagtggtggtgcacgcctgtagtcccagctactcgggaggctgagataggagaatcacttgaaccttgcggggggcagaggttgccgtgagctgggattacaccactgcactccagcctgggggacagagcaagactctgtctc

SEQ ID NO: 11707 - DNA, 460 bp, Homo sapiens; identical to SEQ ID NO: 11705

SEQ ID NO: 11708 - DNA, 776 bp, Homo sapiens; identical to SEQ ID NO: 11706

SEQ ID NO: 11709 - DNA, 9883 bp, Homo sapiens
tgaagattccagctttttttattttttccccttttacacaaaacaaagtagaagaaataatacaggattaaaactgcaaaagtagttaatcagtagaatatgtatgcacacaaaaaatccagataggaagacaggcttatttacaatgaaagtaaggtaaaattaacgtagttttcttatgaaataataaaaaaaaatcaaacatatgctacaatgggcaccactgttcacagcaatattaaagaggagaaaacaacacttatttaatagggacagatataccacaaggtacaacatcagtgcaataaattcacaaaactatattacagctagttaatcagtttaagaattgttcccgtcagtcacattttttggccctcagaagttcattcctaaagatttcaactactctaaatttctagctaccaagaagttaagaatgattataagaagctttccaaggagttatgaaatctttgtagaccagaggccaactatcatcacctcaagtctgctctcaccaacagcccttgtatttttcagggagaaatctctaggaaaaaagtcagacaccagtgtagtcactatctcccatgtcaaacctaggggactaaaatggtcagtattaccataaaatgataattttgaggtttaccttaaaaggcttattctggtctcaaaaattagataagattatcttctactgaaatgaatattgactaaacatagaagactgctgtccttttgccagtcttagagtgaaagtcatagacatgagtcttaacctactgtatactatagctaatgtcagctgaaaatctgaaattaaaagcatgctagaaatcctaaatgcaatcttttggaagtctgctattaaaaagcctttaaggatttactaacttcgagtctaagtgcaaggggacgaaagcttaagcctgtcagacattccttttcttggacaaaaagatcaaagtttcctacaaattgctaagctttgcacaagggagaagcctacatgtactagtgcatggaatcagtttcatcttatttcatggggactcttctcccactggaaagaaacagaatgaggaatgaatcttaattggtctcttcatcagaagtggtaaacttggtctctatattcacgaagtcagacagttttttaagcagactgtggaagcagacagaaccagcttcctgtagccacagaccactacatggtatctaagctaaagcaaagatgaacaattatccagattcacttgaactgtactaaagggcaaggttcaccactacaaaaaggaagttgtctaaaagcaagaattcaattaacgctgggtaagaaaagtcaaaacactaatgagttgtccatgaagccaactgctaagaacgcgctcaactatacgcgacatgaagacactatgcacgaagccttacttggcgagtctgaatttctattaactaagggcagagtgagggagaacaaagagctacttccgtaacattttagtatccagatagtacagcagaaacggttcccggggcaatgggtgctgcattaatcacactgattaaagcagatgaatcattcgtttttcttttctttttgtttgagaagtttgtttatctccctcttggccattccaatgtacttcaaaatgattccatgttggtttagtccaggaagcaatagtaaggaagtcacttaaaataaaaaaaaacccaacattaaggaggcagcaattaacctgctaaaggttattactttttttttttttttttgagacaaagtttcacttttgttgcccaggctggagtgcaatggcgcaatcttggctcaccgcaacctccgcctcccaggttcaagcgattctcctgcctcagctacccaagtagctgggattacaggcatgcgccactacgcctgactaattttgtatttttagtagagatggggtttctccatgttagtcaggctggtctcgaactcccaatctcaggtgatccgcctgcttcagcctcccagagtgctgggattacgggcgtgagccaccacacccagcgacaagtctcactctttttgcccaggctggagtgcaatggcacaatctcggttcactgcaacctccacctcccaggttcaagcgattctcctgcctcaccctaccaagtagagtagctgggattacaggtgcctgccgccacgcctggctaatttttgtatttttagtacacatgtgatttcgcaatgttggccaggcggtctccaactcctgacctcaggtgatcagaggttattacgtgtgtatggcggtggtgggtggggggggtggtgagtgcagtggtgtgatctcagctcactgtaacctccacctcctgggttcaggtgattctcatgcctcagcctcctaggtagctgggactacaggtgtgtaccaccacatccaactaatttttgtatttttagtagagacagggtttcgccatgttggctaggctggtctcaaactcccggcctcaagtgatccacctgcctcagcctcccaaagtgctgggattacaggctgagccaccgtgaccagccagttattacattttaaagaaggcaggttcctacattattaaactcagtaatgggaggaagcaacatgaaatcaattacttccactgggatgtatccccagaaacttctgctctcatcccctcttccacctcagaaaataatcattgcttatttttacctcttgcacattactttctaccttggttattgcattgttttcactttctatgagaccataataatctttccatattcccacagttccttttcggtgtctaaaacttaggaagtattcagctgtttactgacgaagttacagttaaatttcactggccaggatgtgcctgtagtttttcctcaaagacttacctatcaggtaggtgagaagcaggttgtggacttgttgtcccacccaagcaaccgcagcaagggaaacgatcatggtcatgaagtactagcaatgaaaacaagaatttaatatcaaaacttcatgtgacaccataaatatatgtaatttttatttgtcaattaaagaagaatgtgtttcaaagttcgggaaataatttagcttttattatcacttttctttaaaaattcttagatttaaaaacctattccattggatctactttatagaatttggatacatttcttcctagaattactgcaattctgtatgtaaatattttatgatataaattatacgatcttttcagttaataacttcacggaacagcctcacgacgtgaagcttacagataagagaacagatgaacagatgctttccttttttttttttttttttgagacagagtctcattctgtcacaaaggctggagtgcagtggtgcaaacagctcactgcgcaaacacagctcactgcagcctcgacctccagggctcaagtgatcctcagccttccatgtagctgggattataggcattagccactgtgcccggcctaaacagatgctttctaagtatatgtcttttactattatttcagtaagaaaaatgaaacagaagaattttgttttattagaataaaaaattaaatgcaaaaatgtaatttttaactttaaaatgattcagtctaattaatacaggtaaacatttatgaatgtacttaggaattaaccaatgaataattttcaaattatagctattaagacaaaaaggcgaattgactcaaatcttaaaattttactgtacttaagtcaaagcaaaaaaagtaccatcttaggtttttcttcctttagtgtgaagaggcgtttccaccaacccacagctctgcgtcgagtttttactagattgctgcaaatttcatggaatctttgctgttgttcagtggtcctagaaaagaaatttgccttttgctataaacaaatcgttacagtagacaaaaacatgacaccctgttcaatttaagagctatcttctaaagaaaataaaaataaaaacaatgtttcaccattatcttatgtaggtgaaaaaatccttccaccattaagacaccttttatagcacaggagtaagtatttacataaactatgtgtgtgagagagagagtgtgtgtgtgtgtgcgtgtgataaagaaaggatcatctctggctctgaagccacatttatttaatggtagtaaaagactcatgacttctatgggccataaagaaatcagtataaatttgattttgctattcctaaatattctttagatcctagtaaatgctgcactatacctaccagaatcccaccgaacaactgtatttgaacactccttagtaagatactaactactggcatttaacacataacacccccaactgggcttcatacatctgatgacaaggcagcaataaacagctcaaatctaaattcttctttgtaaatttatccctagggagggaaaatataatcaacaaacaacacagcagtaaaaatccaacaagagaccctccaagaaaaccttttatatttataatgtttttcttggttctgatttttttaattgcctttgcactgtcttcgctacacagctataatggctgctattattgccctgtgctgagggatgtgttgccttctcttctctagccctcatctctgtaaaactgcagtgatagataaagtacaaggatttctgctgagccctggaacttcttttcaacaatgagatgttatttcttgcccatggtcaaggctagattgtggctatgcaaaagagtattctttcttccttgtaagatcaaaaaataaacaaaatctgctctatcaataactgagtcacatcacgaaactatcagtggttatttctgcaaactttcctctaggagttataaattagcagactggaatgttatctggctaataaggccaaggtcagtgatttatttcctttgctaactctgttatactgcacattcagaaacttgcccaaaagagccaacaacattgattcattactgcaagtgaaaaacaatttggacagttcctaacactaatccattctgctgttgggggaaacacctttaaatattgtcaattatatcataatttaagcaaactttgaatttgttcttaaagatccataaggtacacatttaaaattcttatatttacagaattattttgcaatttgctatcctctgagatacaaacaaccaaaggcacaagtagaatactaaccaaataaaataaacagccaaggatagaatagcagctgagaagaaaatatctattccaacttctattttggctgattatttgaatcaaaactcaacatgctagagaaagttaaaatacttttaatatgatccttatccacttaactatatctgaggagttcataagcaacctcatggtataaataggccgggcacggtggctcacgcctgtaatctcagcactttgggaggccgaggcgggcggatcacaaggtcaggagatcgagaccatcctggctaacatggtgaaaccccgtctctactaaaaataaaaaaaaaaaaaattagccaggtgtggtggtgggcacctgtagtcccagctactcgggaggctgaggcaagagaatggcatgaacctgggaggtggagcatgcagtgagccaagagcgtactgcactccagcctgggcaacagagcgagcctccatctcaaaaaaaaaaaaaaaaaagagaatggtataaataaaatcagcaacccatgtgtatacagcttgaacctcttcggaaacacttggtattcactttgttaactgccattccactgcctcagtgtctcagtatctcagccttaacacaagatcaatcttaaaagtcaaaatatttcacagtactttacagggcctgccacagtaggcatttaataaataattgctaaatgaatgtgaatgaaaatctgccagtttccttttctgtattcattcaaaaataatttgtgaagttattatactatcctaaatatcaatggaaatgtaaaaatgtatatgtgcatttaccataaaagaactatggagtacagaaaattcatagtttatattcaaatcagttacaatattcttcacataaaagcaataaatctaatgcttaggtgtctgatggttagacaattatctctgcttatttacagcatactaatcacagccaccaagttcagtaactacacaaaaatgagactgccaaatcattatgctacctaccatttattggagccaaaaattctaggcgctagaatgggaacaaggtagtcagccaagcacaaaaacataacaaaacaggaaacgccggacagaacagatggatctagatagtagataatcctgttaaaaaaattaataaaggttagaaaaacatagtcattattattcctaactaaacatgtctaacttaactattcacttaactattcaccgcctctcagagatatttgccatttttcttctaattttctcacaagtggctttccagaggctttgtgacatgctgatatcatagctgcagtggttaagtatatatcaatggacaaaagctctttggagttctcagcacttttttaagagtttagggaggtgggggactaggggagggatagcattaggagaaatacctaatgtagatgaagggttgatgggtgcagcaaaccaccatggcacatgtatatatacctatgtaacaaacctgtacattctacacatgtttcccagaacttaaagtataataacaaaaaaagagtttaagtgtctggaggacaaaaagtttgcgagtcactgatttactcaagtgctttaggttaccaagtttacagaagtactacaaattctggaaactagaagtgcttatgagaaacattctttatgggttctttatgggttatatattacagaagacttaaggcactcccacaaacagaagctatatattaaaaagtctttattaataagaagcacaacccatagtaatctaatagctcacttacagaaacaccaaagaaaccacacccatgatggcaggtggaaaccaggctctttcccatcggaggactttatcagccatcagcatcacttctccccatccttgcagctgttcttccagacttgcagtctctgcagcctaaataccaccgacatttaaagtgatcattttaccactctcaacatttttgtggttcatagacttcaattattttaaagctccaaatacaaaaaataacctcttaaccaaattgccaattttaaactagttggtttctgaaaaactgcaatttcaaagatgaaaatacaatgggtttttttgttttttgtgtttttttttttgagacggagtctcgctctgtcacccaggctggagtgcagtggggagatctcggctcactgcagcctccgcctcctgggttcaagcgattctcctacctcatactcctgagtagttgggactataggcgcccgccaccacgcccgactaattttttgtagagacagggtttcaccatgttggccaggctggtctcaaactctggacctcaagtgatccactcacctcgtcttcccaaagtgctgggattacaggtgtgagccaccaggcccagcctaaatatcctttaatggtcacttttctagtccaagcactgggctattctttatatacatgatgtaacttaatccttacagagagccacaaggtagggataattagactcaatttacaattaaagaaagtgagctcaaaatggtttactttctcaaagtcatgcggggaatcgtggcagtgcccagagtattaataaaatgaaataactttttttaagtttgtttatttcagatggttagaattgatccgttgtttttgtcatcttattgatttaaacccttctaaatccattaggaaagactttccctgaatagcattcaatttctaaaatagctctttgtgtaatggaatcactcagatgttgacattcattggacaattaaggaaaactactttcaccaaattaaggtggcattttacggtcaatatacctcctcaatacagtgtttcttaccactcaggatgtcattttgattatacttcaaatttctctgactctgaacagccgaaagtgggcctctaggatgagctaatgtggcaaaagcccttaaagctggttttggtaaaggaagaaaaatttagaataagaaactcaagtgtctctatgttatcaggctggatgcagtggatcacgcctgtaaacccagcacttggcgggtcgggggggattgcttgagcccaggagatcgggaccagcctgggctgagaccttgtctctttgtaaaagtcattcactggaaatcatgcaaatgacagaacaaggcacttaatcttaacaaagacgctcgctatctgtgccacgctgagcactagtgtgatctcaatatttctgactttatattccatgcttaatactagtgaaagagactactatgtgtgggcactctgctgagcattcatatttatacttcaattaatcttcctaacaacccttaaaaaaaggtgttattactgtccccattttaccaaggaggaaacagatacagaggttaactgatctgcatccaagaaatccacgaccaaaggcgttgctttccttagagttatattgctctgctggaaggagagttgggaagcaggagctctagcccaggatttgtcatttcaacagggcttgagctacttctctgtgcttcaattaatcctcttaaaaagatccacgctgagaactaactatgctagaaggagcgtgtgtttaaaggaacaaaccatgcatttctaaaagcaaatataaaatcacgcacaatcaaaactgccctgaagtcacgtcattggccagcgtctggggtcttggaagttcaaaagcccctaagtaaattctttggttccgtttttcattgctggtatgtgacctacagtcaccagggaagggcaactgagaatatgcaaggatatttctcttgttttttgcccacaaggtgcgcttaaattcataacaaataaaaatgtgtccgcctatgataccatctcactgcagttccttcggatccctgcttattactctaaagctgtttccagtagtcctgtgaccccacccccgccagacttccaaattccagacaaacgccaagacatcccattgtctgttcagctggaccccgctcccggttccccacggtgagctcgcagcctccctgtcgttttaagttgtaccagctctaagataaattctgggcagtagccctttgaccctccacccttgtccaagttttagggggaaaagaaggcaggcacatccaggttaagatcaaagacggggaaagccgaatacggctggggcctgagccgcgaaagcgctggacaggccccaggaggccttctgcccccacccgcaccccaggctagtgtcgcagcccctctgcctcccacttcctcctcgactcctactcgcggtgatgaatcacgcgccctcctcgccccgtcgcgcaccgtccccaggaaaggtaagggttcgacacccaggagtcacccaagaagcccgagggccaggcatcgtcgcctgcccagggagagaagggccgggcccgcggcgggtgacagggacgaggccgcggtgtttgagcccacggacgtctggaggcctcgctcggctcccgggggacaggcagccaggactcaccagcaggttggtgctgcgattatctccctccgccatcgtctcggggatgcagtctctacaagcgcaggccacctccccaacgagtcctccaaccgaaacccgcacaccaaccacaaccc
